United States Patent 9,328,346 (POLYCOMB-ASSOCIATED NON-CODING RNAS) - sequence listing, part 62

SEQ ID NO: 12427 - RNA, 913014 nt, Mus musculus
cccucccggacgcgcgcggcgcgguugaagccagagugaguugcugaggagagcaggcggcuacuucugucuccagcauggcagcucugcgcuaugcgggccuggacgacacggacagugaggaugagcugccuccgggcugggaggagagaaccaccaaggacggcuggguguacuacgccaaguaagcggccuuggagcggcguuccugggagccguguccugcgaggccuggacccugcgcugcccugccaggcgggcaugcgcauccgaaaugccagccaccugucccaggcugucccccguuauuaggggaucugggucaaggucccgucaccuggccacccgccgcacgcccccugccgcucacuagguggcacugcaccgugcggugguggcgccuaggucuuacuccucuaaagaggaaauagagaaaacuucaaagccaagcuccugccauggggaccugaucuggaggcccagcaaucuguauuuuuaagcagauguccuggauggcucgcagugguuucccagggaagucuuggaaaccuccacagagccuuucccuguugcuaaccgugaccuugggccacugaaagcaagccccugacuuuucuguucuccucaucucugaaaugagcagacacaagaaugaaucugugcugugcacaaggcacucaguggagaggcuaguagguugccccgcaggcguuuucuguuacuuggacuguaucuguggcaaaauugcauaggcgugauaggggauaguagcucccauagggggagcuacugcagcugacucuaugcuuggggaccucuguucauuuuuaagaaauagauacuuaauggacaaaaugcuagguuuucauacagucuugaucaggcucugccagucaaagaaugaaaaagcgggaaauucgcaauguagcagguagcaguggagaagucuccaacaccuccgacagcagcaggcacagucagcaggcugaaaggcacucuguaggggaggacucguguucacagggcagacacacauggagaaaacaacugcaaagccaaagggaacucuggagccgaaaaaauugcagccucuucuugagggcuuugguuuuaagucauugaggaguuuucauucccuaauuuaagaguuggucaguuugaagaaaagauaaggguuggucaacccacaucuguuggguaacguguccugauguggucucgaacuugcugagccagucaucagcaacagcugacuagcaggagaaaaagcccacaaggacuuuguuuuaagaugccaggcuuucgacucacauaaagagugugaggaagaagcuggcugucuuggaaguucaccaccugugucaccuagccaugguuccucucccugucugccuuccaagaugucuaucugccuccaacccccgaguuucauggucuccuuuuucuuaugaauauuguguacuuuuccugauuuuuuucuucauaucaaauacuuccucuucuauuuucuuauauaucugugaaauauuuuuaaaacagggucucauauagucgaggguggccuuaacuugguuagguggccgagguugagcucccauuucuccugggcaaagugugcaugaacaacacaccugacuuuaugucuuuaaaagcuaggagacucaaucuuuuucaagcuuucuaugagaguaucuuaucaccuggcuuucagaaaacaaacuauuguauuaacaccuguaaguguauuuuuaguuuuuaauaauuaacuuaaaaaauuauauacagaccagacuggcuucaaacucacagagaccuuccagccucugggguuaauggcacaugcuacaguuuugucuagcagugcuuccuguagcccaggcuugccuagacuuucuuuuguaaacaggaugacauaguucuugaugccuccaccucccagauauguaauuacaggguuuguacuacccuaccugguuccagaaagacuuaaaagauaacguucuugcccuguuaucaaauuaggaacuaaugugcccuggcgucuccccacugaugggcuguaaaguaugagauuugcagguacucaaagcuacucacugcugccccugguggccagauagaaagaaacagaaaagcuuuggugaguucauucauucaagaguccuuaagggccaggccggugggugggcauuggugauguccagcuaaguguggugcagcugccauucuuaaggaucucugcaauaccagcaagugauuucuaaugauauaguuccagugcacuguguccagcgugaggugggugggugggugagggaggccgccuaggagaggugucacuugcccugugucucagagugcuguagaagguggccucaggugguaggaagucaggcagguuggagggggcagugggaggagagaccccaggcagcccucucucugugguauagaguuguaaagccugagacuggugagaaaggaaucaguuugcagaggcccuucugugcuucaccaaggacuuggauuuuguugucggacucuagagccagccgaugaucugaagccagggagugauagugaguuugugucuucagaaggacugaguggcucuggagacaugaguggauugugugagcaggaggugcugggguauaggcaugccaaugguccugcauugggugcuccuacguggaccucaguguguggagucucagcccuagaaaacguccuagacugugcugcuccaaccaccugaacuuagcacuguuucucaguccuuggcguccgcugucggcgucucguccauuggugaugauguaauacaguuuacuuccuuuccgaggguggauuuaaggaaaucaagcuuaaccuucgagugccuccuucagugccuggcugugucccucacgggagggaugcccugucacuggugacaggugguucuagcuuucuacccacguuuuaaggagaauggucuaguacaguuguacuuuuucacucuauuaaaugugaaccgagcaaaaguaaaggaagaaacagcaaguagcagauagagagaagccuuggcuagcaaaaucuuaucaauagagcacucacagugcccaucagaaacugacuggaagagcccagcugagagaggaguaaagcuuagucagguguguacaacaucagcccacaucugggagccccgacugaggccgugguggagcucccguugccugguacuuauucuccauguuucccuuagccaugggcaguuuuauaucaugggauaaacaguagcugagggaaggcgcuugggaaucuuuuagcuauguucaaggacaaagugugugugugugugugugugugugugaauacccuuagcugucugcuguuuuccuuucuccugucacagacuggggagcccauuagucucuugggagcuuuugaagggcacgugaaauaaacacacuggagccugguaaggggaagccuccuauauaccagagucugcuuucggugagcucagacaacuuaccaauagaauguaugacagcucaccauuguauuauaagauugcucugugagaccauuuggacaguguccuggagacagccccauucugcagaugacaggaggugauggcugagagguggagucaguggagcaguggugcguaggggcugucuggucagacccagcguucacagauccguggucaucuugucauagcuaagugaccugugcuacugucucgcuacacucuuaacauccuuuugggugcacucaggacccagagauuaaugagacacugaaguuauaccuggggccaaaauacagauuuaaauauuugugaaugugugugugugugaaguguguaugugugcaucccauggaguauugguggagaugagaggacagcauucaggaacugcaucuccucuuccuccgugggauccaggcagcaaacuuggguccucaggguugcauggcaagcacuuuuuccuccugagccauuuuggcaggccagaauauacauuuuaaaagucacaucuggccgggcaugguggcgcacgccuuuagucccagcaccccggaggcagaagcaggcagauuucugaguucgaggccagccuggucuacaaagugaguuccaggacagccagggcuauacagagaaacccugccucgaaaaaacaaaacaaacaaacaaacaaacaaacaagucacaccuguaauuuuaauaauuaggaagcagaggcagcagaaucaagcguuuaauaucauccauggcuacguagugagcucagccugcgccacaugaaaccuugucuccaaacaaaaccaaaacaaaccaaaaacccaaaacucaaaguagaaagaacaaggaaaauaaacuuuagcaaugcaauauuuaagcuacaucuaauauuuaaauaugagcguuauaaaccagauauugaagauagucaguguauucuugaauaaagggaagaggagugcagaaugucuugcuagagcuuugugcuucccagagcuuuguaaagcugacucuagcugcgacccugccccgcuugcucucccagugaucccccugccugcccugcaagauuccuucagguuugauucugaccuacaaccagaggccucugaccugucgucgucagcagaccaucugcccugagucugccuguucucaggacuccagcuauaucaggaagagccacagcuaacacagugacaucguauagcaguguuaacuuacucuguugugggucucuauuacagucacacugaggagaagacccagugggaacauccgaaaaccggcaagaggaaacgggucgcaggaggucuguaugccgucccaagcagagaagcauuaaguagcuaggggagaugucagcgguggugagguagcaguuaacccugccuuucugggaaggcugucugguggguggccgucaaggagcaaggcugucagucugagagcauaacgggauuuggcagaaggagaagauaagaucuugagguggacagaaggaugucuucuggcuuuaaacaaaguuuauugagaaaauuggagcuuugacuugggcuucucugcaguugcaccaugggagcaauuacucuugguguaggcuguagaggcagaugucaguauuuuauggaaaccuacaaagauguuucugaggcaguacacaguccauggagugggaguauuggauggaaaccaagggguugcggcuccucaggaugcaggugaagacagaggagcucguacaugacaggauggcucuacagcagagcacaaggcagccugggcagcacaccacugcucaugucugguguauuugcaacauggcugugagcuucgggaauuuaugcucguaggagcaucugccgagaccugagguaaaagcaggaguugagagaacacuuaagagugaucaagagugcaacaggguuuugguuaaaugcaggaggcagaauguggauuccagaugggaugcugggcccucucuaacugccaugugaccagccugguccaggaggaggcagggggacuggggauuagagggauaaccucuuuccugacccuggggugugacguggcuucauucccuacacacgcacuguuaaucuuccuuguguuucagauuugccguauggaugggaacaggagacugacgagaacggacaaguguuuuucguugaguaagugucuguguagaagccuagccaguuugacuuuuaagagggauuuuuaguuauaauuuccuacauugacuguaggaaaauaugaagucauagagaccuguuuuacuaucaggaguaacccccuuuacaacuuugugauuuuuuucuucuagucugcaguuuuccacccuucuuuguacacuaagguuuugggguugggucagcccacucaucugccacguggauuguggugugguacucccuaagcacaccccuaauauagcacauaauauaauugucauuccuuuaagguuaaacaaaaccuuagcuuuuuggagacagcgugauauuuugggaguuucaugaagauuuccuuggguuuucacucuacuugauugggcuucuuuucuuucuuuccuucuuuuuuuucuucuuuaagcggcucguccugaggcuuacuaacauuuuugcaaagaaucgauugaugugucugugugucuguucgagggugucgggcucaucuccugucagucuucaaaucuccucuuaggcagggucugucccugaaccucacgaggaagccagugagccucagcgaaugugcgguaucugcagucuucagagcuggagugcagaugugcaaacaugggaugccgggauugcaggauggugcugugucccaggcuccagucuucacaguugggcagcacgugcucuggaacugcugcgucgucucuggaacuucauuuuccccguuuuuagcacuacagugacaguugguuuggccucaccgguuacuguccauguagugauaguggucguuguagcaguaggcucaccuggagaaguguuuugucagcaaaccucaugaacucccucgcaguucagccuccacacugggagcaggcaggccaggcuugcuuuggagagucugagcagcugcacgcagcccuaggagggcagccucuccagcagguggcuacguggauguucuuugcuaaugauuagacuaugaaggguuucuucucccuugauuuauaaaaauccuuucccuuaucaagacagggcuaucauuucuuuauagcuuuaugcuacaaauaucccuuucuacguuuuccuuagaccccuuggcuguagacacucacaggcuccaugcagccagacuccuccuguguaggcuucugcugugcacacacgucugcucagcugcccucuggagugcuuuucccuuuucacuggcccagagcagugguuccaagauggaauucuccagucagcaucauuggcagcucuugggagcuuacuagauauacacauacucaaauccuuaccaucugaaucucagcgugggguguguuuguggugguaaggggcagccgauucccuccagggcauucugaggcaggcagguuugucuggucuacucuagagagggaccagcugaacuuuuguguaauggaucagauguguuuuaggcuuuggcacuaccugguuucuguuuuaauacaaaaauaauggccauugcuguguccuaguaaaacuuuacagaaacaggcaguaggcugaaucagccagcugcuggccuaaugaaaaaugagcauggaccguggaagcaagcuaggacgagguuagguauuuuccagcuugcuggagggugugcugagaucagcauagcacgcucuugagagaaaggaaguguagauuuguuuccaugugcaaauacugucacugguagcuacuuacaggccaccaagguggaaucccaggggaguggagacaacggcaccagccagcacugccagaugucaguguggucagacagagucucacgaaguuguucaggcuggccuguagucuaccuguucggaccuccugaguagcugggaucacagggcuaugccguggcucucagauacauacaccuuaaaucaugauaucccaugcauuucaggaggguucuauaacuuuucaaggucuuuaucucaagccucaaaaaugcacauaaccuuuguacuccauuuuaucuauuuagaguguguguaugugaacauggcauccagguagguaucaggacagcuuggaguuaguuguuuccuucugucauguaggucugagggauugaacccaggucaucaggauugguagcagacaccuuucccugcugagccaucuugacagcccaagacuguauuuaaaaauauaaaaaugggauuaaaaggaguaauuuaauaaucuguauguaccaguauauuuuaauguuguuucuagauuaauuccaaaccaaaaguucaguccuuauuauagauuggcuuggcuaugcaaacaauuaaaaucuugcugucuggcuugcuuuguaguuauuaagacgucuaucauuuccauuuucuccuuguguaccaauguguguaggccuuugcacaggccagugaaauuacauggaugucuauugaagagaguggcugacaggucuuauagaugcauuuauauuaaugugaauucaguagaaacuuagagccuucucagcaggcugcugugggacccaagaggccugcugugucccaguaccuucaggguuguucugagaggcuccacggcucuuuucaggcaagagugccauccuuccagaggccagaagguagauggaauggcuucugggucucuucguguuugacaguaaggcuguggugcauuguuccccugaaguauuagauuuucuuguacuuagagaugcugguccuugcuguauagaguucaauguucuuucuuccugcucuuugcagccacauaaauaaaagaacuaccuacuuggauccaagauuggcauuuaccguggacgauaauccgacgaagccgaccaccagacagagauacgacgggagcaccaccgccauggagauccugcagggccgggacuucacaggcaaggugguccugguuacuggagcaaauucgggaauagguaggccugcagcuuacuguccucuuauuucauuuauuuaauuuuugugagugcugcaaagaauucuccuuaaauguaacuguaaugaaacguugguggugacucuccaauugaaagaggcuguuacagcucucucagcuguugucucauuaaaaccgcacucccucuccaucccaguguuacagugugagguuuguggggccugaccuugaaguugcucaaagcugagaagucagcagaaggcuguggcuauuuugguauucaggggcuggagacaacaggcucuggcuaagagguuuugacccggucggugcggugcauggaugcauuccaauuaccuggcugauucaaaccaaaauugauugguaacgggauccuggacagcaguagauugugacuuuggauccaaggguacugcagguucccacuggucacugagccuaucguuuucucuugguaaccguaucuuauuucuucauaaaacuggagaguguguccuuguccucaccucugcagaaacccuccuaauugccccuguuuaaccacagugaccacgguggcuuuccgggcugcugcagugacagcccugaggcgggcaccugugccaccucaagagauggggcuuuacuuuguuuugguccauugacaucugacauuagcgucugaauggcuuugggauaggauaugcaccuucauauucaagaguagaacugcaucugucuguccucugcuuguccucugucaguuuucuguccaucugccuaucugucacagugcccccccuuauggccucucucaugagcuuuccucucuuuuccuuucuuuccuuccugauuuuggaguccccaguguccuccucuagcaggcagaggaggugagguaccacaguggaucagacacucugcaguguggcuuuuguccuuccaggcagucuuggaaaguguccuugcccagguagucuguggcuucuagauaacaggcuuccuucucucgagccgugcaacuugcccacuuauaagcugccauuacugcuucguugggccugugcacugcaggauggaaugagcaucugcucccaaggcuccuaguguugcccucugugcgagcccugccagggccuccagcauuccuuucuuagggccgcagcagggagacuguugagucuucagccugugacgcugaguggaugagugcugagcacagucccccugugacuggacagacaccuugucugcccaagagcgcuguuggggcaauggcguuuccacacuccccucuacgugggaggugggagauauggagggaggugugugcucccugacugacccacuggguucucacagggccucccccuuugaugugagcucugagcagacuguuguguggaugacgcucucacgcuguccguaagcaaugcagaacuaacuuuugaauguuuauacucgauaguacuaaggcaguugaguaaauucucaguuccaagcaggaaggaagggcaggaugguccuggaauguaggagguuucagaggcaaugcagaaguacaacgagggcgugaaaaacauugguuuuagacacagugucuugcuguguguccuugccuugcguuagcaauguagcccaggcuggcuuccaacuccugaucuuuaugccucucacgacaggauuaugggucugucccgccacacucaguucccagcccuucucucuacaguugugagcuggcuuuaccucugucaacugaauucagccuucuggauuggauguggaucaacuacagcccccggguauaaucugaccuccuugauuuuguagguguuuuuuauuggaacacagccaugcacauuuaggguaucaccagaagucgaguaauuacaguagggaucauguggcucucaaagucuuuacuguggggccugcacucagcauuuacucugggugauccagcugaacccaaggcaggguugccucagcgucucggaucagcccauuuagcugaggcugggauaacgggauacccaggcuacaggaagagugcaccgagcacaucaugaauagcuggaaggguugccccaucaguauuugccugccccuacccguggucuuagugagcuacaagacuagaauguugucuccucaggaacuaacacucuucuccucuugaccuuuguuuaaccagcuuucugaaccugaagacuuuuagauugaaagcuguagcuuguggaccucaguggagaacagcaucucaggcuccaggggagccauccuuucauccagagccgcugcuagcagaucaagagccggagccugcuaaccaguagacaauggagcagcucacugcccugugugcagcacagccgggcaggaggggcagcaggggcaggaggggcagcaggggcagcaggggcaggaggggcaggaggggcaggagguuguggcucuuuggaguuacacacgggcuggcucugauucuguaaaaaaagaaggaaacggcuucaacacggagaugacugcaucuaaguccccgggagucucaggaaagggaaagucuagcguuuagacuagggagucucccacuucccuggggcccauggauuuccuaagcuacaucuguucgagaguagauuuggcugugugcacagagcuguguggaagcugcuugccuugaaccuucaggcuggcuugcuggucaggcagcacucucugacacaggcaggcacaugucccuugagugggacagcagcugcccaucuuuaugucagaggggcauuugaguuccauacaacugaugcuucaucgagaccgguauauugucauuguauuucuggaggaacagucaggcuuuuggcaaacuguguuggaaacccgauagcagcuaugagcacaugagacaaucuggugucuggugcuaaggacagaacucucuucuuucagucugaagcuuggaguggcucagauuugauuuuaaguucuuucugaucugucuuuucccuucuggaccuuuauaaugucgggcagcgucauacauggucucccccugaaacagccagaggagcaacaaaaacaaaacuagcucuccucuuagaguauuguaaucaccaccccaggccuuauuguagagguucacacacacacacacacacacacacacacacacacacacacacacacacacacacacacacacacgcacaccagguucacacucccagagaugaaagagguucacacggaaggugucagucaucccucacuugguucucuuuaaagcagagcagaggcaugagcuuuucaugcugggagcccugcgggauccuuuccguacagugucuucauguguaggcuuagagggucugucccuagacccuguggugaugcuccagcauggaguuagugccacacuuucacuuguccauuguuacugugauggguuccugccuagaguaaacccuuuccuuucugggcugcuuuccuuccagaccguguagcagcccugaccuuuccuaaggagcuguagaggauccugagccaggcugggggcugccugaacuuaaccccguaacccccuuuuuugaguaaagcccgcguccuuguguuugggguccuggaauuccccauuacauucuuuucccauugaugagcugauggggccuuggguuaucuuccuuuugggaacucugugcucauuaagcagaggggaagccccuaaaucauccaagagaccccuagggaguuaauuaacuauaucugcaacaacgguucucuuaagcuaaagugaucugaaauuauuuccuucggagaaacuauuggaaguuguuuucuuugagacagagucucauuacauagccuagaguagauucaauucagggaaguucuccugccucagcuuucuccacaccuggcuggacacuugagauuuuuaugacaguauugagaaaaguccuugacuggcauuacacaaaaauuaaaaaugauuauuuuaugagucaaacagccacuucacaugugaacguucuuagauaucguaguacgugguacccuuaauacccagaccgggugccauuagaaaugccaucgugauugcugccgugcagucggcuaacccuggguaggagcagaguagguauagaguguguguguaugagucacaggcccccaacagauuacauucauguauacguguccacaggugccucucugaacaguuccagaggggucuguccucugaggccccaguuaauucuguauuugcacuuggguuugguuuucacuuuuuuauagugucagcuuaguaaaugaaguuccuguugcuaugcuucaaugacaaaguggcucaaaccccuaauuuaaagaaaauguuuacaaaucugauuucucucuuauuaaggugugguggugugucacaugcaaacuuggaaauguucccgcauaaaauccaauuaaagugauucuauucuucccugccuuuauguaauggaauggcacaguacgaguccuaacacaagcauugcuguuuccuguaauuaaccuaaaagcagccauguuuaucuaguuuauacuguuuccccacuagagggcacuguugcccuucgagauaguugcacucggaguuuucuucucuggcugccuagccuggcuuuuccuuuuguuaacagugcccuuuccuuccccaacauaucuucuagggcauguccggcucagugauagagcccuggcugaagacuaggaccggugucaucuuucucuuucuuggcuuugcguuuuuguuuuguuuguauaaaaugccaaagacgaagaggcccauuuaacaaaaagguccauuguguucagggagcagcuuguuccgccaaauuacacaaggacaguguuucuuggcauuaucgguuuugagugugcuggccuaucaauuaucugauuucuuuuucuaaguggggauuguaauauuuaaauauuaaugcccguguuuaagguucauuuagaaugccucagugaccuuauuuauuuauuuauuuuugcccagcagccuuaucuagugugauauaauguauuuuaauuagauuguuuaugagcuaugcauucuguuacuagaagcaaauguguccuuuuggauuugguaucuguuccuuaaauaagaagucauaacagccagacugugaaacaggcaaccaguccucugcacaguuggggggguggguauuaccauuaaaguuugagcaggucguuuguggcccagaagaaaggaccuuaggcuuggcuuuauaaacuauuuucagauuuuaaguggagacaggauaaaacucuguuagauacucuugcguguauuauguuccuucucagugacuucucccuuucuuuugaacaugggugagccuaaaaaugccacgggugugaaccuguuccagagcagagcuguugcaccagagugaagauguucagugcgcucaagcgcugauguguucauuauuuaagaaauaaauuguuaaaacuagguggcuuuugggaauuauugcagacuugauaauaaaggcggcgcuggcagcugggaccccuggcugucccuuggguggugugaagcagucuuguccugucuugugccuuuucagccaugcacauuuacccccgugugaauucucaacuuuuuccaaaauugcacuugggccgcggaggccucuuucaagggucucuuaauguaagacacccauagguuaccaagaaggucaucauuucccuugauuuagcaaaugaaguccccacagugauuugccaaacugaacucugggguacagaacgaguaaggcaugaugugcaaggcaugagccacgcugcccgcucugucucucucaguguuuguuuauccggcugucuaacuucucuuucucuuuggauauuguuauauacuguauucagccagcugccauuagagucaaggggaagauuccuuccuagauucuaaggagaucuagaugcugugugugcaugagagaugucgaugggaggugggggagaaaggcgagagggaggggaggcuggaggcugccuggggccucagcuucacuguguggaggcuggagacugaguuggggcuucaccuucacuguguagagguugauuagcaaggugagcagagcuaggcucuuuguuugaaccgaucucacagaaacaaaguuagccagcauucacaugugguuauaaagaaacuucaaaccacaucucucauucuuaucuuuacacucaaugauaccagauuaguguuuaugcauuguuauuauaucauacagacaggcauuuuaaauagaagggcucugcugucuuuuaaaauccucaucucagugcuugcagcuguaucaaaauggugccagaguaggagaacagagaggugaggucaguacccuaagugugccuagguccuuggacagguacagaauaugugugaguuccugcccggggcucaaugugcuaugcccaccccuuuccuuaccucagaaguaauggcacauaccccgucaagcucacucacucugcacccaggucuagaauggaacugaccccgauggucuagggaccgaggguggagcuguaggguaggcuguggcagaugcaguuuccaagccccagguggaucaagggugaaggcacggaugcuugcuugggguucuucaucguagguuagcaugcgagaggggugcucauggagucgggagggacaggagccaaguguuacauggaguuaguguucuguguccucucauuuaagugacuuuaaauuuauuuuauuaaauguauugucuauggggaauguagaaaauagagauaaaaaaaccagaaaacaaacaaacaaacaaacaaacaaaaaaaacaauucaaaauccuuacaguuggaagcauaugccaguguucagcaucugugauccgaggcaguggcuuuccucuuuucuucuacugggcugugaaauguaucuuuccuuaccauuaaauauuccaccucuuaaaugguugcauacuauuccauuauauggcuccagcuaucuccccaguguggcacauuuggguagcuuccagcuuuuuaauagccacggaauggaggcagacauuuugcaauuagauguuuguacccaucugugacauucugcagccuuauuuugugcaaggagaauugcugaaucgacggauuuacccacuaaucuuaauaucuugaucugugacacugcaccccuaaauuguuguaccaaucugauugccaguuguugcuccgugucccugccaaucuugggaaggggcauaaagaaaaagaaaaaaaaacugucaauuaaauccuuaugccuccgauuauacccaagauguagccguucuucacgccgggccauuuguacuuauucuuuuaugaauugccuuuucauuuuguaugcauggcuaucagauacauauugauugcugauugauugcucguuccaugcaguauaauuuaauuuucaaaaugucccuuucucuuagaaguuaauuuaucucaaagugucccuuacucuaaguacauauucaauccugugaucaagaggcaauugagagagaagccggccugacuuccccucuugcuucugugaaguccucuaggcuucaaggcuauuugcuuugcuuagcacacucacauccugggcacggaaugggagaggggcccucagcucagcacuggcuggcucacgaugggguuugagaggcugguaaacaguagccaggaacuggugauucugggauuggcgccuccccaccccccauacacaucccagcuccccagaucuguuaaagcuagucgcaccaugccggagcuuucccgugcauuuguucacgugacaagccgggcucccacguagcgaaauuguaccaaugccgaaaauagcucugcugacaggcagggcaggcuugauugguggcggguuucagucuggagaggggcaggcgggcgaggaguucugacucuagaagcaggcgugaccuaguuuucaaacugcuccccucuuccuaccugagugacucgggccaggugacuuccuccagcucaugggccaggcagguaguucuccgucucugcgcaguuguucaggauggagaugugggucccuugcagacacucgcccugcagccauuucugcagcggaugcucgggcccggaaugaguccuuauacuaaguugguguucccuagcuuugugcuuuacagguccucccgaggauggcaccggagcucugcauuggccccgggaucaucuuuuugaucgcuuugaauaacugguaggcauugacuggucuuuaguuuggaaagauuuuuuucccaccuuuugguuagaagucagauaguaccaucauguagccaaaacaaaccaaacaacaccccuccccccaaaacaaaacaaaacaaaaaacaaaaaccaaauccaaugaggcugucugguuauuguuucuguagccugggagcagaaaaagauaucacagacagggacuggagggacuugaaccguuagcccuuguaugacucagaucacaguuguuucauuaggacccucgcucaugaaacuccugguuugcagggcugucugcuguauuaagacuaaguguccagguuugcagccccucuccucuggaauacgcgagaaugagucaaugcuggcgugugauuuuaucagcacccagagggucagcaccuugacuggaggcucuugggacauagaaggaagaaaacuaguggaaugacaguuaacuuguucagugaccuagggcaggccacuuuaguauuuuaaauauaaggcucuucauuuguaaaauguagagacucucugucucuuaaaacauuucgaaguuacauuuauuugugugugugugugagagagaguguaugugugugugugugugugugugugugugugugugugugugagagagugugugugugugugugugugugugugagugugugugugugugugugugugugugucuguguguguguauguguguguguguaaggauaacuuuaacagucucuucucuuucuacuguaugggucucugggauccagcuguggucaucaggcacaauggugagcgcucucacuuccugagccgucucagugacccccacauuggccuguuacacaugggguugcguaggcucggcugacuuugagugcagagaccuaagcacaugcuaccauucccagcucugugucuguugugcauggaccaauuaauggauggaagcaugauaaggcagagucccuuaggaucagggugcuuacggcuguguguggaggaaaauaaccucucagcuguaggaaagagcccugaagguuagaagagaagggagaguguuuucauuccuuccguagauggaacauucuaggccacucuugauagcuuuuucacuagggcugcugagguugcuucaggccuaggccccaguguucagaaagggagccagauguugagggacuagacuaugugauguacagcugguuugguggccacauaaugccagugggcucagcggcccacuagcccuuucggccugagagagugagacuagguguaucagcaagcucuggguuugacugagagucccugccucagugaguaugguagaucgauggggguguuuccugauagugaccaaggaccuacacacacacacacacucucucucucucucucucacacacacacaugugcccacauuuaugcaaauauacacauauacuugugcaccauacauacacacuuaaaaaugggaagagaacaaaaacaaacaaaagggccucucacuguuagccacucguguccucaaggaugacccucccaaacuuuugcauucccccucccccgcaagcccccccccccaucuuguccucuaacugcauugcgcucucuuauguguggccggccgugauguagaguaaccagcuguacucucucagcucggcagcuggguuuaagaagcucgucucggccgagagaucaucaguguauucaaagaaagaaacaaaacaggaccaaacaaaccccaugccauuacagcuuuaucuguuagugaagacauuucccuuccgaguucauguacgguuaccaaacugaguaucggguacaucggggagcgcuguaacacauccauuccaagagacgucucagccaggagccaagucagauuuuuggcaagagacaccaucuuuucugccugcagagcugaugucuacgugcacgagacuccuuuuucaccaaguguaauugcugcuuggccagcguccccugccucuuguccuuccuuuguauuuuucucucggucagggauggagccaguuaacacuugugcgucaucgccaggcacucugagaccgacuaaccagacuguacacguauacgccauaucugucgcaugguccuucccuauuuauuuaguauucauuuccugucacugcagugaaagaguaucauguacccacuggcuuaaaacaaacuagguuucugcaccucagauaacagaggucagaaguuaaguucgucucacugggcuaaagucaaggugcuagcagggcugguccuucuggaggcuuugggguggggguugggguacccauuuccuucucuuuccuaaagcuccuagcggcugccugugucccuugguucauagcccuauccuccacccucuaacuuuccaguacauugcuccagcuaccuuuucucccagaguggucuagcuauucagugccuccaucuaucagcuauugugauuauauccaguauuucuccucucccuccauaauccaagaccauccuuccuccauuuuaagacccuucauuugaccccauugccaaaauccacuuugcugugucaggugacaauccuagagaucaggaugucaacauccuccgaggagggacauuacuguaccuggacaauaauguauuaaugcguugucccagaaccuuagcaucagauuaucagguacacuucuuguccuggcaacaaauccugguagaagugauucuaggcucaggguucuagaagguacaguucaccauaguggggaaggcucggggacugaagagcuugccguaugccuuguuuacaucucgauggaucaggaaacugaccugcuggaagugcagucggauucugguccucaaggccugccccucagggcugaccugucuucugucagcaagauccuauguccaaagggcucuguaaccucucaaaacagaaucaccagcugggagccagguguucagccaccugucugugggggucguuucacaucuggauugugauaacuuggagaacuucugucccucucuauuucuuuccucaaugaaucucuggacugggaaauuuugucuagaaaagcuaugucugaguuuugggagcaguuuccuggcaucgcagcuauaccaguuugauaucuugagagcaggaagguccauauagaccuaaaacuugugcuaucuugucugcugcugagucccuuggaauccagugauuggugugggugaucauguuuaugugagaaugugcauguggguuugcacauuuaugugugugugguguguacauguguguguaauggggaugccuguauauaggaauauguauacaugcauguguuuauguaguaugugugugccuguguguauuguguauggugugugugcauguguacauauacguguagugugugcauguauauagugugugcacauguguguagacugugcgucuguguauagugaauauguacauguauguaguguguaugugccuguguguggucuguuuguauguguguaugguaugugugugcauguguacauauguguguaacaugugcguguguguauauauagugugugugugcacacguauguaguauaugcauaugugcaugauauaguauauaugaauguguguguguauguguguaggguauuuggcuaagagcagagcuccuaguuaucauuuaggacagguaaaaacuaauggcccauuuuauuuauuuauuuauuuauuuauuuauuuauuuucuuaccaucauguuaaaaucaggacauucuacuuaaaggaaaucuaaaguucugagaaaugugagaaaucaguuaguguuagauaugcucacauaugcucacaguguuagagugcugagugacccugaguggagguggugccucaggcaugugagugagucccacaguggagugugaagaggauuggugccuuuguaagacuggacccgagagcaagcucuuucugucuaggaggggguuguguggucugagaaggcagccugagaaccaggaugagggcugucuccaaaagccacacuaagucagaagccugaccuuggacuucucugcucagugagagcaaaagaaagcugccccugaaggcagcccgucugugggugcuuauugaauagugcugcccccugcaggcuacuucccugcugugugugaucaugugaccuagucgugaggcgaguuuggauaggucgacccacaaacucagagacccuuuuuacucagucuuuuaugcauucuguacaaauaucaaguacaggguacuaguuggguacugguugcuuagucugcaguguagaaccagccuuggccucuacucucaggaaggcgcagacaacucagaagguuagcaguggaucuuugugcuucugcagagcauuuccacuugauuugcuugacaguguugcuuuguauguauaugugugccucugagucacuucccaucuacagggaaaucacuaaauagauucuuuacuucgaagagaacaguugccaacaguggguggaugcucuuuaaacuguaggauugauggcuaaguuuuccuaagcuuugucccacaugugucgcaguggccacaaaggaguguagaguguaggacagguccagggugaguacagagucaccgugaaccuaagcgcugugucaucugcgauccggcguaauugcuuauucugagaugucuguucacguucaccacgguuuggcugcucacauuguguuaauaagcacgcaggcauauugcagguuuuuuuuuuuaaaggucaccagcagccucaaguuccugcuucugacccgggcagugacucuccaccucgugugugccggggacgaguagccaggcugaguggcaagacuccuuugcuugauuccauggccagauguccuuuccuuuucucuccagguuuccuuuugugagcucgcaggcuucgcuccguggcaggaguucaucguagcccugggcucuucaggcccgaugguauagcugagcucugcuaaugcuggcuguggaucugacagucuggaaggagguuugauaauugccguaauucucggcaccaccccguuugucgucauucuuccagugcugcuguuucucugaugcacaggguuugaagcaggugggagagaccuggagcugcaacucguuguugugcauucugucagggcuguggggauacuggucacggugcuggauaauauucgaauccgcguaucccaagccaacuuuuuauguccuguuauauaaaugaaaaaguaaacuaaaucaggauggcguagucaauccucagggagugaccugaauuucauaguucaguugucauaaagguggucuugugugcagugaagaauuuaaaaguguuucacuuuccaaaggacacuuuaaaacucuguguuguguuuaagccauccagagagaaguacuugggugugauuucuaagacccuccgacagagagauuuaaauggaucccacugcugccgagagcccugcuugcauugcacacacaggagccuccccauagagaagccagcucacgagggagggcaggggaugcauuugcggagccgagcuugaacccacgagggaacaaaucaguacagugcuaucgcauuagaaauacggcuuuccgaauuuacagucaauaggcuguaaauucucccauggucucuugcagacuauguggcucuuguucagauauuagagcaccauauguguugucuuaaaugcuucuuaacgguuucccuugggaguugcuacacaguggcuccccuuuucgcucaccccuccauguccgugagcaugcagacacacacgaguguucucaggcgguguggguggguggggaacuuaacuugugacuaauacagaguaguaagcauuaguguggucuguagcauuugcuugaauuugaguguggacugucaacaucccgugcuagcagugacgguugcuaguggaugcuaucagaagucuuacuuaggaaugaaacuauccucaaggcugggcaugacugcaaacaguacggacuuugggaaagugcugggcugguaccccgugcuuagucacaccugcugcuuuacgccuacucuuagucucugggaagcauccagcuccucuuuagauucgcucaacuuccauugauaucaagagaauuggugccucuuccuagcucaugacauucggaguccagccccagcuggucucuucauccuauugguaccucucacuuugauuucagcacaucagcgccugccauuacaguauuuaagcucuuggaagauuuuggcagucgccggcuacuugagaacauaaaucgcucuacuguuguucucugcagaguuaaaauauucccauccuuagacucaggcagugaucauuuaggugcuccuuagaaugaguagcacaggauguuuugcuugcugaguuaagccgauagcuuguguguuagauagcuccaucauguuuuugucgguguuacaugugaacagaaccaggagagucugaggcuauuaauagugucgucacagcgucuucccgcuguggagaagaaguguguacugaggagucagaagggagcauuaaacugaagcaagagagugaguuuuggugacuuacgauguugcugacacaggagaccaggagaggacaggagagaugguguugccugcaugccagacagucgaaaugccgucuguccccuguagauuaagagcgggacuuacugugaauggagggcacacaugcuccccugggcuuccugucuuagaauucggggaagccagcagugcagcagcuuaugaauagugauuugccaaggagcaggcagagcccagccucccacggaacgugagccccgaguuccuuuuguguccuguuuaguguggagcccuuccuggcccacuguuugccauggacgccacaguugcuuccugggaaguguguacuugcguucucuggggugucugcagcggacaguuuccuaaaaggaaacucucuuaguagagaggacaacaggagagaggauuuagguuuucaucucucuacucgccugaggaaguuaaauguugcuaaugguauucagacaucagaggccagcuucauugagcaccugaacauugcuggaucucuuugcucuacgaacucagauuucuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauauauaugcagcuagagucaagagcucagggguacugguuaguucauaauguuguuccaccuagaggguugaagaucccuuuagcuccuuggauacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuuauaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggaucgaacucagauuucuuucuuccacccaugacuuuaucuaaaucaguucccccucccacuuuauauaugaaaucgccacaaauuguuauaauagugaaagugaugacaucuuuacaugccacacugaaaaccauugaauauauaucacgggcaaauuaugugcuaugugaauuauuuaucaauaaagauuuuauuuaaaacaaacaaacaaacauuucaccacaccuggcccaacaaaagauaaauuaaaacaaugucuguagauaugucugucagguuaucuuucugcuuggucuggcuuguugaggagugaaccuugaacauggguagauuaauguagcuuuagaucucuacaguagaagaucugcgauggugacuagagcgcauuuagcuugaaagugugucuggcugauuauuaaauaugcacacacauauauguauaugguguguugaaugauggguagguauaguggccacauauaacauugcauuaaggcccaaaaggugcuucucugaggugugcuggcaauggcacccggcuuuccuagggcuucuucuuguccuuugugaugaaucuauuuauuacuccuguaaugagccgcacacacgguugguuagccgaguuauugaacuuuaucaaccuuggcugagauucacaaugcgugccaaacuuguuguaacauguaagacauuacaucuggguaaaagguucaguagcggcggcucugauaauggaaucuuucacagagcaugggguuucaugauaugccccugauucuuaaaaaauuacaguguuaaagcaaaacaagaaaucacacacacacacacacacacacagaaauauauucccuugcguagauccuaauuuacggcaggugcaucccaguucuagguuacauggagugugaccuuguccacccaaccauugugaugcggcucgugaacccguuugggucuaacagugccacaucagcauguuguaguucuggacugauuugaauuauaacccagugaugacacagauuuucacucuuaccagcaaaaccucagcagaggugggucuguaaacucuuaaggaggcguuagaguuagagagacccagcauauagaauacauuuuccuuccugaguuaugagcaaagggagaaauaaggccagcgauagaucagacuggggaacgaagcaucucugggaccaccguugcgguugacuuauacugacgggcugucaggaagucgcuacugaacaguagaaguaaacaagguucucaguuagcaccgaacugggccagugcccucugguuggcagagcccaucucugcugcccgcacaagacauggcaguagagccuagcgcgugcuguuugugaaaagcgaggcaaggcuuccagugucugauucucucaggaugccaacucccuuaaggugcauugucugccauggcggggagugcucggcccacaagagggaucaggauacaaauggagaaguuucacccaggaaaacacaucugaaauggggacgguuuuccuuccacucuaacuauuagaaacuccaguuaacaugaugaagugugggcuagagagaggucucagugacuagagagagcauuugcugcucucgaagaggaccuggguugcuucccagcaccacauguuagcuggcaacaccuggaacucuaguucuuggggaccugaugccugugugugcaugauucacauaauacacucaggcacacacacacacacacacacacacacacacacacacacacacacacacacacacuaaaccuuuaagaaaacaacaaaacaaggcuugggaaaguagaauaaaugcagacuucuaguuugcuuuuggcuuaaauguugccacuuagauaauuagaauuuuuaccuuuuccucuucuuuuuccuucaguauuuuccaguucuguuucguuuuguuuuaagauuuuauuuauuuuguguauaugaguacacuguaguugucuucagacacaccagaagagggcaucagaucccauuacagaugguugugagccaccaugugguugcugggauuugaacucaggaccuguggaagagcaguuggugcucuuaaccucugagacaucucuccagcccuguuuuccaguuuguuaacucuaggauuuuggacuauguuuuuuaucccaagccuuagcuucuuuuucugagaaguggggcccaagacaccagccaguuggaguuguaagaggcuagagagagaaaaaaauaaaaccacagaaacaaagccacucagugcagcaucuaccuagcagucuguaacagacugcucacugagaguuucuguguuuaaggucugauuucuuuucuuuuagguuuugcuuuuguuucuggagacaggguuucucuguguaucccuggcugucuuggaacucacucuguagaccaggcuaaccuugaacucagagaucugucugcuucugccucccgaaugcugggauuaaaggcgugugcagcaacugaccacugccaccacaaccacaaccacaaccaccaccaccaucaggagcuuaaggccuuauuucuagaacaagcauuuaaaauuuucuuuccuuuccuuuccuuuccuuuccuuuccuuuccuuuccuuuccuuuccuuuccuuuccuuuccuuuccuuuucuuuucuuuucagcagacaauuucaaauacaugccaacaugaagagaauuaucuucuuuccuuaggaugcacccuuaacugacacagggaaagaacacucggugaguuugugaucuacaagcugaccucccgagggauagccguauaucugucauggccacccugacaguuucauaaacauugacaugguuuucuggacugcacagaauugccaguggauauugaagggcgucuggcaaagcuucagcuguguaugcuguauuguaacaacagccacacguuucuuguugugguggucucccguauagaggauugaacccuuuaucucaggaguacugggcaugcacugugcaacugagcugucucaccagucgaaaaugaaaaugucugguggcagggucuugcucgguugcucagaguggccuugaacucacucuaguccaagcaggucuugaacccggcacaucugucuuuuagaacuaaguguuuucuguagugugugaucaugggacuucacaagaggaaaaagaagaaacaggugaauacgguccuguugagggaugggagcuuaggucaagagaaagagaaugcacuugaaaggacuagcuuucauacggugagcgagcgcugccuggcagguuggcgauggccaucugagugcucugucacugucagugguuagucagacaggagaagacaugaaaacaaucacacaggccggcaccggucccucccauacucccaugggagccagccuagcuuuacggacgguacagugugccuuuuaauuauucugucuucagugaaauauuuccucuuaauuuuauuaaaucugcuuucccuuuuaagaaccaggccagguuucuugccaacagauauuggaaacacgcagcaucuuuuuaaaaagaguccuuagaacucagugagcaguggacuccaaauacggauguguagaccaccggacgaaagaugcacaggccgaguguggcacuugcccuuggguggaggccaagugcaggcucaucgucagcacugguauccaugauuuggcaugggagaauagcggagaauacuggagugauuagucauuucugagaaguaaguauguuuugaggagccauaaccuccugagugggagucuuucaaaugcuuauuuauuccccucaccccgagaaugacaauggaacacacugggggcagcccacccccgagaagccagcgggcagcugccugacgacaguagcaaucaccgaacugcugguagacaguaaucacgcuugcuagcagccugcgcgcugcccugcgggagagccagagugaaguguuuaaagcgccucuccacugaugugaaaggggagcaaauggagagagccagcuuggagggcucaaucagcauuuggcagcucuaacuacagaugcuccaggaugcuuccaccgcgcagcugccuuucacagcucuugacauccucagcaaugcggcccaugacguagacaaaucauuuguaucccuaguugguugaaacgaucaggguuuguugaaaauaaacguaagcagggccuagagagguggcuccguggguaagagcgcucgccgcucuugcagaggacccgguuugguuccuagcgcccacauccugcugcgcaccacugcugguaacucuaacuucagggggaucugacgcccucuuguggacucugcaggcaucugcacacaugugaccauggaaguagacaucuagagaaguaguucucaaccuuccuguugcugugacucuuuaauacaguuccucaugcuguagugaccccaaccaugaaguuauuuucauugguacuucauaacuggaguuuugcaauuguuaugaauuguaaauauuuguuuucccgauggucuuagggucgcaacuuacaagucaagaaccacugaucuagacuagucuguuccuuucuggaugaagcacggauaagcugaaagcuugcugaaguuucuguucugagcacaccauuaaagggagagugagugacuaguggguugguaggagagauuuauauacauuaauucugauagcuacuagggacagagauaaacuuaagauacucuaaggcagugguucucaaagugugggucacgacccccuagggggccaaaugacccccuuucacaggggucgcauaucugcuagccugcauuaggaagguugagaaccacugcucuaaggauagacgugggagugacggacauaauucuacaagacgcaguacuuaagugaucagaagcugcuguguguauguggguaggccuuuuuaaaaaucucaaguuguaugaaaacuguuauuuuuuuuuaugggaaugauuuaagaacuugucuuuuaucucuuagcuuuuguucccucaaagggagaacccgagccaaaggcagacuucaaaucguuuaagaugugauuucagagaacuccacagaggcugugagaauucagcaaggagaugagggaaagacgggcaagcacaagcgcgcggguucugggcugggccagugcugcagccgcugcugcgccucuggcaagggcuuucugaggaagcuguggaacgcauuggagagcugucugucagagaaggagagacauuuguccauaggccuucaucccuuuuaggccacgguggccccaucguguguuggcgcaccaagcaguguucuguaggccuccgaugcuccagugucagggaauuuccagaauuggaaguugggggugggagggcacauauugcugucuggagccagcugguggugguuguagucaguggagcaucuguaguggggcaagggugagacaccugcuacugcucacccauugccguggcucuucaguccccuccugcucugggagacgugaaaggacaucaucaucccagguguccuucaggcuaaagggcgugagggcugcaaaccaguccaguugacugucggucuugggcccguacacauuguuugcaaggacagcucuaucaagugccaggaagugguggcuuaggacacuguguuuuaucaggguggaaaucugaaaccaaggguuggggaagggccaggguccaacugacaccuggagcacaggauucucccugagagauucuagacgugacgacauguacaucuugaaggacacaggucgccugggauagcaguuuacgcagaccaacacacaguuguaaauuuaauauauacugagacguguguguguguguguguguguguguguguguguguguguguguguagcuagauuuuaaaguucuuaaacgugaacuuguagaugauggcauggcucagagaagccaaaggcugggcaucccuguaagaggucccucagcuauggucccucggcuguggucccucggcuguggucccucggcuguggucccucggcuguggucccucggcuguggucccucggcuguggucccucggcuguggucccucggcuguggucccucggcuguggucccucggcuguggucccucggcuguggucccucggcuguggucccucggcuguggucccucggcuguggucccaguuccagccucugcucugucagcacaagcaucccuccacaucccuucccguuaucuucccucggugucggucuccaauuccccucauuucuccaaagcacaucaguucuuuuugcuuuccuuauggucucaguaaaauuuacguuuauuuauuccucgugagugugugcgcauguauacuguauacuucucucucucucucucucucucucucucucucucucucucucucucucucucugugugugugugugugugugugugugugugugcacgugcgcgccccaaugcauguguggaagucagggaacaacauucaggcuuugguucucuccuuccaccauguggauucuggggacugaacuucuugucagguuuguuagcaagcauccuuaccugcugcgcuaucucacuggucccuaacaucucaccauaccuugacucuguccacauuaccuccuguaaagugcuuggcguagaggccuccguucagccccuuuuguguguuguguucuggggagggauacaguuuagagaguaacaacuguccuguaaacagaagauguucucuacuaugggugcuguucagguaaauacagcuguccagugaggccuugugauguguacuaauauccuggcugcaguggcucaugucuguagucccagcagucugaaggcagagaacagaucaggaguucaaggucaucccaggcuagaaugagcuguaugauauccucucucaaaaaacuaaaacaacgccgcugccaccaccaccacccauaacaguaaaacaguaguagcagcagcaagaacaaaccaacuuaccgaguaucuauuauguacaaacccugucuaaggaccacaaggacucaucaguggugccaaaugcuccugccuuguagggcuggccuucuuguggagcguaagugucagaaggauuugcuccuggucugguuucuaucccccauuaggaacuaagcggggacgugcucucugugcuaaagugcucagcuuggggugagugcuucagccuugggugauuucagagcugggcuggauggaccugcacaccuggacgcccugcgcuuggcuuccauuuucuuuuaggggaacagaguguauuuguagguuucggcuucaaaaucaucccaggccauugguuguuaccuuuguaauuuuucuuuuucuuuucuuuucucuucuuuucuuuucuuuucuuuucuuuucuuuucuuuucuuuucuuuucuguucuguucuguucuguucuguucucuccuuuccuuuucuuucuuuucuuuucucuuuucuauuuuugcauccugugcuccuuugagauuauagcucuguccccucuccuaggggagagaugcauccguagacgacagguuuuguguagcgucuucggguagaggaaggaccggcuccuggacucugaaugaaacgaucccgaggcuuuccagggcuugcaaucggcacugacaguucaauguacacgucugcucccacccccuucuacuccauaaaaagucaucaaagaggagaaggaagaaaacauggcccgugaauguuuuuaacucccuuuaaaugcauacgcuuuggauagaaauuuauugguauguaauuaauaacguaucacugauuuccaaauuacacuuugccaaacaauggaaauuuccuaaauaacugucagguaauaauaaaaaaaaaaauucagucacugacagcuugucacgguugaaucuaaaaccuaggggcaaaauacauauauucuauguaguuuccauuucuagacccugaauuucuaaauucuuccuuauaaaaauuuaaauuucuuuucguuuugaaagaggagaccucuaauuauugauuuccuuauuuuauaaucucuuaacaaauuugauauucacacuguagguaauucguaaaguagccccucugauagucaauaugugcaauuaauuuaaaggaauuggaaggacuggcucuuagaaugaggaacacguccaaggccuuaacgucuucuucauggaagguaggugagaaacacuuccagaaucaaguucaggcuccauagcacguuuaacagcguuuaaaagagaaauugggacugccuuuguggacacaguaauuaacucacauauuacauggugaaaaacuaaaguuaguacauagaaaacaaagucaugccugggcguguuaggaccacuggaccuccucagccaauggaaaagaaauucagcaugaacauucaucaaagcauuguccuguuggcagagagccagucacaggagcuccgccuugggagccgcacacagacucacagcauggcuuccacacugugauguuuuggugggaucucgugggguucggauaagucucaggccagaugggcgccauguuccucagcuguggugugucggacuuccugugacuugaaacagauccugccacgucgcuuacaguugggagcuucccguuuuuccaccggagccaacacuguugaggaagucagaggccccaccaccccgauuucuccuguaggcugaucucaccaacacuuguuccaguuuccacucauuugagcaagcuggagaucccugccaugaggaaggacuauucuuagcuuagugauucacuaaguggccuucuucaauguuugguguuauauuugaaccaaaacacauagggccacgugugugacaaggguccucaugucaacauucuauuggacuggaagcagaaucaacacauaagucauuuuaauucauuuaaauuggcuuucuccagaauuccaggacccaaagucaacauguuuguugacugcacagagauggggaggcaggauguaguuuaacacucaagauuggcgacaaggugcaggaagagucaggggaggcagcacaguaagauuuugaugcgaguaggguacucauguuucucguuuucuacuuguuuaagcgagauucuccucagauaauguguuuugcacagaaauuuguaaauuguccaaaaucaaacuuucuacgauuacuguccuccuaagcccugaaucuggguuguugaaauuaauuuuuuuuuccuuuuaaucagagaaauucuguaagucaagguuaccugcauccagaccuuuguucuuauuuugcuucagguauaaaagugcauuguuuuuucauagcuuaaccaacgggcaugugacccacccuagccuuguaaggucuaguguaauaaaguauuaaaguauuaccagacaucgggauaccugcucauuuguguaucauccacaguugcuaucacaguucaccaucagagcuggccaauaagcccuagacauguuuuacagaaggcacgcgccaucuugguggugcaggccuauaaucccagcauugggggcacugaggcaagagggguacugugaguucgaggccagcuacagagcaagacuuucugauaagaugcucuucugguaaacuuucagcauuaacaaagcccaucauggaguugagugguaguguaugccuuuaaucgcagcacucgggaggcagaggcaggccaaucucugaguucaaagccaucuuguuuuacagaaugaguuccacaacagucagggcuacacagagaaacacugucuugaaaaacaacacaacacaacacaacacaagaaagugcaucuuggggcuggagaggugguuuaguacugacugcccuuccagaagccuuggguuugauucugagcacccauaugguggcucagaacugucugucacuccaguuccaggugaucucaggcccucucugaccaccuuggauaccacacacauccaugaugcacagaccaacaugcaggcuaccauucuacuacuacuacugcuacuacuguaacuuguagauuuuuuuuuuuaaagaaagcacuucucaucuaaagagcugcuaugcccguuuccauugaauaagauggacaccaugcagcagccuguauccuuucauugcauugcuuugccaggagguacagaacucccaugcaagugcucaaggggaugaccagcucaauucagcuucccgauggaugagcauccuuuucuugacaaagccacacacuuucccuucuaagaaaaucuacucccugcacucuuacauagcaaccuugcacuaacuuacuccauuagacccugugcauuaggugugcacacuugugacuugccugacaugugcacacagccauagccacucccucaucaagacagaguagauuugugucgcuauaaaaaucuccuucuucuucccccugcccccaacccgaaccccaacccuaggcgaucaccgaaugccugcccagcaauuuuuaauuuucuuguauguggguguuuguuacccaguguguuuauuuuuuauuucgagauagagucucucuguagcucuggcagaccugcaagucacuggccuuggacuuauggagguuccuucugcuucuguuugcuuguuugagacagggucuccuguagcucaggcuggugugaaacucccuaggcuggggugaccuuaaacucccgauucuccuacuuuugccucccaaaugcuggaauuaaagguuugcuauaccaccaccuucagcuguuccauagugcuuuaaauacuucuugaaagucaacgggguaugcacgacuaauggcugaggggcacagccagaacacaaacaagauucaugucuuuuguguagacucuugugcagauuuuaaaaccuucacagaaggauuugaggcauaacuuacagagagagcguuuugugacuguuguauuaguggggaaccugacacucugaccccgcuguuggaaaaagggucuguugacgauccccauuugacuuuuccaauaacccuguuaaggguguuguuucuuaacauucccauuuugcagacaaggaaacaggggcucacagaagcagaauauuucagcuuacuugcgcucuguaccucuguaccagaggucuguaagcuggguggacaguggucaguaagcuggguggaaauguaccaccuugugguucugggugccagagaugagaagaacagacuuuuguguguaucugagaguuuguuugcucacacagaucucggggcuucugguuucauaaguggcuuuagugauggaguccugcuauggugguuuguggauaaggugaaccacaggagguggggcacugcuagaggaagcagcucacugugcgcaggcccccaggacuuuaucuugccuugucccuauuuauauuuugcuuccccaccccucuuuugcuuguuguuugccaugauggaccaggaccucugucguuacaguaguggcaaaacugaccauggaguaagacucuugacguguucuccagcuugagaaagccguugcuuucagaguauggucugguggugccugauguaauccuagcguuugggaggcugagacaggaggcucgggagugaagggucuccugggcuacauaaaacccugacucaaaguuaaaaagaaaagauuuguuuaugcguuuauuacauuucccauuccaugucuauuuuaacgugccaaagaaaaucaaguguacuugacuguaauagagacacuaaaaugcugugugcuugcagggcagucuaaauacgauagcauguuugaacuaaauaagaaagagugcugguugagcaugcuucccucaagcuguuuaaucuaugauggaaaaucucccccggacuuuucuggaaugaccucccguuugccucuguuccggcuguucggagccaucauaccuccuggcugggaaccaagcucccugcaaacugaaaucuucucucagggcucuaaagccuccaccagcucagagcacacgcguucuccuuuccaaauggaaguugagccuaaucucccaucauucccguuacugauguuggaaacuucuacccagacuucuuggaccagcggcagccagauaaggggagccaagcgaaaggguacagcuggccaagcuucaggaaccagcaaaaucagccucagcuagaaggugccgugugcaucccugagguucauggcaggcaggugccucauugcagcuagcgguuagcucgguuagcucgguuagcucaguuagcucgguuagcucgguuagcucgguuagcucgguuagcucgguuaacucgguuagcucgguuagcucgguuagcucgcaaggcuccugaggagcuaaaggcuuucaagcugaugucuuucauuaauaucuggugaugguuuccuaaaacaagacguuaucgaacucaacccuccuuuucuccucccccccccccccaagucagccugguuuuuauaagagcggcucuuagggagcuuaaaagguaauggguaauuuucuucaacgggugugcgcucuguugggacacaggcacgccacucaccagguguguuccaucagggaggugugcugggaguggccagggagauggcucgguugggagagugcuugaagcacccccccuccccauuguuuuacucuuuuuacccccucucuuccauuccucuuucuccuccuccugcucagugagucuuccccacuuccucauggacaggcauaggaagguauguugggaguggucaugaaggaaguccucagugagaccuugggaucaacucccuucccccacggcagaaggggaggugcaagagccagaagaugggcgggcggagggagggcugggaaaggcuguccccuuccgcacaguccugucccugcacagacaccgcggguucaguucagcccagcccaagugcagacucugccgggcuugccucugcucuugaagccuauggaagugacuucuucaaaguacaauaggccaggcuucggggcaaagccuuccacuucugcaaaccagaagcacugugcccagggucuagaaaugcaaaugugugcaugcacacgagugugugcgugugagugugugugugugugcacacgugcauguguguggauguugaaauagaaucuugagcugaaagaacauaauaaacuccugaguacugugugugagacccuggcuccauaguauccccacuuuuuucaaugcccgugaacuaaaugcccgugugugugucuugccgagguacgguguucucagcaucuaaaaggcggguuuuuaaaacauuuuucaucaggagacccuuguucucuuuaauuuuuguccuguguuuaauuaauuguccuagggcucuggagcguguuuauuauugugccacauguacuuugcuuaaagaggcacagacaacaagccacugcggaguuccuguuacguuuguagagcaggaggugagcaguggcuacacgaaucccauucagucaggacaccccuuuaaaguucagauccacaagccuuagggaauuaaagggggaaaaaacgugagcucacccugugaccucgguggugagauugcccauuggcuguuggaagcaggagagggaccgcauucauucugcaaagccguuaccauucuuggaagaaggugcagggggacuuuauuuucugugaccuuucuuucgccccucauaagucucacacagagaccuaucuaugaagucaguagugaagugguguuaacucugugcucggugaugagauguuagagaccguggcagagcugggggauagacuccacgaagcaggcguguugguguaaccggguagcggaagaggccacaguucuugccuuccgcucuggugacacagaagcgggagaggcuugaaaacauuacuggcauugaggcaugagcuguggagaccacccuuccucaugacgggcagcugcuguuagguuguccaagugcccaaagcacccaugcauauagugguggccacagcuugugauaugcacagauaggguuacgucucauuccguucacugcuuguuuuuguaugaaauggugacaccauuucuagguuuccuugaagagcuucuuagaaucccugcauuguauaaagcacccaucgugaugcccugcagcuaggaacucucccaggcccuccuccuuaucuggguguuuccauagucuacacgccacacagcuaaaaccauccuuggaguuggaauugguuccucccguucuucuccaccucgauugcucuguauuaaaauucauagagacccauaaauuaucaauuagaugucauucuguugguuauuuuuaguuucuuacuauaacaggcauacauacauguguuaaaaauugaaauggcaugcgucguagcauguacaguaaaucuuccuugcucccaaacaauugcugucucucagaauaaucgcugucagcgcuguuuacacaugcgccguccuuguuuauguucuguuuuguaggccauuccgugcuuuagcuuugugugcgugauagcugcguuuugaacucaaagccuuguguauuuuaggcaagcguucuaccacucagcuauauacccagccuagccuaacuucauuccccccgcccaccgguguuggggauugaagguaggaauuuaugcaugcuagggaauacuaguguuucacuaccaagcugcaacccuugcuguccugguuagguuuuaaugccagcucagcacaaucuagggucuccugggaagagagaagcucagcugaaagaauggccuugaacagauuagccuguggccacggucggugaaagaguacucccuugauuaaugauugacagugacggcccaacccacuguggguaccaucucuaggcagguggggcugggcucgaugagaaaggaagcugaggaaggcacaggacaagccaacagguaguauucuucaguacucgcugguauagauccacguuguauuguguguguuggaguguuugcccgugugcacgcauaaaggccugaggaggguguugaguaucuaucucuccagcacucucccacaccccgugaggcagggcucucucucuaaaccugaagaugaagcuaagcuguuugucgguaagccacccccauuucugccucuaacaguacuggaguuaaaggacagagacauguucaccgggcuuuuugcuggaacccgaacccagguucucaugccugcacaccgaguguucuuacccacugaaccaccucuccagccccucugggcuuaagcgcagcacaguguaguuuaaucucuacaugccauguggcugauucagccuaacugagggacaauguggcgucaaauguuccucccacaguauuuugcguguguacaaguguguuuguaggcuaaauguccaaugguggaauaccugggccacagagcaugcccacuuaacacuugauauguccaguugcccucagagguuuugagucaguuuaugucccccuuucccuucauaugugagguugucugguuccccacacccugacaacccaggcgcugcucaacauacuugcaauuacagcaugcgucuucauugggccugucgagaacugugcuaauugugaucucugggcacucuucucgcugugauuucuaaccaggacugucacuagcaggucagaugagaacguccucacccgguccaguggcagcacucguagccagccugaggucaguuucgccucuugagagauacucacacagucgcuugcaauuuauuaucuagcacugcaaaaccauucuggugcuguguugcccaaaucauagagauuuagcucagggauggugaagauucccagggaaccaacccauuucccaccuccgaguuuucgucucuugaauuaauaucuuucuuuucgguauguuaaggugugaagggugcugagaacuuuguaagguacuuuucauuggcuguauuugaugcaucauuuccaaagcaaggcuggucuugacuaacuuucucuggagagaucgcauguuuuguaauuucuuaagagcuggcaauuguggauucugucuggugagggugacgugggucucugcaacucggagguaugugaugguaugugauugaaacaguguggaugguaagcaagaucaugcaagggguuaugcagggaauuagaauaacuacagaaucagcaaagcagguuaccacugccucuuggcuuuguccucaucacugggaugacuguguaucucagagguuccucugcagugccucaggagaguuggguuucagugucucagucacugucaugacuuuuaaaucccauuuacauuagucagcucuguuuggaaagugugguccuuguagauuuaagaggguguaaggaaaacucacagccuuaaaacgaccagguuuuguuguuugcuugcuuguuuaccuguuuaauuuuauaguguuggagcuugaacucagggccucacacaugcaagcagucugcugaugagcagcacugcuggcccacacuaguggucuauucacagagagacgguucauugaaugaaaguacucugcaugaaagggugauaaccugaguuugcauuccaagaaccuacauaaaggugggugcuacugagcauccaguauugccacgguaagaugagaggcagaagacagggggccccugcaagcucuuagaucagcuagcagcuagccugaugcaugcagugaucaguagagacccugcccacaaacagaccugaagcuuuccugggagcaacacaugcuguacuguguucaugcacacucacucacucacucacucacucacucacucacucacgugaaaaccaaacgacagcuccccaacucuggaucguccccaaauauaacgucaccugaaaugcacaggcacaugaugaaggccaaugggggcagauucucugacuuguugcuugguuccuaaagacugcacuagugguccauuuuugguguguggggguguaccuuggguaguggaccaccauuucuggguccuuuuauuggcauacaguugcaaguaguguuugucuccaguguuucacaauuauaaauuaauaauaacagcccauuagaaauuaccagugucguaagucccaacuccuuugggcaucuuaauaaaaaugauaauuaaaaccauaauuuacaguaaacggggacacggcccaagcacauccacaauauggaagaaauuaaaaaucuccaaccagaaagaauguccccggcacuguggaagacucugccuuguucucggagccugugucuguggcaccuugucaggguuuaugguucugccuucccaccauggagucuuuugugccuguggaaucugugggcagcucugugcucuucuguguggccuccugcucugagcacagaccuguguguuuucuguccaugcaaacaagugucuaugcucacccgugcugccggggaaccaucauaaccucccggaugcccacucuagcccggauuuagacaagucaccgugcuuuguggauuucuccaaguguuuuucuaagucacauauuuagccagucagcaccagagaguucuuuguccccgccugacugaucaaagagcuucuaugucuguaugacuccuucaucuucaaggccacuggaaggacuuuaauugaauaaacaacaacaacaacaacagccacaacaguaacucacaguguuucgcucuguccagaauucuuccucaacacccucuuguccauuggugugcauggcucagucuccaucccugucacuacauuucuccugugaggcugucccucaucuuuucuccugugaggcugucccucaucuuuugucauucccgguaccuuuuugugcaccuguuucuuucuuaucuccuucaaucccaauguaguucuuggcccaugguuccugcugccacacagugacacauucugacgcauucuacaucccgucaaguugacaaucaauaauagccaucacaggugacuagguauccggugcaugccuccuguauuccuagcucuuaagagccugaggcaggaggaucaugaguuagaguccagccuuugcaacaagaacuuggcucaacaacaacaacaaacaacaaacaagaacaacaacagcaacaacaacagaucuggauaagcacgugguuccugggaaaugccaacagcauggcgguucuguguagcugaccugagaugcagcuaauucaauuagggagaaaagguauuaugugggaggcucugagaaaagaagcuggagauagcgggguggggggugauaguggggugggggugggggaaaggaggaccuagaggaugggaaagauggacgaagacaaugaggcaaauagaaguguuuguguauuugguuuguucucuaauuagucauuguaauuucuauccccaagaauggaaacuaauguaagguaagggggcacuuaguuuuggggguuuacauuuucuaucuuagcucuuuguauuuaaaacugacaaccugaauccacgagguguuaaaucccccagggccacuuagcucuucugaccggaucuccuauugcagacgcuagggaaccuugcugcugcccguuguuuaaaaaugccuucuguuauuuauucucuucauuuuauuagcguuaaauauucucccgcacccacuggcuaucuccucaugguuaagcugcugcaauuuaaacauugucaugaaguuaauuuuuuauaagaugaaucagguuauuaaauuuaguaaaccauugccuucauuauuuuguaccaacuuuggccucacgcaggauuggcuuagcacuaguacauuucgguaauuaagcuggccaucagccgcgguguuccgagcuugagggaugcuguccucaugggcuuuauucaggacuuagcaguagguaauguuauuaaacuuuuuuuuuuuuaauuuauaaaacuccauacucuggagaugugguuugcuauaaacguguuauuguccuugcuguuaaaccaucaucuuuugaaauauccccccgcuuuguuuucgcuccaaaggcaguuguaaaggauuagaaaauggacuugucgccguagcuuugacaagucggcuagccgcguguguagcucuguuuagauaaagggaggcgugagguucagagaauaacuuuacaagucacagagacagauggcuuagccauagcucuagccaggacuuaucugagggagagaagguauacucacgcccuugcagccuguugcugacaucaggccagaugcacagcuuucaauaauacaggcuccugugcaguaggucacuuugucaagugagauagugcaaccuaggaaaaucaaaggugacagagaagguucuguuuccuguuucccugcagauuuccaggcacugucauuccaaacguagugagcaguauucugacaguaauuuaauauuuugucuuuauuuauuaaaaagcaaguuacaggauuauuaggguugcagucuaagagaagguggauuauucgagagcuccacagcauggcggcccauuagcaggcugcacgaacuacccauuccuuagugacugcgucugggaugcagagaugaccaggcauggagacaacuguuuacugauaaucuggagagcugaauacagccucagcaucugcccggcuuugcaucacugugccuuccuuuccacccagaaauaauacauuugcuuuaggguaccacacauccuaaaucccaacgcuugggaaguagagucagaagaacuggaguuugagggcagccugggcuacauagugaguuucaagccauccuaggauauauagcaagaacuugucucaaagcaaaaugguucccaaagaaugccuggggacugugcuugccauaacugauuuauauuuuaauaucauuuacacgauuaaaauauuucugugguggugguacauaccuuuaguccucggcacucaggaggcagaggcagguggaguuugaggccagccuagucuauagagagaguucuaggacagccaggguuacacagagaaacugucuuaaagcacacacucacauauuucuggucauugaguugacaugaaaauuuaggagggauccagguuuugccaucuucucaaagaucuuaugggcacaucaggucccagguagcagaugaagguguuauuggcccguuggugcugcuuuccugcagacaacaguguucuauccaccuuagcuucuaaaauguggcauuuuggaggcugggacaugguucaguggguggagguacuuguucugaaaaaccagaguucauccucagagcugaagcucagucccuguagcccacaguggaaggaaagagccgacuucugaaauucguccucugaugcccauauacauacaugugugcaucgcaucuccacacacauccauacaccaauaauaaaaagauuaaaacauucucugauguccacacacaugcaugcaugcacgcacauauaaacacauccauggaacaguaauaaaacaauuuuuuaaaaaggaacugugcauucgcuuggauuuccuguaacuuuagaaagugagguauggggccuggagggauggcuugggugcagaggguuuccugcuuuccagaggacuaugggucagccccuaagaacccuuguuggguggugcaaaaccacagcuaacuccagauuugugggaucugauggccuccauguaccauacacaugaaccauguccaugcacaaaugaacauacacaaacacauuugcauuaauauaaaauguaucuauaaaauacauaucauuuugccauucagagcaguggcuggguuuucaacuccaggacaagauuuauucuuccucucucucaccccgugcuucuccgucuccaugguuuuuucuuuuuagaugauuuugacauguggacucaauaucuuuacauauguagacucuuuacauguguagaaucuuucaauuuuccaguuuauccuugugacuuuuuuuuucagaaguguuucccuaggaguuuuuuuuuuuuuuuuuuuuuuuucuugagacaggguuucucuguguagcccuggcuguccuggaacucacucuguagaccaggcuggccucgaacucagaaauucgucugccucugccucccaagugccgggauuaaaggcguacaccaccacgcccggcuggaguugccuuuuaaaccucaugaauuuaucaucuuaaaauagucaaacauuucacaaaaucuuuuuaggguuuguggguauguauggaguccuuuuaauauuuuuaucuaauuuuaacauuuuaaaaucuaggaaaauacuauacaggagcuacacaugccucuguguguguucggaugguuuggagaggacucuccacgaaaccaccauugcaauuuacaaagacuuuauauuuuaaagauguuuuuauuuuuauuucaugaauaugaguaucuugcauauguauguauguauguauguauguauguaugugcauauauauauauaugcaccaugugugugccuagugccccuggagcucaauagaaggcacugggucucuugcaacugaagucacagguaguugugagcugccgugugggugaagggcacugaaccugggucccuguaagggcaaccagugcucuuaaucccuguuuauguacuuuugcacuauguuuauuagugugagagugugggugugugcacaugagugccgucgcacauaagggcuagaagacgacauugaauccccugggucuggagugacaugagucucugagccuccugaggugggugcugggagcggaacuucuccguccuuugggagagcagcuagggcuguccaccucucucucucucucuugcuccccuuuccuggagaucguagccauuacugcuuucagccacgauuucugauagcaucgagaacgguucuucucucuucuggccuuucgugacaucugguucucuugcuugucucacaguuucaggcucccauuccuaagauuuuacaugagaauaugagaugguuggagggguaacuaagguuccgauggcaggcuccuuccucaaggagcuuuguaguuugauagggacaggcuacuuucauccauucaggaacccaaaugcccgaggcugagcuuccugaaaggcugcccugacucuggcucucccgugagacaguagcccuggcauauccaccaggacccuuccuuuugauacauuuacauccuucucugccagucuucugucucuuguccacugcucuagaacuggaaagggacugagugacacccuaacauaguccuguuaugugcugccccgccuucccaaaccuuggccuccagagauuguagcauacuucuaugauauuuucagagaaggacauguguguguauaucuguauguguuugcaugcauaggccgguguucccauguaggcauaugccuucacacacacacgcacaaaggaguguguguguguguauauguauauauaugcucagauuauuuucuagcucuguguauguguguguauguguguguguguauguccguguguauauauauauauauauauauauauauguauauauauauauauacauauauauauauauauauauauauauauauguaugcucagauuauuuucuagcucuguguguguguguauguguguguguguauguguguguguguguguguguauguccguguguguauuuauauauaugcucagauuauuuucuagcucuguguguguguguguaugucugugugugugugugugugcauguguguguguguguguaugugugugugcauguguguguguguguauguguguguauguauguguguguguguauguguguguguguauguguguguguguauguguguguauguguguguguguguauguccguguguauauauauaugcucagauuauuuucuagcucuguguguguguguguguauguguguguguguguauguguguguauguauguguguguguguauguguguguguauguauguccguguguauauauauaugcucagauuauuuucuagcucuguguguguguguguauguguguguguguguguguguguguaugugugugcauguauguguguguguguguaugucuguguguguauauauauaugcucagauuauuuucuagcuguucucaccaggaagauaagaaggagggccuaggauagacugcuacaauugcuggauuuguaaguucuggaaacacccaucacagaguagaauaugggggccucauuaaaccaagggucuagucaugguugguagugaagcaucuggcgguggccugaacucucuuggacugggccuucuucaucuuugaaauagcugucucgguugggacggcuuucucacaucuugccguuggccuucucugucagcagggcucugcugugcaucuaaaguaagauaguuucucuaucuugucacuaaagccacuaacacuccaaugcacagucucgcccucugaaaauaucuccugaccugucccaguccccuggggcacagagccaccucugguugagcaccgcucagucucgucagugcugucuacuguccacugacaugucccuucgugacccacacauugccaccagcguuguuucuaauguggacuuuuucuucucaccacaggguucgagacugccaaguccuuugcccuccauggcgcgcaugugauccuggccuguaggaaccugagcagagccagcgaggccgugucccgcauccuggaggaguggguaagcgcucugcugcuuuguuuccuaucugucaaauccaaacguaccccgggcugagugcacagagguuucaacgcugcauguauaguucgcugcucuuggaauaacaucuuugcuuucugagucaucuucacgcuguuuacugugugaaggggagggugagugggacgguuauuacccaugcguuuguuuaccguucaccgccagugucacucucuuuauuaggagacuguuuacuuauuuaacucuuucauuaagagaaaugaaaugcccguggguacaguugggaugugucugcucacgugacauugcuuaccuguuucuguagccauuugguuguuuuccuuuugacggguuuuauacauggacacagacuucaaaggguccucagagagucacaggggagcgagaugggaacaccuagaugagucuuguuuuccuguggaaagagaagguacaaaguaaacgucuucccuggacccugaaaggugcacaucuuuaacuauuucuugugugccccucuagaaaaaagguuucgaauguaugcaagaguacacauaugcugauccgcauuuuguuuggcucaucuaauacacugcgucaucuuucggugaggugaagucuaaguagccuuugggcuagggcuuugcucgcuagguacaaagagaagggagaaaggaauuuuaguuuuggcucaggugucagccuagagcuggcccaccccuuugcuuuuagacuggggaggaaggaagccagaaagagggagagaaagagaggguguuggggagggagggagggaggaagaagggaguuggugggggacugauuggggcuucuguguauccucuaggacaccucaugcccuaguggccuauauuacucaacuaggcgucccucucuaauuuccagcacccugcagcuguaccacccgauucuucucagucaguagacuugcccauccaggaagucagaaucuuugugaccuaauuuuaucccccaaagcuuuacauaugaccacugcugcauuacggaauaagucuucauaugugaaccucuggggggggggggcacgguaccuccaaaccauacaacuuuauuuucuuuaaugguuguaugcuauuccagugugugcuuauauauuaaguuaaccacggucccguuuggggcucagaaaguuuguuagcguucuugugggaaugaauacaagugauguaguguccucuaucuccugcaucagacuuucucaucaauuccugugaaauuaggucuaaaguaugugaacccucuucagcauuuaaaucuaugacuuaccccugggcuggagccuuagcagugagcuccucucaucacuggguuacauaugcagguaacauuuuuacauaugcaguuguugcugcauguccauuccugucgguugugugcaauagcuuaccuggugucuggaggcugauuagacuucucagaucucacuugauugaaugaugugucucggguugcaaugguuccacugacuucagugauucugccguuagcacccugcacacagaucuuaaccucggagcuggucuccaaagcggaugguguagcucaguugcuucucaucuuugaccugaucuuucucuuagacuccaccaaugggaacagacugaucuguagcuauucaauuuugauaucuuaaaucuaucuguccucuauuuucaucuaucuaucuauccauuuaucaucuauuuaaauccacugucuaucucucaccuaccaauucuguauuaucuuaaucugucugucugugucugacugucaauuaucuaucaucuaucuaucaaucuaucuaucuaucuaucuaucuaucuaucuaucuaucuaucuaucaucuaucuaucauuugucugucuaccuaccaucuaucugucuguuaccuauuugucucuucauuuagcuaucauccaucuuuguugccaucucucuuguuuguuuguuuguuuuuauuuuuuuuccagguaggcucucacuguguaacccaggcuagcuuugaacucacaguagucauccugugucugucugcugaguucuggaauuauaggccaccacacuuguccugauuccauuaccauuugauacacagaggcagaaauucuuggaucuaccucgggcaagucucuuuagaacaucuggcacaucucuaaugaagaagguuuaaugagaugaucucagagacccagcguguacucucuccucccuucauguuaagcccuaacggcguccccgugagccagauucagaugaugggaaauaucacuguggcguuucaccagacaguuuccugauguggaguggcaauccuagaggaaugauuaucuggaaacauucaaguuagggacgugggaacaggaaacaccagcggagacgaaugugucucuugcaguuucacacacugaaaucgcauccuagaggguuuggacuauagaaacucagcccuuuggucauaucucaccagugcacuuguuuucuggguauuucucauucccccaagauggugauuauggaggcccagauuuagcacuaaagccaugguuaccauucccugucacugccuucccugucagugcaguguagagacccaauccuguuaccuucuuuauguuuggcuccccacaccuuccccccaugcucacccuugacauugcuggucugauuuucuucagacuccuccugauuucccgucucugcacagggauaucaccuggcauuucagugaggauugucaaggucaguuuaauccacugcagguuuucagucugcaagccagcuugaaugugaucauacuuuaccugggauggaccauaucuguacuuggcuggggaugugcuaagacauauugcuacccugugggagguucugagugguccaggguuucuuguugcagcaagagcucauucagaaguccccgggcauuuuggcuccagauugccccccaggugccaaggcucugucggcaucuuuagcuuagcucuggagauggaacugguuucuucauccgcugggcuuguuccacccaaggcuuucccauccaaguuccgcugcaucuuccaggaucuccauguucccagugcuucaugucugugucuuagccagaggaagguuuuuuuuuuuguuguuguuguuuuguuuuuuuuuuuucucaauucucaguguuggggcagcugacugcccucauucacgggauuccugucauagacuguguccaggcauggcccacuacaaagaacaagccuagucuucauuagaggagccgaggcacaagugccaaagaugggcagugcccagagccacauagcuugugagcucagggaaagggcccuuguuuaugccaucugccuugaagaucaaucacuugguucuucucccucuuaucugagugucgcauacuuaaaguuuuacagucuuugcuucggaugcuuugguggcauccaagugguuaguuucagucaucuuuagagaaagcaacugguaaacaucgacaucaauaaagccacaucccuccuccccuuccuccuuuccuucuucuccauagggauggggucucaaacuguaacacauucuagcugggaacucacuauguaguccauucuggccuugaucccaugucucuccugcuuaagucccucaaauggagagacuaccggcgugcaccacuagauccagccuuggguccaccagggccuagagcugauuugauguugaacucacuaaggaccgacgugaauacaaucaacccuuucuuuuugugacaaccuagaacaucucuggacauauccagaugcuuucuaggaauguugcaaccuauuucuggcuaaugguuacagaaagauauuguagggcuggagagcgaacugacucuaauuccaggaucugggaacccaauaccuucuuuuggccccugggcaccugcauuugcaugcauaaacuuacauagaggcacacagggauacacaauaauaagaaauaaagauaaagcuguaguauguuggcaaacagauacacacuaugaccuuggggaaaugucugaacuucuggaaauuucagcaucuccaucuguaaaaugcagaguacaguguggguuucaaggcagaggugguuugugguaaauacaggacuuauggguagguaaaguauuaacacaugguggagaaagauuacgugcucagugccacugccuugguuaaugacagugauggaguuauugguuucuuacuuacacacggagcagagcgcaucgcaaagcuugcuucucucacccuccacaagugaccagaaggggagcuauaaggacgauguuuaccaacacgguugagguggagucacgaugaauuguuuucccagcuuuucaggucuggacucccacaguuugauagaugcacacuuagucgguugauuaguguuuuccagugcacuucauauuagcacucaacugucgucugaaaaguggucuuaauuauuuacgugauugcccuucccuuuguauuaacaaagaucugccuuuugcacauauccaggaaaugcuauucagucaccaggaaacuggaagcagcggauacugggaagggagggagggagggagggagggagggagggagggagggagggagggagagagggagagagagagagagagagagagagagagagagagagagagagagaggagagagaagagagaagagagagaagagagagauuagugaugguaguggaauguggcagagagcacacauguuggcuugauggaagccaccugauccagagcuaaaucacuccuguucucaauggugugguuuccaggucuguuuaucuccccagagugaagaugcacgggcauugauggugcuguugaguccugacagucuucaucguggacaucagaaggacuucgugccugccaugacguugggcaagcagcacuggcacuuggcuuagauuuuucuuuuuugagacaggguugcacuguguagucguagcuggccuagaacucaugauguagaucaggcugcccucaugcugucucugccuccuaaacgcugggguuaaaggugugugccaccaccugacacagcugagccuucaacaccacugacuccuuguucucacgcuguauaguaguaagugugggguggugugggguacucaacacagcucugacgaguuccccggaaauccagcagcuuucuggcuaccccggagccacugggcugguggagccuccucggugcuugugcggauuuucccuuagucccuuuugauaggaaaagcuuauacuuggcaguuuguuuuuccagauggaaggagugagaggugauguccucucaugcaacgugagcaccuguaaguguguguguguguguguguguguguguguguguguguguuguaugugggguggcugacauagaagcuuucuacccagguuaguugcuugccuuggagaacaugauuguuaucugagacaguccaagguacaaaacucauccuguuguuuugaaugucagcuaaacaaacccacaaaacuauuaguacuaucacuaagcgucuuaguuaagguuugauugcuaugaagagacacgaugaccauggcaaaucuuauaaacgaaagcauuuaacuggggcuagauuacaguuucagaggucuaguccauuaccaugauaucggggaacauggugacaagcaggcagauauggugcuggagaaggagcugugaguuccaccucuugagcuucacucugcagaaggaggcugugagccacacugggcucacaguagcuagacaguagcuagaccauaugagaccucaaagccugccccuacagugacacacuucuuccaacaaggccacaccuccugagagggccacugucuuugagccaaccauucaaaacugugggucucugagguccauuucuuucuuuuuuuaaauuuaauuuaauuuuugauuuauuuuuuacacuccauauuccaguccccgccccaaccauccaccccccccccccgucuguuccacauccuccccacccccugucuccacguggaugcucccaccauccaccucaucugaccgcuaaacucccuggggccuccagucucuugaggguuagguguaucaucucugauugaacccagaccuggcaguccucugcugucuauguguuggggccucauaucagcugguguaugcugucuguuuggugguucaguguuugagagaucucgggaguccagauuaauugagacugcugguccuccuacaggaucacccuucuccucagcuucuuucagccuucccuaauucaacaacaggggucaacugcuccuguccauugguuggaugcaaauaucuguagcuggcucuuuuagcugcuugcugggucuuuuggagggcagucaugauagaucccuuucugugagcucuccauagccccaguaauggugucagaccuugggauaugagguccaucucuacucaagccaccacaguuaguuacuaggaaaaguccauccuaaaucagccccuggauuuucucacuuauuugcuuuaaaaguuguuuuucugcacaguauuggauuucaguaaauaaaauaugauauaaacaguucuaugagccaacagcagcuauguaaacuuuuugcuugagccaguaagcauagcgcucgcagcagaagaccaggaugaaguucugcccugggacauucucacaugucguuuacugucaucuucauaugauauugaggugucugucugugcacuaggugaugugcuuagcauuaacagugaggcacauauaccacaugauuaacccaucuggcugccaaggcuuuugggggcugguuaagagguguguaauuccugggggaugaguggggaaucuugaauuugaaacugcaucacaccaauucuuaacccuucugauaccuaaucuaaaauuccugguguguguuguuucuaaagauuggcccaaguuuucuuuauucagcugucugucugucugucugucugucugucugucugccugccugccugccugccugccugccugccugccugccugccugccuaucuaccuacaugcaucaguauuuugacugugaaugucugugugagggugucagauccccuggaacuagagcuauaggcaggugugaguugccaugugggugcugggaacugaaccugaguccucuggaggagcagucagugcucuuaaccaccguaugugccuaucugugugugugugugugugugugugugugugugugugugugugcauguggaugcacuuguuuauaugugugagugcaggugcacgcgugccaugguacguacguagaggucagaagacagucguggguauuggagcuugccuuucacuuguuggagaaggaguaucuuauuugccacaaugugagccuggguagcuggcucaggagcuucugucucuaaugcucaguggaauucuggaacugcccaugcuuccauaucugcucucuuguggguucucaguauccccccucagaacuucauggcagcagggaaagcccuuuaacccccgagccaucucugguucucuuguaggggagagugaccuugaacuucugcccccugcuuugcccucucaugcauuuagaucacugccuugcaucaucucaucuaguuuuucgggcacuaggauugaaccuaggccuuccuucauacaagccggcaagcacucucucagcggagccacacacuccucgucuugacgaggcuuguuaaagaacucagccugauacuguacucugagucagugucucaugaugggaaacgugucaguaacaagaggguaccugugguuaccuaggaaggaacuucccuagcucuuuguaauccgaugucauugauaacugggucaaaggagacugcaucuuccuuuccgcccccucccuuccuuguuaagugcuauguaguguauuuaccggucugccuaaguugcccauuugaccuuucuugucacaggcccaggaaagacucuuuaucaguuaauaaauuauucauccccucguagacauaauugguugcuaaaauauuccgaguuuucucugucuucagaaugucugaaaaauugugccugguccuucuccuccaacuuuuccaucucauuucucauucugaaaauucugcguugacuuacucuugacuguauccaccauucuuugaucaccauuucuguaucuucaguuuuuuuuuuuuuuucuuccuggccaucccuggcagucuugaacggaaucuuuucaaacuuucuauccauuauaaccauuagauaacaagggcugugguucaccgcagaauuuuaaaaggaugagcaggaagcacagguggcucgcucccaaccaucacccccaauugugugcagcccaaagaagauccauccuuucaauaaugugggcuccccuggguucuuauuaagcaauuuugacacagucugaaaagacagauuucaucuucagaugguaucuagccaguggcugcaaggcuugcaucuggccacucagcuuuuagccuguuauuuaagaggggaaaauauacuugaaacuguuuuucauguuuauuauggggcauucagagagccucagauguaguguauauucgauuaaauagaagagaaauagucacugugcugauaaaaacuguccaggcaaggacaaauaagagaucagcgguacugaagguggugucccaggcuggccagcgcauagggcagaaggccaagguuaacccaagagaaguauuuacaacagaaauacuucagguccuuucuuugaagcccuagagacuugggaucaaauucugacacaaacaguugcccacuggcuccccuggcuuguuuccuguagaaauggcacaagugacaacuuucagggucaccacgaggacagagugcagccacacagagcucuccugcauggagcccagcgugcugcaaugcagaaagcugugugcaccauuguccaacacagaucccugaacuagacagaugcaucuacgcaucuugaaaaaaguguucuccccuuguucuaguucaggcuccucuuagaaaaaugccguaggcugugggcucaggcaggauccauucccaagcauugcagaagcuggaacucugaacgcugugcuugcucgcuuagguucuuggugagaauugucuucuguuuuauagcucacuaugucuccucauguuaaagagcagagaaauagaagagaccgggaggagggggaauagagagaagggagaaggagggaggcggggcugaggaggagggggcaaggaagggaggaaaggagggagggaggaggggggagggagacacuucuaagcuuuucuccuguuggauccccuuguuuccccagcaguguuagucagcacugaaaugcucugagaugaaaguggauccucuuccauccuuaggagguagagaggugauuguuacugguguagccuugagugacuuggagcaggguggccuugcauaggcugggguuagugcugaagagaaguggagcccacagaggccaccccuaccccuaggggauucaugagaccuggugucugucccugucccugucaucugggggauguagaugcaaccgaguuuugagaauuaugcagaaggagagcuugcagguguguuguagugacgucaaagccuauaaaccaguucuuugacaauucucccuucaagaauggagccugguuauccuucacccacgugaguuggggcuggugagugucucagcaaggucccugugcugguagugauggagggcgacccccaagaaaggugaaaguucccgaaaggcauucuggugucuucuuugcacacugucuggugucacuggauuugggcuaccauauuaggagccaugugaagucuuugccaucacaaugcugguuugaauccacucagaacccucugcccagcucagccuucuguuaccagcuacuaccaugguccuuuagauuuacaugcuaaguucuucuuucagaaccauccaccugcuagaacaugucccagagaccugcuagauuugauuagauacagaauguguacaguuuucggucuuaugcucuuggggaaaacauuaguaaggaacacaggagcaguggccuccagggcagaagccaucucugggacggacuggacccugcgacccagugagcugcucaaggugaaagacuucccggguggccugcuacagcaucccaggucagaggccuccagcuucgcuguggacucucuucuucaugggucacgcagucaucccauucugguucugugugaauuaauuagaaagaccucccucguagugaaaauagcaucuccuccccugaaccaccagacagaggucugagcuccuuccccagagcgcuguuggcuccuuucucagagcccaacuaauacgcgcaucucucaaauucccuaaauaauaaauccaaaguuauugaagcuaucagguuaccgagaguuggcggugagacugccccuucucauuucuuugcaacccuugucccucuuuuauuauugaagcuugggacgcucacaguaaggcgaggcagcuggggaaccccaaccccugaaucuugcagcaggcagcagcugcgggagcucgggccugcuuugccuucccuggaguuaaugaaucagcacgcaucaagggcgcagucugccuuuaagugauggaggaacaccacauuuauucacucaacaauucugggaucuccaguuguuccgacuacgaggcaguucugcaacccguuaggccgggaggaacuugaaugcagcuuuguaauagcuuuguuguuguuuauugagagggacuaauuaacuuugauuauugcacuaauauuauggcacuuugacagcccuucagauuuaugacucugggaaaauaaacaaaugaaaugcaggugcuggagcagaaagacucagucauuacugaacuuuaauuacuuggaauguguagccaggagagaauugguugaugaauuacaggacgcuuaaaaccaaccccaaauugaaagcaaagagaagacagaaauguaagcaucaaggaggcuggaaaggugcuguguuuaagguggggagagcaaggacacaucuggacugcucucugcggugucucauugaccaaucucggugguucccagggcugcagaaacucacagagugcuucucaaggcugaaucaggaucacccgagaacaugcuagacacgcagauucuuggguccugcccagaaccaccaguucagaguuucuggagauggggacucaaggaaaucuggguacacgcagaagucgauauagaccaccaccugguuucccacucuguuuuuuuacuaagagaguaggcguacacuuuugucuuuacuuccaacaguuaaauauuguccuagcccagauccugagccaucccagagauuuucagccccgaggaagccccuuuaccuuauacuccaucuuaccggcccuuggucaaccccucugaaauugagaaucauaauaguaagaauggcagcuagcaugaugcuguagucgcugugcuaaguacuucuaguccuuuccuuuagcacauguuaaggauggacccauccacacauucaguuucaugaauucugguuuccugaaaagaucuuaaggcacagagguauucaggaugugugcgaacucacacagcagagacaccacaggcaugaggggcuuucagggcagcgcaggagguauuaccagacacucaugggaagagcaagugggcggucaagguugcuaaccgagucauggacauugaaacccagauagcacaaucccgugcguguuuaccuuuggaaagguguccagcacaagguauauacaaccagacauuuauaaaguuuugagcuuugugaguugauuagccuguugauauuucaggggucuccaguuuuucagccgacuucuagcuuguucaagaacacguagcuauuuguggaaugcuguauuacgguauuuaaucccuuuuguuggacauuacuaauccuuauugauuauaaguagccagccuccccacucagugcugguuuggggagggaugacugggauggggaguggacuaauaagcaaacauccuggagggacaggaagaagaaccuucacauagaaagauuggcuccagaggcugcacugaagagcagaggggauggaguaaagagcuagccaggcaugguggaacacacugguaauccuagcauucaggaggcuaagacgagaaaauugccacaguuuacacagggaucugaaggccagcggguagauuccauaggcccguggucuucacaugaguauagguaaacagggagagcagggaguuggaugguuauuuuguucuuugccucugcugggguuaauugcaucaguaauuguuuuuaaaugccgaagauguugcuagaguuugagaaggcaagcauaaaaccucucugguuucccguugcucaggucagaagaaacagcaagguuuggcugcgugucuaacguuccacuuguuucuugguuaauaaguguucaaugugacaaauggugaaguuugcccagauuauaugcacgcaccuguguguguauacagacagacagaggaaagcagaagaaaagagaacauaagugagcuggcaacacaaaggcaggacagacagacaaagacagggagacaaagcagagcugcaaacuuuccugggagccucuuaaggagagcucuccuggacuggccugggccagaugagggagcgggcucacugugucuuauguccccuggucauuucuugcuuagaaaggaagaaauuagaauuguugagcuaugauuuguuuuaaucagaaagaaauugucuaacauaaaucucuucucgagugcuggaaaagcccucaagcgucuggggggcaaauaucaauacuuugcaaaggaggaaugauuguuccaauccguggcuuaauugaguuuaaaccuuaaugaaagucaggccagggcaggcagcacacacugcacacacugcagccuggaucagcagcgggaucugaaccaguggggggcggaauuuagggcgcuuccaguccuuugcugcugaugcuauguucugauuggcuggggccacugaaucccagauaauacuuugucuuccuaugaagagaacacauuucuuucuuccuggauaguauagcaauuuaguuuaaauuauagcuuuccccccccaaauuggaagcauuuguuuauguuggauuaucauuccccaagugaaauuucauugaugccauguauaauuaaauauaggguuuuuuuuuaaagcauaguauauauauuuaaauuuguaaguggacaaacuggaguauaugaagccuuuacuuaggaagaauaaauggcucucaaagucagcucaguaguuguuggaaaggauucauuuaguguccacacaucuccaucuguugggcaccaggguggguuaucugggaaaacugcaaagccugaaaggguuggaccauaaacuacguugcaggucuaagcaacagacccagacuacggugugccugagucucaguccuguuuguaccacacgagagccaggcuuccuucacuuccuguucugucugugacauggggugccaguaguacccaaauaguacccaacaucggcuugugaagaucaacugucaugucacucaccaggaacguagaaugauaccggaguacuuagaaugguuugugguguaguauccaagugccagcagagacaagaaacaauugaaagccaacccaguggggcuggggagacgccuuacagcaugcggacauaaguucaauccccggaacuuauauuacagaagacuggguuuguuguugcacacuuuuaauccuggcucuggggagagagagagacaggcagaucccuaggucucaauggccagccagcuucaccuacuuggcaagcuucaggccacugagacccugucuccaaaaaaaagguggauagcgccugaggaggcucagucacgaucaucuucucuaucccacuugcacuagugugugcacauguguacguguguguguguguguguguguguguguguguguguguguauacuccacaugcaaacaagauagagucaaaaaccccuacuuguggcacacaugcagaauggccucaccugcuuguccagcucaugccuggccacucagccauucugcuccuuguucaagcuguaucagaaccacugugucgcccaaccuucccaccucccugaaucuuggcacagacugcuuccucagccuggagggaucacagccagcguguccaccuaccauaugucccugugcuccaugagucucuguucaugcccgucucuucuccagagucuccccaggauucuccaggaugcuauucugucccccccccccaauuccaaaaguaccugucauucuaccccucucagcuggguacugugcugagcacuauuggagagaucaaagcuuccugcuucccaggaacuuacagaaugcauuugguuuuguuuauuuaacuucagauuggcauauucuagcuuuacaugauaaggaguuucauugugacauuuccacacagacaucuaauguacuuugucacagucacugcccccucaucccuucccccacaccucccuauucacauucuccaacauccgucuuucacuuccacguccccuuuagcguucaguuuuuaaauuaugcauugauugauuacagcauugaucccauuguguaucgaucguuugucggaugggcuccuuauuuagugaacaaauacuuaucgacagcaucugugcguguagucuacuggauugugaguguguguguauacaccucauuggccucguccucauggagucugagcuacagugacagacauguaaaugaguaaugguauccaagacacugguuacugcauguguguguguaugugcgugugugcaugcaugcauaugucuaucuguuugucuaguaugaagguagaugggguugagaucugguuaugucccaagcucaguguuacuugugcaaggggcagguggguucagagcucugucaccuagcggacauugaacuucuggucuuccuauuucuguaucuccccagugcugggauuuuuagacgugccccaccaagcuaaacuggaaagaugaguuuuauuuauugaaugauugauuuuugaugcugcuaggccaguuagugguuaagaacagagguuuggauuuagaccaagguuggccggaacucucccuggcucuacauuucuguaguggugugguaaucuuagcucucagugguccuccaugugcccuccaucuuccuauugcuucccugcaucacaagaugauugucagguguaaaugggacagcagugcccugcucacagugcuggaagccccuguucgucaccucuccaugcucugcucgucuucccucuccucuucccagcagcagccccuucugccucagcagggccggccucagggccagacacagcauccucuggguccgucggcuucaaguucaaaggaaagcuuccucacugugguauuggauuuugcaggauggugacagcuucuacaaaccucugguccgugagccaauuuggaggaaauugaaucauucucugcgccuuucggcuucguauccuaaaaagcccgagcaaacacucugggcaggcuucagcagcuucacauccagggcucaaucacagcuucaaaauaaaaacaucccucauugcucuccgccugugaagcuggcuguggagccugucacaaaccucggagcuacagauaacaccccuuacccugaacacacaccauaucagaagguccucgcaggcacaauucacuuagcgugcucuguguggacgaaggcuggggguggggugggggugggggugggggaugggagcugucaggagcaagggcucuccugcgccuguagcuccagggaggcucugucuacuuacgucucucucaaagugcuuuccuguuccagccugggcaagcaagcugagcucugcaaggguggcguagcccuuuggcaucauggcggagccaccagccucauuacuccucagcaaagagcccucuguagaaauggcaguggauuuuguaacuggcagucucgagugguccaugauucgcaaaggauuuauaugugaagggaaacggauggauuaaaaauauuaaacaguguagccaggacccgcucggaugaauuguugggaucuauuuucuccuucuacucuaaacauauggcaugaauuuuccacccucauuacaguugcugcgagaaggcaaaggcaaauauugauauuucauucauguuuuacggugaaaacacuguuugguuuguuuauacaguuugacuaucacaguuuuuauggugagcaaugaaaccacuguaaagccaagccuggguuauauagcagaugcgauaaacccucacauucagggagacuccccggaugggauagcuaaugucacauguccagaacgaacaacugaauugugggucaggacaggcuagucaggacguaauacccaacagccccuguggacccucuacagcauaaagcuaccaaggucucucuugucuagacugaaucucuagccaguguuucugggagugccguggggggaggggggcgggcuugcagcccacauagcuggaugcuaugcacaggaaggaagaggcuugcugguuuguauugcagccaagcuucugcucccaagugagaccugucaccaaggcucaugucccauuggcccgugugaguguccacauucccaagucucgggauuaccugcugccguguguacguggacagggguauauggcugggaugucgcagaucagacugaggacugccugacacagcuacacuuaacgcaagccaagcccuuguguagcuauuguuuuaacugauugucugcuaugugugugugugugcaaguauaugccugcgagugugugugugcguguguguggcauguguguaaguagguaugagcauguggaggccagaguuaagcauugggugccuucucugucuuggaauucaccaguuuggucaaacuagacagucagaaaguucuaagucuuucucagcaucaaacuuuccguucccauacccacaugcauuuccuguaccuaagguggaggacagcucuucauacauuucaugcagucagcuguugagacguaccugucuucaugguccccaggcuaaucaucccagagcccugccuguguccucauccaccagcccacaucucuuuagaacauccuguaaacaugacacauaacauuucucuccucuucccacucucucucccucuuuugaacacugugucucccuagcccugacuguucuguagaccaggcuggcuuugaauucauugaucuaccugccucuuucuccugggcgccaagauuaaggguacacaccacuaccacccggcuugacauuucuuccuuuaaaaccguucagaccaagggcuggcuggcugguuugcuggauaaaggcacucacugcuaaacuuggaugaccugaguuuaacuccuggggagaaccaacugcuuuggguugcccuuuuaccuccacacacgaaaaaagugaauaaaagucuugagcaaaccaagggcuguccugucauguguacaugccacacacgugugcaucacguucuaucuacacugugugaauccaagcgcaugcucucuuccccaccccucuaaagaagagaaucauguuuguuguacuuauuuucauuaggguccuuucuuuaggcuccauugugauucugaaaaucuuuuaaaaaacgaaucaauuaaauggaaaugaacuguuuugaacaucagcuaagcagcuguguccaaggaagagcaauucauccgaggcugagucugcagagaugcgugguuggggcugggugaggauggaccgagauuuuacuuuccuugagucucaguuucaacagguguaggacgaagagccugauaaggauguuucccuguucauccaugugcugguguugcgaugccuauaauuuagcgugcauugggcacccugguggcuuucuguaagcuugacucuuaucucuaugagaaaauugaggaauuagaacacagacaacucgaguauucaauggguggaaggcaugucuuuccuucauccuguuuguugaaugauggaaugcaugaacaugguuuuuccaguuucauaagcuuuccaccuucgaagaaacucagagucucugugaucaaucacguguggccaacuccccagacacaacagcaugcagauagugggugaacucuugcuuuccccuuaacaucucccuaucugagucuuccuccuuaaagcacaaugugguaaccgugacugaauuugagcagaucccuuggcaggcgugggagguggguucuggggacguuggcggugugauggguguuucccaagcaucgaggccuccuaacgucucauuuccauuaagccucauggaugcguuccaagaauuuaauuaauauaacaucacugccuucauugugauuccucaguaggguuaugggaaccugggaguguucaguugauuaaauggcauuuucugugggcuuccaacuacugcuuuccauggaauuuaguaccugccagugucuauuaaaucaaaacuguuaaaggggaucacaaaagaaagagguguucauaucacgauguagaacaguucucuuagcuacacagggaaaauaguuguaagaguauauauacaguuugcagucgugggguuuuauuuaaaaaaaaaaaaguaaggccacaaacuggagauguuuagaagcugauauuagaaaggaauuacaguaaagaauaucuuauagaguagacaguaaggugugcaccaucgugagauaguccaggauggaaaaaaaaaagucacuggcugaggcagaaguaagguuucugacagaccuaauggugcuaagacucucagugggugcuggggggaaggacaugcucuuugaaguuauauaaggggguuuucauuggaccacuggagaaaaugagccugcuuccuuuuguuaaaguauucuuucucccucuccgccucccucucucucacacacacacagagccugaguggccuggaacccacaguguacaucauucuagccucaaacucugagauccaccugccucugucuccuaagugcuggguuuaaagguguguaccacuaugccugacuucucuuuuaagagucauuuacuuuauuuuauguacaugaguguuuugcuugcaugugugucuaugcacuuagucccuguaaauuguagaacaggaugcuggauuccccuggaauuggaguuauucauaguaugagccaacaucgugggugcugggauuugaacccagaucccuuguaagaacaacaggugcucuuaguugcugagccaucucuccagaccccacaucauauuuugaucccuugcucaauaacauaagagaugaguaaauaugaugucaggugagauugugcuaugauacauuaaagggggcuguggggacaggaguggcugaggagaaucgggucauggggccggaggaugaagcugggcagggcagaagggcagcaccugaggaacuggccuucuguacaugcugauccucuauccacguugaggcugaggggagcuguucaucuggaggauaguacuguaggaagcacauuggggcugagcagagccagaaacggaauccugccuccugccuuaggagcaggaaggcauagccuccacagauagcauuuaucaccuuuaucaccucugaaguucuagcgacacagcacugucuuuccuggcuccguccucaccuuuguucguguagcuggcucucaaagggcccaugguuugcugguuccccuguccguucucagcccuagauggggaggcucgucuacagaacugucauuaaccagagaaaucuggaacagcugccugccuaguacuuuuuugagaaauggggagguggggguuguuaauagcugugaccaguggcugacaccaucauggcaccuaagcccuucccugcuuucuucugggcugguuucccacccugcccuucucacaguggaagcaguugugaugccgauuucuucaucuacguuggcuaucaagagcugcaucuugcagacugcggaagcuucaggguguuuuacaugaucugguuuggcugugguuuauuaugguccauuagcagcggucagcgccacgcuggacacuuacuccaccaauggcaggcagugcugugcuggccacucaucagauaauggccauccccgagucaguggacaaaaugcaccaucuucucuguuggacugggaccuggaaggagaugugagaaggaggugggguaagagaggguaguuuaagcugaaugaaagcauuccuuuagcuaagcuuaauccuugcccuuguauuacaaaauaaugacucccucuuuguguuugagcuggugucaacugauuuuucucucacuuggcagugaaauuugucuaguagaauggacauggugaugcuugggccuccagagguuugccuugugggugcuguuacuccuggagucucccccuuucuguccuaucaacacuauaccuuaccccccaauccagucacucguguuguucaaacaggaggcacaugagccaggcacacuuagaauggaucggcugaggcccugcauccuuucaaaggcugcccgcagucucacuggagugaagggagagcacauugaauacuagacuugaggccauuugguuuggaucccaggucaguuucuaaguggaucaaccucagccaggugauuaaucucugcggugacaccacauacuucaucaaaacguagcacuggcugauaaugggucgggggaguugagugccuucugccgcacugguuugccacacuugagcacacuucaugguccucuucuaaaauauacguggugguacuuauucggaacccaggcuggugguuuccaucagcacuggauuucucaauggccuuuccguaggucuggcaucucugguuuuaaaagugcguauacugcaagggacugcuagcuucuaggcuaccccauuucaguuuaaagaugaaacugugcaaugcaauuuauuuuaucagcuuccuccccaccccuggugaugagaucuggauuaggcaccuagauuacccagcacagugcauaagagcaggacuguuagucacagggcauuauugggagaaguagaaaagaggccuugcucuccugagguacauuguucuuccagcuggacacauggccucaugagcuaaggcuggcugggagccaaccccaccuugcuccuuggaucaccauuugcugaguuagaugagguauccggggaguacaugccucugugugugugugugugugugugugugugugugugugugugugugugugugugcaagucacacaaaaagcuaucaccugauagagaauagcauuauaggccauuucagauauauuuauuugggcuuaggacaaugugcuaaauauccauauauuuuuccaaacauucucagagauugcauuuaagaagccuuccauaucuguuuuguccaugguauauggagcaucccuugugaauauucucauucuuuuaaagaaugccuccauaucuguuuuguacauaggaacagagcccuugugaauauguuaauucuuuuuuuaugaauguuaguccuuuauuuucaaguccuauacaugauggcugucugauagcucuaguuugguggaauuaauauagauuucccacauggggaaggguuuggguggggauuuaaagcaaggcgggcucuugauccuuggaagaaauucuuaucugaggggggauugagaguagcauuguagagagguaagcacagcuaugcggaaaaugaauggcugugauuauuagauaggucucagaauuuauaggacauuugaucauaagagugagugccuuuccugagggaugagaugccuggacuuggacuucuuuuuaauuaaucucuuuuggcuauauugaaagagcgaugcacagagaauacuaagauggggugugaaauaaccaggaguuguacaaagagcgaugagggcgaggugaucugguuuuucugguggauggguuuguuagccuccuggcguuucacucuccucauuaugaaacagggauaagagaacagaugccugucccuggggcggaggaggaguugcaaccuuagaugcaggccagcccagucagcaccuugcaaacuuccuggcuuccuguuuagcucucaacugucucaccgcuggccauucaaugcuuugaaacucuuacuacaaagucauggcugauauagucucuccuuuguccauuuccuagcaguaaccauaaaaaaugcuccaggugccuagugcuguugugguucagguuuuuuguauuuuguaacuucugaaaacaaaacaaagucaugccuuaacuucguaaacaucuuuuuuuuuuuuuuuuuuuuuuuuugguugcaaggauggcauauugauaagcuagcuuuugcugcaggacaagcgacugccgccuccugagcgcuuucacuaacacacacuuuuguuuucucaugacacacaagguggagaucugucugaggccuuacuuaggccuccgugagcuccgaucgguacuuacauccuagaacuugacgucaugagggccuccugagggcaaaaccucacggcucugccagaagccauggucaagaccauugucagugggacagggcgcugcgaucugccuucagggaagcguggcagaggcaggguaggagcaguaaucagaaaccauggguaccauucuccccaaaugugcucuugcacauguguaccuacuaccuuuuaauaaaacaccaccucucagauccgcuuaacucuuucucccacgcucccguaagcgaguuuuuggaaccaccaauacaaguuuaaauguuacuaaagucaggaagaaggaaaagagcaaaaggcacagccacgucaggaaaagucugaugucuggcaauccaaucaguggccaucuaagagaucuguaaccccauuaaccgggccucacugaccugagcaggaagucccagcuccguguccuggaaagagcuguccagauuuauagccugccccagcuccucuaaucgaggcuguuuucuccccugaugcuguagucaaucaguaauuaauuugaaauccaaaguuucauuaaguguuauugaauucucucacgcugacauuuggagugcuauauuucuuuaaaaucacaaaccauuuuucauacugucauuggcguguuuuagcaggggaggcugcagcucucguguaaaugacccaguuuuccggauguuuacucugcugucaucaacguaucaccccucucucccacuucaucgcaucuccguucuuuugcgagcguuuugaaaugguauuuaaaauuucaucagcgcaugcaaauccuaucuaaaguaugaauaaauuuaaccgggcaaguauuuccaaagcaaccucgaccuuuugaaggccugaucccgugcagugcagugucccaagacuuccugucagaaaugggcuccggauguuggaagcauggcccggaccgagggugagaagacagaagccccauauggauauaccaauauagauguggagaagaggagaggcagacacaaccagaaccaucaggcaucuuuuguuuguuucccggcggaguguuuggaguguggggugaaugagagcgaagacauacuuuuuaugacuuggcgcuaguuugcuauaugugggaacguugcauuuggagggaagcuuuguuugaagggugcccuguggauuaccuagauaacauuuuuuuuuuuaaaucuuaguuaagaagaauuuuuuuuuccucgagguuacaaagcucugguuucucuuaaaaauauuggaaggaaagacaaggauuugcuagcccggaguagaacuugcaccguguugggcgaggugaugcuuacucugcucuucuucugcauguucguucuguuucaccaaccagcccucuucccucuuuaaauaucgacacuuuccuauuuaauuugcacuuacaguacaugagcaucucauuuaauuuucuuacgaguucuagacuguccccuaauggaugugcuccggguucucaccuugugcugcaggggacacagggcccuguguaugcuagcaagggcucuaccacuaacugccuuucagccuugaauucugauggagaacucaaugcugugacagcaggccucugguauauaucccuugaagagcuaugugaacauauaucuauggccuggccagaauccaaguuuggaccguuugcucacuggggucccauugaacucucccaugcaugcuucucuucuccaguugccucaagcuguuccaaggccaaggaccuuggccccggcuggaaguugcaagugaacugacccaccucacagucgucucuuccuucuucuugagcaucauguccugugugagacuugccuugugcagcagaccuacaggaaccccuucucuagaccugacaggugugccugugugacaguccuuccacucaaaccaugccguucucgagggauagacgugugacuugaugacccugugauccagccccagcucgccuaccacuggcuaggugaugaucaccaaguggucucccagugaugucucaucaacuauugguuucgaugcccugggcacuuuccagaaaucuccacacaucuagguaggaagagaagcagaacaggguacaagcaaauacuugagaccucagcauuugagagcaagaggcaggaggaucagcaauucaagacuguccucagcuauagaaaaggccucugggcuaugugagaccuugucucagaguacgagacaaaaacaaaucgggagagaaauagagacugaauucuacuccccacagguugucuugcuuccucuuccuugaccucacaaaugcaaggugcaagccaauacgagaaagaugacauugccccuccaaagcugccuuuuaugaguggagaugaacacacccugucucaguguggcccaagcuaaaaacucuuugucuuagucugucuuuuuuccaacaggacguaggcagauggacuuuauggugaagacuucucaaaucuuuacauaauaacccccgaagacaguaagaaaaaaaaaauaguuuaacuggaugauuguaccuuuuaaccacaucuguaaugaaacugaauguauuguuagcugguuaaaauauuccauuaagaaggaagguaggccuaccuuacgguaaauacacuuaaguguuuauaguacauuucauauuuuacaugauuuccuuuauaauucugcuuaucuuuucauuuuaauucccugaaggacauauaaaagaaccccuaaagagaguaauuacugcugugcuuuuuaaccaaggcuuccuuugcagagaggaaucugagcugcuuuuuaaagaaggccguuuuuuaaauaaaaaugcaaauaagcugcuuuguacccacauuaauuacccaccuagccucuuauuaccauguuuguauuguuugcaaauacuauuuacagucguguggaaauuaacauuacugguccuaaggaaagacggugguggggaggcugugcuuuggaaccaauuaggacgaaccuugucuccaccgacacucugggggaaagcgcagccuugccaugucaaauaauagcauuagcaccaacugcaucggcagagcaccguaauuauauuauuggcccuauuuugcuucugcaacgaauuucauugcccgcauuguaaaaucagcaggcagcgaaguuucugcuaaugaguuaaugugcucucugaucauuuuggacaaaagucaccggaacagccaccagggaguuuuaacacccccccacccccccacccccccaccccccccaccacugccuggcuugagccccuguaagugggaacaaagcaggguccuuaaugcccucauuugaguggaaucccuccucuacaacggcacucugaaaauagauccuacgaaugaagcucggggucugugcacugcagaagucagcagcucuuguuggguuucagguuagccccgcauugcuucaggcccuaggccuugagcuucacucuggggagcagccgccuaucagaggggagggagggcuguuuuagcucacgguucagaggggccuguucauuauguuagggcugcuaugguuggaguauguuggucugugguggcuucgcauaucccccagaugagguaaaggagagaugaccaucuggcuuuagccaccagaggcucacuguagcgacacacaucugccagccaugccucucacccucuguguuccucacaaagaaggucaucaguuaggaaacagaaguuuugauaugugaggccgaggcggggagggauuucacacucaaaacccgacagcggcucugcaucaucugugacuucaucuguagaagggaacugaggaaagaaacuccuccgugagcuccuagcuuucaggcggcagaggcaggacgcagccuguggggcugccugacugcaaagucaccuggcuccuguauaaacaguuccucauagaacaugacagccagcuucagugugcacacagcaucugggugacacuguaauuagcccuccgcacaggucuacuguuuuguaguauacuuuuuuuuuuccaagucacugauuaaugacugauguuuggauucuauaauuaaaaaauauuuuuucaucaaaacagggaggcauaaaacauuaaaacguuucccacccgcuuugauguuuguuugaaccugagcuuaauuauguugcuauaaacacggguccuuuccuuccaggaaacauuuaugaauaaucuccugugccguggagagcugagccuucuccagcgcucguagcaaggggcaggagggggaagggacauagugcucugacucucuacggugccccaccuguuuacaggacaccauuugauuuaaucguuuaauaaccagaaggacugucacugucuccacuuggucaguaagggaagugacaguguggugacacacgcugacugcgggaggaggggagccgcacgcgcccgaggccauguucccaauuccugggcggacgcagaauuugaaaauggagcccauucgucucaaccaugugcagugagcugucauggucaccccaagcagccaccccggacugguacuuuuucuuuucuuuuaaaaauguuucuucuuuuucuuuaucuagcaaaaaauuguaguuauugugaggcaaaaaaagacaguuuccaccccuuuggucuaaagguguuguuucuuuucuuucuugaaaauuuuguuaauuuauuguauuuuaugucuacguguguguguguguguguaugugugugugaguaugguuguaugguuguguguguguguaguuaugugugugugugcuguacaugugugugguuguguguguguguaugugugugugguugugugugugaguaugguuguaugguuguguguguguguaguuaugugugugugugugugugguuguguguguguauaugugugugugguuguguguguauauauguaugugugguuguguguguguauaugugugugugguuguaugguuguguguguaguuauguguguguaugugugguguauauaugugugugugugguugugugaguaugguuguauguguguaguuaugugugugugugugcaugugcuuuauuuuauguguguacccugcauguauguauaaguauucugugucacuggaagagcugaagagcccauugucuccccuggagcuggagcuaugggagauugugagcugcuuggugugggugcugggaaccgagcuccaguccuguguaagaacagcaaguguucuuaccugcugagcucucucuccagcacccaaauuguuguuucucaaccaaccagaaagucacaacugucccuggcagcguuggcuaggcaguucucuuccccccaggcgcccguaucccugcccucuaguccuggguaccacaucccuccuccgguugaugccuuugcggaggucuacccaggccaccccgcaguauagccaauuccucucccacauucucacauccucaccgauggaggaaggagcccuuccagagccugcacauuggauugcuacuggagggacugcaugaaauaagaagaagggaacagagcaagcaacuuccugcagacgccccuugucuccuuugcaaguguuuguaauuaguggggguagggaggggaaaucaagggacucagaaggguagccagagcuaacaguaaugucuuuucaccuuccgcuuucguccaugauguccauucaacccagaacuggggaugggcucuguguaccuguuucugagaggugcagacacagcccaucuugacauuuucugguugucaagcauuuggccacucccugguccugaccuggugcuuacaaugccagcugaagucaccucaugcacugguggcuuugcugugagggacucggaguuagcugacccaucucccaucaggcuuuguccagcauccaguuuuguauguuuuuguauggaauagggcuguauacauacauuuaucauaugcgugugcaaguauuuacguucuguuuugcuuauaaaucucuagacaagaccucugcaugcuaagaaggggcaguggauacuccagagugucccacugguucauuuuuaauuuuaauuacuaauauuuguguaaaccugcaccacagcacgagagagcucuuaggaauccguucucuccuuccuuugugcaguuuggggauuaaacucgggcuuccaggcuuacaaggcuggcaccuccacccucugagcuaucuucccagcaucugccagcucaucucaucucucuucuuccucucaaaggucucuucgacauacgucugcacugucauacuuauaauauuuguaucccggucuuuaacaguaauuaaacgcccugugcaucaccucugcauugguugcuaaagaugagggauagaagagugccacaugaugucacauuuuuuuuauuucgaguggaccgagcagugcgguuggucuucuguuucaugucucccuaagcgccccagcaggaugacccucagaaucccgaggggaccugaagcucaugugaagcucuuuucuuaugcucugccaguugucccugcaacaugcuguuguuccccacaggcuuacaggauggagguccgaguguccucugugccacucaccuguccacuucaagaguaaacucagcggucauucuuauuuugugcuccauguucauacgccguccccaggcugccauaaaaaaaauagaguggggaaagucuggauugggcugacccaagaccucucugcccuccugacucccucuggcagcuaggcauccuuguaugaacacuugaguguugaugguuaucaacagacuagacaggcuguagggugggcugauaaugaccugaggggaaaccauugauauacacagaaccguuucccaguagggcaaaguucauuaugugucuacaagacuaguggccagguagccaacauauaaacaauuuucauuuucagucuguuaagauggaaagggaagaaguggauauuguauucuuaauacuuccucucuuaaguuauauguaucaaccaagagauuuuuaaggcuagaucuucaguucaugauggaacuggaaagauggagugggaauuuuugccaccaguuccuucugcacacaguaggcuauguauauauguauauguauguauauauguuuauuuguuuaaaggaguuuguuuauauguauguauguauguauguauguauguauguauguauguauguauguauguauguaugucucugugucuagguucuugaagccagaagauguaucuggguccucuggaacuagaguuacaguguuugugagcugcccaguguagguguugggcaccaagugccaguacuuucuacaagagcaauaaacacuuuuuuuuuccuucuuggaaauaccaccaucuuuauuauguacucacggcuccucucuauauccagcuucuagcuccccguuaucuccucucagaggucacccuaacuugcugcuguucuaccugcuucuaaguuagcaaaggacgcaaaguagaaagggcagcaguuagaaggccccggaggagugagagcaaagaucucggacccgugcaugacagccauuucaggacaacgcgcauccuuggggcuugcucugugugugaguggauaccguuucuaagguaacauacaaaagaaguaagacaguagugcuauaauuccuauugcgaguguaguuagaaaaguggcagggggcuauuuugcccuuauuugaucaagaggacaggaaagagaaccauccagagaaccuuggaaggcuuugccauaugcuuuagcgagauagcgauuuccaucacuguccacuucaagacgugcacccuagggaaagcaguagguuuggcuuacgagcucacugugcuuucugcuggucacuaugaguucagaagugggccgucagggcuccucagucacaaccguguggggaccauucacagccaaaauuaaagaggaaaguucuuaacauugugacuaaaguaacucgugccuaguaaggggaaaaccaucacuuugcagcugccuggccacucaccagagccuuggaaggugggaaaaguggucuucucuguaucgagaucgacauaaaguuugucugacagguuaaaguaugcagauagauaccucuuuguuccaucagacuccggcuuaaggagagaguaccuggaaacauaggagaagucagguaaagccacugucccauuggcagugcccucccagccgucagugccucccucugucuguauaacagaugucacguccaguggguauggacaccauggagcaagccugagugaaauccagauguguuuguucagguuacaauuggacaucagcaucuuacugacaaucuaagagaaauagaaucccauuaguuuuuguuuuguuuuguuuuguuuuaaaauaggauuaucccacauuuucccacgacacuacuugguauccuggauaauuuucucaggcucaucucuuugauuaggagguaucuggcaggcuccuuuaaucaggaacuguggguaguuagggugcaaaaggauacaucacaguggugggaggcucucuuccagagagagauagcauuccguaguugguaaauacaguuuuuaaccuuuuaaaauuuggcucaguauucaaggagagaggcucguuuuucucugcugcuuauagacaaugaaggucuuguccuguauccaggcaauauauuuuuuuuucaagaagagaaucauuauugagaaauaauuguccaaauaacaucucauugugguaugugguguaaugucugaggucguauucccuugaauuguuaaugaaacccacuaaucauugggauccugguuauacuuucuuaguggguguuuaaggcuauguaguagacaaaauuaacuuuuuaaaaaaaaaucuacuuugaaggccaauugaaaaucucauccucagggcucaucugggcuucagaggaaucucugguccccauaaucuuucuuuuauuagcuaguccaucuaugugaggauaugccagaggccucacuuggccacuuuuucuuuucuuuucuuuuccuccuccuccuccuccuccuccuucuucuuuguuauuuuuuguuuguuuuuuuugagacaggguuucucuguguagaccaggcuggccucgaacucagaaauccaccugccucugccucccaagugcugggauuaaaugcgugugccaccaccgcacuuuugcacuuggaagugugaaggagacuuuuccuguguguugacccuccucuuugcagaccggacacugguuagaguccacccaguggcguuucugugaugucccugaccaagaacacaggugacugugcauaguuauaggacauuuugggagauggcuaauagucuucugagucaguuggcucuggagggcgaagagaaaaauguucugcuauuuaacccuucugaccacagcaguauaggcccuucaaguaugaauacucaacacccagagggucagagucgcaaaugcucuuaguggccagccaucccuccagcuccaucgcuuuccagaaucucucuggucuuguauccuccucgucgguuuccugugacugacuuuugugagcuggguucccuuuuguccuccucacucuacgcacacaccugggggugacucuguaucacgguuaucucaaaagagugaggaaagacgggagaaaggagagagcaagagaggaaggaaggggagagagagggagggauggacagauggagaugacgagcaggcaagagaaaagaaaggagccugcugcagcggcacaugcccaucagcccagcacuccggaggugaggaggaggaaguuuggucugaguuccaggcgaucuucgagcuacagagucaguacccaucucaaaaagcuuugcucaaggcgucugagucucaguuucccaccacucagcugugcguuccggucugcaucacagcgcugcgguggggcacagcuaguucuguggccgugcucagcagauccaguggaccgcagcucgucccggacuuuucauuaccgcccugauuauugcugagccccucuuccaggcgcuuggcuucuaaggugaccacacggggccugcccuuccucgguggugucucauaguuaauccauggaccgggagaucccucgucaacgcgcacggccccagggaagcucuguugucaaaaaagggcuggauuaauuuucccgugcaguggccuuuguccaggugggccugucugucuguucagggaaucacuggcuccaucccggaccugcccuuuggucaguacggugcuccaagugggagcacucggccagcaugcauuuacucuucgaaagcagguagcccuaccacaugugauucaugcaauuaaacauccauuccaauuuuauuugugcacgggucuaagugcacaggggacagcaaacaagggaaacccaagauugaaagauaaacauugacuccugccuuccaaacagacagcaguccuccauucacagaagcaauuaugggggaaauugggccagaagcugcuuggaucauugcuugguuuuagccucguacccauuagcccuccccggauggaagugauggauuaucgagaaacuccugaaugcgauguuuuuaucaucagauguuaaaauguaccuguuaaugugacagcagaaucuguuucuccugugcuuauugaaguagggggagggggagggggaggggucuuagcucugauuggaugugugucuggaaaggacaauucuuuauugagcaggcaaauuaauacaucaucgucacacagagaguguuggaaaggcugagggcguacggaaaaguuauuaagcuuacaagaauauugaaagcaugagaaggcaugagaagaccguauuaacgacuugaacuugauuauucugacuguauucuaagcccagaguguugguaggaaaagacccaaaaugagaaauguuugacaaagucaaguuagcaucaggcugaaaaauauggaagagagcgguguguaucaguaaaacauuucgguccuuucuggaagagguacaggucgggccacgccagccaggcugcuugcggcauuguuuuggagucaccauugucugucuguagcuuuucccacgcugaacccucucugagaauuccuucugacacagucuacacuuucuuuccccuacaaccuuguguuuuauuuucugaaugcuugcuagccccuuucuuucuuucacacccuggcugaaaacuugguaauggaccccuuuuugacagcccucccccccacaccaagacccaaugacuccacauuggcagccagagugggcaugcuuuagacaaccugcugggccugcugucugcucuucuaggcuggguuugguuggcugcccccagagccuugcuggcccagugcuguuuuguccggccaugucacauugaggcuucuggugugaagaagaggcugucccuccaauuaugccucauccuucugucuucuuucccuucccgagacagagcuacuuaccuuucuucuguucagugcaucugaagauugcccauguugaauuauaagguguugggacauggcugaaaucacaagccuucaaucauaacaaagaauucugcaccuuagucauaacuacaacaugaauuagguuaguuguugaaauguuuuuuuguuuguuugguugguuuuuguuuuuguuuuuuuguuuuuuuuuuugaucaaauuuuuguuuggggaacauauuggucacaagacauaguucaacuucuaacauuugaaacaugcagccuuauugggaaagaaauuucacugagcucaaaauacaagaagguugaauguuauaccuugucuguaguagugcccuguccuguucuccaucucuguaguauauccuguuuuaaaaaggacccaaacuaucaguaugugugccauucauuggacugccccuguuuuguccugagcacauuuauugcauuucucacugaauugcugaaauacaucagaugauccaggaacaagcaucucaacuugagcaauucuaagugauguugagagugccaguagaaggaagguggcaggugggauggcugugccagaaaacugcuugcccuguaaucucgagggaagcagaguuuggaucccccaguuuuccuauaaaaucuggggcugauggcgugcguuuguaacuucugugcuaaugguaguagugaggucguggggcauagauagguccucagaacuuugagccagccagucuagcagaaucaccgagcuccagguuuaucaagagaaccugucucagaaagugagauggagagugacugacggagacucuguauguuaacuuuuggccuuuacaugccuguccccaucccccaguagugucagggaaaaaaaaagaaagaaguagaacacaugccaacacauguacaaguuguccaucgugcacagaaguguuucaaauugugcuaagaggcaguagaggggccuggggaaaucugcuugugugcaugcucaugugcacgcaugcugggucuugaggccagagaaaccuaaaggggggcggccgcuaaaguuuggagucuguaugacugauggauggaugugucuauuuuucuuaacaauaugaguuacauaggauuuugaacuuuaaaacugauggauucauaauaauaugaacauuaauuuuuacuuuuucuucaucguauggaugagcuacguacauagauuucauuaaucagccucuuuucuaauuacugucagguacgacauugccauaacucaccuuucccacgucuacggcagacaucaccaaucaaucacaguaccgccucccacugacaauugaguucugcaucuaaacucuuaccucguaugucaagagaguaccaucaggucuuugaaacugggucuuucaucccuuugccaaaaaaaagacaucuggucucagacagagauucugggccuaacuguuuuuaguugugguccauccaagcauggugacguccacucuucucugugguagcuuccuuugggauaaacacuugccaucuguguggaucucagcuagauuccuguuuaacguucacaucuuccauugagaaguggauggcaccuucuucugcuuggcuucagaggcucuuuagcugaguagggaagauuuauauauuuauauauauauauaaauauauauaugagagagagagagagagagagagagagagagagcccauucaugagccuuuccacuuugguccaguucaggagugggcuacuuugugugguggggugggauaucuugcaguaaguacucuuuuucaugagggacucaccucuauuccagcaaggaaagauagaagguuaaggagccugggucgauguuugacccacauagucuauguccagaagucccauuuguuuccuaggauggaaacagagggugaaaggagccaugcucacacccacacuaauaacugggcugggcaacuucaggcucaugggagccaacccauuagcaucaagaugaccagggcagaugguuuaguuuuaggucuuuuuuuuuuccuucuccaaaaucaggcuauuuuagcauuuuccaugcaaaaaaaauguuauuauguauaacaauauuagauaauuaauuacuuuauguuaaagauauauuugagggcacauacauaugcacauaaauguauagauccuugcauuuauaucuguuugcagcuauguucaucugauuggcuugaucauacaucaguguucuauucuccuguggaacuaggacuaagcuuaugugaauagauguucccuaugauaaucuaagugaaagcaaaucacucuaauuaccaaaaucugucuuugauaauaaaguaggagagaagugagacagaaauagcauuugaguaaugcuuugcccuucugucucuagaccuggaaacaaauguucuugaauuuauacauucuuaguccuuuaggaaccaugaaaaccugcucuuuuguauaugugaaauggccagaacugcauauuuauuaagaagugugacccuuaggaccagagaagucaaauuaaauuucauaaaaaucugcuauggaaaaugaauacgugacaccauuuuuuuccuuuucagggucuacuuauuaauuuugucaugguuaauauguuacaguugcaaacaaaggcauaaauguguguguucauuccuaauuaauuuauguaauuggguuuuauaaauguagguguuuaggaagcuaugcauaacacaccccauuuacugugugcuauagccaauaaaagcauaauaggaagaaauacagguugaagcucacuucagugguaaauauagauuaguuguaaaugauaucuuuguaauguuuauuuuaaguuuugcaaugcugcagauuuucucaacauaccaauuaauuuucuuauuugaaauaaugaguaguuaauggcuauaaauuggaagucuucugucucugacaauuaaaaggucucuuaaagcuuuuguucagccucccccacgccccucguguaaguagccgucaggcacuggggaaggaaggaggauacuuagaauacggggaauaauaugggcucauauuucgaauggcuuguuugaugcacuucggugcaucuuuggugugccacuucuuguacgugugugggugcuaaggguguuauguguguacccguguuagugcgugugcaggccagaggccaacguugaaccuugcuccuuaggcaugggcauuaggcucaccugaccagguagcuagcccagggaucugucucuaucccccuccucagucccagaauugccagugacuuccacuguaccgaguucguuacgugugggccagguccucauguuugugcaggaagugcuuuuguaacugggcucuccggucagccuugguuucuguuuuucuuaugugugcuuccuauuucaugccgaagaggcaguguaugaguugacgaauauggcuggaaacuuuaaaaauggguuguaaaugauaaugugcacgucaguacacccaggccaaaccaguaaguucuuacugaguccgucaucgcugugugacagugagugacauugugacggagaucucaguguucuggaauggcugugggcuucagccugguuacguugaguggcuuugucuuguucuagggacagcuuccuccucuuuucugagcuaaugcugugcacuucuaaauccacagcuuuggcuggcauucagccuuucucugcagauguguugaaacauaaggaauugcaucuggccagggcaaaacaccguguccuuuuugacagacagcaacgcaaggagcgcuuugaauaccaaguugcaugccuuugagaccuuguuggauucacugugagcaucgcaaacauccacugggggagggcggacaugugaggucaauugagccaugccucuguauauucuguuuugcguguugcaggugaaaggagaauguuggauuugcuuaugaaaguaagcacuugcaagacuuuaaaaaaaaaaaggaaaagaaaagaaaagaaagaaagccuugaauaaucacauauaagaauaaauacuguauguggaguaaguguuguggaucgcaucuaugaugaaauaugcaugucuuuccaaggcuaagacccucauaauucauuuauaaguugcaugccucaccuuacacacacguagcagaauaguaauuuucuucauucuuucugaagauuuugucacauagguuaaggaacaaagaagaaagauaaacuuuucuaaaauagcaggaugcuauugagaguuaacggggugggggggggacuauuaaaaaaaaagccaaaagugugugugugugugugugugugugugcugaggcaauggcgugugggcugaaguggcaggcgccaggcuucauguguucugucaugucacgacagaaaucauuacaagugugauagguuuauuuauaaagaccggcuucaauauucaaaguacauccauccccgcauuccucauuucaagccaggcuguggaucaagaugaaagaaaaauuaaauugcguauugaagagcuguuaauugagcugugcuguauuuaacggggaagcaccggcuucaggcagucgauagcaccgaggguuuuuuuaaugugcugcaucaugagacugacaguuugcuuuggagaaugcaaacagggcuaaugacaaagcccugcaagcuugauccucacugcgagucuccccagaaagagaacauccauucaucuacacacacacacacacacacacacacacacacacacacacacucacguucaugggggaaugaagcccuguguauuuucucccuggagguguaaugacacuacuuagucacuagaaugagucuuuucuggggcacauuuuaagcuuuuuaguguaaggcuucauacauucuuagauuucgccccuccccuccuuaaucaauguaaauucaauugcauuucagaaggggauaaaggcuauuuccucuucucuaauaucuguuuaaaaauguuaggccugcccuguuauaauucucaaaaguagccuaucagugguuuaauacguuaucucuuuucucuaaggcaguguuaauuuuccuuuguaguuaaucucuccugcuaccaaauuuaguauauuuauuguuaaagauucucuuaagcacuaagugauuuaaguacauccgggauaaaguggcccugacuuuaaccaugaagcaaguuuuacuucuuuucauucucuucccugauaaauccauaguaucuggaggcauuucuagaacuguggacaaucugagccucucuaguuugauuaaagauaucuuggauauuccgaccgagaagcugcaaggcugagggauuuauuuuugguucugacccucgcaccgcucgauaggaaggacagagacuguggauuuaguucccaugcgacaaacuucuccucagucuucaggaucacugcuucucagaaagagucaucuuguggcuguuguguggguccucuuccaugcgacaggaaguccacagacaugacaucaggggcucuuucccauccauucaucugucuguucauucacccauccaucuauuugucuauccauuuguccauccauccaucuguccaucuacccaacuacccacccaucuguccaugcaugcaugcaugcaugcaugcauccauccauccauccauucaucuauccauccaucuuuucaucuacucauuucuucauuauaucuguccugggggccuccuuuuuauauagcacugcccuugucagguuuucgagggcggaagguuugacuggaagaagugacauuugagccuggcugcaggagaggccaggaagacaggagggcacagcucaguaaaucaccaggcaucgaggcuccauagcugugggcagauaaugcucuugcaacugcaucuuuaagaccugugucuacauaccacggacaugguggcaaccugagagcucggagagauagagagcuaggcugugcccagagguggagagcuagcucuguuagcagaacugugguaagcaguuucaggagaguuggggcugcacaugggaggauugaggaugccuguggaaaacacagauggcugaugggaagccaggaccaaacccgggcuguuguggaguuagcgucauccuggagaggagagaacagugggaaaaggcguggagaggcguuguuugguguugggguuuaggggaagucacacagcaucugaagagcacaguuacaacccaggcaucugaccucucagaacuuccuucgugguggauacugcucguuagaugucuucuguucccagcacauaaucagaguugacuauacguauuugaucuuacuuauuuacugguccaucuugaaaaggucaaagaggcugacugaaggacagccugacagaaggcgucccugcccagucccaaccuuauuccagaggccggcuucugauauggcugcagacuguuagcuggcugauuuuuuuuuuuuuuuuacgucagaaacugucgcaaaaggcaggcucacugccuggaaaagaaggcugagcugccacuugaagguagacgaugaugguugauucugguagggaaagauguacaagggcauggcgacuacauuucuaggagugcucagguccuaagagugguggcaauuugccagggcaaaguggaguaaugaauccuccuuugaugauauugcguagcauguccuggauuccagcagacugacuuuaucuggauuugaauuuuguagagaaggguguguccaccccuucuagcccucucucucaugaugacuugcuaagaggcagucucucucucuauguaguucuaguuuaaauacaagauagagggugaccaacaugucuguguccacagaacucagaugguuuagggcacacgaauccugagcaauccuauagcauuaggaagcaaaagaaaagccagcccaaugacaaagaaucaggacgugaugauggaccucucaggacagacccagaccuuugugacuucacacacacacacacacacacacacacacacauacacacacacacagugccuuguuucucaacaggauauucgagcagaaggcaggcaggggucuuuugaucuuuaagucugucagggcuccagacggacucucaaauuaaucucugacacagccucaguuagcucuguagcacuaggaagagaccauggaaggccaguuaauuuuguuucuacaacaguucuuaggugaagaaaaaaaccuguggacagauugacuucgaaaggauaggggacacagcccuacuauguguccuaaugaauucaggaacugggacacuugugagcagauguuccuaucugucacaugucaauggaaguggcauccauuuuuaaugugacugagaaaauaauugguuagauauugcgggaauuuuuuuuuuugguagaggguggaaaaacagcuugcagauggaaguggggggggggcgaggaaagaacuggaaguagccccucuauuuuaaacagaaugaaaaagaugacauggggaccagaaacagaaauuucacuucugugccaugacaaaugccggggagauguaauugcaaaaugaagcugcaaaugucucauccaggaaccagguaacaaccugcuuggcuucauaaagaaagaacaauauccaauuagacuaaguguauucgguacgugagugacaagcccuggagaccucagggccucuggggcccccagggcgguuucaggaggcugucuccagaccuguccggggugugagcaugucacauugugcccuaugccucccagcgcggcugccucggcucuuccaaggacuaaaaugaggugcaccuuguauggggauaucuaccguucucagccagcaggacacccacaccuugcccaccagauuauccuugcugcuccgcugcccauggccugugcaugcugggcuccuggcaggguccagggaccgauauuucagacaaacuacccaaacccucagguagucuguguucccagagucacagugacugcucacgcuaggguguugaauauugcaugucagcuccagguucaagcuuccuaagacccugccuaugugaccucggaacaagcacugaagcccucuaaucuccuguuuccaaaucuucagaauaugguguggaauuuuuccucgucuuuaagagucuuuuugagcacagugcuugugucucagugggugucacagcugugagccgucauuaucaccagcaucuacaaguccccccucccccauucacucguggauuccuggacccuacaccuccaggauucuucuucagucguaccuauuggcuccacuagcgaugcguuuaacuaccacacuuagaacuugcuaagauccacagcccaaaucugugaugaaauugcuagccuucuucagcaggcaaguccaggucuccauuuaucagaauuuuuaauuuccagacacuccccucccccagcauguuuagccugcguuugcuucaugguuugauuuaauggucuuuauuaaugagcugccuuguuauugcaaaaguaaguugaccguggaucgucagcgaaccuuaaggagaaucaggcaaguucucccagugccaggcaagaguggaggcguguggcuccguggguuuuacuuucagccugaugauggauuugguacugaaccacauucaaacagguuugugauguccuauggggagguauuucacgccacguggagucuuaaguacaaggccuauucagucagcaagcaguuguuucacuuauccacacaggaagcuuucauguacggaggcgcagagagaagucugucuggagguugugggaccucauauucuguacuuggcaggaucugagguggauggagaagcugagaacagaguccugucaagcaacccuccacaaucugucaaaacacacaagcuaacucauagcugguuugggaguucaccugucaauuucuuucuugaaaacuugggguuucaaauguagccuccucucccuaggaaaacagaaacaaaggggucccaccucacccaacaacucggguucuacuguuccucaguucucuuucuccuaggcuugcucuuuagauaagcggauuguucuccagcgaacucaggcauuugaggaaggcgagggcuauuuggggcagaugucauggcuuggcuguguuaggugacaaucaguuguuuuuugucugauccuacagugaaacagcauguagaccacuuuccacucgcagaggagaagcaagcuguggugaaguaauuaaauccaugauauucauggugaggcuuaaagcucuucucuagauucauagaaugcucuccauuuccagaaagcugaggggaagcggauacuugggggggaggaaucccuucaggagcaggguguccauguccucucugggcugugugguguagacacagggccaggguacauauccacugucaugugcccucuguagagacagugauuuguauucauuagagguuuuuuuuuuuuuggagucuaauuguuuuaaaacugccacuuuuguuuguuaaagauacagaugucuggccauacaggaaagcaaggugaauuuauugucgcaauuagaugcuccacgauuugaaaacuuaucacuuaaauuggugaagugucacuuuucugcaacuugauguuuagaaguccucagagcccagggcugaucucaugugcaauuuagcaagaucucagugagacugagcagagggaagucgcacuugaagagacauugagacacacggagauggaauuuucccauuccccccuccaugguaggguaggugaaggcagauagaccacaaauugauuuuuguguaacucguaaauuaaguagagugaaguguuuuguuuuguuuuuuuaaaaagaggaccaguggauuugaaguugccuugugucaggguacacugaagacguuaguuaagaagaugcuaauaugaaucugcauggacagugcuuauuucucccuccgcguuaauucguguugucuguucaucucugcgcaaggcgagcaaguugucaguuauaagcuuuucaucuauuaccacgaagcaauaucuuuacaauguaaaagagagcuggcaaaauucucagccuggcaucaacagccaacgcacucugaagcgacacucgguguguacgguuuugcgccugcuucugucuuuaaugugacaugacuugaaacugacgcagccccacggugauggaaggccccucagagcuugucccccaugauuaugguucucaucugcacaacuucauuuuuucucuggcugagucucagccuugcaaaugacagcagcguuccuucuuuuacuuucuucccaacuugguuuggaaaccgucguuuggcuaccaggcaaauacaucugcaauaccacagaggaacgaugugucagggaccguggagacucacccuagaaccucuuuguacccuccccacuucuucuuuuuacuaucaucucauuuauuaaucuguucuuuuguuuguguguguguuugcaugaugcuuguguguguguaugucucuguguguaugugcaugugucucucucuguguauguauauguauguguguaucucuuuguaugugugugcgugugugugcccauaugcauguuggagaagcuguauggacgucacaaggauaguuugugggacucagcuuucuccucccccagacgggcuauagggauucagaugcggucacuggacucuugaucagugcaccauuuugcuggccccguuuucuccccucuccuuuuguccuuucuaucgacggugcugauggcugcguauguuaaaagcuguugaguuguacauuuuaagugggugaagugagugugaacuacaucuacauaaagcugcacuaauuuuagaaaaagugccucuugaauuguccucaguagaaaauacucuggagacucuauuuugauuaauucaaaauuaauuuaugauggguucuccaauggcaugugccgacacguagcguguuuauacaaguuuauuugagacgggugcauagagugugcuaugguuuugcucaguauguuuuuuaguuggggguuaauuuggggagggggcaguuauauuugauaucugugaauccugugugcuuuauuauggaaacaucaaucuaagcagaaauuauagcauuaccuuauucugauugcacacacugcuauaucgaguuuuacugucccccacacaaguuuucaaaguaaaccaugcuuguucaguugcaguaauaaccaaacugaacaaccacuugugauaguuacagcguuuggccccaacucuaggacaggaguuacugugauagacaagucccccacaccucuguaaauucuucugcucucuuagcagucugccguugaucuccuccccccccccccccccccagauuggaacuuggaaaucaaaguuuccuguuccguuuuuaccagcccguugaacucaguagucuuacauuguggauauuuuaaccuuugauuaucuguggacaauugaaaauauuaauuuaaaaugagcuuaguguuuucuuccauaagacguguagggauaagaaggccgcuuaugugucccauaguauugaaaaguuuacaggucaccugacaagugcugaggcagcgaaugggcugggacaauaaccaguuccaugcuagagugugagcgaaggcgucucagcugcacggcagggugggggugaucuuguccuccccucccuugcuccuuccuucccucccuuccuuccauacacccugguagguucuuuugggcucagccuaacaccaggauugaaacuaucuauugagaaccucgacuuuauuaccugaagcuagaaaccuuuauugaaaacacuuuuaauuuacuuaauuuuggccaucucaugccguguauguuuagacuccuuaauuucuuuuucucaucuaaauguacagcgaguguaucuuugagcagguaagccccggaacuggcuuuauuauacauuauaccagcaaguuaaguuugauucauuugaauuuuuaaaaucuccagagcuuugagaacgacuuuggaacauucuuuacuguuggagcuuaaagaaaauaaaucucaaaugugcuccuuauuaauucaccugcuuggcaagcagagaugaaaggguuuggcgggguuuuccuauuuucucugauuucuguuuguacuggagcaaacugcccuuugcacagaguggccgaacuuucauaaaacacaaagauuucauuauugagauacgaagaacaaggggcaauguuguguuauaaacaggccuagaaccucccguguagcugguuugugugagaugugagggacuugguaaaguacuuaauucggugagcugugaauuaagagcaggaccaggaaacaaaacuuugucucccuucagaagguauuuugagugcaugaaguaaagaaaagggaucagguaaagacgugaguuccuccacagagaggcaggaacggcuucucaguuccuuuccaaucuggggaucugggaacccacggcugcugaucagcuucucuggaaaugagaagacacaaggcacagugcacaccuugcagccaacugacggcucaccccagcugguguuccugugcgaccccacagugggaaaguuugucauuuguuuuugacacauuucucuuugauuucauacucucauuccuacaggucuggccuuccuucagggccuucuuggcgcagcagacuccguguauucaguuuagguaauuuaucacugcacaccgugucuccuuaauaccuaaucucucuccuuaacacuuucccugucuuccaagccagcagcauaaagaaggauuccaggggagugggccuuagagcuucugccaagaaaagaaaggucaagguccacgagguccccaaacaucccacagauucacuccacugcccucccuuugcaggcacgagugcagaacauugacaauucaccaaaagucacugcguggcuuggaacaauggcccuguuuucucugcuugagggcuaagauggccacagggaaagaagccagccagauccaagagggccaagggggcaacacugucucuucucuuagaaagcuuaagggaagccaagaguuuugcagcucauuaccaacaugaauuuuauucagggccaggggcccaccugugccuuauuagaagugaguuuagcugugacagcaugggcugagagugaggaggaagggagggggcaaggaagggaggugggggaaaagccccacuagguacaacagagcuuaggauaacaugucuagaaucuuucaugucauauaaagcaugugccgaucacuagcugugaggaagguggggaggaaagacauggcgaguaacagucaacuucuucguaaagaaagggugaaacgacauuucucuucugcagacacgucacuggcaguaccuguuaacuuuaggcauaggccaagugucaacccuggagagagacgaccagugaacagcuccuccugccauuuaaucaguccgcugcaucguauuuauagcccuggagaggucggcccauuguuacaaggcggaauugugauguucagcaguuuauuccuugggagcuggaagcauuucuccauggugaauuuguaauauuaauuggccaugucagcucaugacaaauguagugacaucuauuucaaguauuucaguuuuauggugcugaaaaagugacacgcgcuugagauaaaguaaucucacaaaaagaucuucacgcucgcccguguggugcuucuagaaugcucucagaggagccucguguaggcuccguguuccacgggccgucuccuuccuuugcuaaggcugagaggguagcaggagaaggaaggaggcacgcggccucuggagauuccggcugagaucuucuggagagcgaagguugaaggagcauuugugacacagucauuuaucugacuugggacaagcugcuucugggucagaccugucaggacuaagacaauagugccuuucucacucacgggaugcaguggucauuagccagagugaucccgcaccccuuccggaccuaaggaguuacauggccacaucgggauucauuucaguuaucacaccuuagggaagaauggugugauuugcauucgguauauuaggaauguugcagagcuuucuggaguaaacaggagauuucagggcacggagaucugccugcuccaaaagacagugaugccaaagcuaagagagcccgugcgcauguagacugugucccuggcgcuucgaaacccaaagcauagaugagcaguguaacacagccuaggaggauaaaggaagcuagcaagccaccaagugaagggacuggagacauggaaaguagccagagcacccugguguccacacaggaguccggagaccaggaggaagagacaggaaguuagaauucagugcggagaccugguggugggaguguggugccugugaccagcugugaggacacaucugccaguggagacgagaaauggauuucauuggcuagugugacugcaaacuccaacccagcagugcaacgacaccguaacuuacacgggcagagcaaguccucagacauaacgcuguugucuccuccguacagcccaggauggaggcugcuucucuucuacacugugucuaaaugggugaagcugauguccuguaucagcggaagggcagggaccagaagauccccugcacaaucucccuucuuccuuaagaacuggucauuuugaggugaucauuucaacuaucuauuaccgaugcuagagauauguuuguccauaagguucuuuaaaaacaaauaacugacaugcccccgaagaaagaaaacggacccguuuuggacucugcucucuauuccacucaucccacacaggaagaugcucaguagcugcccagcaucugaauggaggcaucacugucaugauuuaacgacccccaguuguuggaggugcaggcuggacacaugcuuucccucucgugugaagggagcugugcagcaaaagcucacagcaggcacgauuuguaggccugcucacuccaggguaagauccucuggagguccugaggagaccugcucacucaccgcccucuugaaucaaggcugccgggcagcuuccuugugucuucccgaggaaccagucacauuucccaauuaaagcuguuaagggaaagguuggucggacucuucccgugugccucccucgcucuuggugaagcugaacucucuuuguggauucauugacacauuuuucuucuguagguugcuuuuuuuuuccuguccuggguuaguuuacauuuaugaacaauaagaacuuuugcauauuuggguacuaacauauuaguauauuugcauauuuggguauuaagauaguaaccucauagaauguaucgcaaauacuuuucacggacauuuuucuuuaucauuuuauguucaaauccagugaccagccucaauagcugcacucuccgcuaguuguuuguuugagaacgcuuucuuugugacauccagcgcacuuacuuugguuggcccccuucccuacaguuaguccucucuccgccccuuuccccuuguuccuaaccuuggucgcuucuucuuggaauggccuccccauuugguuagcccaaccuccauccuccccaccccugccuucgguuagcccucccccauccaacucccuuucaguucacccucucccccgcugccuuugguuagcccucccccacuuucaguucgccuucacccccacuuccuccccuuguucauaaccucagucacuucuucuggaacagucucgccugugcauuuguugugauuauuaacccucuuagucguucagauuaacggguuucuuccugucuguccaucacuuugaauuacaucccaugcucugggucucauaauuugauuaacuuccguagccugugucaaauaguaacauauuguccccuuucuccacccaugucuucaaaaaagcaaaugacugugccccugccaucacagucccugcuaguucugcauggaaagaacagauacacaguaauagaaagaaaaaaagaaaaaaaaaaaaaagaacccccacaacauagagcaaagcaaaagaaaacucagcauuuuggguucuugugcaauggaagaccaugcagaccauuuggcggugaucucuucgcaagcugucuucaggucuccuucacccaugggacgaguggguuccugagccuucagaggugaaccuucugagguacgauguccaaauucugcacuccaggcuggacuuuaaauuauaacucaguuugcaccaugcaaaccaugcugccucccgugaccuaggagaaggguggcuacaacguugagucuccaucucugacauaauaggccuucugucggaaaauccgaccacucucggcaacgcagcagaaucagcugcacuaaccuuaaugaaagcuccuugcucugccuaggagcugcuaaaaggaagaaggaguguacuccgcaccaggaucuugugacuugcugucguguagcugagguuucgcuguuacgccacucugguggacaacagcagguaacagaugugugcacccagucucauucauugucacaccugaguaggggaggaaggccacgccuggcugcgcuguggucucugcaaaugggcacacggaccaaaagguuguggcagugugucaaaggaaaagggagguguuuguacugaccagcaggcgugcucuguugagagcugcucccagauggugggucccuuacacgcgacagaccugcagccuacgcacauuugccuucugaaggcuuaaagagaaaugacuuuggaugcaaugauauuauuauuauuauugucauuaucauuauuguuauuauuguuauuuugaugugucugugcuuaugucucuaugcaugugugcauguguaugugugugugcaugucugcgugucugcguguguguguguguguuguguuguguguguguguguguguguguguguguguguuuauguaggucacaggacaacuuaguaguucuuuuucuccuuccgcuguggacucugaggauugaacucaguucucagggcuucugugaccagugccuuuaccaccucgcugaccaacagcgaacacguaauauuagucagaugucuucuucuauucaccucuauuaguuugaggucccuuccugucaucauccucccugcucuuacuuuugaucuguuugcagucacugccgaaugaccaauuaacagugcuaaguaauuguuuaguccguuggaggcucagucuugaccaguuuucaucucccacacccaacauuuagcuuucgugaguuggacgcuucaagaugacagaauuccuaguugaauguuaacaaucuuucacggcacuugcugggauucugucauucgagcucaguauuaccuggggauccgaggcacguguguugcugccaauguguaugucugugccucgauucugucuaccaccuuuuucacccaucagucacugggaugguuguggccaggggaaccuagaacuguuggcucacuuugaauguguccguuguggaagucaaggucguggcuuuccucuguggagucauuggcuuuaaucugugguuaacuuuguuuacccacuggacccaaaugugugcucuuuuuguacuuuugaacaaaagcaagggcaaaugaggagucaccuggguugacacaaacccuggcacagucaaauggguggaaccuuaggcaucucuauauuuuauuucaccacaagaugucgcuaggacaccauaccagcguggccaguaggucaucucucuggcaaagagacagucaucaaaggccaccuggcucuggccacagagaaauccuaucaaagcaacaggaggacacugucagggacgcugggaugccaucucuuggagccuuuaugaaagaagacagggcaugggacagaagaaguucaucucagagaccaaaguauccaaucagcccagaugcuacuuuuauuaggugagguagcaggugacccagagaagacaucaggauagauugugucucugagugaaaguucguauuuuauucuuuuagauaagucacaauuucagguuaucuaaaaaguagacauuuuagcauuuuuaaacuugauuuuuuuugggagggccagcccauuaacacaacaagguaaucauccauuaacagauguaucauugaggugugauauaagucucuucuccauucuagacauaugggaaaaguugugugagccuggagcugugguggcuuuuauugcuuaguagcucugcaucaacucugaaguguuugaaccuuucgugauacucauggauaaacucaaaucuaagcugggaauggggacacacacccacaguccuaggacuuggggggcuacaguaggaggauuggaagucagaggccagcuugggucauacuuugagacucugucucaaaauaaauggcaacgcagaagacagucaaauguagcaagcauugccugcccuuauucuugucauugggccacuguuauccucauuuaugccaggacugguuugcauugagauguuugcugucugucccuggaguaccugcaugccccaguuuuauagcccuguagcuauuucccacaccugauccacgucuucuuaauuugguuagauuuaauagaccaauagggauaaacaucgauuuuccauggcaagagugaaguuaacuaucauacugucgauacuuagaaaguuuucauaaaucuguuucaaggaagaagacucgggggcgggcggauucccaagcuccuuaucauugaccaaaucgcucguuuuaagcuggaguuaagaauuaaggggcuggagagaugguuccgugguuaagaacacuugcugcuguuacacaggacccgaguucaguucccagcaccugcauggugacucacaucaguucuaggagaugggaugcgacuuccagcaugcaccugcacguucaugggcagcacacucacaugcacagaauaaaaugaaauauuuucaaaauuaugucuuuuuucuuacucaaacggaggcccuacgucuacauuguucuuuauagcuuauaauuuaaaucaucucuaauuggucagaaacuugguauuucucuauaaccuaauuguuggcuuuccagagcauaggccaaguguuucuauuugcagcgucuuuugguuucagagucugaaccuaaauccugcguuuuggcuuaguuaauucugcaguuuuaguguccuuagcucacgugagccacgagccugcagggcacacauacauguaagccacaagccugcagaccccauggaauccuacacagcuucacuuuagggccacuggccuguguuguaaucccagugcaugggagaguuagaagcaggaggauugagucugaugccagucugggcugaacauagugagggaggccuugcuuccugaaaccaaccaaccaaccaaccaaccaaccaaccaaucaaccaaccaaccaaccaaccaaccgucaaacaaucuaacccuuucccuucccuuuuuugguccuggcugcuccauuuuuucuuccccccccuaagagcagcgucucagccccucucuugauuuguucuuucuaguucaguguggcccauucuauccaauauagagauucaugggaaauguuggaaccagagugagacacguacuuggaaggucuaaaaucacguuuagaaugucccagugaaccucagaaaggccugguucuguaggcucaaugucgccguggugugugccggaagggaacaggguuguaguguucauacuggcaccagcuuugaguggaccacauuccuggcagccggccuuggaaaaccauuugaaauuuuaaacaugggaauugaagaaaagggaagccgauauugcauuucuguuacacuggugaauauauuuaucucaucauucacugggcuacucaccauguugauucaaguuaaagcuuuccagggagaguacuguccccuguagagugaccguuucuaaagugagucauuuucaaaggcguucaagaaaggaccuugcuuucuuuggcuagagcagcacaucucaaaccugugggucaugacccccauaucagcuaguuacacugugauccacaaacauagcaaaaauuaguuacaaaguagcaacaaaauaauuuuaggguugggggucaccacagcaugaggagcuguauuaaaggggcugcaacgcugggaaaguugggagccauuggacuggaagcuugaucucaaauccacguacaggggcccuguggaaaggaaggugcauucacuguuggaaaucaaagguuguaagaucagggaacuagaucagccaggacauggaagaggaagcuagcaccuaucagaauguguguucuccggggagauucauuucccacgagcuuaggucacuggggcuacuucucaucucauccacgcagaaaacagcagcagcgucacuauucucaggugccugccccgacugcaucuagguaaggggcauacccaguauccucuuucucugcucuagcucucgcugcuguguuccucucgcuacugugccgcggcuggcacuuuccaguguuguuggggggagaccaagagagaagaaagggggggacugagaacacagauguccugaguugaaaggcugccucucaaaguuuuccuucaaaccaaggucuuuugaagaccuucccguggcucuugcugucuggcugaacguggguuccccaggagggguggcucuggcauggucacuguguccgagaagcggucugcauugcucugcagcucacaauuaccacuugcaauuccugaauaccgauuaagcagcaugcagccgugaaugacaguagagcacacgguuauguaccugcagaauccagggcauccgaagcaggcucucagguggccgucagaaauagccagccagagcuuugcugccuguuuuccauaauuguguagcuuugccuuucccuaguuaaucuguuuaauaaacucccccugcagaaucuaaaugcucaaauuuaguuucuuuuuugucuuuaugguguuuaucauuguuaacgcggcaucagacuugcccgacuuucgcaucaugauaaauucauaacccgagagaaggcggaaaacauaauuauuaucaauugcuucucucccagaauugccauuggcggagaggaggaaaauaugaacuuaaggaguagcugauucagagaauugcaggccuggaacugggccugucuugauagcauggccauuguuugcaaugacuucccacuggacugcucuucaggguugccuaggcccugcauucugcaagacaugcuaauuuuuaaagaggucagcuuucccuacacucucuagaauucaugugcucggucacucaguaggucgugaaugccugcuuuggguuaggccuugacacuaagauucgaacaugcccccgugaaugaggagaaguccuugcuaugauuguacccaacuugggacagaagucgagcacauagcuaugugcuccaguuaaagaaggugcauaugcgcacacucuuccagaaaguauucacugcccuacgcagagccuuaaaaaucaccuuuuaaaaguaagcagagcggggcaacuuacaaaagaagauuuucagucuuuuuauggaaaagucaccuuaaggugugggaggucagaagcaaacuuacccaaagcuacaucuggaauacugaggcucugaagagaguuucuaugugaugucacuuucuuccacucgcaaaugcacuucucacuguccagggaacugguuucugguccuuccugacuguaacucuuccucaccacgccaauucugaaccugucaguccagcuucugucacgaaaggucaaguccagagcuuuggaagaggcuucgagaggugacucuugagggacaccaugaccgcagccacuuuuauaaaggaaaccauugaauuggaucuagcuuauggcgucagaggguuaguccauuauggucacacuggguaacauggccgcaugcagguagauauguuacuggaggaggagcugagaguucuacaucuuacuguguagacaguagaaggagagccauacugggcucauaguagcuugagcacaugagcccccaaagcccacccccacagugucacauccuccaauaagccuacaucuccuaauagggccacucccuaugagccugugggcuccauuuuauucaaaucaccacacaaguguuucuuacaaagggagcuaacugucagggagaaguccuugucucaacagauuuugggucaagauaagaaacuaaauuuugaaugaugucaaaguuggagauuuuucugcagagguuaaacaauuauuuuaagcucgaguugacuuucccuaaugaaagauuaucagaugaucaagugucaaaaugcuacagaaaaacauaaacugcuccucaacucagacccucuuuuuucuaccaaauaucaaaaaguaagaaaggaauagaugcccgugaugguuucaaaaugcuuugucuccauuugccagacugccuuucccguguagugggagaaaggaaagagacagaugccucuggccauggcugccaguggcugcuuccagcugggagcgucuuaggcucagcaucagacacuggaauucugugccuuugguaacaccaccuuucccccauccaucugaaaugucuugaaaacaucacuaaaacccgcuguuucuucccaacauaucacagccacaccacuuuguucaccuccauucuagacaguuuucuuuuccaauuacaguagccaugaauugaauuucuuguauuuuaauuguuaaaaaaaaagacucaaugugacaucgauuccuuucacgaguuuuucagugugaaguauauuauugcugacuuuagguacuugaggacauuuuaaauguguuaucuaccuuauguuugguucugucccuaucaguggguuucaucgcauauauguaucauggcaguuuaaucaagacuuuauuuuaucuaaaaaaaaguuaucaauuccuugagaauucccuacaaugcguuuugaucauauucacuacccgccccacucccccagugcucuucagaugcacccacccuucaccgucaauccaacgugugccuuuugguaaaacaacaaaagagaaaugucauccaauccaguuugcacugcccaaauauucuuggauuaguggccuuccaccagaggcugcacucuuagagaaaccgacuccuccuuccacaaccaaugccaacacuccaccucuccgggugagaggccaugcccagguccuuagcuccucccuucacgcuaggaauucauccgauuuggguuugcccaggcccugcacucguuaucccaauucccccuuuuaaaaaugauucguuuuuauuuuaugugcauugguguuuugccugcauguaugugugagggcaucagaucacuuggagguggaugacagacaguuaugagacaucauggggucacuagaaacugaauccagguccucuggaagaguggucagugcucuuaaccacugagccaucgcuccagcccccccuucccccccccccccccccccgcuaucacagcuucugugaguuuguauguguaguuccauccuagguccagcagcuacugcugccucauaguuaucaugggccuguggcucucacauuggccuguagcucucauacccuuaacuuugaaaggcaugagggugcguauauauucccuguagggcugauaguucuguuguuucauggucucuauacucugacaguugcaugacucuguauuagucaccaucuacuacaggcagaaguuucccugaugaggaccgagaagcacguuaaucuauagguguagcauauugaugacucauuaggaguuaguuauuuuaauaccauguccauuuagcagaauaauacuaguaaguuucucgagggccugugaacugucuagccagagguuuuuaguccaauaauaguaccagcuguggguuucaucuucuggaguggaauugaaccaggaauuuaaaauauuugcuucugcuggcuuaguuuucauuccaggauauacucuaguuucacccaaauauucuaaaaguuucuucuccuuggagcuucuuacugguugcuccccugggaaaagcccucccuuguguugcgucuugcaggcacacgugugacugccuccucuucuggcugaugcaagcacuuuauccuuuaaguccaggaugcagagcaugugcccuggaaucagggcuuuaaugauuugagaugaacuuaucgauuuuaggccugagcauggggagaggggaggauauuaauacuuauuuuuaaaauauugagauuauauaauaaaucccuaaugcauuaguuauucuauuuuuaaaaaggccuuugugaaugcuauauauaacauuuauaagucugagauauaauguuaaaaaauucuuugguccuuaaauucucugacauggguuauuauauuuuuaugacuauuaauuuugauauaggcccuuuaaaaucaauuuuucccuguaauuacaaggcuguuuuauggugugugugauauaucaugugaguguacuugagggucaugagaaguucacaugugugcugugugggcccagacucuuugccacagcuccagcucaaggguggccugugugucccuuucuuaggauacaggaggugcucagcgccugggcuccugucccauccuccuccuuuugguuuuaacaucauugaaaaccagcgauaucguauauugagaaauccuggacucguuuggguauguuuggauuuauaggaccaagcagccacugagucaaaacgaugcugauaauucuccaagucccaggcagcgcccgguaucacacaguggccacagcucacugucugucaggcugguuugguacagagaaccacacgucuguauuuuaaaaauagaacaagaauuauaaaauaccacaagucucaucccacaagggauuuacaacucaaaguuaaguaaaacaaaacugaguaagaaggauguuguauauagaaucccucccaaacccccucccuccuuccccuugcuuuauuuuccucgucuccuucucucucucucucucucuaaaauuucuuuuccucucuuuuuuguccuuucuagcaaggggauuagagugaaaacucaacuggacgugcccuucuggguggucuuaaacacuuauuuauuuuuuguuuguuuuugaaacaguaucaguuucuuuuuuuauuaaucauuuuauucguuuacauuucaaaugauagcccccuuuucgguuaccccuccacaaccccccccauccugacccuccucccccugcuucuaugagggagcuccuccacccacccacccuaccccagccucacugcccuagcauccucugacccuggggcaucaagccuccauaggaccaagggccuccccucccauugaugucagauaaggccauccucugcuacgucucuaucuggagucauguguacucuuugguuggugguuuaguuaccgggagcucugggugguccagguagcugaugucguucuuccuaugggguugccaucccccucggcuccuccagcacaacacuuuuugguuguuuuauuuauucuuuucucauuuauuacacccuaaaugcaguuuccccuccccccucccuucccaguccccccccccuuacccccacccucuccuccuccauuucucuucaggaaagggcgggccucccaaggauaucaaccaagcauagcuugucaaguugcagcaaaaccagccucuucugcuuuuauuaagggcggacaaaagaguaagagcgagucauggccaccacgcuuaggagucucauacgaagagccagccacacaaccguaacauguaugcagaggacguagaccuccgcugccucacugauugucgggccagccucugucagcccccguaagccuagguuaguugauuucuguggguuuucuugugguguccuggcccugcugucuccuacaaucuuuccucucuucugcaggauuccccaagccuaauguuuggcugcgggucuaugcaucuguuucccugaguugcugggugaagccucuguaaugaugaucacacuagggucccugucucagaguauagcagaauaaaaaugaauaagaauaauaauagugagucaguuucucaaaagggggguguggguugguuguuggguauggguguggguggggcaugggguuuuauuuacuuggcuuuaggggguuuguuuguuuccugcucuuauucucauuuucaagacagcaucucacuguguaggcccagcucuuacugagcucacagagauccacugaccucugcuuucugaaaugagggcauguaucauaccaggcuaucugccggcuuuaaaggagaaaaaaacacacacacaaagaugacguuaguaauaguuaguaauaaacauaaaugguuaagaauguauuucaaaaugguaacaguuuuuacacguguaucuugacaggaaucaccccucuaaggccuuugguccuugcccucuggccuagugaaacaagccugccagaccagcucucuuugugcccugguggcaggucacgggagugcacuuguggcgaugguguugagacuccaguuucucuuguggcuagaaagagcuuccacccggagcugcccucagcucuaccugcauggucagucaaggauggcuccacgaucucaaggucuccccuuccauccuugugccuuuuugccucucuuucugcuuucuguuacguacaucaaacucucaaaauagacggaaacauggaaggcggcaugcaguucccucgugccuuguggacagagcugucuagcaagccccccggagacagucugcucugucauucuggacauucgcauuguccagacaauaagggcagucguguauucgggaaaggagguuccaaggcugcaugcaucugaucugaacaguugcccaggcgugagacugcgcagagagccugugagggagccagcuuucuccaguggaggacuguagucuaguuggaauccacauggggcuacugcauggccuuucuugucaaaaggcuaggugguaaaaaaacaaaacaaaaaacaaaaaaccaaaaaaacaaacaaauaaaaaacccaacuuauagcucugugagcgcuguaguccuuguugaaaugcuguucugcuauuacaacauggaagcagcauagaaaauuuauacguggaugcuguguucuaauaaaacuuuauuuauacagccaggcugagggccagauuugcccuauggacuauauucugacaguccgucuggacucuagcuuuccuccgacacuuacuuaucccauaaauguaugcaagucaauucauucuguguuacaguuuccuuauuugucaaauggacugaaaccagcuucguugccauguuuugaaaaguguagaugauguaguuuauucaaaacauacaggguucagagugauagcucacauauuauuucugugcuguuuugugcaauuauggaggauggagggagcucuuccuaggcguaccacacauggaggacaguugaucugagguugcucuugcuuuccaguuugacagcugccuugcaauuucagugggucauuuuggaaguuugaaggucacuguggccguccucuucugugcuagagaauucacauuuccucagagcaauuuuagacacuugauuugcuuccgguuuacucccaagagcuucugagaucauuccccacucucccacagggcagagagcacauuuucacucuggguuugucuaaucuguuguggaauauucuuugcucaagaagggugaggcgucagaauaccaggaagucuauacgcaaagccaccaggguuagccuuaagucagcaagaagacaaauguacaagggccgcagaguugguccagggaucuggggauggauggguuguucccugguggggcuggugagauggcucagugguuaagagugcggacugcucuuccaaaggucccgaguucaaaucccagcaaccacaugguggcucacaaccauccauaaaaaaaaaaaaagaaagaaaaggguuguucccugguaguaaggugugccaggcucgcugaguuccagaggagguggccagagggcaauauaauguuugauugauuugcauaugcaugagacacuuugucacugugauucagauuucuguugaucucugaaaugagccuguguguguguguguguguguguguguguguguguaugugugugugagcacaggugcuuauggaguccagaagaagcacccgaccccuggcaacuggcuuuauagacccuccugagcuauuuggcacagguccugggaacuaauuccuguccucugcaguagcaguacacugccuuuuaaacugcuaagucaucucuucagcuccuagcuguaacuugaaaagauguguuuauuuaacagaaaucucucuuugcuaaguuaugguaccugcagccacauucgguguuuccauuuugaaaacagagcagaaagcaguugcuucccggauggugugacuguugaagcccugucuuacuucagaaacugccagaucugguucccucuguccgggucaugggcucccacaugaucccacccccacccccaacccccuuacagcgaugacuaacaggccucauucuaggacuggguucugccugaccugcaaaauccuaguccggguguuacaaauuauuaggccuagaucccauguagucugcagucuuuaggggcaagaauaagaacuaaguagauuuauaauuuuaaaugguugggggaaaguaaggaggggauauuauuuuaugacacaugcaaauugaguuacuauuucaguuccaaugcuacguuuugggucccuucaaaaagaaagggcuuucuuuucucccuuuacaugagucugaguggccuugguuuugccucuuggcccacaaagcuuaaauuauuuaccaucuggcccucuaccuaaaaagggggaaaaggguuugccaaccucugacacacagcaaugauuuucagucguuucuguugcucccaaauucuuucauuaaaccgaaucuccugggagaaguuugguggagcuggugggagugggagggcuggccugagcccagucuugccuccucuccccaccuuuccuccugggaauaaggcugccuggaucaagaaagucuuucagugaggcuuguaaagacccaucugcagucucuuugcugguaaaccaacaugcacagaggucuaaaauacaacaauaauaauuaaaaaaaaaaaaacaauuccgccccccuccccccaccccacagaaaauuuuuuagcaaauccauuuguuguuggucaaacuuguccucagcugacuugagacuugucagcguccugguuucuuuuuuuugucuuguguucuuaaucacauuuucacuuauguaacauaaacgucauugucacuucugcuccuccacuggagguuccucccgaagcugggcaugagagguaccugugugauguggaaggaugggaggugcuggagccgaucagugagguuccaggggaggaugaaucuuuguuugcugagcuccuauucuaaagaccuucaguugauaucaacacacacacacacacacacacacacacacacacacacaccccuguggacaccagggugggaucuccgucucagccacacccuuuucccuccauugccaaccagaaccuggaugggacuuuauuuggaaauuaggucuuugaagauauaauuuuaagaaucuuaagggggaaugagucccaaguccaauaccuacaauucuuacaacaguggaaaggaggcagcgagauacacgaaagaagagcaaacauagaaauuagugaugaagccgucaaugaggagacaccaagaccuuggagaaccaagugcuguugagaugggaccuggcuggcuuugggguaaagcaacccugcagacaucuugauguuggcuuucauucagagcucuugaaaugucagggcacaaauuuuuguuguaucaagccagggagucucugguauuuucuuuuuaaucccuagcaagcacccgaggaacuucccggaggagacuuaacauuuuuguucuugauuugcagucccuaaaugucuuccucgcccgcaucagucauuucagaaucgaggccuccugauguacauuuguacuguucauaaaugaaucuucacagccucuuaggggcaggcugggauggagagcagaguuuuucuccuucucucccauugaggaggcaggcaaggaaccgggucccggcuccagcucuuuugagaacucaagcaaagcugcuaaauauuagcagacucaaagaaucaaugacugccacacacuccucauuuuauuguggucauggcgucucuugaccuaccgaccccuguuucaguaaguguguucuucacauacccaggcuuuccguuguaagcucaugguccacgacucacuauuccacgaguaccguggcuggaggaguccccauugugcagauguggguaccgcgaccugugacugaguauucacguugcuauccaggcucuccaugcgguagcugaacuucccaugcugagcaaggaucaugguuucaagcagagaguaaguggucaguucacgucaguggcucuuaauuacuucuguuugcugcaaguucucuuuccagcgauagugaaucucagcuauggugagaucuagaaucacuacucugauaggauucauggaaaaucugcccacuguggguggguugaaguuuuggauggucuaagaaugcagaacccuggcugaauacacacauucauuguuuucuacuuucugaguguggaugucaugugaccagcuguuccaagcuccugcugucuagacuucccugucaugauggacaggagguacccuuggacugcgagccaggaggaaccuguggcuuucuuucuuucuuuuuaaaguuuuuuuuuaauguauuuucauugguguucugccuccaugucugucugucugaggguaucauaucaccuagaccuggaauuaaagacaguugugagcugcuaugugggugccagaauuugaaccugggucuucuggaagagcagccaguuuucuuaacuacuaagccaucuuuccaggcccccuuaaguugcuuuugucaggguauuuuaucacagcaauagggaaagagacagggcaucucccuuccugccuuucuccuccggucucauccuguguuguaucaaccgugucaaaccugggaagugcuggucauugugguuuguuccugugagugauuaugacagcaucagaucucagcuugacgcccccgguagaggacaguguugggucucacgcccgugcccccuccgcuugucuucuuacucauuaaauaaacagccuggagcguuauccuccuuucaacaggccucacucucucaggauauucgaggccugcaaauguugcugauuaaccaaaaacaaauguuuuggguaaauucucuccagcuacacucgauuugggucugagaaauggaauuccugucaccguuggcugacaaauccagcccuccuaauaggauuuuggcacaggagccgcuagccgcgcugccccgcggacuuaaagaauugccacauuggccuaacguaauuuugguaacucugucugcuucugccuuggguagaaauaauucacauuucacucuccauuuucuuuaaugggcuaaacagucagucuguaauaccuguauuuuaugagacauaauucuggauauuguuucuuuagcauuuggguaagacaaaccugagagagaccagccauuuaccucaagcaauuguaaaguuauuuguaaaaugauaugcugucuuucuuuccuucuuucucucuuuuuuuucaaaccaguuacuuuauaaaguuacauucccuggcaaauguuaacacaacuucucugugugugggcuaaauaaauauugggcaacacugaccgagcacagccuuuggguaaauaauucucucuccacacaucucccucccaguuuauaaugaggaguuuucuuucuggccccaccaaaugccgcauuccauuuuaaaugagacgcaaaccuauaggugaaugagaaguuugaggaggcuuauugaagaggugugaaugggcgggauuacauucucuugccucccucucugccagcugacuagucucccaucucuaggacacauauguccuagagacccgugacaggagagauguaaggcagacacuucucagaaugcccaggaggacugagagucucagagcaguccaccccucugugcaaucacaggagacauacuuagguuugaacuugaagaacacugacucugggccaaucuguacuguacagucugauuuccuguguugaucacgccccagcaagggccuuguuuuggcucugcacauuguggagggauucucagaugguugggaugucuccugcacuggguauuggucucugcccucuccuuuuccgucuguagugugcaggugucuacacccagugacacuacagaguccucaagguaacgagccgacaguggucaucuucauuuccuugccuguuacugugacagaaauacucugacagggucaacccaguggacuguggguuuguuggacuuggaguuugagggacaaucgguuccucguggcagggaagcugagguagcaagcagccagucuggguagggcuucucagcuuaguucauguaaucaugauaauuuuccacaggcauacccaaaggcccaucuccuaugugacuuuagaucccaucaaguugacagucaaccauaacuaucacaaacuauauuuuucugguggaaaugaagagagauugugagagacagggcauguaauguccccgggaggcugaagcaugagaaaauggccagccguuauuagcaaucauggaugauaccagguugucauuugggccacguuuccugauaugccucuuugaaaccuccuaccacaguccacucuuccuacugaugaugaagaaauagagacucucaauguccagaauaggauucgaccucugccuugaccuccaucuauaaaccccgacuccuugccacaucaccuuaucagaugguuauauuacugcaucuauucauauucacauuaauuuuccacacagggacuugaacuuagggcuucuugcauacuagguuagugaucuaccacuguaucccuacuuuuaacuuucuaucuugagacaguaugucacuaaguuaugcaggccggccuugaacuugcuguguagcccaggacaggccuugaacuggcgacccuuaucccucauagccugcagcaaccuggcuuuggguuuuucauaucagugcuguugauagucuugucugaaagggguuaacugugaugaucaaauccuaugggcagagcccaggaaaagccuguuccuucugccuggcaucucugcucauguuuggugcucugcaguucuucucauaggcguaggaaugagugccauaggcccagaaugccuggccucagcuacucaguuaucauggagcaaaaagaaacauuuucccugguuagggggauucuugaaguuagcaauuccccauaaaaaggaacacgugcauuaagaauauggaacagcuaaaaaguugagagugagagagauccaauaucugcaugccuagucuguauuuauaauuuuuauaaaaauuacuuaucugcucacaguucaauacaucaucuguugaaacuagguucccuuccugcugaccccuuuuccucccagcgaguccuaugcucccaucucaguuuucaugcucagugccuuuagucuaaguugcuugcauaagaauggauauugggccucggagagaacacuacaguuguuccacucaugacugugcucacagcugucauugguucuuggcaccuuggccaggucugagucuuggccuugaccgucacccacgucagacagaagccucucugacgaaggcugccuaaucagaauucugguacacccucucccaguaucucccaguauguaaacaugccuagcuagcuuguuuuuguucuugcuucuguuuuuuaaaucaugguacuauguagacaugugaagaacacccucauuugcacaagggguuugcauuuuauucuguucccacaauccaaauacccuagauauacccagcuuuaacuugguggugagcaugcuguuggggcuuagcauuuccuaaccacaccucuaccuucucacuggcccugaacauuggucugaauggucacagggucagaaacgcauggacgaaucguggcuuauucccuguguugucuugguacuuggauugucauguugucacugacugaauucauagggauguuaugcggccaugaacaucucugcuuugaaagcccuaggauaugugggucaagauaaggaagcucuaagacucgaaaucccuccuaaaccaagccagaaaucuacugcguagugagagugccuggaccuuacuaaugaaccagguagaagacaggaauaccaaugccuuuucauugugaaucaccaggugucggcuugugguugauagccaaagagccacuugauucuuuuaaagccaagcaucgcugagauuuccuuuauggacauauuuucaaagucaugugaucccgaagggguauugacccucacacagaacuccgugacaugccuuccuauuuggaugcuuccuaaguugguucccgccgcacccuguggaccauuguccucgccuccgacgauggcagaaucccaaguaccaagauguuucaagacguuccugggccauaauuaaccuucuucaaaacuaagagggaagaaagucagggaaaggucuccuguaauccagaaagggcaggaaggaagaaaggcuccccagcagucuugaaagccugcucuuuuccguuccauauuaagaaaccuccuaagaauacagcccuccugcaaaugucuccucuucuccaaacugaaagagcgugcgcuugagcacaggccaauccaagcuggccgcccuucccaacucucuguagccuggcucguuugccacaccugugacugcguuccuggcucccaaggaaagcuagauuuucuuuugccaucgugauugcaugaugagcccacuuaauggaauuaagugaaaacucaucugaauuguguaucccaagacccaaacugcugcauccagauaaaaccagauaggacccaguuugcagggucuucugcugucuucccccaagagguccaugccccaugaccuagucuuucucccucucuguugaaugcuccucuauuuuugaaaucacggauucugcuagucuauucuuuaaacccagggagggggcacgggagaguaucggccccuucagaaaacggcuaacaggaagcccaaggcaucuuucaguguagguuuugccugcugcugggaauggcuccaucaaucacgguugcucacguugagccagucuuuaugucaguucaaccgucuuccaucaaguucggugaagcagaguccaagaacaagaugaauguccaagccacuucagcgggguggagagggcuuugcuuuuaaaugcccacguuguuuucuuaauauuuucuccuuccucuucugaagccaguuucuuaaugaccaucacucauggauucguucuuuucaccuuguucaggaggagggauggugccaggcuguaagugcaggcaauugaucaguugaggagguguauucauuaucuguccucugcucucaagaaagggaaauaaaucccaggacccccgggggugauccucauagccacaggaaugcgagaggccccauucuccagucggucccuagcaacacagucuggucgguugggagucuugcaugaggauguauuauugacccacacaagaugggauaacauggcuguucagagggauggaguuuguaugucucugccacagugccguuuacacuuuuguugccagaaaucuacgggaucccugcccucgccuggcguugugucggguucuguccuucugaaaauauuuguugagugacugcaguguacagaaccgugggauaccaggaguagaugugaagaaaccugggaggguccgaaguccccggggcagcucagggagaggaguguguuuccacugacacucuuugaagugcugugacaauaagaaguugaaauguuuuaugaagucuugaaaaaucuucccucaguggaccucgcucccuuggccaccugugggccuuuccaugccaugcugcggaacugggaaccuugggccucgagcaacaguaaggaugcugaccaguccugcaggagggugaugggugaacagggagguagcaugcgaauacagaugauaacuguaccaucugcguugacccagauaucacccaaaaucuccucucccuuucuuucuguuagcucagugcaaacucuaacuuugcauagucccacugguccugugaaaaacucauggccuucucuggcucucaacuccugggucuguggucuugggccacuuucugauccccugggcaugcgcuugugguucaugugugcccagcuagaugugggauuguccccuuuccucccucccaguuauacuuggcauccugcagcaccucuggguugcaucccucaaucaagagaaccccugugcaaguggagcugugaacacucaucucuguacaguggggccugaauggugaaucucacaagaccauuuacucuggaaugggccaggcagaccaugggaggugacagugauggugccacgaacacuccuuagguauccacucagggcugggcucagugcgccauguucucugcacauccucuuggcaucacugaagguaaguucucuggcguccugugcuacugaugagcaggcauggucccguccucuucccuaugcucuuggauugguccugaggguguagacaguguggacuugccucuacugccuccccaggcccgccugcucuuuccugagcucuuccuguaccaucacaagcccccuacggugcucuggguacuggaacuuagugcugagcugggugucucugcccucugcacugucacuggagaagccugggugguuuuuuaaacccuguaauauacucagcugguuucaggcagaggugagaaggcguggccuguggagguugacccuugugguugugaaugugggagggguaagaauuuaaaucuugaacauguucuaggauaauugaagugacuauuuuagcaacauuugaguuuucuguuuuuuaugcgcuaacacauacacacacacacucccccacccccacaucuccccccucccccagccaggaaugaaugaaaaaucaccagcuagauaucuagauuguggcaccauaaagggugaucauuuuucuagcacuuucagcagagauggcaggguugggagggagaggggcugggaccuggauggggaaaaagggcaucagaaggagaagcggaagggcagagcaggugugccaagcccagggaaucggaaaguaauaaaguccuacaguagucagagggccgaggccagcucccaggugagcagugcucauucauguccuggaccugagcucguaaucacuaccuucaccccgagucacaguccuggcucucggcacauugcuccccacuccuggacucugugaccuugacaguucacugcccuucugcaagauaggugccuugugugugaaacaguagugagcucucauuuguagggccgcauaaggauucagagagaaagcaugcaggcggccaaagcacaguauguggugugguaggacaaacaucagaacugccuacgucaaggcacugagcucaccucugaagcgugauggccugccugccacaugauggcuccguucugcacgcugcuccuucuuagcugugcaguuuuggguaaguggcgagacuucacuagugccucugcacccuccucuguagcagaaggauggcaccagacaaugcugcuuuagaugagaugguucauaacacgccuugcucaguggcguuaccuaacuguguaagcuagugugacagcaaggaacccauagaaaccagcucugccguguaggucacagugauggagaguaccgcccagucagcggaggcucggaugcucagggaugcaccgucuugucuccuagcuuuucauacagcuacacuggaauauuuaggaggaacuccuuggcucgcuuaucuucucucugcuuuggcuauuucugagguguuggcuuuugcuuuuguggcucugguacugcaguuagcuguuugaugcagaacauuuuggggugugugugugugccuucuuuacuauuuuucuuuuaaaagcagcaauaaaaggggaagaaaugacacaucuccauccauuuggucucagaacaugcugcucaguagugcuguucagguggacacccaaaguguauuuauuagcaagcaucuagaaagaugaccauugaaccaccauacuuggacuggaugggcuuacagccauuugcuugcucauuagcuugcccggaaaggauuugcauagcacagaaagagacgucaagagauuguaaugugaaaggauuagucaauguccaucuccuaccccaucucucuaucucccuaagauuuagugaaggagagguagaaaugaauugccaaaugaagguuugggguuauguguggaaugcauuuauccaagcuucccacccccauuagcaugguuaauuaagaguugucaauacaucuuugcuagaguauuugauuauuuuuuucuuccccagccaggaagauuagaaugaagucuucagaucuggcaagcgucacgggacuuguaguguaaauugcagguuaagcccucauuuugauccccgggacgagagcaagcaccguuucauugacaugucauccgcugugaucugagcgaaugcgcggagguguccuuuggggaaagcggggcaucuugcucucucucccauauuggaaggguuuauaauacacgagcaaauagcaggucagagucagacuggguagacagacaguagcucuggaaggcucuugguucaugcuuuaucguuaauguuuaaaaaaauaugcucguauguauguauauauguauaccugccuaugaacacacacaauugcaugccuguuuuugucacaugaagaugugcauucauauguaugagccaaccacaaucaggaguaaaagugacagaagcugucucuguaaggcccuugauuuaugacuuauugaaaggucuuuaguaaaaaguacucacccacauaucuccacuuggauaaaaaccaggcuuggugcgucccacacagggucuucaggggaacacuucccccacauggcaaaggccgcugcccuucaggagcucccucuaucauuaauguugacaauggcuuuuauuuuccuucuauuagaagccucucaacucuaagaauacaucuuuucagcaauuaauuaugcuuggaaauugccacgagagguagcauaacuguuauuauuuuuucucgcuaaauauaccucgagauaacgcagcucguauuuacaguggcaagccuguuuuauuuaugggauuauaacaaaugaucaaaaacaacccaaaaagggccacuuagaccaagcuccuuauuucuccuucugcuuggccaaugaauuaugcaugcauugcaaauggcagcaaggaggaaaggucgguuuagaacaacacagauuggaaaauuacaccauuuguuuaaacaacauuuauuauugauugcucagcauaggggccgauagaaacgcaaauaguggcaggaauaucaucuauuuaccuaggcccuggauaaaugucgggccgcacccucuguuuagaucagaauaauugugcaaaaaugucccguccuguuuuauaagaguaaagaugaagugcggcaaggacuuccugccaucuuuuaaagucugugagagucugguauuucccuccaucacggaggaagugauauugggauucaggcacuguuauuuauuuauuuauuuauuuauuuauuuauuuauuuauuuauuuauuuuauuucuugguggaagguacuccucuugagaucauguggccauucuuucaugugacacuguauugugugccugagccuggaauuuguuaaucaugguaauggagauaauuguaucauaguaaugccuauguguucucuguuucuuacacacacacacucucucucacucucuguuucuguaucacugugucucugugucugugucuguccuucuguccuucucuuucucugucucucugucucucucuguuucucugcccccccccucucuuguguguguguguguguguguguuuucuccucucugaaaugaggguuaaacuuaggcucugugaaugccuggcaagaguucugccauugaacuauguccccagccgucuuuaauuuuuaaucugggacagggccucacuacauuguccaagccugcccuggccucacucuggagucaagguucuuuugagccuggaucuccgccuccccccccccccccccgucccccugccuacccucccaaguggcaugcagaccgaauugcauguauuucgggauuugauccuuaugggaauucugugaauguguauuugucacgucuguuuuaagcugaaggaaccgaggagcaugggugguuagguaccuugccaacagcuccaggacugaaaggaagaugagcuggcuaugggucacucugucacagugucugucuuuugauacucccaucccccguggacaccaauccaccaguggauggcaguuaccuuugcauggacaguguggcucauacugcagagcuguccuucaguguucuaaggaacaaaaaauguauccgcuccucagagguguugccucaugguggauagccacacuguugccucucuguccacugcuccucucuaaaugcucuccugggaaguccuagguucugucugcucuguguaccccuaauuacugcgccacagagcauugacagagccuccccgugucccuugucuggaggggauccagggaggcucucuuuugcaagagcugcccaggguauccgcagucccauauccacuguguucccagugucagccaucacuuucuucuuuguuuuucuccaucacgcuaaaugcgugccaggguguguuugcacaggccugccuuccgcacggcuuuggagauuguuuagcauuaccaccaucaagaagggcauaacugacuuggcaagcuuagaucccgccccucccuccugccuuaccuuccggcuccuggcuaacgggcuuuacgagcuggugguacaguuuugcgcucuuauucccccccuaaaaagcggucaagcacagaaaccuuuuagaaguaggaaaaggaaacacaacugaaccaacauucaggauuggaaaacaagaacaagccauauugcucagagacaagggcauaaguucuuuugggaagugagcuuuuacaguuauuucucuugccacguagccugaggagagacaguguaggggcggggagaaaagaacauuuacugacugcacccucgcacuucacaugagaaaaaugugugagagaggccucagaaagcagcacgcauccugaaaacaggaaaugacaccaagagucgccuggguuccccucacugccaugaccaaaagcacaacggaagccacuuuggugaaggaaguuggguuuggcucccaguuuagagggaacagucuguccuggugggggaaacauggugacuggaaaacuuggccugugguggugggagccugcagcccggcccguucacaucuugagagcuccgggaccagggagcucaggcuggacacagaagcaggugucacuuucaaaggccagucccucaguugcacuguguaggucacagccucagugucucuccagccucccccaaacagcacccccaacaggaaacucagguccaaacacaggagcuugugggccaaguuuuacauccaaaccaauuacugugugggcucgguguuuuguucagcuuuuugacguuuguuccucuguggaucaaacucaagucacacacgaugccaggaagcaucauuuuuuuuuucuccauuagauuauaaucaggaaaaucuugaaggucaugcuauucccaugaugguacgggcaaaguucugaccuccaggcucaugggcgguccccaugccguaagcuucacauauuuauggaacggaguggaagaaaagaaaaaggugggaauuaucacaccucccagccuccaucccuagccucuacccccgguggcccucaccagcucauguacucgacugcggcucucaacccagacuccccuuuuucgcuccucccauccuagaacuuguccuugguauuagugcuugguuaagacuuguauguuuuguuuuguucguuugcuuuguuuuucccuguaaugagccagacagcucaagucaggacagaaggucacaguagacacacuagcaagacucaaccuugugacccucauagaugauuuaauuccucauguaaguguuaucguucaccagaugagaagaagccugucaacucaauaauuugaugaaaagcuaggguuagguucacccugaauuuacagaguggguauguauugagcgaaguauuggacagagaacaaagccaggcaguggagagugguggacuuggucagggcuuucuccuuggagucaucucuggcucgggaugauuguagaccagcagacagacccauuacuucauauguuucagcagugguuucugaccaacuccuacaaucugaagaagaagacaugguauauaucuuuacuucaggagagcuaagauagacuauucccuguuaugugauaguuuaacagucugaaagaaugucuggcugcuccauuguuuaaugaaggaucuguauggcucuucuagguugacacaaugacugccaucuguuguuuuccuaaucucccuguaaacaucccuaagagagcggcuuaggaguauauguugcucuuagagcuaucggauuuccucaagugguucucaaguacugccccaggucugaacaacaaucaaauaucugcuacccauggaacaguggggugcccauucagugagagacaguaucaauagauuuggguuauaccauuucauaaccaguugcuuugggaggcagcaaaggcucugcauagccagcagcugaagugucacagcauugugugacacucuuccuguauguuucaaaccaggcagaauccugcuccaguguggggaccugcagggucuguuuugggaagagguggcccugcucuccccuguugccuggaaccuucccauuagauuccagaaagggcaucucacgccaggagauggggcccuucauucucauaacuuguuuuuaggagaugcuguguucagagaacagccuucuuauuccucuggcaucgcugcuugcucugcauagcaagguccgggacagaucucaguguucuugacauccuaagacuuguuuucugauacacuuuuaccacucgcugucuuggagugcuguguggggccgaggcuuggauccauggccuaucugucuuucuuucugacagcacugacaugucagccuaaggcuugcuggacaagggcuuuaccacugaacuacacuaucagucaucuuuuuacuuuuugagacagggucuacagcagcugucgcaccucccuguuaacucauccugggucaggucgcugcuuguuacauucucaaguuggaaacaauguauauaaaauuccaccugcugcuacugcauuuccuaggaccuccagccugcaugugaacccagguucuccugugucccggucugagguccugcagacucuuggguaccuaccaccuccggcauucuaaauugccuauuaauaaaaugcuuuucauauaauuaaaaauguuuuauuuuaguggcguggcucucgauauugaaaauguuucucacaccagccaauaacccaucgauuucucacucgcuaaugauauuugaaggaaguuuuaaaaauuauauuagccacuuguaggcggaaaaaaagaaacccuauucauauugcaguauuaauagcugcuaugggagaaucauucuguuaauuuaaugugccuguaaauccugccccagauuguuagcucuucauuuucugggauuagaagaggauuaaguuacaggccagguagguaaccuggauauagcuucacugacgcuuugauggggaccuuucuuuuuuuccacuuugguauugcugaaucucagaugguguggagagaaaaaucaucacugggaaguucuugcuuuaaaaaaaaaauaacaaaaaaauuaucucugugugugagaauaaaagugugugucacgacacacuuugggguggugaggugaaaggggagccucaagugccagccuucaccuuccacguccuuugagacaggaauucuuguucuucacugcugcguauaccaggcuggcuggccagugagcuucaguggcuucuccuuuggcuuccucccauuucccccuaaaaugcugggauuccagagguacacucccacaucgagucugaugaagguccugaggauccgaacucggguccucacaccugcauggcaaacacccugacccauccguuaaccacccccgccacucccccagguccaugcacuugcuuucuggaaaaguagguuuaugaagcugagcucacagcacauuuucccuggcugugccuuagaggauaagacaaacccuccucggaggcuugguggcccacgggguucccaggagcugucugugacgggcgugauacacccagcuuguccucgagcugagguugucagucggaccagagaagaaaauuuccaccuguguguucacugggcgguuaaacaguaacccugcucuccuggcucucuaagcacaggcgagcucccagccaaggccuguauagcuuuccucacuccaacucugccuauuaucuugaccuuaaaguuuacgggguaaaagaaacauuuauggaacaguuaaggccaguuagaacauaacgacucaccucauuaucacaccccacaaaucuccccuuuacgggguucccuccccugucagcuccaaccacgagcuuggccugggcacaguugcuggggcucacacguggaaacaccaggaacgucucauuccugacuucaaaugugccaaaaacaagaauccuuaagaacucauaaagucauuuagcaccacauuaauaauagacgcaugauauugaauuauguugguaaguauguguuugagccgguaacaauuauuuuuggcuggcaguucagauauuuaauccacuuaauaaauaaacagcgcccgcaaaucaacaagugagaguggaaggggggaggggcaaugauaaaaaugucaaaggucauauaaacaaaaaacaguauuuagaaacauuaaaguuuguaauuagagaagagaugaccaagaacaaaaacuuuauuguacuuuugaagacauggauuuuucuuaugacaaaguaaaacacacaguggguagagaaaaacuguagaauuuaaguggacagggccuugagacauagcucaacuuggucuuaaguucauacuccugccucagccuccugagugcuaggauuacaagcaugggauaccacacccugcuucugugaaauguuuuaaaaauguuuccuuuuuaggaugauuauauauagagacauacccgaggggaauaaaacaacuuaaggcaacucaacucaauuuaacaguugaguuccauuauagcaaccucacagguaaaauaccaugcauuucacaaaagcccuaagaaagccauugcaagacaagggagauguuauguuaauuuuguauauuguuauaaugugugcguguggaugaguggacauauauaacuugaaguuaccuguuugauauacauacauauauaaugcaaaguuagcauuuggugaaucugacagcugguuccaaaggucuuagccaguuuuuaaggcuuuggggguacagaugagaaugaaacaagccuguacuccagugagcuaguuuuaugucaccuugacacaagcuaaagucaucaaagaggaaggaaccccaguugagaaaauaccuccguaagauugggcuguauggcaaacauuuucuuaauuagugauugaugugggcgggcccagcccauuauggguggggccaccccgggcuggugguccugaguucuauaggaaaacagucugagcaauuguggagugcugauccaagguuccuucuaguucuuuccugucacccauuucagccuuuuccucuagucuaucuccauuccuuugugccuuccccaacccccaccccaaacauucucuaccugagagcccaugcuuggcacgaucaugagugaacaacagcaaccaaaaaguggaauaucucccuaacaaagaugagacuagacauauaugcugaggagcacauuaaucaucagaacuccagaugccuagaucccagccaaaaaacacaaucuggaacagccaagacacucugccuccucuagaaaccaauagccauagugccauaggcccugagaauuacaguguaccugaagcauaaugcaaggacuuaacaauagcaauuaugaacauguuuaaggaccuuaaagaggaugugaguauauuccuuaccaaaggcugaaaacccaaacaguugaaugaaaugaggcaaacaauucaaacaaagaaauagacucacugaagaaaacucaaacugaguuaaaacuggaaauaaaaaacucaggaugucaaacaaaaacuucagagauaagccucaccaacagauuaacagacaagggagagagaauuucaugucucgaagacaaaguaaaagaaauagauugcucagucaaagaaaauguuaaaucuaaaauuauccaggcauaaaacacguauaaaaucuggggcacuaugaaaagaccaaaucuaugaguaauagguauagaggaaggagaauauacugaggucaaggcacagaaaauauuuuuaacaaaauccuagaagaaaaaauuuuccaauguaaagaaagaggugcuugucaaaguacaagaagcagauagaacaccaaauagacaggaccaggaaaaacaaaaacaaaacaaaacaaaaaaaaacaacuacccaugacacauaauaaguaaaacacuaaauguacagaacaaaggaaggguacuaaaaguuacaagggaaaagaugaagucauauauaaagacauggccauuagaauaaugacugacuucaauagagagucugaaagucagaagaaaucauuccuacaaauggaugcuuuauaagcucugauaggccacagaugccagcccagauuccaauacccagcaaaacuaucaauuauaaucgcuguaauaggauugaugcacauaagaacugagagacuaugguagcacacauuggaccugcacagguucaagccugaagggguccuagcacagagaugagggaguagacauugggucccaccucuaaucaagaagcuauuuguauaccugcuggaaaagggaaacaaagcuucaaugagugucacuggguauaucaacuaaacuccaagguaggcuucaugucuaggaguaguuagucaucacaaaacaaaguguguguguguguguguguguguguguguguguguguguguauguguaugugugugugugugugccuuuuugugugguuguguuuuauuauuuugaccuucauuuguuuuuguuguuuugcugagauacagggagguguaaaggagaagaaacaugaagaugaagccggaugaguaggcagguggggaggaucuuggaggaguuagggcagcagaaaacaugaaauauauuguauguaaaaaaaaaauuaaauaaaaaguaaaagagcuaacaagaaacuaaaaaggggggagggaagacauacuguucauagugguugccaccugauaccuuaccagcguguucauauccacgucagauguuuagggcauauuucacucacacaaaucauucccacaaauacuugggcguuuauucucuaccauaggcagagguucgcucugaauaucaucuguguuuggaacugggauuugcccacuuuaacuugaggcuggugagacuucuuucugucagauuuguauuuuaguuccaugaggaucaaagugaccacaguauacgcauuuuauuaaauugucaugagagguccaucugacagaucaugccuuccaaaauaaauggaaaaaucuuaguacauuaucuaugaacaaucacuaggaaacagaagaggccugucaaucauuccagagccugugcgaauguauccauaguguuuugauugaauuguagccuauccaccuuuuauuuugucaauagcucugccuugacccaucaccuuggauuccaguauagggacaucuuccuuuuauaauaggugcauauacuaugucguucagagaggaaggagucccagaaagaauuccacauugugacacuaggggcaccuuccagguguuguccuuucugaguaccaaaucuugucuuauagcagcuaauauuaauuuucucuucagagaucuaugcgcgugccacacacacacacacacacacacacacacacacacacacacacaccacaaacauacguugcacacacauacaaacaugagucuucacccgauuugaauacaagggaaagacccaauaggagccuuccccuugucguggaaacgagaugcacuugauagagucacaguacaaguaugcacagagugccaugacaugcccucccagccccccucuaagacuguagcccgggaccugcuuguuaccuaacuccuuugacccuuuuccaagggcccugugacuuacuucuacgcugggauuaguggagcccuuguuucucauccuuccuaguuauugauggaugauccaugguaucuacuuaccuuucugaauuuaacuugaaccagcagcauuuguuaagcaaaaucuuccugaaaguccucuguccccgcccaccuccacccucauuuccuguaguaaacaacuggcuugcugacuucacagaucucuugaguucuuggagguuuuugcacagaauccucucugaucaguaugauccaugcuggacaacaggaagcauuccauacugcuuggccaagaggaagagcuccagcaauuauccucccuuuucuucuuguucauguuaauggcaugugaaacacauuagagucagggccaucauugugagaacucugguaacagugcagagugugcucaugagcaggucugucuggaauggaaagucaguugaagcaucagggcuggccauguugcccaggggccuuucuuccccauuuucuacuguucgugcagcaagcugcccaggacauugugacuagucguaaagaaugcacuaugucacagaagagucccaaacuauaggagaucuuuuaaauauaaacucccugggacuucagacaaagcaugaguuuuggagaaacaguuuuccauuucugagcaaguguggcuguuucagugggaacccugagauuguuaauggugcauccaguuuaugugacccuucauccuagacuagugugcugcugcugcugcugcugcugcugcugcuagcuucuuuuacacacuauaacuucugggugugauaugguccuggauaugcuucuuagaguguacccucuguuguagcaugacucauagggagugggguccucucagcuuuccgugggaggaaauuacagauuagggaaguuaaaguaacuguuaaaagucuaaaaaugagguuugucuuccacugauuccuuagaagucaaaauguacuaaggaaaagguggaggccgcuguuuuccggugccacuguccauuuucgcuguguccucuguguuuggaagaagugauaccgucccacucguuugugaucuccggaagcugucguuggccuauugcaucugcacauauaguucugucuccuuccagcacacuguacaagugcagccuugcaggcuuacucugagagcggcuucauuaggaaggagccagcugugucucugcuccagaugucugauauggcucuccucugcuucucuaguaugugcuuuuuggguguccacacuaugacucuugcugaagggccguguguguguguguguguguguguguguguguguguguguguguguguguugaucuuuuuugugucugcauuuaaaucuucucuggcugacauaaaugcccacccacucauugucuuacuaggaaaggcucccaggggaacuaagacacuagcaguugguugcuaaagugagaaagaacaugcucucuauugagaauacagucauugcuguaucgaaggcagagaucaacaguuacucacuccgugcuuuccagugagacugcuuuccauuucaucugugaccaccugcauguggauuuuuuuacagaaauaauugcaauuauugugccucugacucuagaaagggucucugguugaaacuacacauuggagaacaaggaagauacugaaagccucagcucacacgucucagcuugaucccauggcgacaaccccaaaguuucuaagauacacauuuccacacacuuucaguuuuacagugacauaugcaaacaauuuaucauccuguagaaucacaguuguugcuccucaguuuucucucaaugguuucugacaauuuacauauaggauuugccugaguaaguuacauuuuggaucaauaaugcaaauugggaggccaaggcuucauaauauccgagugggucuuugagaaaucgagaaauaggaaauguauguucuccacauguuuuuuuuuacuauaugagauauguuuauuuccuuguagcagaauagguacauuaguauauuuucuaaucacaaguaguuggaaauaaaaaaucagaccaauacccauucaauuaaaguguggcaucucuucgagucuguauaacauuauuuuauuaauauagcuguaucauguaaugguaagaaaugccugucacuugucuuucauuuccaacuucuuaaaagguuugcaauauuguuuuguuuucuguuuguuuguuuguuuguuuuuuacuuacuugcuuuauaccccacucagugcucuauuccuggucaccccuucucacaauccuccucccugucccuccuucccuucuccccugagcaaguaggggcuccccuggguauccucucacccugagacuucaagacucugugaggcuaggcgcuuccucuuccaccaaggccacguaagucagcccaguuagaagaacauauuccacguacaggcaacagcuuuugggauagcccccucuccaguuguuugguguccacaugaagccaaguugcucaucugcuacauauguguggagaggucuaggccuagcugguguauguucuuugguugguaguuaaaaaaauaaaucaagaaauaggaaaugcaugucucccaccuucuggauucuaaaauagggccaaaguuuugugaguuugggagaucuuuucuuugugguaaauaucugccuugucugucuucuucugauauuuguguucccuauuacauccgaagaauuucuugaaaucaagcugaguagaacagucauauuucuggaggacaagcuuugccuucaggguucguagucuauuugugaauuucucaucccgcugacaaaagugacagcaucaccaauaugucugacuuggugaggucguuagaauaggcaugguccucauagauucauguauuggaugcuucaccuaugaggaguggcacuguuaguagguauggccuuguuggaguagguuggaauaagcacgccaugaugaagguaagcuuugaagucuauauaagcucaaacuacacccagggcagaagauccuggcugcuuucagaucuucuccuccagaaccguguccgccuucccaaugccaaacuucccaccaugaugauaauggaccgaaccuuugaaacuguaaggcagccucaguuaaaugcuugccuuuaaaacagauaccucggccauagugucuuuucacagcagugaaacucuaaggcacuuggagaaccaaugacuauuuugggaguaugggucucguuccaggaauacauacauuccaaagcagcuacaucgcagaaaacccaccacaauaugggucacagaucauggaagcuggaacccuggaacuccuugggcaacuuggagagagcuagucagguuagagagucuccucacuucuguaguccuuaaccgcuuaucuagccuuggggaagguagggggccucgugcaucugguaaguuucagggacuuccuaagacuuuugguuuguuugcucuaugucucuuaaugagccuccguuuagaaccuuuugagucuuaaugaguuucccuccaggauggaauguuucaacaugagggaaauugauacucagaacauacucuaguguacgcuaaguuuucaaagcuaacuaacuaauccuggauguggacucagccauuccaugggcuggauacuacucaagaccugggaaauugaggcucgcaugcccuuaacuuacagugccaguccaguaaagucuuggaucugguccaggcacaugggaagggaacucaggaagggaugauacuuggggucaaaggcacccugugcagaagguccgugaugacagcuccugggacugugauauagcaagaaggugcuauugaacaugaggcuacucgagggugaggaaaagcuguuauucugugccauuacuucacuagucauaaaacaaggggcugaugacauuccuugccccuacugcuuaauuuucaucagcucucaagaacauggaaaaacugugauauaguaaccauaaaaagcagcuuguuucccugcuguauccgggccuggcucuugccccaggcugagccuggccucuucucuugacauuuauuuucucacaugggccuuuuggggggagcauccugccauauuguuuacuucucuguccucucuaccaccuaggcucagaguauguuuuccuaguucucccacuugcuaaugguccaggcuucaucuguauugggccacucugagucccaugcucauuucugagccaaucacuggugaucagagcacacuaugugcgaugguuuguauguguuugccccagggaguggcacuacuagaacauguggcccugcuagagaagguguggccuuguuggaguaggugugucacugugggcaugggcuuuaaaauccucauccuaguugccugcaagucagucuucuccuagcugccuucagaugaagguguaaaacucucagcuccuucaacaccaugccugccuggaugcugccgugcucccaccuugaugauaauggacugaaccucugaaccugucagccagccccaauuaaauauuucccuuauaaaaguugccuuggucauggugucuguucauagcaguaaaacccuaacuaagaugcuaugauugguucagccauggucauguggucacuucuugacacaggaagggucaagcaacuuggaaaugcagugggguguaggcuucaccugaaggaaacuaaggaacaugucacagaaccaaaggagcaugauuggaggaagagcaaaaacaauugacccuccccccaacuuuauuucuuucuaagccuacuuuuuuucuuuuuaucuauuuuuuaacuagauauuuucuuuauuuacauuucaaauguuauccccuuucuuaguuuccccucugaaaauccccuauccucuccaacccaccugcucuccaacccacccacucccacuuccugguccaggcauuccccuauacugggucauagaacucuaagccuacuuuuaaaugaugguucuuaaaugcucuaaccucccuucuagcccaccacccacccgagguaguagaugggggaaguggaccuguuuagaaaugguucuuuggagcaacucccauccguguugucuagaaauuggcaguucaguucacagguuagcagaggcaguuccaucuacucgcaaacacuucaaagauacaccagcaguccaguuugauagagaugggagagcaaacaugaaucagcagcaguggcucuaccuaacaaagacagccaggccucagccucagcacuucuuagcaggagagaccagaaucaacuggaaugccagaaaaaguucuaggcugugccuuucuuagcaaagcaaagaucacugaagacaagacaccaacaaguguugcaaaacuagcucugccagcaagccuagcucagccuccaucacuguccauagaguauguuuuauacugccuccagacaucauguguccuccucaagucuugccucagcacgugagucugucucagcuaacaucacucugcuauucaucccgaguccaaggaagcggcaagaaacugcagcacaccaccagaaguguuuuggcuggaggccggggguggggguggggucucccuauggagucccaacaaguggaguucaacuaugcugugcaaggcagaccaauacaugugugucauuugcgaauaauccuucaucacguguccuuucacaugcuugcucuagcagaacaucauuucacuugugugugcuucagcaaaauguuucuucaugaggcugcguuagccuuuuaccuguaugcacuucaggaaaacacuccuucauguguuugccccaggaacacaccauccaacacaauggacuuuccaaagaacccauaaauuucuacuucaccccuccacggcuuuguugccaucaaaugccucuuaauggggucccugguggcuccagccauuguguuccucagggugaaguugucauagcuuugcugaccauugugaagggagguggggccagagagaucaagagagaaugauccuauuuguuuucacuccaguguggauugugacuuuuagcuuuagaaucacugaugaguggaauggcuauacccaaccuuuccagagauuaucuggguguuggugucuucucgacacccacuuccagugagcccagcuaccagaugauggaaggccaauauccgggauagacucuggcacgcuucucaggucuguguggaaagauucugcauuuuauccuuuaaagaucuagucccucuggccugugcauuuucccuuaauguaauagggaacccaguguuuagcugugaucuuucugcuguggagugcugaggcaugccuccuccuagggugucuuguuuugggccaccugcccuggcucagugugugugugugugugugugugugugugugugagaugcuguaacuguaaguccuucuuacaccucagucacgauaaaguagcacucuccauuaauuuguucaucagcacagagggcccuagggacucacuugggcaaaggugaguuauagcucgcaaggcagcacugguccagcacugugagagagcaguuggggaggaugcguuugcauagggacugaagcucuguggggccuuggaugucaugcagaugcucccagccaagaacacgggucacuguacacugugcuacucucguuaaccaugugcuuucggccgguuccucuucucagcuuaccccuugauuggagcauagcuacugaugccuucuacaggacagucugugugcccugacuucgucacagaggagccuccuuccccuccccaggcugcagacacugcugcggaaaccuugauacccaagcagccucccagguuccuggcucucucacucuucgggggcagccauacgugugcuuuugagcaugugugugucuuccugaauacauccgugugagagaaggaagggauagggcuuuggggaaaugacuaagucaugaggggcccacgcccagaaauagauuaaugcccuuaucaaagaugccugugggagauuauccccuacccccaucaugucagggcucagccagaaggcaccaucuguaaagcagauauccagaguuuacaacaacgcucaacuugaucucggauuuguauuuaaauauauuccuguguuugggguuuuacucagccuaaggaauggauguagcagcccacacagacaaggacagcacggugggagcugugaugcuuccacacugggaauucuacuccuggaacccugucacuuggggcuccaagcuguggcugcuguucucacugcugucuccucacaucuuaauacgaaacagcagccccguaaucgaccagccaacuaaguugucuaucaccugcccgguaccgugcugggagggaugcagaaacaguuuguuccauuuucaaaaugaauccgugagagagcugugacgguucccuuguucggauguggacacugaggugugcucggcaaggcgccagagcauacugucacagauuuuaaaaucagagucucggaggguaaggcuccacagaccacaguugaagggccaacugugaccugcccuaacuguccagacagcuuggggucuagcaaggagcuuuaugcuugaaggaugaagggagaggucaagagaagcauggucugugcuauguggucaucauguggucaucauguggucaucauguggcugucucggcuuagugucuuuucaguagagugcuucuggaucucggcacggccuccgcuggccuccugcuaucgcuggugacuucugcugaugaccaaaggggugggcagcagggucuacagccucucgucccccauagccuaugucaguaggccccuucuuccauaauuccugccucugcuauuguaucuucuuguuccuccuuagccaaaggaagggugugaccaggggacuagaguagggucugggcuuggcucugcucacaugagcuuuuggagcccaggaagcaugcacauugaguuucugugccauguugguuuucuuucacuuuagauugcucaucagucaaaagaaaaucacgccuacugcaggggccaucugcugucagugagcucuggugcugggggcacugcucaguauauaaugagcacuugacacaugugcucuucauucucucucucuucacacacacacacacacacacacacacaccaauuuuguauauuauauuauccagggaaggauauucuguuauucucucugugucacugaaguguagagugcuuaauguagccccacaaaaauuaauugcuuguuuuguuguucuauaauuaagaacuugauuaaaaaugagaauucucucuuuucaauucucucuacuuguaugguuuggauguuuuguuuugcagcccaucaaaguuagaaaguggguguuacuuuccuggguauuccuacaugaggguggcaaaggcugaacccaccccaaaggcggccugucccugagguuuccuggugcuauggccaguaacagcauugguugcuaggggaagacugaaaccagccagcagggauugauggaguuggaaggaggcaagggugacuguggucacccggugcugguucuuuucagagaccuggggggacccugguccucacugaagucugcucuggaauuuuccacauuucucaugcuggugccaacaccaguacuguuacacagacuuacagggggaaagcaugagugcugucaguacaggagggagccacugugugagcacagucugcucucuguaaugcauuucucuugacucagccugaccuacugauguagggaggucacucaguaaaguacccugaaagcacaaagaccugaguuugacccuuaggacacauaccaaaaaucugggcaugaccuugggacaugccugcaguccuaauacaggagaggccgagacagaaaugucuuuggggccaacaagccuagcccaaguguccagacccaggucccagugacagacacuaucucaaagagauauccaguggcuaugaaaaugacguuguccucuggucuccauauauauguucacacauguguuugcacacagauguauacacacacacacacacacacacacacacacacacacucauagagccaagacugaaaauaugguacuccuuaaaauuuaucuuuuuuaccccacuaauacuugguguagggacuugauaagugugaagcugaguucuuuguaacuaguucccugcuguguguuauuugaaacugcggcccagguuggcccagcccucauggguguccuucugccucagccuccuuggugcugguagcaucggagggaaccagugucccaagcacagucagaucucggccaugcaugucugccugcucagccuggcuuccugguguaaccuaguaggguuuuuucucaucuaaagugaccaccgugagucccuuaugccaagcaauagcugguuccuuuuacucuuuguaccuugaccuacagaugaaugguucucaugagaaaugcacagaucacgacuuccucuuccucacccacgucucuccuuucucccuuccuaccccaccuuuuucuuuucccccagaauucuguuuuccgugcugcuuuucagccccuuuuuccuuccuaagagacaaacccugcuuuccugcgucugacccaauucgcucaccguagcgcccucuagcuucauccaguuucccucgagggguggguuucauucuuuacgacugaauacuacuccauccuuugucuguaucuccugaggccucucgcucuugacccaugcucaggcugaucccauaggcuagcugucgugagcaacgcuggacacagcgguacauacagaugccggucuucuacaauggcacaugcuuguguugagaaugcugcccgcgcaugcgcagucuuugcacgucuugcaaaccuuuaaccuucgcaagagcccaaggccaagcugaucccagcacccaucucugucgccuuaggacuaguguauuaccuuucuguugcugugauagacugccauaucugaaagcuacugaacgaagaaaggcucuauuucggauuaugguuucagagggcagaguucaucaugacgggaaaacauggcacaguggcaccgggcaggacucuagcugacugaguuuucaccuacauacaggaagaaugagaagaaucagagagacagagacagaggaaacagacacagacagacacacacauggcagagggacagacaggaagcugggcaaagcuauaaacucuccaagcccacccccauggagguauuucuugcaggaagguuccaccuccuaaggguuucauaaccucaaauggugcugccaacuggggagcaaguguugucaccugagccugugagggacauuucucauccaaaccacugcuggcuuaguuguuagaucauugacagggaggcuggguagauaguccagggcuucacugauggccccaaacuuaccaggacguauaaauaacuuucugguuuuaugguuuuuuugcauaggccauauguaccuuuguguuguuacaauuauuagauuaaaaaauaaauagaaaagaaacacaugcuuauuugaacauuuaaaaaacuacagaaauugugacuucuauaaaggaaucauugagaaucuucuccuccccucccccuccucccuccuccugggguucccauacuuggggcuaaacaggaauacuagcuccuugcacaucugucuuugucuuaagacacacauacacaaacacacacacacacacacacacacacgauuugugcuuuuucuaaacagggguauggaugcucuaccauuguuagauaguaaauaguaucugugcauccagccagugaauauagcucuaguuacuuuuuaauggcuguguaguauuccauagcuuacaugguugaguugauagauuaaccacgugcaggucagugggauuaagagcuuuguguuuucuauuucuggguucugauuaagauuuuuucuugauuggugccauauccugggugggagcaucacaggugggccuaauuacccuugauuaauagacuguaagcccugauaggcuagcaacucagcaaaguaagguuguugugagccugagagagaccgccccacgaccgugcugccggcacauucugaucugacugccuaaacuguccugugacacacauugguuaacaccaggaguugugagaaagggagaaacccagacauuagccaccaacuuaacaagcuggugacucagagaccagcacacucacaucggcguccucaucaaagacuaaaucuuuaucuaaaauuuauuagcugacuucaaaccuguuugccagcgugcuaaugggagccuuuuugaaucaauuugcucuuauaauuuaaacagcauuucaauguauaugguugaagcagaaaaggagcuguagcucuagccagucagauuaauuauuuauuauccguuuugcaaauacuuuccuaggccaacagaagugaaaaaugcuuagacuguuuuuaaaaaaguacauacccuccacuccuaccuacauuuauacauuugcauaugugcacacaugcacaccacacccucugcaugugugcacaccugcacaucacacccucuccauaugugcacacaugcauaccacacccucugcaugugugcacuccugcacacacucccaugcucucacauacaguguuuuccagcaguuaauaugaaaaauguccguguauuaguuuucauuuacaucugucuggaaacauuuacaucuacauguaaggauuuucucccaccguguauguguguguguguguguguguguguguguguguguguguuuguguugcacauuuaauucacauuugcaaauugguuucuguuuuuaacugaagucacuuucucagcagaaccgaagugaugaugucacuugucaucucaauaguauuugaucugaaacauuaaaaucgucaaguucauuuuauuacugagcacuuuugaggaauguagguacauuuauuaguucauagaaggacccucagauuaaagucauguuggcuugaacauuuucuuuugccugucuugaggccucugauguucgagaugcuaugcuuuaaguuuucuuuucaagaauuuuugccuaacguguauguuggaauaguguggcaguuucucucuggagugggagggcaggauuucuuaggucuucugccacugagaugcugucuuucuccuaagcacagguguguccaauucauuguccucgggcugcaugcgccccuggacagccuagaaugccacccuacacaaaauuguaaaguacgucaaacaacaugaauuuugucauuguuguuauugucuguuugacaguuagauugcaugguucucucgagcuugagcuuuguaggugacaguguggccuagcccagcauaaacaggugggucaugccuacagaguagugccuagaguggaggucccugacaaagacugggauuccuaaggacaguuuauuuaaccaugauaccugcugugcucagauccccgaccugggcuguguguuuauauccuccgugugggacugauggcagagcaagaugugugugugugugugugugugugugugugugugugugugugugguccugacggcacuaggaaguucaugcuauuacucagcuucaaguauggggaucucugugucugguucucagcucuccagucuucuagagaggccugguggcgauucggagcuuccagggagggugggauaggaaacacuuugugaaaauuuaguagguccagaacugagaagaggggcgcugacaaugaacagacuucagcccuugggcuaaagcagauuguuugguucuuguucuuguuuuuucucuuccuccuccuccucuucuucuuccaccucuuucuccuucucuucuuccucuucuucuuccuccuucucuucuuuuucuuccuccucuaccuucuccuucuccucuuccuccuccuucuuucucuuccucuuauuuuaaaauaaugcuuaaaaagaaggcuuugaauauaacuuuacugagaggacaucaguuuaauuccagaaccaugagaaauguugggcauggccaugcacacuuguaaccccagugccagaaagccaggggcacgugggucccuccuuguggagauccaggccacugggaauccuugccucaaauaaaaccaguggaugucccaagaaugugauacuugagguugaaaucauguccuccaccuguguacauacaaacgcauacaggacuggacauaugcaugcaccuaugcacacacguagguaugccuacaugcuccuauagacaaaagaaaacauauacacggggugggggagugauuaggccuauaugugucuacaaacuaagauauauacugucucacccuucacacaaaaaauugucaauuuaauuuagggaagacuguuuugacaaugucugcuuauaauaugcagcaguaauagcagcaaauaaacacuguuaaccauguacgauuuguacaauguggaauggcuccccccccccccacauagcugccccgugaguuaacaaucaccauuaucccuauguaggcaaccacuuggaccucuucauuaauuucacgugcaaaagugggugcagagggacuggcuaacuuacccaaggcacaggggugguauguggugggugaaccauuagagcacagacccucagggccuauguucauaacccuuugcugccccacucugauaacagaaacauugagcuuugguugcuuguguacauccuagggguugaacacaccucuggaguuuggguagauggugucuguauccugcccuacguggagagaucgagcccccgaaugccguggcugcccccaggaucucacgauacccacugguccuggaauuccagcccaaggaucucagggcucagagcuggucuucccucgcagcucauuuucuccugaaugcagcucaucuuuuggcccauuuucaaaguaacuagccguauuauuuuuuauagcccucuuaacuugguacuucacaucgguuauaaaucacuucuuuuaagcugauggcccuggcauucgggagcuuuuagcagucugugggcaguuuggcucucccgagaaggaaauuuucgggcauucuaaccaaagcaaaucuugaaguugcccacccuguuccauggggggagggggguagaaagcagaaaugaaacaggguaaaugucuuugacccaagaaaugcaagcagucacauugcuugguguugaugagggagacaggugguagagggggaaaaaaaaaaaacucaugucacaaauguaucaauauuuagugauuugagaauguuuuguuuauuuuggggcaaugaaauuaagaauuauugaaucaacaucaucacuuugauuuauuucuucuaccucugcuugaggucaccagggguaggacugcggaugcugcugugcgucugcaggagucauauacuuuuccaugauuucuuuugaugacucuaagcauucucucacccacagauggucccccuguccaccugacuuucaaauccaucucaguccugggaauuuugcuuagguugaaagaacgagcggaugcauccugucaacagaaaucacagcccguguaaagccacucuggcuuccaacauuuuauccauccaaacagcgccacagcgugcugaaguuucaaguucuucuguccuacagacagcccugcugcaccugucaccugcccagguuccuuuagcauuuggaucccgaaaaccaaccaagagagauuucacaggucccgauucuucaaaacucaucauuuggcgagagggccuggguggcauuucaucugaagaaccucuuucuuguuuuccucguagaauggcaggaauuuuguguccgucggaggaccguccuccagugggagguuaccgucugaccuugccauuucuuuuacaucuuggucauauggaaaugacuaacucuuuucaacacugaaaugucauaugagagccuagcuccacaggaaggccauuaggugcagagacaguuuaaacaggcgacaacacugaccucuuagaaauccagucaucucugguuacauguguccuuaagaacccuuggugaccugacaguccggucuaaacuucccaccugcagcuucaaacugacguggcgaaccuucucaaccuucuuccccauauaucggcacuuucugaguuuccccaggaucaggauuuccccagugugugugcaauucaaaaguaaccacuccauucaccagaacagucagaagucuguguccaagggagcccggacuggaccaugucugcuaaagaaugcacgcugucagaaaacguaugcacucuacagacaugcaguccagccacagggagccauggaaggcaucaggagcagaacaguggaaaguaggacuuuccucuuuggagcuggcucugaggaaggggaccaagagucaggguggauaucuggaccccccagaugagaacugaugaacugacgagcuccugaguccauaugugugcagagaaagcagggaggagagaagcacgagugggcuuaaggagggagaagccaguaagguuuggucaacgacagcagcggagugacaggcauggagaagaaaggaucgagggugauguggguucugucuugagcagugacgugcuugcuggauccauccucgaugguggaugugguaggguuagcagacaagaaggugguaggaaagcacuauguuggauguagccauacccaagucaagaugguguggaagauccauccuuccaaguggucguccaguuuggcagucaaauauggacuggauagcguaggacugugcacauugggucuggaaugcaaaaggaaacaaacugguuccuguggaguaaacauguuacauauuuguaacucuuuaaggucagaauuugcuacaucccgcccccauccccucauauuuuugauacauuugguguggccccgggcuggcaucuggccuuugcauccagagugcuggguuuacaggucagcucucauugccuuugguuugcucaacucuuuccauacauaauaauuuaugcaaaagugugagcagaguuuuaagcagcccacacuaaaaaguuaagaguuuuaacugccugugccuagucaguaucuguccucucccuuucccaugucaggcugucauauaugacuucuucaagaguggaucuccccggcagagggacugggcauggugcugugaucaguguggccugggcagaggacuacguugguguccacaugucuuagacaccaagaguggauuauuuucuuaucccuccuuucucacuauugacugcuucuguugccugaacuggucucacacuuuccacuuuggacucugcaucaccuugggguucccccugagaaaacacaaacgcacgcaccccuaucucccuucuugcccaguaaagcacaggcagcccauucagguucaagggagcacucuuagucccugcccugcgugggaugaaaugccgcucccaucagguaccagggccucccccucuuccccuucacucgucuucaucuuuguuaacgcccugguuguauguaucgguaccaagucacugugugaaucagccuaguucaacuagcccugugacaugaccuccuggaggcagguaccacaaaagggucucucagacuguccuuuugcucuuaggagacucuagcauaaaguggccaagcaguauaaugguauaagaccuaaacccuggcucaguguauccuggaguuaugcuggagcaacccuucauguuuugcaucauacuccuccuccuccuccucuuccuccuccuccucuucuucuuccuccucuucuuccucuucuuccuccuccucuucuuccuccucuuccuccucuucuuccuccucuuccuccucuucuucuuccuccucuucuucuucuucuuccucuucuuccucuuccuccucuucuuccucuucuucuacuccuucauaucgaaaacauuucagauucagauccuugcccacccaaaucugacauucuuaucauaucaccacacaccacacccccuuccuaguagcagcuccugauuuccuuacagugucaaccacagguccacccacaccuaccuguccuuauaguuuuuccccugacccacucccagcugaaucugaauccucuuugacccaugcagccacagaugguacagguagagggcucccuccggguuaguuagccaucgucuucugguucuuagacuuggggaugucucuguuauccccgcuccaccucaguguccaauggaacggaaugggcaagagaauuggcauucacuuggacaaagcacucagcacacuugggaagagagauggcacccagcaagugguauugaucauguuacuaaucauagcagaaggcucauggguaauccugccuugugcccuguggccacugugaaggagaagaggccaagagcaggaguucccaccuuucuaaaguuucaucuucaaagucaucucacuccucccaguuuccucagccuggcugagcacauccucagcuaguuaugaauucuaaauaauuaaguaaaucagccccugcucuccuguccagguuggcgccacauuaacucucggaguuuaagcccuugaaguagggaucucucuguagcccugucagagcugccacuuuaagaggggcaguggaucucagcacauugggaagacagccugccauuucccacccccaccuggcagccgggcaaggggcgggggcgaggauauuuaccaucugaaaguuaagcgaugcuuuuacgaauugggccaucucuccucaguccccauuuuuccucgcgucucugaacgcucauuaauuuuucacagacucgugauggauaguuuuuauuuauucacgucugagguucuguugugugugaaaaaggacucauuuucuaacauuacauauucauggcuugggauagaugggauaaggaacuuauuauuaaugugucacugugggaaacuuacucuaguucauuugcgaaccuuguuaaaucugguguggucagcaggcagggugaagcucuggaugcagucuccuaacagaggacagagaggcagcuucucuggguucaguaaaacaaguuuaaaucuucauaggcucuugugggguuguaauuuuaaagaaaugggucuuuuuuuuuuuuuuuuaagauggcagagauuguguugagacaagugcuccaaucucauccuuucuuaauuuugauuuucuaguuuucugagagacuacuuaagagagcuccugaaggucucuucuuuccugccagccucuucugacacucuucugggucaaguucuggcuuuaucugcccauguuuucaucccucugauccauucccugaaaaccccggaguccuuaauucaaagcuccuauggacaccacagaacuccuugccugggacaaacacggggccuauuaaugcaccaucuuguaaauccaggcugcggggagaagagccagcagggaucuggcgcaaucugcuucugugugagcucaggcagaaggaagcauaugcugcaagcagcucucugcaaagacaggcgcugcucccuggcagggacagccuguggguuuggcgacauccguggggccuugccacguuuccucaguuuggucgagccauagcaaguggucagccaagaugaaccaaguccuucucugugaaaagaaagcaaauuaagugcacuggggugggggugggggguggggaaaaaagugccuuucaaaaacuggaagaaucuucuaugucaggcaucagaguccgagagcaucuggauuaucgccagggccgugccaucccggggaauuuucuuccccggaaauaacuucgcucucccuggagaugacaaaaggacaguuguucauagucaccaaggcucaugagaucaaggcuagggucuuaggagugcaagugaggggcaaaggaaggagaacccuuagaaagcauccuccagcagcgcucuucauaaugcaaaacauuuguuucuugccaggaucccauuggcgguuccccucguauuauauugccauuuauauuggaaagucaggcagcgcgaaacuguagucuauuaagaguuugugagugugugcguguguacacagugaaauaauaucuugugcaaugugaagugacagucaaaauuacagcuccucucuugccgcaaggguacuucucugccaaguauaguaauauuguagugucguucaagguugucagcaauucuggcucgcucugcagagagucauaacagcacgcgcagagaaggagcuuccugucaggggaaauacuauaauuuugauauauauuuguuggugccaaacugcaauuaaauaggagguguuggaaaggggguuuuauuuaaccagcuugaauuuguuaauuaauuagcgaaaacuuauauuucgaaugcuucaagaaacagcuucaugauguccucacaagcaguuuuguuuuguuuucaccgcuguuucuuuugguuagucucuuagagaaaacaaaaugcuucccuccaggaaaacaggauacaauuggguaugggauuuuucacaggguaaauggcccggaaaaaaaauaaauugaugcagaauaaaauuuuugugcaguauaaauugugcaggaaaauuuugugucaaggggaaaaggauuuccagccacuaaagggaugggggaaaaaauaaagcaccuugaauaaugucacguuaugguucgucuuugcggugcaguuccccguucauauuuagaguuggacuucagugacagccgcugagacucuuggagagauccuucccaacggagugagcuugagcccugcuagcuguagcuacgauaaagacauuuucaggaaauauguguguguguguguuugugugugugugacguuaucagaucacaguguuugugauuguaaacuacuagucaaucuuuguagaaucuuucauccuagguauguuauguggaguaguaacacuuuuuuuuuuuuuuuuggaugcaaaagcuuuuuuucugaucuuccaaaaagaaaaagaaaaagaaaaaaaaaaaaaagaaaugagcauguccucagaguguacucuacacuguuauucagaugaaaacuacauucuuuuuugaguaaguaggaaaaaaccaugggagacugaaauagcaacaauauauuaaaagcucagagacaguuaugugugaaaaagacgagcaagaccaugugguuucaaaaaagcaccauugaggagcuuuaaaaaaaagcagugugagauggugguggggcagauacucgcuccuccuauugaacauuuugcaaauuaagugaguuuuacucuucaauaaaauaggaaucuaauaacauuuuauaugaucauaaaaugugucugcuuuugucucuaucuuucaugaaaagaagaaauauucccaaaguauauuagcaaaaauaauuaauaagcaaccucucagaguuauuuucugagguuaauuauuacccggagaaaucaauuucaauuucuucccuuugcaagacucacugaggcgcguuugcaccucggcauuuccaaaaaggcagaguccacuccugcacgagaaagugccugcgcugcccgcugugauuuauccuggcagucguacuguuucccaccccugccaaggaagauacaacagagccauucagcuccaacuuaguugcccaucagcgccuucguauuguuaaacuaaaagccagauacacucgaaugcugaugaaauaaaguagcuugccucuuccaucuaacccuccccagcagcccuggcugacguguccaggaaagcagggcgaaucggcucuggccagggucgcugcuccugucuuaggacccaagugaagaagaaggugugugugugugggggggggggggggugaacguaaaccuggaagugugucuugaugggaaccaggaaaucauugccugucuuccucauccaucgcaggagucagcagcagcacgcugaccucucaccggccugcaggauuuccugaaccaugaccacaauggccuggucuauucuggcugaucacagcagacucuuccccaagacuggggacagaguggcagugcuaggaauuucucuucucuccccaguuucuuccauugcuaggccuaaaaugacagcaucaguuuccaugguuggauguaguauguauguauguauguauguauguauguauguauauauauaaaauuuggaauggauaucuggaaaugucacuccaugguagugugcccacagcaucuguacaaggccauuguuacagcauuccaaguaagucaguuucuuuucuguugcugugauuaaaaaaaaaaauccucugauuaaagaaauucagaggaguaaggcuuuguagaggcucacaguucagggguauagccugucgucacagguaaggucaaggcagcuagagacugaggacgcuggucacaucauguccacagucaggaugcagagggaugauagaugccagcacuugccgucccucuaauccagaaucuccugcucugugaauggucccagccaugguuuagaugaguuuucccacaucaguuaaccuaaucaagauauaacaccaccacuaccaccaucaccaucacuacuaggcaugcucagagguuaugaggugagcccccuuuucccaauggccccccuuccccccuuuucccauaggaguguagcucagugggagcaugguugccuagagugcauaaagacacguucauuccgaaacacugaagaaaacccagccucguagcuggagugaugauagccauuaugugccucacccauuuuaagaucaacauacucaccaugacauucagcaaagaacgcaauagcuucacaggagccagcgagagaagccauccaucaguccaucuggacacugcauucuuaccugugggguccugauccacuguggguguggaggugggaaggaaaguggcuuuuguucuuguacacggaagguccaaguucaaaugauguaagucagcaggguugcuguuauugcccaacaugcauugugggauguaagaaugagacagaucauggaagcaguuggcucugagccaugcggaugcuguggcaacuccuuccuuccuuuugacuucaacacugcacgaacagccuuaucaguagguaaaugauccaguauggccaugcacggggguggggggugggggggacuuuauuugcagaugcuggcauuugaauuucuugcaacuucuuuuguaucuccuuucuuucucucucaacuguuaaaaacaauuguuuucacuccuggucugcacaggaacggguagguugcaguguuucaggguuggcugagguguuguccagccccaguacugugucagccccucucucuuaucuguagauugaacccagagcuucacagaugcuaagcaaguauucucaccuuugagcuacaucuccaggccuuaguuacucauuuugauucagggucucacucaguuccucagguuggccuugaacucaugccacagccucccgaauaguugggauugcagguacgugccccaaagaaugcucuuuuaguggaaaccaggauggcuacugacgucagaccuuuccgagcuuagcaacugcuaauguuugccugaaagucauaugcugccuggucccccugugcuauugagagaugacuggaccaugaaaugcuacccucaucaauguuuuaaucuacugguggauuccuugcuacauuagaucgucaggaugugagggccgcuuggugagaguaggcugugcuggcauacuauuuaagguucugucugauggcuggcccccuccaguguuuuguuuccccucugguuguuccaccaugaaaugagcuacuuggcccuaucgcugccuccaugccacaccauccauagguucauaaucaauagaaccacccagccguggacaaagaccucugaaaccgugagccaaaauaaauccucucuggcuugcaguguuugcuuuguuauuugucccaguaaugagaggugacuaagacagcagcccuugucacagugagcucuuuuccccaugguuccugguacaaacagcucagggagaaccacgcuuggccuuuuuauugggcagagaccucccgugaaucaccagcagugacccagguaauaguguuccauauguaggcugguguuaacgcccucuuuguacaugaugcuaggagucuccguucccuacugggacagcaucaucuuugcucacaucaccggacuaagcaccucaggaaagaucuuggacaggcaaacccauggcuucccccauccacaguguucucccgguagcucaccccaugcucugggucuuucgagauguuucuggggcuagaaagaaaucccggugugauugucaacugcuugaugaauuggucucaccagugauccgcaaagaaagggccacuuucuaagcgacacuacagggagagccuuccugcucacaugcuuccgauaccuguucucaggucugucccuagaagcagagcuccacgcugcuccccuguguucuggguggacuugccuuccuaaggggaaggaagacagaggccacagagcagaauucccgacaagaauguggcuuccacugaagguuggcuucagucugaccccaacaggagcuccuggagggccaagugaugcuacccaaauuggcccugccugagacaaggcuuuaacugacggcaguccgugauuggagaacaucugccagggaaggcgggcuaugugggagaagucccuggggaauagggggagguggcagauuagaagcaugugaucauaauucaucaauagcuggugucuccugggcuggguagcucugcucagagaaagggucuggggcaagaaggcgguacuacagcagagugcucaccuucagauggcaguacuacagagugcucaccuucauccagaagcuccucucaaacaaguccuccaugcagagaggaacagagcauucaugaaaugcucugaagucaggucuugcacccaugcauucuacaggaucccccuucuuugaccccagcacaggugugcaagcugacaucaggcucuucccgcugaaaucuucucaggcucacuuucugcagucugaccuguuuccucccguggugauccucaaguuaaguuuuguuuagugaaacgcaaggcuauucaggaugcugggcuaacaucuucccguuguaauugaguaaauauauuauacacagcuggguaggugguuuccgugcuggccuggcugcuaugguuucaagauggacaccaucuucuuuaaaacacacucggcggugaaggcauuuguuccugguuucccguggcgcuccuccucuagaaaaaugcaguuaccuggacauuucagaagcacuuuucguacgauacugaaagagugaaaaaggaaagccccuugcccuccccaaacaaugguuacacagagacaacagugggcugugcugaaugcagccacgucaaggaagugcaauaaacggagauagauuguucuccaagccucacuuuauuggauauuguaauugacauauaguugucauuuauaaucaucuguccauuccugggaguugggagcaguaaaguuaauuguggcggcucauuugcauuaaucucaccucugaaggguacaguaacccauuaauaucacgucaugaugaauuaucgcaaauaacauugagcauauugauuaaugaucucugagauuuguaucucguuaaaacauuuuguuagcucuuuaaacuuuuaagccaauaacccuuguguguaggaggagccuggggaucauccgaggggugcugugugcguggaggugugcaaucgggggucaccgguucacggaaucagccggccugcuucccuuugauuauuuauucuuugcuuugggacaucaaggacuuuuuucaggguaacuuucuugcgugcuuccauggucggugcuuucuuuagaacagcaucuucuuugauuguaaagagacucucauuguuaaaggauuguaguaagauuuucacuuuauuauuauuuugugugcaugugugcaugcacguguguguuguguacauguucaauugaaugugcucguguggggcuauacauauagaagcuacagguugacaucaagugucuuucuuaaucuuucuccacccuacuuuucauucugucugccugucugucugccugccugucugccugucugucugucugccugccugccugcuuaccuaccuaccuaugaacuaaccgggacuuucaugacccagaacucaucucuuuggcuagaccagcugggcaucaggcuccagggaugccccuguuucauccuucuccacucuccgcacugggauugcagaucugugccaccucccacagccuucaugcuggcuacaggcucagguccccaugcuggugcagcaggcaggcuaaccagugugccauuccccuagcucagggagcguuugggagccacccauuguggcuuuuaugucucuuagccgcuuggauacgucugcuaccuuaaaguucaccauuauucuuuuuccucuauggcaguauuuucaaacaugaguguuaacauaaacauacauccuguacaggauggguugcucgaaugaaauacugugauuuuuuuuuuuuuuuuuuagauacugcucgcuuagacacccagagaguuuaggugauucaagauuucaucucucaaacaaacaaccaccaaccaacacaaaaaacacuaaaaccaaaagaaaacaaaacaugaauccucauauuugccacauguauacuauguacccauuaauaaaauaauaaugaagucuuaucaaaagucauuugcaggugcuggagggagacaucagaagguaaaaauguuugccguacaagcguuaagacgugaguucgaucccagaacucacauaaaaaguucugggggagagauggcaugcguuuguaauuccagagcuggagagcuggaaauggaaaaaucccuugggcuccccacucaggcaagucuagccucacuagugagcuccuggccagugagaaauccuauauuaacagaggcagauggauuccugaggaugacgcaggacauugucccuuaccucuccccacacacgagugaguacacaaguguucucgcgugcacuggaccagacacucacauuuguaguaaaacaaaagacaaggcccuccacaugguuuccuggcacacguuuaaaugugggagucacuguagagaaaagucagccuguaacuugaguuacuaagcuuugcucuaauauguuuuuuuuccuucauugguugcaaaugcgauccaguccucagucuuacaaacacguauaauucuguugaaguuaguauucugcuuauuuucucaaggugguguuuauuggaauuuuaaacccagccuccugggcuaacucuuuaaagaguguggaauuaacccuccugagugaagaaugcugggaagacaaggucacaacuguccaccccggcuggggguuccacagaaaggggacagguuuggagagagacaaaggaccacugcuccugcuggccuacagaccccagcccggggcccaucaguccuccacgagggaaggacuguuaccucagugacauauuaacggucacucuuugaaguggaucugacugccccaguucacagucuaaauaccacggggaaagggucacauucacgcuguguccgcaccuugcguuaguaggugaggacaguccuaacacacuccaggacaccuguuuugauggggcagcccuaaaaccguaaucugcccagaugugcagcagucuccaggcguaacuagcugaggacgggguguccugcuuacuuuaagagcucccuccauugccugcuuugucagggcuguccuguuccucaccccacugaguccuuuaagaucaguguuuucaaaucaaagaagcuuuucugucucccaggauagugucuuguaaagccaaucucuuuauuacuuccccaguuuaagccuuuauuacuugcgauccaaagccugcuagugaauuaugcauuucagagcuccggguaucuucucagcccacucuuccucuaccuuuugggggguccaaaauaaaaacacaaacccaccucacggugagcuugaggugggcgccuuuccauccacagcauuaauccuuuuuuuuuuuuaaaucugcuaacggaaauauuuccauuccucucauuaaucaauugagauuuucauucccuuguuuuguaaaagcuguuacaauaaauacuuuuuuuuuuucacaaggcgaaaauccaagagauggaugcagccagcguaauuaauugcacccgguuacaggagaucagcaaguuugugagauucgcaugcugcucugccauaugguugcccaguaggcgaaaaauuugauuaauguuuugaaguggauuuuuuucagcaaauauuacggccccagaugagguguuuuccccccuccuucucacuuucuaguauuguuagacuuagcggaaggaaccgauccucugauuuaaaagcguaauaacauugugauucaccgaaaccuuaacaggcaaucaaacugacaguccuucugucucucgugaauacagaaaaauaguccauuaugucuuuguuugguaauuaagugaaaugugagcauugccuucuagaacuugauucuucccccaaaugaaauaauacacgcauuuccggcaugauuuauaaguugcguauuugcaaggacuuuuaaaacuaaaagcaaacaacagaagauaauaaaaaauaaaaauagaccagggaaaaaugccaccaaugaaaccauccuguuauuauucgguagcuaucaaaggaaagccaaauuuaccugcaguuggcugcccuaaaguauguuacuuucaugagcgcuucuguucuuauuuacuuauuuauuuauuuuuauuauguuugaaacuaggacggccacguauaucacugguccauuucacuaccagguuccugaacuccaucacuuccacaugggggucaugcucugaguuuucuccugagugagaacaaggauugauccuuuauaaugcaauaggacaggauguggccaucugacuuuggcauccauucaaaaaggagaaggaggaagaggagggaggaggagaaggaggaagaagaaaagaaagaaaggaagaaagaaagaagaaagaaaaagaauagagagaaagaaagagagagaaagugagagaaaaacaugcaauuuuaaaaacuauguggacuggcugggaguucuuuaaauaaaaucaaacaugucuccacauguuugagugagacuugaugucccagacuucucugcugggguugucaacguuucuccucuucaaggguuuuccuuugcuucuugaaacagugucuuacucugcauccccugcuuacuugaacucacagcaauuccccugcuucagccuccagagcgcugugaucacaggugucuuuaacugguuaagcccugacuguugagcuaccauccagccuaaagucccugccagggucagagucuggaucucugaccucugaccaggugugagcccauuucugagucuuugaagucaagcagaagucuccaucuucuguauccacaaagcacuguaacuccuucuaucccucugcccuuuagagaggcuguucacagggcaccucuguuggacacaguagcagucugcugucccccugcaggcaucccugggcucuucacucagaugaccguuuuuccauuuaguaacaguagcaauuuaaagacucugaaggugccucccuucucauggccugccaagacaccggagcagucacaggggcaaggacaggaccacuuaaaauccccccacaacacccagcuuuugaaacuagcugaaucaaaccuucaggcaaaaaggcuucuuuuggcauauauauauagauacagauagauagauagauagauagauagauagauagauagauagauucuagaggacuggguguuggaucuguuuucuauuuuuuuuuuuuuagaaaaaguggcuaaggucaguggagucacauuuaccuacaaaagaaugaaguguuugaguccugguugguuuuuaauaaugccugcaggaaggcauccaagcagccugcuuucuuaaauuugaacccuuaacucucccauaauacagcaguuuuggaaauauuuacaauaaucguuucccuugagacuuagcuaauuuucccuuuuugauacagcuguucuaagugacuauuuucacucugcauuuuaacacacauaauacaguacauaucauaaagaaauacuacuuucuuccccauucuauguaguuuguguggucaccucuaauuauucccugggcacuuuuuuuaaugaaaagaguaaagaguuuuuaauuuuuauuuaauauggcaggugaaacacggacaauauaugaucgguuggcaggagacaguguguugaauuauuuaugaguuuacuucccccccccccugccccuucaacagcagguacauauaggaaauucauuaccaggccugggacagauacugcggaggcuuugaugaacgucgugcuuuauaaguaucagaaaugauguccuaguuugguguaggugguuuggguuuuguugugaugaugguugugacuuuuguuugaaugcaguuugugcagaaugagcaagccaagcuacguugcaguuuucucugcaaaaaaggaauauguuccguaccccaucuuuuguuagaauuguguuguaccugcugcguggugauuuuugccccuuuguucucuagaggggcccaauauaaauguaacaccucccuuugugucaaguugaaguuuccuaggaguaaccccuuuagaacaaacuaagccagagaauaucauuccuuuauauguuccuucuucuauaugaacugaccauuggaaucaugagguauuauaucucaucgguauuuccuuacaagaauagacucauuuauauuuaagcaucugucaggaaggugagagccacuacauucuccuaauuggggguaaaauccagacaaauuuagggaaacaauuaucaucucaagaauuggaagagcaaaaagaaaacuaacgcaggggaggggaggagguccugggugcuugggauuauacaguguugccaugcagaaguaauguacugcccagcaggaaggcuccacuucuucucaugaacucaaaaggaagacaaggcaugccugcaagcuggcagggagagucggggcacaggcugccgcagcaaaacuuuugccacaauguuucuuccuagcuuuggaaugccaucuuugucaaaagugaaugcaggagaguuaauguguuuccuauuuuccucucucucucucucucucucucucucucucucucucucucucucucucucgugugugugugugugugugugugugugugugugugugugugugugugagagagagagagagagagagagagaauuuguuuucaagaugcuaacuuggcaauaaauaaauaaauaaaacuuucgcaaaggaaaguaguuuuuggagaacccaagaaggcacacccuaaagggguucuguaaagggaagcaugugagaugcuuucacggcagggguccacacauuuauuucaaugaauuucugcggaggaaaaggggaaagagggggugaguggacgauggagcagagggaaggaacagaguagugacuuccugagcaaaggucagggaaagaggcccagccauucacuugcagaucagaguucugaaaugaagcuguuuucuugccaacguugcuugugagcacauccucacgaaaucuuucucuuaugccagcuggaaucaugugauauuuucuccaaagcucggaguaaaauauuacagguuguauacagagaacugauuuucuucauggcagguguuguuuuuuguuuuuuuguuuuuuuuuguuuuuuucuuuuuuuaaaaaauucuaccagccagagugugagucaccccgucgcagauuugagaaaacucggugacauuuccaaucgucacuuucuuuuucuuucccugaagaaugaggucagcuguguuucauuuauaauccccaggacaucagcucacagauucagugcaagguuauaaacaucgcuuuauuaaauuuguaacagggaaucgccucgcuggcccguuuauacauuuucaucucucuguauucuuuccccuugugcguguuguacuaacugaaggaucucgccagcacacuccucuugggucucuacaccugaaguuuucuccaaggucccagauuugaccaaacaaagcacgauuggccuugcggacccccacauacucacaaagcagacaugucaauaucugcccacguguuuauuuguaauuaaagcccaggcacucuagaauggcuuucucauuaaucuggaaacgcagcuucguuuccuggugagugauggaugucagccugcuucgugcugccucugagagaagauuguuccugccgcagcgugacccaggaaacguuaccauagggcucucgucucgacccgcccuaacuucuguuguucgguaaaucugucagaagggucugaggggccauauuuaugaagagcgugcagaguggucagucuaaaaagcuccuuagcgcaguacuuugaauuuuaaauuacgcacauaauucaaagguaauguaacuugccgugucggacuuuaguccauuccguuaaauggagaaaaaugacugacaugaggaaagacuuauugauucuuggugggaaaaugacuucuguaauauaggaaguaugguaaaaggaauagguuaauuauuuagggagcacuuuucaaaauaugcuucuacagcagcacaaauuguauauauagaaaucauaugaugagucucuuucuuuuuaauucuuuagaugggggaagcuaugagaauuguuaugcuauucagucacuaaggccaaguuuaauuuuucccaaacuguuaaagacauuuagagauccaagggacauggagaaguuucuaaaccaccgagaagcuuccaaagagcugacgaacguuaccagucugucagcuuaagacuagagauuaggccaggugagagguaccagauauuuauagccacccucuggcucucucccucacucccugcauguguaugugucugucugucugucugucugucugucugucuguuuuccuccgucucccucucccucccugucuaucucuguguguaucuguuucuguuucucucuguuucuauuucugucucucuuucugucucucuugcucucucucucuccuguccaucucucucuguaucucuaucucucucccucccucccucccucccucuguguguaugugucugucugucugucugucugucucucuccuucccugucuuucucugugucugugugucugucucucuguuucaguuucucuuugucucucucucuguuucuuucugucucucuugcugugucugucucugugucucucucucucacucucgcucucugucucucucauccaguugauauuugucagcaguuacuaggaauuccaucuuaauucaucagguaaauauucagggagcuaagauagcauguuuuaaucugaaucagucuucagaaauaccagaugaagucuuuacuucagcuuuucuacuguucccuguuuucauucagaguguauccuucgcuuaaggaucagagcccaguguuauuuucagcagacuucaguguuggccucuuucagauaaacagcacauuugcaguuaauuggcugaccaugcuccauaauuacauuagaaccuucaugugcuugaacaguugcccacagagggccagucacauggauuaaguuguguuucucucaucauaacagagauggcugguggcugucauugagcaauggagucaggauaaggggccugggacucauacagcgauuuccuuucauucccaacugagauggcuaccuggagaguuuuagaagcugaccaugaaaucuauguucuguuuggauucccagguuucauacuaugggcuaauacuucuuugaauuuucagaaagcauugguuuagcuuuucaucaaaguuauacagcuguggguuuuguuguuguuauuguugcaguuuuuuaacaacaacaaagcaaaccuaguacuuugucaagguggaauugaguuucuaggaaaagucaccaaagaaaugggcaggggaaugggccaaggcauuugaaugccaguagcuaagggaggaagucccuuuaucuuucaccccauaagcaaugccaccuggguuguuagaggaagcccuggggacugauuuuaggcuuauagucccaacauuguccugucuggauacuuaaugaucagccagaagacaguacauuuuucuuuguauaacaaccuaaauuagguucugggaauccccuucuuaaaaucaaauuuuacuuaugguuggccuguuuuuaauuuuuuucucuuuuguugaaauggggugucuaucuaggcugaccucagaaauuccuguauagcugaagacagccuugaacuccugccucugucucccgacugcugcuguuacagauguucauccccaugcugauuaaugcaauacugaagaucaaacccaagaucaugugcacuaggcaagcacuuuacuaauuuuauaccccaagcccugcuuuauauauauauauauauauauauauauauauauauauaauuuacauuuuucaauauuugaaaaaaaauuaaaauucaaagcugaaaacuauuucaggucacaugacuaacgugugacuuuuaaauuugauuguccagaaggaaaguuuguuuggaacccagcucuguuuguccauuuccugguugcuuagccagcugcuuucagacugcaguagccgaggccaggaguuacggcagaggcauuauaucuuccaggcugaaagauacugucuaaucuuuuauauacaaaauucgccacccacggauaucaccagugcaccucagcuucuguccaucaccaccccugagcauggggacugucuccgccucagugcuuggccuacagagggcaauguugacuggcuggaugaagaaugaaugaaugaaugaaugaauggcgacacaaaagccguaggaauagagacaucugucaucuuaucuuuggccuaacaaccaaagauuguugucaugaaauuuggaaauccguuugcaaacauguuugaauugauuuuuauggucuuuuaaugaacucaauaaaaaugguaacaacacagcaauuuuaagaaaauagcagauccaagguuuuuuuguuuuugguuuuuuuuuuuaaucacuaugcaugcaauccccguuccacccacaugagguauuuaugcgguucaaauaauuaucuuuuggaccuggaaaugcuuuaaauuaggauuuauuugaaaaauuauguuuuauuuauuuuuugaagagaaaugaaaaggaaaauauaaaagcucucuucaaauguauuuacaugaucgagccaauauggcucuuuucagaaagacgggacauuccaugugggguaagugcuggccuugccuugagguguuuagaacccucuacugucuccagauugauuggagagagggggaggggaggggcaguagaguuggaagagcaugacaucgaauacuugguaaaguauucaaggacagguuagagaaucccacuucugaguccuuggcagugagagaucuaggccaaaggggugcauucugucagggggguggggggguaucagaaccugguggcuaagccccuagguggauaugccccaggugggaccugccugauagccuucucagccucacagaucugacuccuguguggcucuggagguggccucucaccuccaagccauuggucaacccagcuaggcaauaggaaucucuccccccuccccccaacaccacccagcacuggagacauugacucucucccauuaagcuguaaagugcagaugggggcauagaggauuccuuaucuuugcucucccucccggcaccuuuuguaacugaguucaagucucacccguacagaaguguagagcaauggcccucucuccugagcccucuccucugauaaccuggcacuacuuguccagguauccugugaucccuucucuccuuccucccuucuuucucccgccuccucauuguuguaagcugccuggaucugauguguccuuuaaggaagcaggcgaguaugugugugguuggucguucccccacuguccuggcuggugggagaaugccagccuuuguuacugggcuccagccugcucgccucaauucccauuucuuccuguacucaacuagagcucuaaguaacacuacugcauugagagcugaccuccuggcugccuguccaguuuaaucucuacuggacccgacucagcagcucuagccaagcccagaguugagguagagacauagaggcacaaauacauguuucuugccagagauaaauuuucaguuggugagccagugcccucgagcuucauggcuugcuccugccuggaucuuacuaccuacuuucuuuguaugcuggugcuguguguauauucuguguagguaaguguguauguuuuuauauguuuggggaggugcaucugugugcacacgucuggaggcuacagaucaaccucagguaucuaaauuuuuggcuaccuuguugucugagacaggguucuuccuuggaacccaggacucaaccgguuuagcuagagaggcuagccagugagucccauguguugggauaacaauggugaguaaccuuaccaggcuuuucuuauggauuguagggaucaaaugcagucuugauacuuguacacgcagcaaacacuuuacacggagcuauuccuguagucccaacuuucccccuuucuaaucucacuugguucucacuuguucuguagggcuuggauuuaucguaucuauugcuccuucccauugagaaugugagaaaaauaaguuucugcaucgacuuaagucuucguaguggagaguucuguuuuauaccaaauccagugaauuaugaugauuuccuugugcauaugacucucacuagaugguggaccuuauaaaaugguggugaaauacagcaaucuacugcacaugauaauauucauuaguagaguaaugauauucugcuauuagaagacagugugcuguagcaugauuguucuaagaugggggccagaguaaggaagacaggaaggagagaaggaaaugaaggcggggagaagagaugauuaagucaguguuucuuauuacaugaaugaauggcuuacuaaaugcacaaacacacaaagcaaagaauggaugaaugcacgaaugaguugccaacaagaucuggaaaaaguagacauguagacuugcacugaggacucacacagggaggcucagcuauugcagaacaccaugcucagaggucuggacucuuccuguuucugcugugucugcugucuuaagacccggaagacuuuugggagugucuugugucuugugaccuugguuucugucuucagucauggcaguguuagcugagccuguauagucgaaagcuuugccguucauauacguuagggcagaaagcauggcauagcucaaucugagcagaugugcacaaagccuuagcuucuguuccuuuggcauugugagagaguggggaucaauggcuuggaagcagguugaagaaccuguggaggcuccuuguagucucagaggagagugaaucguuaucuuuaacucucaugucuguccgugguacauguucucaagagagagcacauaacagcaucuugaggaccuuuuagaagacaucccaggacgccaucccagagccuuuuauuucaagacuuucggaaugggacccaaugccccacauucuuggauucccagcugguguugaugauauuugucugggaagcauagugcacaaauggcuugaaaagacugauaguuucaguuugagcaugcugaguuacagggugaguucccuucugcccacaguguccacuggucaucacuaugaccuuagggucugaacaccaucaagcucacuuuagugaagggcuuuugcuaccacagccuuugcgccggcucucugggcugagcaaaccaaaaaguaaauuucucuuauugggauaauuuguuguaaaugugaguucuguaucccauuuggaaaacacguagagcccccacuuugaacuuauauucucagccuguaccguuugauauuuccuccacaaauuggauauaccugccccagauguugguuuuuguggcaauaaugcuuuuuuauauuaaaaacaauucugaaaugaaaaugugacuuagucuuauuguaaucuccccuuugccuuucuguauggaucauuuguuugugaacugguuauuucaggaagggcucaaagguaauuucaugguuuauagcauuuauauuggcgccuuuaaugagcaaaacauauuguuuucuaauacaugaaccacagaguucauauauguauguguguauauauauacacauaauuuucauuuccuaauauugcauguauaucaaguugaaaacaaccauguaaagacacuauauuuccauacacuagggaaauaugaaaauuguauaauacaaaaauaaaauaaaauaaaauaaaaaucaacauuuucaagcuuaugagaugguguuauuuuuaaugaauucaaacaauagugggagcugcuguuguguuugcgucucauacagcaauucauacccacaaacacaguaacauauggcucuguuauuacuggguuuagggauuuauguaccuaaaggaguuuugcaagcucugggucucacucggcucgccauacacagcaacucaguuggaggagcuggaguggcuaguuucucauuuucagauuaauaagcucugaccaauacacuuuucucaggucguguuuaugaaacuccacgacguucuuguaugucguuaaugaccccccuccuuaugauguugguagaaggccggauuagugaaauauaaaaaauuuugccucaacaaagacaaguucuggauuguggggaaagcaccagcuucccuuucuagcucugcagugcgguggccuccagccccuggggucacuugauguccuggagauucguugacacccacauacucccuaucacaagacggcccccucagguccuggcuguguuuguuuuagagcuccugcauggaacaugcagcuguguaaacccaggaaugguuucuacccagcuuugaucuucucauggaucaacaguugcccucggucccugaacccggcuucauagcccccaucuuacuuggauuuuuccauuuucugcuaauuaugacuucgcauaggaagccugccagcagcagcccccacgacucuggguagauaauuuggaaaaaauguuguaagucuguuaguguagaacuauauuaaggaauaauuuccauucaaugccccccaaaauauguccuuuaguuuccucuuuagagacaguacgacaauaucaaguagacugcuggaguuugaugaacauauacacauuauagacggaauacaugggguuuucuucuguuuuguuuuuuaaccaguacaacguauccuuuaucauaaccccuaagaggcucaauucuaccaaauguaccucaauucaccauggacaccgucuguugggcugacuuguggcagcuucuuuuuccaucaauaggcagggagucugucgagaacucugcagcaacacuacaaaaaucauacugcuuauucuuacaaccuagacaaaagcuaaauccauugcuuaggaaaggccagagauaugaaaagaagcccuagggaguuccggggaagauggcuucuuccugggcugguaacgaguggcucaugggacuggccuguaaugccuccaggauguagaguuagaucugggaagaagugucucuccagaaggggugacaugugacauggaagaccgcaugccccagugcagaugggcccucagaagcacaggcugaggcagaucuggguuugcuuucuggcucagccccuugcuguuugcaugguuuuggacaguuugcuguuugcaugguuuuggacaguuugcuccagcuuuaggagccuuggcuugcucaccuagaaauguggaauuaauacugauuccugccucagagucuggaaggaccaagugagaaaaacacaugagaauugcucaacacuguccucgggacacguaaguggucaagaauguuagcuucugucauuuccagcguugugacuuugggugcuccccccacccucccuucuguuuuguuuguuuuugcuucuagcaugugugucuguguguguguuuguuugugcaagcacacauguguaugcauguuuauguuguaugugcacauguaugugcgaguagggggugcauccaugcaugugcaugggcaggguucuugagccauccucuccaccuuagucuuagagauaaccucucucuuacagaacccagauccuaucauuucagcacucagacuccuccugucugcaaccacucuccagagcugggguuacaaggcuuuacccccugacucaccuccccagcccuccuuuccuuuuuuacaccauaaaagauaaacugcauuucugcccauguucugguucaaugggaaccaaagagcacuugacaggagacucucugacuuguccacguacggggauaucuuaccuggguuggaagagcacagccucuacagugacucucaggaaggcgcuuggcgagggaacacugaacacaagucugugaguguuacuuaguguccaccccaaagguugugccauauaguacauuugucuguaggugagacacuucagagcuucauguccucucagggauaagcucuucucacgccguaacugcaucugacccucugaaccugugacacagagacagaucugccguagugaugauguuuagggaaacgcuguuucucuagagguaucaguaacauagcagagaagaaagagcaguaggaugcuaaaaaugcaaacugauaccccagccagcuugugauaucccccuaguugaauuugcauguccuguuugcucucacacuggccaucagguuggagaugcagggccuuggacaaagaugcgggucaaguugguucuauugcugugccuucagauagggaaggagggcaggaaccaucuuaccaguguguuaaagccgcccagggagcuggaccaacccccaccaccccaguguauggaaagugucuagugauguagauuucugugggaccuauagaggaguuacuuaaaaugggacugaggaaaaaguagcagaagauuuacuagucucucacaauaagcauucuauccauccaucgguccgucuaucuggcugccugucugucugucauucucugucugucugucugucugucugucuguccgucuaucuguuuuacacaugaauguuuugcucacacauguaguugugcacaacaugcauguccagugccuauggaggucagaaaagggugcuggaucucuuggagcuaggguuacagauagcugugagcuguaauuugugcgcuaggaaucgaacucaagucgucuggaagagcagcacugggccaucucugcagcccuccucacagugaugcuaaagcacggggcacuuucuuuucccucuuaaacguagauuuaucaucuucuucgaaguaucuacauuuagauauaauuuaccagauaguagcccccacccucccucucucuacccccuacccucugcuucugacaugucuaaguaguucgucacacaguggcauuacuaauggccugacuuuuuuuucuuucuucaggaaaugauucauuacuuuauaauuucaauucaguaaccaguuucagcuaugcaauaaauuuaaauccucuacuaucaagauaacauuuuuuccuccugucaccaaaaugcaacgauugaaaaccgucucuagaagcuggccccguggagacaaugcuuauagauuugucuuucacucuaacauacaccuuguccauuaucacugccaaucucauagacucucucccuugucagugaacccaggcagauaacacaggcauucagccucaugguagaagcuguccacaaguuuauauauucuccaccgauguaacccuggaugugucccuuguuuugcagucacaaacagcguccccaugggcagacuucugguuuuaggucaggccugcaucaucaguggcugaggggugacugggaauggcaucaacagauccguuuuuuuuuuuuagaugugggaucaaaggauuuugacaaauauccccaagucccuuuguacugagguggaaccagcgugcaugucuaccaacacuagaaaaaaaccauuuucuuaacuuccauuguccuugcucgcucucugcccucccucuuguuuuuauuccucccccuuccccuuucuucccuguucaguuuaagcauacagauaacuuagcagcauugggcggugagacccagcugcuugccccacccaguugggaaucugaauucccaucucuuaccuccgugguuucucagcuccucuugaccuccaggcuaaccucuguuaggacaggcuugguggucccuuuguaagcaucugcucauacucugguccuuugcuucucucaucugcgaaggcaagguuauccucuggcgaguaggaccaucagcuugggugaccagggagacucuguuaauagaaaaagaggagugagcuagcauccucuaguuccuguucccaacauccaugaugaacaaagccuccaggugagugucagugcugggagcauuugaaagggaaagaaacacgcaagaaaaaaaaaaacuaugggcaauguggggaagauaaccaucuucucaugauguagggauauuucaaaauuccccacuaaguucuaaaaguguaaaaaaaaaucauaauuaguuccaauuccccaaaccaauucagagucuccagcccauccagguuucaaccaaguguguccacaaaauauucuuggaucucaaaacaggcgcuguuguauauuuuuacccuuuguuuuccucuuuccuuuccuuuucuuuuuaauuuuuuuucuuaaggauggaaagcccuaucucaguaaugauccaaggacagaguaauggcacccacccaccacguggguguccauggagcaccauggguaccacacagcccacauuaaacgauccacgcuugaggguugaugguucaaguuaauuugaaaugagaaauugccagugaccuaaaacccaucauuauuaaccuuguggcacaacacugccguaaccaguagccaauucuucuguuuuuuuuuuuuuucuuuuuccuuuuuucuuugguuggaagaaaggcucauugauagaaguuggcucaagccuuuuuguuuaaguuaaguggucagaccaccaagaagaauugcuuuccauugauugggaacagguccaguacagaugucccucacaugggccuuccucgguggcuuacauacccacaauugguucgagcuguguuuauauauagacuguaaaagcgucuguguguuaguguuuaacucuucaaaagugauuaucuuccaguaauucauauuuguguugcuugagugcauuuauaguuaguaaaaaguuuagcuuuucuucuuucuuccaaaaauaggguuaagugagaaaaagaaagcuugagaucggaaggcucuggggacucgugucgugggcaauaauacccaugcuuccccugggcauuuuacacuagaagauucugacagggcgaauccaguccagaagggguuucaugcauuguugugucgacuucucaggagguuggaguucucaugaagauuugcuuucccacgugccaguaaccauuucagaguccugucuguggcauccacagagguccccugaguuacacaagaguucgguuuggcacccuucccaaagauggcucccuguuuggcuuuagcuauuugcucuguuuauuaugcaauuccaauguauugggcuuccuucagucuguggccagaaggugacauucuuaggucaaaguguugagaaauugucuuuccgcaguucccaguaagcccuguuucuucccacaugucaccguaagccccacuccuacccacaauucccccuacacuccuacccacaauucccccuacacuccugcccacaauucccccuacacucgugcccacaauucccccuacacuccuacccacaauucccaccacacucuugcccacaauucccacccuauuucuucccaucaguaccagcaaaccucaccccuccccacaauccugcaugucuccucuuucccacaauucucagggagccccacuugggugguauguuugcgaauaacccguguuccucuuuauugugagcuuccagguuuugucuuacucauuuuguuaucccuuggugaguuucuucaguauucccuggggcaguuguccuuuauaucuuuuucagaugauauguuagaauucacuaauaacucugauuuccaguugcugcacccugucuuuuuucuguugguguuuguuaaggauaccagacgagggguuuuaucagagcguguuguuaaaggcauuuugcauaugaugcaaggacaaagcauuguuucucugcugccccuuuaucgacggcacaauuccuguuuuucagugaacagcuauggaacaaaugcauggaguaaucaaauagcaggggucauggcuccuauauccagguccuaauacuagaaacuugggaauguuacacugcaaaagagacauugcagauauggucagguuagggauuuggaggcaaguagaugaugcagacaaucuguguggucucuaagggcagcucuacacuuucuuguuggagggcagcauagcaaagcgugccuauggaaggaaggccacacgagggcaguggcacuaggagggguggcgaugcagccacgaagcaagaugccaguggcuucuaggagcugcaagaugcugggggugcauuuccuucuagagcaacgggaagaaccugcucugcccauguguugaguuuaguccagaaacauuaauucuguacuucuguuuuccagaaccaggagacagaauugacugaaaugguuacaugaaugccucuauuguugcgguggggaaaacaaaaggaacucaccaauagucaaauuuuguugcugguccuguaaaguuuuaggauggagaacugguccuccgugugacaccccgaguuacaguaguagauggaagauugauguuccauguuugcauuagcaaguccuugacucugacucccaccugcccagcuaggccuugguucuuuucuuauuacaaaagcuuugaaagcaggcagcucaaguugugagcaaaggcucucagauaccauggcugcuguaguucuccuucagagccuuagcuugugauugcuauacccccaggucguuuucccaggcaggcaagacaauaaagagagaggugagaauuccuccagcauugucaaagccuggcuuuuaccuuguaaccucccauagcugcaagagagucuggaaaggcugaugcucauacuagguguacaguuaacuagaguuaaacuggagcauuguuaaucaagaagaagaaggaguggaugauaaaaaaggugggucacuagcaguauuuguuuaaggucacgaauuguaacuguggaaauagguaggugcccuggguugaauucuggcucuagcacuugcaauauggcagcugucuaaccagucugaaucugagucuucuccccuguaaagugaggguaaccacugggccaaugucaaggucgcugagaugacuagauuaggccagacugaugaagacguagaacaaagucuggcuuccaauugguauuccauuacugucauucuugugaccacaacuucccugcagcuuccaucaccaucauccucuccaccaucaugaccaccaucacccacgaagcugcuaaacucaugugauuaucugcaaaacauguccaaaggccuugugucaacuucuguaagaauauucgcguaauauguuuccuuccaccugugaccuggcuccagguguaaagauugcacagaaacuugaccuucacaauccgugcuuucuccugagagcuuuccugccgugccucgucccuugaugccugacacacacuuggugugcgcucgcacacacucacguggaugcuguuuguugauggaaugaauuaauauuuuacagaauaacaacugcacugcugacuauauuccuuguggagccaauuuguuucaucucugcaagcaaggccaguucaaaaggacuuccugauggagcugauaggugaacccagguguucaauaauacuagucguugacauggcacuguaugucccaguuccaacccagcaugugcaggcugaauguccuaugcuguccucaguggaaaugacaggcauuguaauaucaacugugacauaugcauacauacacacacauauacauauaucauacuuauaauuucaucccaagggagacugaggcagaagaaucaggaguucaagguuauucuuuuuuauauagugaauugggagccaaauuggcuauaggagaccucaucucuuauuaaacaugaaacaaaacaaucauaggagaaucucucuacccucaauuuccagcgagcccccaccgagagaagccagcaccuuugcugaugcaguggacaauagccaggcucucuggaaaccauagcuaaauggacacagagggagagcaugggccaguccucuguguggucucagggaaguuuuccgagaccagcucugaaagucagacuuaauuuaugggucaccaccaagcuuccaggagacguggggaacagauaggagacuugggaaaacuuccaggaacccugagcauucaguccauaggaggcgaugaaaucugaacggucuaugggcauguggugugugucgguggcaaaguaugguugggcuggcugauuuguugcugaguuuuguucucuguaugcuuuaugcuaacguauuuuccccccuugucacacaagguccaauguguauaaacauaucccucccuuuaucugcuaagcagugaguacuuagcaagcuuagacugugcaguuucuagcugcagggaugacagaagguuuguggaaaggcacucagcugucaccuccuuccccguagcaguacugagcagacccuaggacucuuuuacaguccuggagggugucugcuuucuaguuuuuuuucuuuccugggguuaacucuuugugcccaguagugccaaaaggcucagccaagucagcuaugcacacaaugcgugaagaaacucggacaaagaacacagcggcugcuuguuucuugugcugaugucugcaggagacugggaagugggaagaggauccagauggauucuagagguauuguuuaguugguaaagugcuugccuugcaaguaugaguaugucagguuagugcccggaagucauguuaaaaacaaacaaacaaacaaacaaaaaaaaaaacagaacaugguggcagaugcuuguaaccccagcacucgggaggagaagacagguggauccuggggucuugcugcucaaggagugaagaccuaaacuucaaaauaaauagaugaaugaaugaaugaaugaaugaaugaaucaauguuagaugguuccugaaaauuucagacacaggaguuugucuucuggcuuucgcaugcacacccaccuacaucugcauugcuccaaccacucauguucccauaucuaccguacacaaaugaggauacaaaggcaaggcaagguugcagaaccaacugaggcugugguuccugcuguauugcuuuaaccucuuuauuuucuucucuuccuuucagaauuccauacaugaauacaauauaguuucaucauauccaccuuuuccccucccccucugauuuuucucauggacucaucgcauuccccucaaauucauguccucaucuaucaucugucugucugucugucaucuaucuaccuauugaucaucuauucauauaucucuaucuaucuaucuaucuaucuaucuaucuaucuaucuaucuaucuaucuaucuauaucuccuacucagucucuuuaguguugccugaauguacagugguuuggggcugucuguuggagcacggguaaccuacaagggggccguccaugaagaaaaccgacccuccuucucucagcagccaucuacuucccauagaucuucagacucgugagcccuuccccugccuauccuagaauauuggcuggugugaucaugugcaguugaccauggcugcuuaagguucauggauacaguguucccacuaugccccaaucuucuggcggguaggguuucccuguguuggcaccuguguaucagguucagucagaccaaaaacuucuuccugguuucacacauuacuugcagucgcuguuuguguaggaacgccugcuuaagggagcacaugugugugcauuugaccaguucuagcauugcacuguuagcagcuuccugguuuugucuguguuuuguuuuugucuaguuuugauuuuuuguagaguugcuacuguacaagcccagccacauuuuguuguuguuuguuuuaaauccaagaagggcuaagcauccaagggguggggcaguuauuuguaagguucaaucaagaacugcagguuggugcuguaaaauucccucuuagaugucuuauauguugagacagcuccgugcuuagauauguggagauggcuccguggguaagggcuugcugggugagcaugagaaccugagacugugucuucugcauucuuuaaaaucaggcaucaauguggcauuguaagguuggcacugguggguggacauaggcggaucccuggagcucaguguucucccagucauguugaaacagugaauugggaguucacuaaggggcugucuugaaaaguaaaggggacaggcacgguguuacaugccuuuagacccaucacucagaaggcagggaggcagguaaaucucugaguugaguuugaggcaagcuuguuccucagaccuggacacacauaccuugggcugcauagaaagacccugacucaaaauacaaauaaauagaauaaauuaacaaguaaauggggaaggcaaucaaggaagcuaccaauagcagcuugugaccucagugugcauauguacacggguguacaugcacccacauguucccacaugugugaacacacacacacaaaugaugggguaagcaucuggagaaacuugagugcugaugaugaaaccugugcacaugcgcacgugcgcgcgaguauauacacacacacacacacacacacacacacacacacacacacgaaaacacacauucugcuuuggaucaaaaaaagcagcauuuguuuccuuauagugauuuucuuuuuccucccagggacauuugcuagugccuggaaacauucuuguauguggcaguguguuagagagggagagccagcagcuagcagauagacagcgcugaacauccuccugugugcugccugcugcccacugagcuaucugccucuaaauucagaaacccugggcuaaugcaagggcaggaaugaguaggauagugacagagaaaaguuccuuucgcagggugugcauuucuguguguguguuucugugugcguguuucuguguguauacacucgugugaauggucacuuacgggacguggggaaugccccgucuguucugcccaccucuauguccuggaagccugcccccugccuuuugacucccugucuggagaggucaccacccggcagguuugccucugcaucagcuccacucaggguguccucaccuugaccuauggugagcucuguagccccccgcucuguguuuaugagaugcuggaccgagaggaaaugagagcagacagugauacaauuaucauucauuucacuccccauaaaguaucuucuacuucuuuuuuggaagacaguguuaaucccccugcgaauccgugcgcccuguucuuucuacagccgcaauauaaaaagcaaagugggagugacuuuuuccuuauggcugcugaaaagguuacaguguuuggaccguugccuguuucuaccccggaacacaaaagauccaggaguaggaaucgcuucuaacaauaucccuuuagaaaacacugagggaugugaguccuuuuccuuuugcgcuaaaggucucguuucccucauacuugagugggaagauagcucgcacuugaucucugcuuccugcaggggaaccaugauugacccuggcaaccuggaagccaucucuggaaagugagagcuuuccuggauguaugcagccgugugcuuguguguguguuugaauugcuagaggacuuuggguuuucaugggacugggguuguagggcugaggggagaguucauaauucugcauucuguuuguaucagcuaugucuucuguuacuaugaccaaaugcuugacaaaacaaaacaaaacacacgcaaaaggaugcaggguucacuuuggcucacaguuccgagggauguguuuggugaaggcauggcagcaggagcugaagucaaccagucacacugcauccucaggcuacaaagagugauaaauucugguguucagcaugauuucuucuuuuuaugcaagcugacaucccagccggagacauugugccacuuagaauuagggugagucuucccucuuaauuuaaccucauagacauaacuagagguguguggccaugccuccucuaaauuauauuaauuauccagauuaaccaucauuucauugggggcuggagagcuggcucagcaguuaagagcacucacuccucuugcagaagaccugaauuugggucccacuacuguggcaucuugggcccacuucuggcccugcagauacccauacaugugugcaugcucacauagacauauauaaaaguaagaaaaaaguuuuuuuaaauggucaugcaacuagcaauagacaaaugcccaccccaagauucucugauuacaagcaucaucaaagauuuugguuaaucuaaggaaaaagauaacagagagaaguaucagaugucaguuugcuugcauauuaaaaaacaaacaaacaaacaaacucacuaaaguuuaucuuucagagaaaaaaggcuggcuuugguauacuaacagcccagugaacuugcagcucugccacuguaggcuuguggcuucccuuccguuguguauaguacuguggcuauguccccucgggcuccuggaugguuaagugcugcccaggaaugacucaacuccagguugagguucucagcacagcaucugagagccaaagucugcucucccgagcugaaagccgaagaauguuugaaagagcaagagguacuuuauguacaucccuaaggacacugcagaagucaaggacucccagaggacaguguuacacaccgaaauccuaguacgaggccgaggcagggggauugugaguuugaagucugcauggguuacacaggcggacucagucucaaaacacuaaaacugaaaaagaaguuaggaauuaaaugcagcagccaggagggggcaaugagagacccccuagcucuuccuuggucacuauguuugccuguucacaguggucccugaaggagacugauaucugcucccaaccuucaccuuuucccauucaacuguucuuuuucuuuuuuuaguuuuuauauuuaguuauuuauuuuaauuuuuauuagcuauuuaauuauuuacauuucaaguguuaucucccuuccccguuuccucuccacagcccccuauccuauccccccuuccccugcuucuaugagggugcuccuccacccacccauccacucccaccucaccgcccuagcguccuccuacauugguacaucuagccaacacaggaccaagggccuccccucccauugauaaggccauccucugcuacauaugcagcuggagccaugagucccuccauguguauucuuugguuggugguuuagucccugggagcucuggggaucuaguugcuugauauugcuguucuuccuaugggguugcaaaccccuucagcuccuucaguccuuccccuaacuucaccauuggaggccccaugcucacuccagugguuggcugcaagcaucugcaucuguauugguaaggcacuggcagagccucucaggauacauccauaccaggcuccugugagcaugcauuucuuggcaucagcaauaguaacuggguuuggucacuauggauucacagguggggcagucucuggauggccuuuccuucagucucugcuccagacuuugucccuguauuuccuuuagacaggagcaauucugaguuaaaauuuugagaaauguggguggccccaucccucaaccaagggcugugccuaaccucuggauauggucucuacagguucucucuccccuuuguuggguauuucagcuaauaucaucccuguuggguccugggagccucuugguuuccuggccucugagacuuucuguuggcuacucccaauuccccaucccccauugcuacacaccucuguucaauuucccaacccucuguauaucucuccagacuccuccuacaccugauccuuuuggauuaugguuauguugggaccacuugccuuaggcucuggucacuguaaccccucugccacaaaggcccgcaccuugcaccgugaaccagcguauaugauuuuuuuuuuggucuggauauuuuaucacagcaacaggaaaagaaacuaagaccucaacuaaagucccuuagagguagaggaggggucagagaagggagccaaggcagugcugggaaaaggacugugcucugugaguauagcuuugaagguagggacuuaaggucaggagccaguguuccuggguagcucccacuccccuugccaacucaaaacagugugaucuaccacaaucaggaccaguggccuaagagaaaagccaggacgaauagggggugaugucaggcagugaguaagugugacaagaauagugucucagaaggaaggcuuuagcgagcuaguguuuaacuggggguggggguggggaguggacaaaggcuauuuugcacaggauuuugugcacugggacaugcaagccugagguuggggggugggggguuggcagcauucaggggagagugguccuacuccugcugaacagaggaugggauuuuugggguugugcaugccuugaccccagucuugccccauaccagcuccucccaguuccaugguuccccggccccacacaguagccauuagaucaugaggaagacagggauaugggcucuucugccagagcugccagccauggaggguccucccaaacaaggcaucucuguucuauguuaccaugcacacaguagguacgugcacacaguagguaccaagcacauccuucuuagaugaguaaaugagugacugugugugugcacacguguaugugugugugugugugcgcgcaugugugugugugaagguauguguguguauacauauacacacaugccaguggaaagcacaagaggauaucagguccuccggaaguggaguuacagugguuugugaacccuccuacauaggugcuaggacucaaacuucaguuuucugaaagagcagcaaguacucuuaacugcugagccagcuuuccacccugccuuuguaaacggaagagaaacaagaauccuaugcaguugugcaugcauucagucaagaaaccuuuuuuuuuuuaaaucacuagugugugcugccaugcuaaccugguucugauuuagugcugggugcuuuguuacacuucuguaaauuccaaauggauagcuuaaccugacugagcccaaauugcaugguaaaccauuuugcuuuuguuuuuucacucuguagcuuuuuucccccuccagaaguaauuugccugauucauucagaugaaaacaaaccccaauaacuguauuauuccccagagagcguaggcuuuucuuugccagacauaaguaucucaagaaggaauugcugaaguaaacuuaguuaccuuuuggccaaaugcgucuucaaauuauuuaaccaaagauagcaggcugcaccuaggggaagcccaacaucuggaugaagagugaaauauccagauguuuucaaguaucuagauguuucccaccaucuggaucuuucggcuauugacaaaugaugcagcugccuugcaggagaugguauaccuagucagaggggagaguuagaaggcaggauagaauccuguacgcuacaugggguccaugucuuucccugaagccacaguugagucccaggaaaaggaaacagcuuccuguugugugaagcugucuucuggcugugagcgccagacugcagaagauguuagcugacugucucauuuaccaucucaggcuacgcagucuauaucuccuguuguauucuugauguagccacaccucugcucugaucuuuacaggugugcaaaaugacagcugcuggugcucuaagccggccaagcaccaagcuuucuuuguguuuaagugcgaaaaaagucugggaugcauggauccuaucauacacaggaauucccgugcuaugacuguucaauuguauauuucugaaacaagaauuuuagagaggauuaucucuggccuucauuuauuggucagcugugcuuagauucaagguugcauguaaaaaaaaaaaagauuauuaagacuggaguauaaagauauaauuggagggauuauuggaggcuggaaaugaaagccacaucacagaauccuugucccacgguuguuggcaugcugcauugaauuugaaguccuuaaacagauguucgaaucucgaacacagaugugagccugggaauuccccuuuacuugguaaugccguccuuuuauuaggugguacacccaagaacgcacagggaaggaagugauuguaagcugccugguggaauaguucagagugaucgggaaggaguguguguguggggggggggggcgugcuucguccucggcuuuagggcacacuuguauaccuguaggccucccauaggacucucccuuaacaccaccuccguuuccuucuaugaagcacaguuaccaaaauagaaucauugggagcuucaugagaccaggaagagcuggaccaguaagcauaugauucugguuaccuccaaugacaucagcccguccuagggaauuagaugcaaauggguuucauuugugcagguuuguuguacggaucauaagugacagacccgcagagacagguuguaggccaaacguuagcucaaauuagcacacagagacaaaccccaaugccuuuugccugaacacuugguuccaaaugguucgaaagaaagaaagaaagaaagaaagaaagaaagaaagaaagaaagaaagaaagaaagaaagggaaagggaaagggaaagggaaagggaaaggaaaaagaaaaggcaaggcaagguaaggcaaggcaaaagaaagccaaaugguuucaauuucauuguauauaaauaggguggugguguauuuauuucccacuuccccugccagugggcugguugggugggggaaggcaaggacuaacagcaugggauaauccaucuggauucuguucuacaccgauuagauaguuuguucuauuguuuuuuaacaacaucuuccauuccuucuguguguuacccagcucuaaggggagggcugacacuuugaugccuucugaaacaugucuauaaaacuguuuuaauuaaggagcagucuauaucaaggauggcuaguguuugauggccaggaccugggcccuaugauuucaucccugucccacuucauagcuaccaagugaccuaucgacuaugacaacgacgacaacgacgacgacgacgauccuauuugacagcagagaaaguaaugauucagagagauuaaacacagccaguaacuguucaaggagggauucaaacucaguuauguccgaauaaaugcuuccuccuggaugugccugucuguaggacugcuucaccauuucaggggaagugaguucauggucaugagagaacaggacuucucugagguuggauaggcccugcagugugugucgaguccacccuaggugcucauguugguaauuacgguacagaagccaccacgaguaacuaacuucuguacggaagcuuuacucauggcuacugagguuggaguuccaugugucacuucaucagacccuuguuuggauucuuguucaacuauucaaaggugggaaaaccauucucagcucauaagccacacggaacgugggaguggguugagucugggcaguaguuauagauggaugauaacuguuguagaaaagucagaaagucccaugacggcugaggacuucagcugauuccccacaaaccuguccaggagcauccugggacugucauauguggaccagcgcaacucggagucugucuugaagcucagagcacggacuguuucuuuucauaugcuuaguucuaguugguuuauguggaaugauagaggugaugggguggcugggaaaguauccaaacaguuccaugggcuaaauuugggauauucauccaucugucuguccauccuuccauccauccauccauccauccauccauccauucugagaccucuuaugugacagucacagugcuauauucacacauuagagaaugaagcagauaggucauccagccucacaggacucuaugaucuucagggagacaggcucuaagugcacuaggcucacuucagggcauaaugugaccauaagccaccacgcuauucuguuuuccgcuuucgucuuugaacaugggcuaaaacgauaggcacugaauucagacauagcacauagugagagggaggggccucccggaggauggcucaccgaccuggagugggucaugcuguuaucuggcuguggcucuccuucuugugcauggcagugugauacagaggaggagggggacuucgcgaccacagaggcguguuuccuggcagaugcucgcugcucacugagcuuacaggcuccugauuaccuccaccuacguuugccuucccuucugcccacagagguuauggaucucagggcuuguuaggucuaaggcuggaggggaacccagggcacagacugaaaugaccucagggcaacucaaagucaccauucagugaggucuaggacguggugacaggauccuuccuuggguaaugggcauuucacucagguuuuaaaaauucauuauguuauuugugcauuggugugugugugugugugugugugugugugugugugugugcucaccauaugcauauaaugucagaaaagggucaggucccuugggaccagauuuacaggugucccugagcuaccguguggguucuggggaaggaaguggguauuaugggagaggagccagugccucuacccaccaagcccucgcuccagacuuuugcugagcaguuuuugaguccuuuucauuuuucaccacuuaccuucauccgguaagcuaauuuccuuugaaguauggauaagagaaaucaaagcucagauggcuuaaaugacuugaccaagguuccaggaagccuggaagguacagaagcaggauugaaccuguucugccacuagccuagcccuucccauucagggacguugacauccuugacagggcagcugacagguuuuccuguucucagcacgaaccgagugcuugucuuuccugguccugggcuaugaaucaccccacugcugaagggacaaagucggagaaguguugcuagagacauggagaagucgugucguaaccuuuauacucuguugguggggcuaucaggugaaacagcccuuuggaaagcaauccuguaguuucuauaaugaccaaacgugcaacuaccacucccacggcgagcccacucccacauagauacugaauagcaguggaagcauucugggaguuuugucugugagugggaaaauggccgcugcauuguucauagcagccuagugauccaaaugacucaagugaccaucagcagaccaauggguagauacauuguagcaaauccucaucacugcccuucagggguagaauggagugacacacggagcuaagcuccaguuagucucaggagacacacacacacacacacacacacacacaugcaugcacacaugcacgcacacaugcacgcacgugcacucaugcacacaugcauacacacacccauaugaaacuuccagaguaagaaacucacggggacaggauauagaugaguggcugccugcuggugaggagaaagaggaaacgucagguaaaauggacuggaaagacuugcaguuggcagaguggcaguggcuugacugugagucagcugaacgaaucccacuguacaauuuaaguagguagauaagauggaacauggggucuggaggggguggggcuucaggcuuugcuccccugcaccugaaugcaaauguucuucuaagagaccagcuugugugucagccucugagccuccaaaacaggcugggaguggucgcccagccacaggucuguagcagccucugaagacagaacuguuucgagcgcuuucuccccacgaagugcaaauguuuaccaggucuaaucaggagaaaugaaaaaucacacgucucauucugacuacauugccccugaucauagguguuguuaaaacagcucguucacgacuuuauaaauauuccaagauuuauuuuggagccauguuucauuauuccuaugcuaugauuaaauauugagacuauugcuuuuccaauuguucuagugcaguauuuaaugagcgcaauuaaauggaaaaauugccuuuuuaacugaugauaguccauuagugucucugucucuucagaagagaaaagaagugaauuauuaggaugacaaaugaggaaaaguucccaccgugauggagaggugcgauuucccuccacauaaucuucaauuagugaucucuguaagaggguguuuuucaaaaggguaauagagaaguaaugagaucagaaggaggucaacccggccuucucucucuggcaguuugauuaauuuauuccuccuucuuggagauugcugcaaggggcuuuugucgcccauguuuuucaugggaccauagccugagugacuacugauauauucgcuuccaggcaagcaagcgagcccacugcccuggaacacaggggucaggaauuaggcuggcuugcuugcuuccccccuuccuuccuuccuuccuuccuuccuuccuuccuuccuuccuuccuuccuuccuuccuccuucuuccuuccuuccuuccuucccuccuuccuuccuuccuuccuuccuuccuuccucccucccucccucccucccucccuccuuccuuccuuccuuccuuccuuucuuccuuccuuccucccuguauuuguuuucuuuuguuuuucuuuuuuccuuuuucuuuuuuucucuuugcuucggcaucugcacuuggacacuuacagguagcggcggaugcuggugaugaaucuccagcucuagaggauugaaugcauuugucucgccuccacagguacccauaacaaacacgugcauuggugaaaauuaaaaauguuuaaaacuauuaaacugccaacacuggaugcuuccuugggucaggggccugaugaugggcagaugcaguuucuguucaucaccauagagcucaggaucuggugggaugagauggacucagauagcucucuacccgcagacuuuacagccaaagauccgaggagguacagccugaauccccugucuggcuuugaacuuugucugcucuccuuggaguacauggcucagaagaacugugcuuggaagaaaacuuucuucucgcuagcguuuggaggcacagggaaucaggccacacaguuagaacacagcuggggaggguggaccacagggauguucaugagcccagcaagcagaacgggagccaucacacgcacugcacuaaggacaaauguguucacuguagagaaggauucuucagggcugcaugaugugucgauggauguaugagaggauccauucauuucuucucauuggacaccuccaccccccugcacugguuuuccgugauugugucacguuguaauuauucuccagggaaacggguggcugagcauucucaucacacauaggcagcacgauuuagcaaaagguucuaauguuauauccccccccaccccacuuuugcuuucugugugucuuuagagaaguuacucaacuccucugaacaguuucuuaauaugucucucuaucugucugccugacucugucuuugucugucucugucucugucuuccucagccccaucucaagcagaguuacuauauuacuagaaaggaaaacgcaguauuauuuucuggugugcagcccaugucuaagacgugguuuguauuuuuuugucuuuccaucacaaauaccaacagugauguggggucuugguugccgcugaggagucaagauccuccauuugacauuauguuuaaagcacaggccuaaccauugacgaggcaucacucacuucauuucagacauaucuuucuggaggaaaagcucaauuucugagguuggguucuuuuugaauauugaaugucgaauuguggcaaugcuggaaaaacacacaaaaauuaaaaucccacucugccaacaacuccuucgcuuuuguauguguccccaggacacuuaucgcuucagcugccccaggcuuccugggucccaucuauagcccugggcaccgucccccuggagagccgcuacaaggacuuagauccugaccuugugcguucaaguuccuaagugagcucauguugaagaaacuggcccagcccaucaagacccggaguucauuuauacagcagcuaugggacuaaauuaugguucaggucugucuuaugaaagaugauaaaugaauaugucacauugggaaagaauccacuuugucaucguaugacagccuggcuugauuuguucgaggcagcuuccuaaaaaguccggauggggauauaaggcacgcaagccgggagggccugcucccugcccauuucuagggucuggggcaucuugauugggcuaccucagccccugcaaccccagguggaaggagaggacuuugcuggggagugaugagacgucgcaaccuggaacucgcuugcacuuggggaacaguugcacucagcaaccauaaaucaugacccaucucuuccagucuccaggggugguguugggcacccugcacuugcucccccuggaaaugucugcuggacgcagggugaagcuucugaaaccuuuucagccaucacagccucauaacuguucaucggucuuuuaaguaaggaugcauucuuccaacucccaagcagauaacauuuauucauucauucauucauucauucauugugucuguuugguugguugguuuuggguuugguuugguuuguuuuuguuuuuuagagacagggucuuacauguccagguuagccccaaaccaaauaaacgcuuuaagaugaccuugaaguucugaucuuccugccucggccuccauacuguuugguuuauagacacaagccacaauggcaggcucaucgugagcuuagaaagccauuuuuaguaacacuuuuucucccucagaccucccuagcuguggccauaucauuuuaucugugacauuuguugacaacuccagcgaauccccugagccgugacucucaucagugcuaacgcugugagacucuucaauacaguuaguuccucauguuguaaugacuccccccccacccuaaaaccauuuucauugcuguuccauaguuguaauuuagcuacugucgugaaucauaacggaaauauaugauauguaggauaccugauauggggcccguguaaacccuuugaccuccagguugaggaccacuguccuagagcuucccagagagaacuuuaaaauuaagagauuguugaguccuuugcucuagggcucugacucaaccuccccagcccuggggcugcagaaacgccacacccagcugagccauucuuucuuaacuguuacaggaaacucccagcuccaauacaaacaaaugaaaugcugcuuguuccaggcacaucuggugauagcagaacugugugggagcuagccugagacagugagggagcuagccugagacagugggggagcuagccugagacaguuggggaaguagccuaggcuuuuaaaaaauaaucuaaccuccuccuaccuauuuuacugcuguaggugggucuggccucgcaucagaguuacugauguauguaucauuaguggacuucuuaaaaaaguuuuuaaagaaaggaaagaaaaagagcagcugaacucuccccccaccccgacccacccgccaggcacacucccagauuugacuugcacaguuugucuguggauugauuggcagguggguuuauuuuucgugggguugaguuuggaaccagaaucgucugcaggcacccuaucacugagugaacuguagcuccgcccaccugccuggaguucaggcauagaacuagaaauccuucucugugaggcccuugggcagguuguguaauuuucuaccucucccccaacugaaggugacuaagaaggugauggggaggaggaggaggaccacaguccucggggagugcugccaaguaaaugcuaacugcuguauccauagagcaguguuuccuggggaccuucugugcuccaugcugggagccaaaggggacugagauacagaaaggagauaaaauggagucaggugacaguguuaccaccucauuggccuccaguaggaauggcaguuuccccccugcagaccuagagugugcugagaaccuacccccagugaagcgaaauggcuuucacacacuguccauguccuccuugcuguagucucaaggcgggcaaccuuugcugacaugguuuuaauuaucauaagaaaccauuacagggaaauuacaacccgggggcaucugcgugcuaacauuugguucugguuuuucuugagacuggaauuuccuccucuggcuacccaugguccagccagguucuccucugcugcauugggggggggggggggggcaggggcgugggauacugaaauaaagaaggaugaagcaugggggaagggagcugugauguuucuuagaauaguccucugccucagagguucuggaaagagcugucauuguguuggcugacucugucaccaaagggccgggauaacagcuaaaauagcucucgaggcuuugugggcaaaagcgaccuggcuccacuguugugcuggaggcauucgaauggcacuugagggcagguaucagggucuggcgucaaaucauacgcugcuuagcaguguuuucuauguaauaaaacacgccauuuccuucccacaccccugggcaguguagauagucauagagaaagcccuuugcaguguagaugcugugugguugggacaggugucggaagggguccuuucucucuuuuccuaguaacaacuuguuauugucauuggaauugucugccuggcauuaugugccccgccccugcucucucucacacacacacacacacacacacacacacacacacaggaaggggguauauguuccaagaaaacacuggaagaucuucauuuuaauaaucucugauuuaguggaaaugaguaguuaaauaggaccugguggugaggcuuggaaucccagcuacugcagaggcugagccaggagcgucuccagcugaaacccaguccagucaacuucauaagacccugucuccuuguacaaaguaaaaauacaaguguugggggacauagcucaaugguggagcucuagucucucaaauacuaggccccacccccaccccgccaguucaucaaacgcaauagcauuagcaucaaacaaacaaccaaaaaaccccuuaucuauauuaauggauuuacugcuuuugagcucucuaguuaaaaaucugcaugcuaaaauuuacaccguagaucuuauuuugccguaacucuuuugaaaacuacauugauuuccaacaagguccagcuuuauaugaaugcccucaucuacauuaucacaggcaggccacuagggauaaguucucuucacccugucagccaugugaggauggggcucaguggguguuucucucugaacaugccaguaaaguuaagguguguuucucucucuccucccccacccucaaagagaaauuuaauuuacuauuuuauguguucucuuuaaacuccccucuuggaaacagaagcaaauaaaauuagauuuucgugaagcugagaugcuauguauguuguuuugauuuucaauacugguaaagucaucucucccguuuauuuuuaaacacuuccucauaauauaaauaaucuagucguuucugucgcagccuguuuauucagaaagguaggaguuggcucuaaagauuggcguuaaauugaggaaaucauucauguaguaaauaagauaauuuguucuuuuccaaaaaaaaaaaaagauuaaaauauagauuuuuuucccaaggucuguauuauuuuuaacaccuacagucccugacuauauuugauucagauuugcuauccauaauuugaaagggcuuuuuuauugcaauuaaacuaaaauauuaucaguaagaggucuuuucugcuugagggauuuccuucucuaccuauccucuuccuuuuccuguucuucuuccucucucucucucucuuucccucucucucucucuuccucucccuccuucucuccuuccuccuccccuuuugcuaaaugaauucuucuggcagacagcugugucggcuccuagaacaagaacuaaggggaaagauggaacugacauauuuguuguguuacuuauauaguuuuugcaacuuagagcugcucuccaauuaagaaacuaauaaccuaauuauagacuucucugcaaagucucgcgccagugccuucucuuuggguguguaugugugagagauucuuuuggagaccaccucagugagguuagcacucauuccuucacucuuugcuuucauuuucacauucaagauguggcucugggauucgguuaggacaaggcucuguaaauguagcaucuuucaguaaaaaaucacugugucucaguucauuuuucccguugcuaucccauaguaacucauaccaaggacuuuauaauggaaagagauguauuuuggccacccauccugguagcccaagugccaauauugugugucagcaucuggcuuccagugaaguccucucucuguuucgacucuugaagacugacuggaaagccaaagcuugccaaguucacgcaggagagagcaaaauucgauuuagcaauguggggagccaagccauucccaggagacagacauucacccacucaugaagacaccaccccaaagaucaaaugucuguagauaucccucuccuaacacucucaaacuaauguucuaccgcacuggcaccugguucagaaacucaguauucucauuaccuuuuguuaacuugacgaaaauagagacaccuggcaagagggaacuuugaggauucaccuccgucagcuuggccugugauaccgagaggaagugucuuuauugcuaguugauccuggagggaucagcucaccauaggcgaugcugccccuguuccuguggugcuaaagaguggggugauugaaggggaccccacacacagcgccguuucucucccugaccuggacgaggcacaaagcacacccgaacacccgcuuucucagagauguccuuuaucuccguuaugaccuugcaaguauaauuuuuaagacaagaaaaagggguggucuguguucgaaugggcuaggacgcuguaguauguuuugauugggcaaguugauuaggcgagccaaagggggcugugaauugcuggacuuuuaacacuuugauagcugaaccuugguagucagccucgaaaggaggaaggggcccaaauaaggguauagacuucgggggcuuaucuucaggaacauaaucuaaugguuuuuagcaaggcagauggaaugagagcgaagggcaaggccuguccugggcugucuagagucccuucaguuauaagaaagcugaccaggcauaagccacagggagugagcccuuccuagagucugcuucaagccccugccuugaguuccuacccugacuucucucaguaauggaagauggagcagacagcuuccucccaaguugcuucugucauggagcaacugagaguuuagcacaauaacagcaaccucgcuaggacacccuggcucaaucuccuugcaugucccuguuuguuucacugggugaggggggaaugggugugcugugagacagggggauggugguggugaguuuugcugggcugaguugcucauccuuaguuccuccuaguuaccugaaacgucuguauuaauagugccuccuaaagugucucuuguccaccagcagcgagcccgauacuucugcauauguggcuuuauuuaauccuuccgacaaccugugagaugucugcuauagugacuucuuuuacgggcagagaaacagacuuaaagacagcauauaaccuuccaucagggagucugugcaguaggcagucugacucuaaggcucuguuucucagcacuaagcaagcuaaagcaggagugagggucagccacugucuguaagggagagccugacuccuacuccucaauccagccuuaauucagaccuuccucuccagagaaaccuacccagaauccuuaggauggucuagagugagccuacugugucacuguccugccugugcccacccacaucuaggcuucuggcuuuuguuucucuauacuugaagaguuauuuuccaucuuuugccccaaagugccucuggacacucauucugagaggccaauugcugggccuagguggaccuuuuggggcucucuacuuauuuguuuguuuuuuguuuuguuuuguuuuaacucuucccaagucaucguuuggcuacuuccaguuuaagaaacacgcaguguaguauagcuauuuccucugaaugaaaaccuuuaauuccugggguuggugggggaacuucuuaagacuuaagaaggaaguaacacuuacaaggcucaggacacucccgaaagauacaggacucacaauaccuccccaccuccaagcuuauauagguaacaguugcuggggcaaaggcaccugcagguccagaaauuagcuuccggugcacagccucacucacugugaugauuauuuggagaggcaggcaccuuggagucagacacacaucccucagccggacuccgguagaauugauucucuggucgguuguugguacccuaucugggacaaauagauauuuguucauuucuccccaagaaaaguuauagcaugccauugucaaccaugagcagcuucagaccaagacaacuguuuucuccucucugaugucagcacacuccuuaagugggguagccugggauauguagagacugagcgacucuagauacuaacaagaugaaagacagaugucaaaagccagcauucuacccaggcugcuugcugcacacuauaugucucaagacuuauuacauuugcuugaguacagagacuuucauccaucuauugcaaauauuuauauaguuuaguuaagaagauaauaagcauuuuuuguggcuaaugagcuguugaucagauaugaugauuccagccugaauuaucccugaugguaguuuuaauaauaacgguuaaucauggcuauugaccacagugaacuaugucgcaugugugugcaggcguaagggaggugcgugaggagcugagaggauuacucuaaaaguccuggucugucacucuuugguaagaauggagucccuuacugaaccuagaguccauuguggcuuugccagccuggcuggacagugagcuccagcaguccuucuuaguuagaggcaugugcagccaugcuccgcuuuugccuguguccuggagacuggaccuuagguccuuacacuagcucguggaggaagugcucuuagccacucaagcauuuuucucaguucccauuguuggguucuauugagacagggucucaccaagccuaagcuggcccugaacucucuauguagccaaggagagcauggacuugaacuccugacucuccugucccuaucucccaagugcugggauuacaggugugugccaccacacucagcaagaacucccauucacugggugcuuuuuugaaauuuaaacaauucaccucaaagguccugcuagguuucuuauccucguuuuagaugaagagaccgagauuuagaaaguugaaauugcuuugugugacacaacccgucagcuauagagucagaugccagcuuagugagucuccagugcccgugcucuuaacgcuacgaucauaaaccauaguaauuguucagagccuguaucagacauggugcuccaaaggaacaggacuuauggaauuaauacagauuaaaagggaauuuauuagauuggcuuacaugaugcagucugguuagucuaacaguggcuggagggaccaugaaccugaaagcuacucagaccccaagccuggaugccccugcagucacaagcuuggaggaaucuuggagacccacuggucuccagucaucaugggaagccugaagaaacuggauuccaacaucaucaaaccaagguagcagcaggaccaacagcaccagcugcugcugcaacagggugaccaguuugucaggaguggaugaugucauuagcaagacaggaaggcaaauaagcuaaagcaaagcuccccaccugggacguccucucucccaggugucacgggaaguugcuacccacauuuagacuuggccauucugguucauauagcccgaccaagaaguuccccagcaguuacguuugucugccuaacuuugaguugauccugauccagucaagacaaccgacauuagcuaucacagaacccuuauacaaauaguucacaaacccuguuuucaagcgaguuuccucgccuggguauuagaacaccacacuuuccuaggcugggugucagaguuuuacaagcucguuuucaggcguaaacagaaaccagaacccuaggaagcauuauaacucugggucgcagcaucguccauucugaucugauaguuuguuucgagcaugccgagagaauguaagauuuacucgcaacagucuccacccaucugaaauaguucagcgucucauauuuauagaauuugucugcuggaagacaugugcauauacccgcagacacgugcucaucuuaaaugacacuaaugggaauguagcgacccucccuugcagcccuccggaauacauauuucaugaguuggaggcaggcggcuugccugugcaugugaguuuauuggcgcauuagugacaaauggcuacucuguacaauugucaccuaaaguucuggcuuaaguuaucuggagucugguuuuauugaagaugaauccggauguaaaugaugagugugauaaugggauuccaguuaaacguacagcaaggcgcuggacagaccacagcacaaaggguauuaucguaccuucaucuguuuuccuuuagaagccuggcaugauccaguguaguaaauauuucauguacuuugcauaucaguccgaguucccuccgugaggucagguaaauggaauguaaaucccacgcuguauguacuccaaacaguaaaaugguguuauuugauguuccacagcauaaacaugcagauuugauuccccccuuuacucgugcuguaaaaacaaaguuuuuaaagugguuauccauaccugggaauguaaaugcauccgccuaauguaaugccaaagaaaaauuaagacaaaugauaccacacggcugccacaaacugcggcucguucaaaauucacuuuaguuauuaugcugugagugcgggcucucacccuccucugugaacacacaguuuauguugaaugcaacaugaaucauuuuaauagaccaagcaaaaaguccccaaagucgauuuucaaauuaugaaccuuggaacagaauauaacaacagcgaacaacaaauaguugagacuuucgcucugagcucugggugagccauuaaagauacagggagcucuuuugcugggaugcugcacacaguucuuagcccaguggcagaaaggacaggaauuggagcuuugcgguucggguuuuccagccaccguucuguucaauuaguucugcauuugugugaucaagauguucccaaacacagcauagaguuguauauucuucagaacuaauuguacguauuauaaagccaagaaauaccuuaaaugacuugacuccagcagaggggggacgcgcaacaauauauuuuuuuaaauagcuaacuaaacaaaauguuaacucauaugggagacauuuccagggaucucuaaccaccaaccuggaaaguggggaaaccccacaccuuuaaaacuaacccaugugacuggagagauagcucagcaauuaaagagugcuuccuacccuuccacaggacccaaguucuguucccaucaccuauguccuguggcucacaacugccuguaacugcagcugcaaagguucaggaaccuuuuggucucugugggcaccagcacacacaugcucucucucucucucucucucucucucucucucucucucucucucauacacacacacacacacauacacacacacacacauacacucauaugauacucauacaagcauucucacacacauacacacacacacacucaaaauacacacacucacauacauguacacacauauacucacauacacuccucacacacacauauacaccccccacauauacucacauacccuccucacaacacucauacaaacacauacacucauacucauucacacacauacacacacagaugaacacacacacucacauauccuccucauacacacucaaacucacauacacauucacacccaaugcugccauaagaaaacggcucagugagcaaaggcauuuaccucccaaccugacguugugaguuagauccccagggcccacauaguaaagaagggcagcuccugccugaaaguugcccuggucuccauccacuguggcaugcaugugcccacacauccugacauccguauacuguggcgugcaugugucccuacacacagaaaaauaaguauuuaaaaauaacuaguaauguuugacaguccuggcucuuuagugagauauuuucugacuuuaaauggcaguuuauuaaaacuuuuuaaaacaaugugcaguucaaagaaaaccaggcagguugcuaguuuauaacccacaucagaugcuccuaaacaaaacagacugagaaaaggguauaauauugucaaauguuauguugaaaguuuuuaauguucgccucuaguggcauagccuaacugagcaggucacuguccaucccacuuccccaagcauagggcacagugcuagcauuccauaucaguuaccugguauaauuaggaaacugguguugauaugaugaacuaaaguccuuaguuuauguuaaaguucaccuccuguguuguacuuacugugagauuaacccauacaugaagucaucacuccacucccaugcguacagcaguuucuccacuucaaaacucucuuuuggaagugugcuuaaaacuaggcuaagcuucagagauggcagucaggacaaugucugcuauaucagugagaggaacagaguucaguucccagaacccacauuuuaaaaacaaacaaacaaacaaacaaacaacaacaacaaaagccagguguccugucuuguggcuaauaaucccaguucugcggaggcagagacaggccaaccagcccaccuaugccaggcagugaguuccaggcuagugaaauaaugucucucaauacaucaagauagaugggcaacuaaggaaacccaggggcacaugugcaccccacaaaguguacauguauuugcucaugcucuugugugcaucuacacacacacacacacacacacacacacacacagacacucacaacuaucuacuuaugucacccucugcccuggccaugcucaggggacuaagaauaucuuggcuugaccaccccagugcuaagaaugaggcagccccgggcauccggguugcucuaguaauugcagcaauugaaucugggagucauugagcgacaguguuucccuugcuucauauugcugguguaaggacuacagccuccaugccucagcaguagcugggguaggcaucuccuccuuuuccagcagguccucucucuccucccucuuaucuuuuguugggaacaacuguuuuuucuugagaugccucacagaguauugcggcggauaacucagcagccacguagaucacaacagcauuuucuuccuuggcuucauuaugagcauuuguuguuguuguuguuguuguuguuuucuucuuguuuuacuuguuugcucugcuucaaggcaaaccucucugacuggcuucagaguugccauggagcugaggaugcgccuggaguacucacaugccugccuccaccucccugugcugggauuacagaaguggcccaccacacccgguucauuccguucuuuuuaacaucacgcacagcuguucuuauuaaaagugacagaccccgagccaucucagaagggaguguggcuaauacuuuauguccuguguuuguauucacauggcacgguggcgacuaaagcucuccuagguaaacaggaaaggacaguuuaauauugugaacuaaauccgagccaugugaaagcuuccuaguucaaaaggcaaccgaacuucuaucucuggcccuacuugcuccugcugcgaagggaaaggggagcgcgcauguguagaccaggggacaaccucagacuauccugccaccuucuuuggggcacgagcucugguuugcucccguguguaccaggcugucccgugagcucucagagcauuuucucaucugugccucauaucucacuguagggguguuucugggauugauuaccugugccuguacugcuacauucagccuuacaugggucuugggggauccgaacucagguccuccagcuuggcugcaagcccuuuguccacggagcccucucuuuagcccucuguacuuugccuuauccauagggacaccauuguuguuuuccgcagacauaaaaagaugagcaguuucgcagcugcagaacugucuucuguaguucuggcuccccccaccuuugggauauagccugucuuuauguuaaauuguuuuacuauuguuaccuuaaaggagcuaaguacucgugagauauugguacagagagcuaguuugcaauuuccauaaauaaucagaagaaucuuucauugaagagaauuauuuuuuuuaagaugccuauuuuccccauaaaauauuuuuccuagcauugaagauggggcaauaaggccuuaaucuaccaugaauucaauuuagacaauagaaauggguacggaauacaaauuauggucuguugcgguguaagccuaaggcgggccaguguauuuaaaugcuuuucuuuuuccuuucccuuuuuacuucuuucucaccuuuguucuuaacauuuuugcuuuuauucaguuauucauucuuucuauuuucuucauuucuuuugauuaaaaaaguuauuuaagugagugugguuuagagucaggguaacguaguuuuaauuucauugaucacucugggguaggaucugugugugugugugugugugugugugugugugugugugcgcgugcugcuacgacugaagcuacugugaucuuucaugcacaguuaguuauuugugugggcagugucuucauuucuagcccauucuuuuucucuuuucauguauguguguuugcagugcauguauacauacauguuuacauguguguuuggaugcacauccacaugggugugcagagaggcccagagcugauguuugggcccuuccucauggaccuuccaucccgcucucugcagcagucucucucaguugaagccagagcucaccgauaugccacuggccaguuugcucaggagcccucugugcuauuuuacagucuuuaccuugguauauaagagcaaguugcuagauauccucuauguuugacauugcuaauccuuuuuauuucacuuguacauaccauacaaucaaguuaugcuuuugcuuuauaaagugaaugacuaaugauauauaauauucaccacuaaaauauguuccucagugcgucucuuuuacucugccuuuuucugagaggagaguaguagcuuuacugaggugucucucaccugccacaucguaugugguggcuuuuaauauauucauagagcuguugggucaccagcaucauuaagccgugucuuccuuuacuucugucuucccgguaauuauuuggcucugcuuucccccaccucgauuccuauuuugcccuuccaccauuuaaguuucaauguguuccauaauuguguuuucugcugucuccgaccaauaauucuucccacagaagagcacauggcacccugagauuuacacuaucgauuucauguggauuggaguucugcuccaaguaucuuuauccaguuuauuugccuggauguagauguuuucugucccacauucaauguguccuaaagccagauugucucuccaggccccucccccaacaagcaccugucauuccucacaucugacauguccccaaguugcuuaacaggacagcaugucuuagagguucuuccagcacccagcccaguuaggccuggugaacgggccuuuagacaggaauguggguucuccagaaugcuuggaaauauaccucccuucuaucuucuuuagaaaagaguugcaugauugucuuacuccaugccauaugaaauaauucaugcagccaucuuccaguccaccuacaguugccccaacaauuccccguuauaauucuggaaguccuucuaaccugcagccuuuuuuuuuuuuuuuuccuuaucuccacuuaaagcuuuucuggaaggauuucaauuuccgcuuuccuuaaugguccuuaaauguuguacauaucuugaaaguggauuccccauaaaacaauauggauuaugcucucauucuguuaacagugcgagagccagccuggaagacaagaauaacaagacuuucuuaaaauagaguccguguuuuacaggaauguaaaacuuucucuuuaaaaauauucccguuggcuuccaucuucuaauacacagagcucgagucuaguuuaauuccaccuuggaauuaugguuauuaaucaccaucaucaccaucaucaccauccucaccauccucacuaucugcagugggagcagagcugaggucguuaugguuuagcgacugcacggaagcacccuugcuucugucccaaaguugauuuucuucuuaacaaggcaugagccugaaagggaucucauuugcucugugaaaaggaggauacugaagaagaaggccucuguuggacagugaaugccuggugggcaggcugugucacggacacacaucuggaaaaggugggggagccacagcagggagagcucuggcuccuggcgaggccguuacucauuuggaaggaauuagaaguaaaccauggggcaagagcuaaaccagugacuuacaaccauggccgcuuacauuggaagguguaggugauggcucugaccagaacacaugugccugugcauaugcacgugugugcacgugugccuggagcagaaagucagaaaccagguggauccuuggcagaacacucuguagccgaagagaaaagaggauuugggagccccugcaaacugagccuggaguguucaucccaggcugcugugauaauauauauauaucucagacuaggggacuaagguaaaaauaaaaacuauugucuuugggccgcaauaacugaaagaucagggucaagcuaugagcaugacagucccuaccagaccugcagagagcaugucugcacccauccauuuuucuagauauauaaacucuccuccucucuuuguccacauuccuucuucucugaaggacagucuuugguuaugucagccccccucacccccagcccugccccacaggcuucuuuacuuuccacccagucaccacuuuuauaggcacugucuccaaguccagucacauucugagguuguggagccuaaagcuuugccacguggauuucuucccauaccauaggaggcucuagcgaaugucaacuccggaugucgcuuuggguccugugggcuucagaaccucuuccauccccuacuucuucaacagagaggucaacaguggccugaucugaagucacacacagcacacugcuuauugucccaggccugccaagucuccagcggaugcacugaggauccugagcuggcaugccguguacucgcuacgucuugucacccaacccucaugcacaguugucccugggcuugaaagacagcagaugucccgugugcgaaagggaugguuccuguggcacaggugggcuaggaagguggggaagugaugaauccugaguuugaguccaguugauuuuucuucucuugguguucagccuguggcucucggucucauuguucaacaguaauaaauaccugguaacgcggauggcuguuuuucccuucuguaugugcugugcagaugccucugagauauuugugccaguuguaaagucuccucugugaacgcccccccccccuccuuuccacuguagcuucuuuucagcagaucuccuaggcuccauggcuccugcccccacugagacauuaccggcguguccaguagaaccugauagugggcuuuuacucuccccugcguauuugacuugggagcuuugcugucagguuugacucugcugugauucauggucauaguccuggauauugggcaugcuuuuaguccaccugccaggcuccauccuccuugcuucguuuuuuucacucugagugcccaggaccaaggacagaaacagggagccaccaggaugcaagccaugugcucagagagccacaccccagcccauccuuccuucaguugaugccacugcgugcuuguuugaaacuuggcuugguugacucacuccccaaggucagagaucaucuucacugcuuccccauuggacaggcuugcuuagaugucucugccauguacgguugacguccaguuuagauggggaaaaguggggcuggagagauagcacaguugguaaagugcuugcagcacagagaucugggguccauaucuagcagucacauaacaagauagagcaauugcucacuccuguaaccccagcccucgggagacagagacaggccgauccauaccuaagaccaccugggcaaauuaucaugccuuggguuucaguaaaaagauccugucucaaaaagucuuaaagagauagagagcagugagacuuuauuaucaacuucuacaugcauauucauguauaccucccccuuucccucucucuuccucucccuucucucucucucucucucucucucucucucucucucucucucucacacacacacacacacacacaugcucgaggagagagagagagagagagagagagagagagagagagagagagagagaaagagagaguuaguucuguagcagcacacagagacauggaauagugcacauuugaccuucuugcccaccucccaagugcuaggauuacagucagguaugcaucacuaugcccaguggauuggaaauuauucgagcaggccugcaacacuccaagagcaauaaccaaagggcacacagaugcgggcaucaacuuaacgaaagaaucaggcaaauugagggguaaacuaccagauauguggaucguaaguuuucaagauguuacagcugggcugaagaguuaucugugagccuccuagggcuucaaaccaagagagaggcccagucagauuauuuuuaugaauccaucaguucauguaaaucagccugcucgcgugacacacucagcaugcaagucaccucucuguccuucccuacccugccaguugaggcaggacuagcaaccagagaugucuuucugaagucuuuugcuuccuucauggugggaaggugggggaggggauguaucuaaagagaugcaaagacuuuggcauaucuucuuuuuugggggggggugggcauaguaugaauauaucaagcaccaaaaauacaucucucaacccuccaggauuucagucagggcccugccuuucagaacuuagguagaaauugaaacgagccauguacccggccggcucacaguugcuuccccuucaggcuugguauccaaggucaucagaaccagguagcacagcccaguuuuccauccucuucccuuccuuuccccuugcccuugacgcuggcaaaggagccgucaggcuucucauaaaacuccgcagcgauggcgucuucugcucccuguauuuccguaagugaacagcugccuaacgguucaccuccaccgccuuacugcuucccccccaugcuuucgcucuuuccagacaauaaacuuuauuuucuucauaagaauucagucuacgcaaggguauuaggcagcuuguuggcaccuuuuaauuccuggauguuguccagaaagggcucuucgcaggagcugcaauggcuucguugcuguggaucggggaagacaaugcggcuuuguguuuggguuuuuaccaguuaccuucuguuuguaaacaucuguuagugagugcccacccaccccugcacacacacaaccuccccccucccugucaaaaauaaaaggauucuugcguuuuguacucguuugccaagcuaggggagaagacugugcuggcugauucgccccacccgcccuguucaagugcacagguaugcgaccauugagcugaagcccguggacggugcacauauuggcaaacgacuuuccguagggacccaaagcacuuuauuucauuaauggccgggaaaccugcuaaucugcucauuacugccguuuaauuuugaggcugguuuuugaugauguauugaaaaacuguauaaacugccaauuacaacuagaaaacauuuccauuucugaagaggccauuauuuuuuccauuugcuuagcaguccucagcaggccaccagcgccccuuuuugcuuuggacugcauuccuuaaucuuccugaguugguuauuguuauguccuuaccaauaaauauccccaucuuguuuucccccuuucaguccauuuaagagugcccuugagccacuguagaugacgccgguuggucuucgguuaucguuguuaccgaccugcuccuagguccuguugauuugauggguuccuuucuccgugauuuuaugcuuuccuauguggcccaucauuaaaaacacagcacuucggaucggaugagauggaccagugucuaaaggcuccugccuucaagacugaugaucuguguuugagcucugcaguccauacuuggaaggaaagaacagguuccaacagguuguccucugaguucuacaaugcagccaugcccacaguuauaugccaaacacacacacacacacacacacacacacacacacacacacacacacacacagacgaaaaguucagagagcugugguaaaaugcugcauuuucuuauagguuuguggaccugagagagccucuuaguucugggcaaguggcgggaugcaguugcuucucugguccacugcgaacguguugccuuaaagcuggucucucaguuuccgauccccaucaacacaggugugggccagagcagagauguguuuccugggagaacaucuggguggggaguagcguugcugcgugcuacuugcuggggugugaguuuggcccuuuggugguggcacuagggucgaggaugaucgcccagugaagguuaccuuucugucucuuugguucuguucuguuugcauugcugaaagccaacucgaaggauaaagcuagggagggcuuuucagauguccaaggcauggugccgacuauaagaccccaggcacaggcucuggcuccucugagucaugguggccccaaguuugaacuguggcguggaaaccacgugcuguagacaauucuccucaugaaaggagacaaguaaguuguguguuacucaugaugaugaacucauaggaaagaccaguuugagcucacaauuccccacugcgauagcuaauuagcuccugguuucauugcuuuggccuucacauuaugcucuggugcacagcagaggggccuacagaccuaauagcauuccaggaagcaaaggacuaagggcaagaacaaguguuuccaauucuuugaugaaggccauggccccccaccaaugaccaccacugaccuaauuuccuuccuauaggcccaacccccugaaggugccaccaccaaccagauaucaagccucuugcaccugguuuuugaggaacacuuaucaaugccccaccaggcugcuaauggaagucacaaguguagagagguuacuuccuguugguacuccaagaaggccuggggccccgucuuuucaacaccacaugcacacagaaccuuaaaaggaaggauaccugcccugagucuccauguucuuccauacacuuuucccaacaguguuggcacuggggcucauuaaaucacugugcuuaggaggguggguucacaccgcccaucuuuaaucucuaugcaccaguuucccugucagguugaauuaacguggaucugggagauagacuuggguagaaugagagaaaucauguagcuugggacacacuauggaauguuuauuguaugccgaacauuuccauaugugguauccuuacuauucccuauacgucuguggggucaguaauaucaagaucaugggcaccccuguacauauucgcuuuaauuauugaucaccuccguuaucaaggcacaguagugcauucuucaauaucacugucugauugcgugcuccuagcacucuggccuggugcauagaauaacccauguuccaucaggccucagagagcuuagagaaucauucaguaucagcagaguugggcugaacucgggugauuucugucccucuacuuucuuaccuaggguggaaaggcacuguugaggagagggucaagugucccucuuugccaccuguacuccuggagguuugcaugacagauuuggcuuaggccucuguccagguaaaucucuuggccccaagucucuucuugucuuuuugaauaugcuuaaacuauuuuaaguaauacaaaaucaucuucacgcaagacucgccaucauauccauucaacauuuagcaccaaucccucccaaagaugguguuuucuguuuccucacucagaauaaacaaacacaaaauugcuuaugucagcaguagauuaguucaguuggauuacauauuagcauucaauacuauguuuaaucaaguuagaauucuaauuuuucuggauacagaguaauguaguuacuuuaauuacuuuauuagcuauacuugcauauauucaaauauaggugaaguacuucaucagaggaaacuaucacuaugaauuuugcuccuguauuucuuaaaguugacauacuccuacuuuuuuuuuuaggauuuauuuauuuauuuauuuuauaugugugagaacacuauagcugucuucagacacaccagaagaggguaccagauuccuuuaccgaaguuugugagccaccaugugguugcugggaauugaacucaggaccucuagaggaauagucagugcucuuaaccacuaagccaucucugcagccccaacaugcuccuacuguuaaagccauuguaucccagcugcccuucuauagggaugacagugccuuggcagcacaggcucaguaacugcaugacaucgccaccacuggcuugccacuucccugauugcugggugcaggggcucuguucaguuguucacagcugugaacgacgccgcuagcucacccugaagugagaaugcgacguggaaauuaauaauucuucugcaggaugguuguucugauuugcuuucuuuucccagaagcccaugagggucuguuuucucauccccucaccgugccacguagcuaucauucucuaaugacuagcuaguaucacugcugaauaaacccuuuuuguugauaacagcgagcaaagacuauguaugucugacaguuacucucaguauucauaucaauguuaaagaugugugggacaaaagauuuaacacuuugcaugcaaaguuuuaagcugcuuuggcuaauugguuauaaaccacauacaaauaaaauucucucccccccccacgauuaauugauaauaaauucccuuucacgggggcuucagaauuauuguaagaagaacacucagaaaacauaagggaugaguacuugggcaacaaaaccacuuuuuuuuacuuaaacccaugguggugcuugaaaauuaaaggacucagguuguauccguucccacagcauuuacguaggguucaagguguauaugcacucaugcuaaacuuuucaaaagcugcggugacgcacauggagcucuucccacaggugacuuaucuuccccgaugagacuggccauaggcacacugugcucacugcaaaggagccucuuagaggaaguggggugcaguauauguggggagaccaugauuuugugaagguuaucaucugcugugagcaauaccugagaaagcacagaaacagaagcucucgagugcccugugaugggagaugcccauggggggcaggguuuggggcugauguccuggaagaaggaacggagggcuucauuuugcuucagcacagcacuaacacaggaacuuaauuucgcaaucaauauuuuguuaauauuccauggaaggaacagcguucgucuugagaacuugccuugcuuugcuacugagccacugaaacuaauuucagucggguguggugguacaugcccauugucccaacccuuaguagauacaggcaggaaggaugaggcauuuaaggccagccuugguaaccugguaacugagaggccaacuugaauacaugaaaccuuguuaaacaaaagcaagagacccggagaaauaucuuuuaaauaaacauaacagcucucaaaauucacuauuuuauauaaauaauuaaaucgauaaauaaauaaccaagucuguuguaagguucauaccugcauucccagcacuuggaagacugaacaggaugccauaauuuuaaggccaaccugaguugcagagugagagugcgugugcgcaugugccggguccuccgugcguguguaacaaacgcucuuaccacugauucauucccccagacucccaaaaguaagcguauucuaauaucaagcauugucuugacauacgcuuauuuugauuuuuuuuuaauuugaauuaacuucagaccuuccuagaaauggcaggcacuuccuagaaauagacacuucuccuacuuucccccgagguuaacaguuccccucaccgugguccaaggaucaagcccugaaacagacauugguguuugacauccaugguaccacauuacuuggaucacccagugauucgcuuuuaucucaggagcugguccagggguccugcugcuaucugccuggccaccucccaucucugacagggccugcaucuucuucuggcuuuccugccaucgagacccuugaucugucuggccuguuucuugugaucagauugcuggccggcauuauuuugguggagccgugaacgucucaggagcgauguaguuagcgucuucauguguuuucaggggaccaugauaagucuuaucgccaugaguuaacaaugguucuugguucgggagaugacuucugaacuuccuugguagaauaucucuaagcucuccuacaugcuuugugaucauucagaagcagcgcuuugggauuccgacaaggcccuccuucccccgucccuuccacacacugaccgugcaccuccuugucaggucuugccugcagcugcacuuccugugcugguuggucuuggagaggucgggcacccacuacacuuucugauucucuaaucaggauucuccaggggaaaacuagcccggucuccauuuauucacuacucauuauacuacuuacaugcacgggagucacacagaguuauuuuauucuguuccuuguaaucaagcaccauaauuauuuauucaguugcucaguucauuccaguccaggguguuagaaccuguggugguugacuucggugaaggacagaguuucuaguugagcgaucucuucccucacggugccccuccuggcucgcugccuuuauuucucaucauuguaggcuagggauggcucguugggggaacucuugggagcacgcuuguccagauccgugccuuguaccucugacuuguugacauaagaagggaggacacacagugauggggacaaaaacuuaccuggugcuuucaggaagagcaucuauucuucuaggauggaugggaguguggaguguuuccgggagguggccccaguccuaccaauggcccauagagaucuuacucucucaguagugcuuggagaacuugguucucuucaucguccugagaguguugauuucucacagaccuuaguacaguccccgcagcugcugcaucaucacguggugcagucaucacuuuaugucuuuauuuucucccuguugcugagaggaagaugguaacaggauauccucaaagauggggaaaacagggcuucacagcugugagagacugaaauguagauacaaggaugcuggaaucagaaugguguccuguucggagggucaaacgagaaggugcauuuucccaggcccuaccuucauuccuacugauggacuggacaguacucacguguuaagucuguagcuguagagaucguguguguguguguguguguguguguguguguguaugugugagugagugugugugcaggaaugugcacucucccgcacuugaguaugcgaacuuacacacuuaggcauaaugcgugaacauacauaggauauuauacaaucuaggcuuugaauguguuuaugaauuccucucaauucuauaaucuuaaaugccuugauuuagaguauugggaaguggggauauuuuaacuugcaaugauuuugcaagaaaucugaagcugaaagucccugaagacaaaaugcuucuugaauacacuuggccagcaccuucaugcucuucugguagcccucuucaguuugcuguccuucaggcuguuagaagaaagcgggcucuggaauuucucccaccuccuggagagccagagccucuauuuugcaguggagaagguggcacccuaggagggcaggaacuuggccagugucaccagaagaguccauccucuucuuggaccugaagccagacagaucugucuguaccaagucugccagcguacccaucagaucaccugccacagcacccagcacuggacugaggaggagaucaaagcguucuacagaggacucuuuuaaucacacgugcacuugcauuuccucuuggcccuaggccaaauccacccucuccaucuugcuuucaagguugagcuuuccugaccuggcccuugucagccuguggaugucgcucuccauccacagcccuccuucuggacccacuuugcagccaagacuaugaucuuauuuuggguuuggauauacugauuacauuuuagcuucugguauauuuucuuaccugucacaggcauuaaauuuauucuaauaguuacucuacccuacugauagccacuaaagggggaauuggauauugucuaucaauuggcuagucugugaacuaaggcuguaucuaauuacaagauauuguaucaguucugauuuauuaaccauuuacucugccugggcgaaaguagcguuuuuaguagcaccgggcugccuggaugaagcuuucuaaaagggcagggugcccggaauaucugaucguacaguuauuacuuugugucauauauaaucuuguuuuuucccugcaacaaauaaaucuuugggacuccuagagaaaaaaaaauagggaggaaaaaaaaaaacauuugugguuacaguauaauaaaaauaaaccauuugucgugacuguagcugacauuuaucagcccguuugugggugcucuuucucucucucucuaauacagaacauaauuugucacuuuguaaauacauuccagucuaaaucccugccagcaucuguuaguguuugaaggauuaaugugcuacccuguauaugucugcacuucccgggaacagcagagcacgugcuguagaucuuaggggagccaggaaaugacuuuuucccccucuguauuucucuacacaugacacucauuuggguccuuucuggguuuuucccaucccuaacccccauuugcagucuguguaggugccugagaucccaucucugcccgcccggcuucgcagaucuuucaaccuuucuucuuucuucccaccaucaaagucacggcgcguguuugcugcggaugggacacagugaugcuuugagauggacuuggcucgaguucaaguucuucaucugcuuuaugaacccuaccuaguuugggggcuuuuuuuuuccaucuucucauuuacaaaauggagaugcugaacaucuacuucuuaaaggugcuauggauaaagggacgugugaacguggagugcuguagcugugcgcgagcuggggauugagugugggaucguuaccucuggucguugccacgauugaagguguuccuugggagauuccagugcucuaggcacugcuuuucuauuuguccagaaauauuuaccgcccugucgaugaggcgcaucucaccuucagccugugggaaacugucauucugaagaugggcuggagcuuagagagggcagaagcuucaucaucuacaucuagcgugagcugaguccugggucugucucccaggaauguagaaagggagagagggggagagggggagagagggagagaagagaagagaagggcgggguggggagggcuggcauggggcaaguugugguuuccagguaggcuugguucauggaaagaggguaggacugcaggguuucuuuacauuucuccaccaaugacaaagaaauucucuuucuugcugcaagcuccagauuuaucucuaaccguuggauggcaggaauucccuaaaggauacuggggccauuacuuauuuuuucccucccucccucccucccuucccuugcucucuuccuucccucccucccucccucccucccucccucccucccucccuccuuuauuccuuccuuccuuccuuccuccucucucucuucuagaauguauuuauuucacuguauguguaggaacgcuugccuuacugucuuuaugcacaccgugugaauggcugguccccgugcuugccagagaaggcaucaaauccuaggaacuggaguuccaaauggcugugagccaccaugggggcgcugggaacugaaccuugguccucugcaagagcugccaguguucuuaaucacugggccaucucuuccaguccccaaguaauucuuaaugcuuuguggagugaccgcaggcugucaauugcuucuuaucugcuaauuggcacuuggaucagaaaaaagauuucuagacauggaaaacauggcuccugacuuuuucuuuuuggguuuuuguacuuuuucuguuuguggcuguuuucuugcagcgcuagcaaccagacccagugccucaugccucuugagcacauguuccauuacuggauagcaucccccagcacauuucuucauuuucuugccuuuucuuucauaucucuucuacccacccaacuccugaaucuuucugcaacucuuuucucuguaguaaaacagggaaagcaaaguuucuuuucaggaagaaguuccuagguauauuauuuuguucuuuuuuuuuuuaaugcauagaggcacauuaauaggauaagaaugucucaucaggucagggaccuaagauggggcuggcaauaugcauguaccucacucauuuggcacguuuuuccaaaucuuuagagaugcuaacauauauuucuaaaaaguucacauuuaagaagaaacugagggagccacaagcuguggguauucguaaguuacccaggcuccagaaguguuaccucagggaauagaagaccccuugugcauggugaaauuuuauaauaugcucacaaaccaaccccuuagaacaucccuaguucugcucacuuuuugggauugugaaugguugcucucuuuaucaguagccgguaugguaaaacgucaaauaucugcuaguaaacaucugcauauaaaauacuaaucacagcauugaccaacaucagacagcuuaugaagacuguuuuaaaaaaaaaaaucuagcucuauaacagggaugcgaagaaauccagcccuguaacuaugcuuguaaauaaaguuuuauugaggcuuugcccacucacucauugcccaugucugcuuuuuguaugcaugcuacuuggugcuaaauaguugggagaggcaguguagcccacuagaagguuuagaauacuucagagaaaauaauuugcugaccugugaucgaguacgauggccauucagaggaaacaaaaaauaaauagauaaauaaauaaauaaauaaauaacaaccaaaaacaacaacaaaacccaacucugucccaccaaauuauagugagcacauaauuaggccagguccuuuccuucugcacacauggaauuacauucuagugugagucuccguuauccaacuugguuaacccacagcuuggggguuggaagcaggagagcauuugagguuagcuccccgacccuccaccacaaagcuguaauuuaauguuaugaacaaaauagaaagaaacaaugaaggggauuggagagagaaagagagagagagagagagagagagagagagagagagagagagagagagagaggagaaugaaugugggcucagugguuaagcucacugacugugcuucuaaaggaccuggguacauuuccuaguacccguacccaaguggcaguucaaagccuagucccagggaaucugauacccuccucuagccucuacuagcacuguaugcaugcuaugcgcagacauauauaaagaucuaagaagaaaguucugguaugaagagaacaucuuuuaauucacccggguaugaauuaaaaaccucgagccccagaggagggcggcacagcgggccuggcuguuuucuuugguuuucuuuagguaccacauguaccaagccagaguuuaagguggacagcuccgggcugcccugugugucuaggaguggggguguucuucuucccacgaagaguguaugucugauccagccaaggggagagcgaagaggcugcuuauaaauauugaagaacccgugagugugugcacccgugcaaagccacucugaaguggcuuucuaauggacauuuauaaggugguguccccccacauccccucccugugcuaagcugucuagggugcucuucagaaaacauguagucuauaacuuagcaggcuuuuaacagaauccuacaugauccauucaucccauuugacuagucaaugagagacaagacuccagaacaagcgagguaugaacaagccaagcccuugccagcgugcuuccagagcugaacggaaggccccucccuugccucuccugggccuucugucuuuguuggugccccagacagccuuccugcaugcagcaccuugugcaaacuugguuuccuaacguagcccuugcuaggugguuggaaagucucagacaccuagaggccaacuuaacccccggucccucccucuucuccccuccccuccuuuucuuaggguuucucagccucucucauucucucggucuucccuucccuccucacucuuccuuaccuuuguucuuccuuuauccugccuuucuguuaacccaucccagcuguagggauaccauuauuguggagaguuggccggcucgaguuaacagcacuguaccauacagcauccugggcauuguccacaaccacaucaaagucaucaaaaaguacuacauuggaaagucgagacuucaaaacugaauauucaaaguauguuuuauaugcgaagacuaugagguaggaagaggaagaguucaugaaaugccgccccagagccacuuaugaagagcucuauuccagauggcauagaaaucaaucgccucccugaauuuaacaaugaagugucgagaagcaggccugucacacgccacaggagaggacaucuuaccugaccccugaacgacugcacccagccacaggagaggagagcugacccgcuaaccgaacgacaacacccaguucaguguuuuucucaggagaaagcccaaagaggugaaaauuauccacccuccuaugggucauuuacccaaaagggucacucucagagggagcacaagucagccgguucagaaauccaguuaaacauagcucguuaaaacaaaggagacacugcuuaaggacagagccccauauagugauagccuuuaacgucagaauguaacaucucuguacagaacaguuggccacaagacaucuuugccgucuccauugaguuuuguuuuuuuuuuuuuuuaauuaccucaccccacgucauuuucuagucagaagauaacaucaucgcuucguggcaucugcaagggcuuucuguggguuugcauguaacugugucuagauccaagccuugcaggugguugguacuaggugauaggucaucauugacuauugucgcuuggaugaaugucacgaacagaugagcuuuggcagggaagaaaaggggaaggaugugaggagguaauacccugugggggagggggaguuugccuguaucuauaguguucauuuuuaacguuuaaaugccauauuugaugauccugcccucugccucaaaacaguaucuacaauucuucagauacaauuguaucuuuaaucuuugcauuugcagcauuguuuauuuuuuauuuuuuauuuuuuuuacacuuuuucuuccucacucucuguuguggaacaaacacuuugguuucuuuuuuuuuuauagcugauuacuuuuuuuaaaaaguuaaggaaauucuuauuuucaauuauguaugugugcgugaguuuaugugcgcauacauucgggugccuaagagggucaggaacgaugggugcccaggaauuggaguuacaggugguugugagccaccaaauggguccuggauccaaauccaggucccuuuuccugagcacucgcugcucugguagaaaacucugugggugcagccccuguuuguaacccagagcagaguuuccgguccugguuaccucugagcuaaauucuguucuuuauccucuucaaugugaguuucauucuuucaugggucuuguagccucgugugcugcugauguugauguuguucuuucuuauaagccuuuuauaguuuuccugacuauucucucucucucucucucucucucccucucucucucucucucucucucacacacacacacacacacacacacacacacacacacacacucuuugcucucucucuguuuuuugcuucuaauucuuagacaagguacugcuggagauccaauguuuccuacuuuguguugccuuuccgaggcagagucuuuugcagcacaggcuauucuaaaguuacuauguagcugugauacuguguagcugugauacuguguagcugugauacuguguagcugugauacuguggagcugugaugcuguguagcugugauacuguguagcugcgauacuauggagcugcgauacuguguagcugugauacuguggagcugcgauacuguggagcugcgauacuguguagcugugauacuguguagcugugauacuauggagcugugauacuguguagcugugauacuguguagcugugauacuauggagcugugauacuguguagcugugauacuguguagcugugauacuguguagcugugauacuguguagcugugauacuauggagcugugauacuguguagcugugauacuguguagcugugauacuauggagcugugauacuguggagcugugauacuguggagcugcgauacuguguagcugugauacuguguagcugugauacuauggagcugugauacuguguagcugugauacuguagagcugcgauacuguggagcugugauacuguggagcugcgauacuguggagcugugauacuguggagcugagauacuguauagcugugauacuguguagcugugauacuauggagcuaugauacuguguagcugugauacuguggagcugagauacuguguagcugugauacuguguagcugugauacuguggagcugugauacuguguagcuugaugcuauggagcugagauacuguguagcuuugauacuguguagcugugaugcuauggagcugagauacuguguagcugugauacuguggagcugagauacuguguagcuuugauacuguggagcugugaugcuauggagcugagaaggccuugaucuucugaaccuacugccucuuccugccgagagcugagauuacgaacaugcaucagcacacgugaucugacuuuuuauuuuagaugaguuuuggguuuuuuuuggggggggggcagauccgggauugaacccauggccuugagcaugcuaacuaaacacuuucuccuccagcuacagccccaguccaaaauggccaacaucuucaaaugugcugucugcuucccacguucaacaguguuuagaaggcugcucgcucccugaaucucugaccuccucucuuucuuuccuuugucucucaguuauuuucaguuuuuaaacuauuauuaaucauauuagcuauaguuaccgucaucuuucauacaucugggugcucugcucugaauaaaaggggccagccagcccauggaacucagcucaccaaugcccagugcucuccugccauuuauuuccagguuuuaacugaaugagacacaguggggccaggagacuuccuuccaccucuguccccuugcuccaaccucucuaccucuggguauccauuuccacccugcucucuccagccucccuacuugaggcaagaccauguggccuaagcgacagaggugauuugaauauguugacauugccuuugugcucuggcucaggguuaauuucagaacuaccguguaauugaaaagugugugcuuagggcucuuuugcgucaucagccuuguuagcuguuuggucuuggggcucuguuuuaucuacuuuaucuuuccaucucuaaugugaaugguaaaagccuucaaagggugucagauucuucccugguuuaaggcuaugugcuugacacgugcgcguucaugaguuuucuugacuaauugucucugucuuugcacacugucccuuuucaucuccagcgacuguuuuuuuuuuuuuuuuuuuuuuuuugcuuaauauuggacuuuuauguaauauugcuggaugagcucuuacggguuuaaaggauuugucaguauuuuucccuugaccucuuuauuuucagccuuuugguauuuguuuuacucauguagcuuuguuaggugacgagaguggcuagaacaaauaguuuccagugugcuuguuugcuacaacacugggguuugaacccagugcccgacacauuuaaggcaagcccccucccaacuaaguauuuccaccuaguuuuuaauaugcucauaguuucaugcaguguugguuucuuuguaaguuauauuacaguauuuccuaaauucccacugguuggagguggauaagaaguaccgggaauguauauacucagguuggaggguccugaaggagcaugccccacuuauugauauucugauugcugacuguaaguuuguugcugugcuugauccuggagggcccuggguagucagucaaacugaggaccuuugaaauaugacaucaagauuugguaggccaccggaaugcuguuuuccagucuucacacccggggauggacuuuuugauuccuuccucacacacaaaagguacauuaauucuuuucccucuaaggcagggggucuucauguucacacauggcuccuaugaaguuaaaaaucaugcccacccuuauuuccacuuugagcaacagacauggagaacgucauacugucagcgggaucugguccuauuuugcaaagagaaggcgaugccagucacagucugugaucgaauccugcaguggcuggugcaggucuuagcagcaggagcaauuugcaccuacuccucaggggaagugucuuguggcucauccuguuggccccaucagaacugggacuuuagucacaguuacugaagucauacccugcccaguacagagucgggacuuggaauagaguuuuaaggcaggacuaauuuuuuaaaaacuaaguacgauuacuuguuaauaugagucagaucuguuuguucucaguccgugcauaguuucgucgcuacuucuaaagucuuucuacaacucuucauuuucuccccaucaucccuucuuuucuucccuuccuucuuuuuucuccucaguaucaacuccuucaggcuuuuuggaguaauggacuugaucugaaaagcagcaucacuaaucugauguaugcuaccggggugaauuuauucgaguuaacuccaagcuuauaaugggcaacugucucucaaagacuuuuccuggcugaguccacgcugucuggcuuucagcucugcaaaccuuggcuuucauuucugcuucgcaaguugaauaaccugcuuucuccccggcacaucucuuuccugaugacaccagggcacaaccuaugcacacuggcauuccagaugucuccuagaacuuugaccaaguuacaacagagaauggauagagaaugccaguaacuaacuggcccaggcauccuucccaugugugucucugauggacagcugguuuuggucuguugaugagucugguuucuauaggaucccacugcacuccauaugcguuuuaagguaggagaaauuugacuugaggaacccaguucaugugaggguuaggucacgauuugcucuuagcaaaaaccugccugccucacccuccccgcacuacuggcugaggauaugguggcacaguuccaaccacccucuuuacaccaaucccucccuguggagaagaagacugguccuggggcccagcucacucucuacaugugguguauauucugaauaaaaugcagagcugauuuguguugccuucugccuuuucgcacaugaauugaaaucuucucuaauucuugugacuccuaacauaccuguccuuauuucugcauuucuucucuaugacguuuccuuucucuacuauuauuuggaucuaucugggaguaauaaaacuguguauccuggcacucccugcaucagacuuuccguguugaugcagaagguaaaggcucuuuccuuucucuccccuucuucuauuacucuuggaauuuaaacauaaacaucuaagucuucucuuacacuauacacagucauuugacggcuccaucauucugaucacagcaaguuuggaccuggugauuuaacaguucagugaaaauucuccucuccacaaagcaaauuccccuuuucacguuauuucucuuccucacccaccuuguuuuuugagcguaauuuaucugaucucaucacucaucuaaaggaggugcauaucuuggcgauaaccugaccucaaacucuccuuucacacgaggguuguuuuaagcacuggaguccucugucuugggaguguuuuggugggguccuuuaaaaggcugcuggggcgaugcaguuuuaagcaggaaaccuuauuucuuucggaauccugauuuucagucucuccuaguuuaucuuuuagaaucucugccuugcuucugcagaaauucugcacgaucugucucuuuggcucuaucuguaaacuuaaaauaacugccguggcaacuccuccagcguaaugauaccaugccauguuuacaucacacccugcaugcccaagccuuauccaucaccaugcagggugaacaaccucagagaugccagcccucauccagccagcccgaaacacucaggagaggcuggauuaucggagggcugugggaaaagugggaaauggcuacagccagcaucaucagcuacguuuuaguucugccucuugauaccaccucaucugugguacuauauuauaugcucauucauucauuccuccauucauucauuccuccauucauucauucauucucaaaagucaagccgguccugaaaaccggccccgugccacugaugguauaucaaacaucagguaaagauauaacacuguagcuuuuaguuuacgcucugugucaacauggguuauuggauguuugaguuucucucagagccccuccuuuaguguuuguagggauggaagcugcuaguaccucuuuggaagacacccaacaaaaccucugaccuaaggcuucuacucaagacauuuccugaggugggaugggcuugcauaaugcuaugcgugucuacuacagcauugcuuucaccggaagaaacgagaaacaggaucacaucguucuugacaaacacaacagcuagcacauacagcaagguacucguugucuauuuaacacuugaaauuaucaaggccaucuucauacaugccacauacuugagucuucacaguaacucuccagaugaguucugauguuuguauguuuacagaggagugagggaaggcauggagaauuuaauuuaaaaauucaggggucaaggagauugcccugucacuaaguugaccuuaguucagaucucuaguacucaauaaauaaugaaugaauaaguaaauaaguaaguaaacaaacaaacaaagucagcauugugauauguccagggcuggcaaggagaggguguggugacacgagggucucuggagauugcaagacacuuggcauagaccucugucauacauauauggggauggggcuggggcagcaggcagacugacacagacagacagacagacacaaguucccaagcuauuaaguagguacucacccuuguuaccacauguggauugaaaagaacgaggguggaauugugcacucugacauggucaguuaucgacugagaacagcaaagcugugaacagugcugugccacaccccuucauuaguaaggaaagucacagacuaccuuuauauauguagaaacauacauucugacagaguuugagaugagcagguauuagauuacacguaccuuuuaaaaauuuauuugaauauauauauauauauaaugcauuggugugagggcaucagauccccuggaaccgcagucacagauaguuguaagcugccaugugagugcugggaaaugcacuaccuuuguaagcacuaagguacuuuuaagcaguugaagacucucaccaaaccugcacugaaccuugguguugcuggcccugggagccagaagcuucuuugucccgugcggcagacucgugccuuaugggaugcuugcugcaucacagcuucuauccccagguaccaguccgccucuucaaaauugugacaaccagaaauacccauggacauugcuggaugcucagggcauacauagacgggucccugaucaagaucuguggucagaugacaaucauuugcauccaucacugucuggaagggagaugguucucccauuucaggaucuucuaaccuugaaaauucuucgggcaagguauaagguugucuaaaccauggcagacaagucuugauuguugucuuuccaaucaacuucuucacuguuggccugccacuagguagccgaugagccccagaacucuggugggaacugugcaccucuuucugaacuuagacuagggugaagguacugaccuuugucccuccuaccagaaaauuccucaagguaggggguuccgaugcuuaacaacuuucauuaagaacucagcuaugcaaaauauauagaccgcucgcuccuguugagaaaauaauuauacaguaaauuagccaaauguccaguaugcugccuuuuaagcaacucuuugaugcucccaguacuuacagaagauauagggcguguuuauuaagacucuucaacuguguauaaagcuagaccaguccaaaguaauggugucugcugaaggagucuuuaucauaugaauuuaccuucagucauccauuauuuaucucagcuauuuuauaugccauuauaauaaauauuaugacagagaaagcuuuuaugcuucaacuuauuguacgacucuguacuugccugcaauccuucaggaauguaaccauguuuuaccuagaguuaacguaaaucaucacucacauuagaaugaaacauucacagugggggggggaaaacaaggcucuuucuucaauugcaaagcguaaaugcacccucguguugccugccaaacucacaggccacucagugcccugcccuaaacuguuucgaagcuucaaagugacuacaucaccgagagggaaauuggaaggcuuuggaauauuuucuacacuuuuguuaguuucuggcaagauaagcauuuuuaaaaaauccagaaauauugccaauuacugucuaagcauuuuuaauaguuuugcuuuuacauaacucuuaacucaauaccaaauuaaauacagugcucuccagcgugaguucuucuugcaauuaucuauagggcauugauagaguuauuuuauaagcugcgcuccaguaacggaaagugaaaugcucuggccuguacacagugaagagggaguugucaugguuuucucauuaaggauguuuguguauuuuggcaggggggacgcguggguguuuauggggagccugggaaugagaguugauugugaugguugguuucaagguuagaaaugacagauucagccgcucuccuucaagauuugaagagaaauccaggguucugccaaggaucguuuuggguuacuucccaguuucaaagugugcaaucaucaugagagugcccccacccccaggcccgagcauuuucuuauuagaagcaaaauagaccgauggcuauggugcugcuugccuguaauccggaacuagggaggccagggugggaggagccuacuuuuaaagcaagcaugggccacauggcaagacccucucucaaauaaccagggcaaaugggaagccacauacuguauagaguaguuaaaauguauagggucagggaagagaugcuacaugcuuccucuccuggcuguuggagagcacauuuauuggcaucugguuuguacuuuuaagccugucuuagaucaggcugacuccccaccaaggcuacuccugaugcucgacuggacucacccaccugagagcuucagacaucacaaaucaauucaagcuuauuuuuuccucauacauuucccagugguaagacugccauucuuugccaccauuaacauccuuaaacaauacuggaaaaaaaaaaucggugauccaaaguccuguuuagauagaauaucggugaauuauuaaucugguuugguuagaugcugauuguaguucugugaauaaugucaugucaauaauaugcucggcaccaguaucccuugccauuguaaaugugacaaguccuauuuaagguugcagaacauaaaaccaggacugagagucuguaaagaagggcgagagccgucagcauaaugcaauuaaggcccauuggauuagaauuugcaagaugccauuagcaauaagcucugaauguagauuauagcuuugcuuacaguggguuuuuuuuuucucucccagcaauaacgaugcucuuauaaauucuaaguguguaaaauaaauacaauauaaaguagacucgaaugagaauauauggguguuguuaauuucuugguagcuuccccaagcuguguguugaaaggaagcagggccagauugcugugugguguccccuaucuuagcugucaccugcccauucccacugugccucuucgaaguucaccagacuuuguuuugucaucuauauaaacugugcacguuaacauacacugcauagggauuuucaccucccugucaaauguaagagcagcagggacugugucugguugcuacucuugcugcuuuuauugucaaguugguaucuuuacacgcguguuucuuuuacaaggauccagaaacaaacucucccuguucucccaggaguggggugggcagaacuaccaacucugccgccaccucgaagcaauacugcaaaguuguucuuucccucuugucauagucaguaucccauugcugugaagagucgccaugaccucagacacuucuauaaaggaaagcauuuaauucgggcuggcaaacagcuucagagagugaguccauuacugucauaggggagaaugaccgugugcaggcagauguggugauggagaggagcugagaguuuuccaucuggaagagaacuccaucuggcagcagggagagagagagagagagagagagagagagagagagagagagagagagagagauacugggcuuggcuuuggcuuuugaaaccucaaaacccacccccauugacacacuuccuccaacaaggccauacccacuccaacaagaccacaccuccuacuccuuucaaauauggacuuccucagagccugugggggccauucucauucaaaucaucacucaacaagacaggaaguguggcccacaauggacagaacacucugggcauguuagaggcccagcucugugaggccacuggaggccuccguauaucuccauccauugucugccauagcccuaagcacuccuguuguuuuauguuuuuaacagcauuuuuuugugcauuuguucaggguugucacaguacaggugugaaggucggaggacagugggaguuaguucucucuuuccaccucagcucgacugaccacaggagucaucccuuguugcccuccucuugacucuuaccaugauggugguuuuaacaaaucauaccaguggagagcugcugucuucugcagcauuugguguguugaucaugcaggccagaguaugagucagaauccuuugguccagaugaauggagagugcagagccuaugaaauacaaggauaauguguggcacgcccuucccccaggcuaggccaacacaccaaauacugcucaugcuguaagaaugucugcugucuuuuuuguuuguuuguuugguugauuuugauccccuacccccauauguuuuguuuuugacuauugucuuguuugguugguuuggcuugguuuuuuuuuguguguguguguuuguuuaauuuguuuuauuuuauuuuauuuuuuuauuuuuuucguuuuugacugcuauccuuuuagguagguuugaucacaaaauguuuucuuacuuuuuugagccaggguuuuacaaugugguccagucuggucucgagcucaugagaagaagcuuccagcaugagccuccccaguguugggauuauuggaugagccacugugcucagcuuccuggaauuauuucuguuucacuucuaagauuuuauuuuauggggcacgucuuuugucugccucccuggguaagcagacucugagugggcaggacuuccucugaugugcugcacugaagagagaggcccaggagauggacuucguggggaaucuuuagcaccuuccgaggcaguguuaaagacugaaugcauggaagagagggaugaauggugucucccuuaguggcagugcagcuuacaacacccugcuuugucuauuugaugauggugagcuuggccucaguuguuagcaggggccacgaaccaggccagggaccugguaguggaccagaggaaagagguggguugcauggacacugugggcuauagaagcaaaagggagggaaaucuccacuuaguauggacaguggcccuaucugggugaagucacagacuucuucuucucuguggacauggguagauggcugucaggagagacagauacaccagggccugggcuuaugggcagcuucuugagauugcugucguuggccagugaggacccguucuugucagugagaggugaagccauccugagggagacaagagagcagugcacagccaccguggugacucacauucgugagccguuucucaguggugaucuaugcucacagcccguuucucuggauggguuccauucuacuuuacaaccucaguccccaauaaacagcugcuaucauucccacauuaccaaggagaaagccggaugccucgggagaaauauuuuucccagcauucugguggcuugauccaugguauaaucaaacccuuuacuauuaggaacauacauugacugggcucggaaaggcauguguuugugacuuaggggagguucaguggcuucccccagagucucaaaucaugucucagccuucaugcaggugcuguugaauucuuccccaugauaguuaucagaguuaagauuagcaaaagaagucuauagucaccaucaugcuacagauuguuauugaaaaccagugggcagugugcuugaacaguugucuucaaguucacggugguagcauuuucugauggucuuguaccauggcuugcauacguaauagacuuguuuccccgucucaaaaggcaaguaccauuuaugcagauucucaagucaaggcagccugaggcccagcgcugcucugaguucuguugucagugcuguguggucucacugagcugugaauccaggucagccuggcucuggcuucucuguugaaagugacaucauguuuccagcuugcuaucuaaauaccucaugcugcuccccaucugcucgcccugguuuuaggcaguaucacaugugagccacacuuggcugauuuauacucaugaaguaccagagcacuguggcguaacagccaccagcaguccauucgugucuacguggacagccucaugauucgugggcacagguucuagcaugucacagugagcagaaaagaaggcuuguauccugaaggugugucuuuccacuucgacaccaccucuaucucagagaaacaggggaggagagcgugggcucuugaaugaucucccugguugagccccacguauugggacaagcaggcuucuuagcgcucuuggaguuuccaucauguaguggaugccccccugggugguucagcuuuaacauguggggaaggagaagcuguauguauaauuuauaaucaauuaacaucucgauuuugccacagaagccaacuugcauaguggucugauuaugugaaacaguaaagauuuggggaagugaggcauugcauauucuuagcauggaguucuuucuguugaccaaagauugauagguagguaaaauggucagaauguacauaaauauggaaccuauggaagacuucccuccccuccccucccuucuccuuccccuccccccucuccuuccccuccccccucuccuauccuuucuccccacuccccucccuucuucccucccucccuccccccucccucccuccccccacccuuccauccaucuccccaucuccuccagcuucuaugcuacugcuuuguagucaggucugacguuuugcacacaguccuccugccucagccucagccuccucggaguacugggcuuacugcauuugacuccacaucuggcuguggguacugguccugcauguuuauugcauguuuauuauguucaucauacuuguuaaaauauuuucuagaaucgaagugaguuugaagcaagauuggggaguuagacagacgugaguuucaugucugccaucuccauccucauccuggaucaccauucucccccagggcacacgagauuuacacuguauuacaucuuguaaccacuuuuccgucaaugaggugugauuguaagcaauauccuccacuguccaguggaagccucuugagaucuuguguguagcccauugcacugccugcuguggaggcaccaucaugacaaagaugaaccuggcuuugcuaaaugugagcagugaaggguuuguugcuguguuauaaugugcugauucagggccuguucccuacagcccuugaugaccgauagagaagaccuugcuggauaugcuaaggaauuuggagauuuugcugguccaucugaauugcaaaaggguuuguuuuuuuuuuuuucaaagauauuuugccaaaguagagaccgggcuuuggccaaauaaggcuuuucauguucuagaugaagcgugcuaacucagccacuuguuaacaaaaguaauguuuuugguuuccuuuuuauaugcgugaugggucauuuccaaaucuugaauauggagaugauuguaugaauuguuaccuuguucucuuguuuucuauugcugugaugaagacacaaaggcaacuuuggaaggaagggauuuaauuugacuuacaugucuugauuacaguccauugcugaugguaggcaaggcaggaacucaagcagggcaguaaucuggaggcaggaacugaagcuuaaaucaugggggagugugcauacugucuugcucagcuuccuuucuuaugcacccaggaucaccugcccaggggauggcuccgcccacagugggcuggacuuuuccacaucaaucaguaaucaagaaaaugcccauaggccagucugauggagacauuuucucaguaauuguuuccuuuucccagcugaccuuagcuuaugucaaguucacacaaaaaaagcaagcaacacacacaaaaggaaacgucacauaauuugacacaaauauagaccaaucaaaggaaagaaaaugaauauaucuccaaacugguaaagagagagaaaaacaaaaacaaacaaaaaacagaaaacagaaaacaaaaaacaaaacagacaacuauaaugacugugaaauaauaauaaauuguaguauugagagugcugagauuuuuagguuauggucauguacuaucacuagugugauagcaccacuauggggagcuggauggagagaccuucuauacuaguuuugaccuuuucugugacucugucacuacucccaaauaaaagcauaugcauuacaccugcucagugacacguggcccacccuagaucaaucacugacagucaccaccaaucuaggcaggaaaucucacacuggcagguugggcacccugccuucccuccccugauaacccacagcuccacccuucagaaaugaguuccaucugcugucgcucuaccaggcgacuccauucccaguuagaaugcaagccacagucaucauuuugaugaagcugcgaaguuugcuaggcaaccaggagggcaaacuuccuccccagcagaggaguggacacacaccccuacucuaauucccaaaggcacacucuuccucccacccccaagaccucacugaguugcacacaguuuuucagaagcaagaaaccugauacccauggcagagaccucugaaucuuccugugaggacuggagucucuguccccaggagccgaguaaccugcagcuuacagauuaguggggcgaccucucacucccccuggauauauauguccuggauuuguucuuauuagcaauggcagcucagcaguauauuuugaagaauaaaagugugugugaggggauggggaccaaaagaugaccuaacgauuuucaguuacacacggagaguaaugugugggucacuuggcucggccauugguuucauuggauugauuuggggucaccaucugggaauguuaucccuguuuuaugggggaaaauauguacauguauuuucauaauguguagcaugcauauccuuugggguuuccagcaaggcaugacgauuuuaaugaaugccugauuuuucuuuguaaauagucacauuucuauaggauucuguguaucucaaugauuaccuugcccugggcaaaagggagaugggaugcaugggaguuaggggcuggggugggcaggggcugacgguuuaucugcuuguuuaaaggucugaucaagcacuuaaguguuuaucaugaacaagaacgugggggaguacaagucaccugucaacagauucuguguaccuagcagaauccuuaccuauuggauaaacacaaguaaauagaaaagugugggacugaauuaucauuucugcagucuauuaagaugccacccugcaacagagauggaaauauucccuaccacucaguauuuuuuacagauuuauugugugugugugugugugugugugugugugugugugugugugugugugcccacaugcaugcauacaugcaugcauacaugcgcacgugcacuugaagugcaagugaguaucuuuggaggccagaaaagaguaucagguccucuggagcuggaguuacauguaguugugagcuucccaacaugagugcugagaaccaaacucuggucuuugagaagagcaacaagugcucuuaacugcugagccaucuccccagcccuuugcugcuguuauuuuuaauggcaggucuuucacuggcuuggagcuucugaguagacaacacaagcugaucagcaagucccagacauccuccugccuccgccuuucuaguucuuggauugagagcaugugcuaccacaccugguuuguaaucauacauagguuauaguaaucaaacuaacauccucuugcuugcauggcaagaaauuuccuaacugaucaucuaucuccccaacccugcucuuuauuuauuucgaguuagagcagcuucucaccaggcugccucauuugaccuuaaucucacucaggauuguaaguguaugccaccgccccuggcuggauugucuuuaagggugaugcaagcucaguugacagauuucauaaccuggguugagucuuuugagauuagaacuguccauugcaucguggccaggcuugcucuuguggccuacccacccccuaguagaugcugcucuuuggagcacauauuuaaugauaccaugagcuagaagacaccuuggagccucuuccgugugcugagugaagccauguguaaccccagccuagagauccagcugagucccucccaugcuccccggacuuggcaguaaaagcuguguucuuccauucauucuggugauguauagucucucugggcuucuaauauuaaacaggggaauuccgacauguuccauaacgcauuuacuguaacuugauaccacgaaccauucuugcuguuauuuaucauuucuuucuuauuuccuuucauugcagcacaaagccaagguggaagcaaugacccuggaccuggccgugcuccguagcgugcagcauuuugccgaagcauucaaggccaagaaugugugaguguuccaguucgggggucauacaucacaauuccuuccuauuguaaugucuuuaucagaugaacaccaccgggagaacacaagacuguagugcugucuuggcaccagaggcucauuuauauguacgguuaagguggaccguauuuuuucuugacucugagucacccuccucaugagaugugucaucaaucuaauaacagcuucccagaccaaaaagcaagaugcgaaggcauuauuaaaacuuguagggcugaugcacaccagggcaguuuucagaugcgccuuguuagaaacgcauugcguaucuaucagaaucgaggaagagcguaccucaagggcauccgacaagcucacuuacucuguacuaauggggcugaaacccugaacaugcugucuucuggugcucuguaagccuuugaugcucagacaugggguguggauacagcucuggucacagauggggcuuguaagacuuuccagccuuuuccaacuccugggaacccacaguccugguuggaucuuacacccacugcaucagcugacauuggaaaugagggaacguucuucaccaacuccucagauccccuuaguggaggugcaguggggguggggaugggggugggguugggcccuauauacuguugcccuccagcugccuccccucccuacagagaaagaagagaagggaaaugaagaagagaaagaaagaagggaggaggagaggaagggcaugaaguggagacccagucuccacucuaaugaaagcaguggcggcuagcuauguuacaauuacaguauuuuguuuccaggguuuauuuucaugguugccucuauagggccaagcagcaccgcugucucauuuaccacaguggcuucaguuucauuaauaaauaacuaagcuuaauuuuauuuuccaaugaggugaugagagcgugaggauuagguuaauccuagcccagguggugccaagggggaaaacaguguugugagggaguccagcgagccuaagaugguuagggcucagaugaggccacgcugacauccccugagaugaugagaggugugggguauucaaaugcuaugguguuaccugguuucuagugcugacuccauucugauccuuuagaccaucacagcauuugaucuuugcuuagcaagcaaguggucugcgccccauggacagagcauccugguccaggugcuuuuauugcugccaugugaagaccauuugguggcucacaggcacagcuagauccaccacccccuccagucuugcccaucagaagugugagucucacuaugugcucuuucuggugccgcguccuuaguggcagcccucucuugcaagagcucucugaggggcuggaagccaggaauagcaucggcuugcacauuuguuuauucaucccguccuccgucauuuguccguuuacuuaccaggcauuugcugagcacuuccaaacucccagccauucuucugggaagacagugcuggccagcgggagucaagcgaccucagacaagccacagccuccguucuagaagcuguguuuuauuacugucgccaaauccucaucccaauaugccugugguuguugagggacaaaauuacuaacaaucccagcagcagaaguuacagcucauuuugggggguccagccaggcacacacauuuaggacacuuuacucucgccuucugguucagaucugaaagcauucuuucauggugggagugacuauguccauuacacagaugagaaaagugaggcuagaaagguaagggaagagauguauagucagcauuugguagguggugggggcaagcugcuaugugcccaucgcaccacgaucccuccuaacuccucugcgaugcugucuuuuguuguaaagguaauagggacuuguacucagagaacuagugagauuauuagggucacccaggaguugauggccaaaggaacaucccguccauucuuacgcuuccuuccuccccuauuugcacuguccugauuggguacugaagugagcgucucggcugaagagagcugacagcuugaucgcagccccguccuccaucccucaaagcagucauuacauuuuuauccaguaaggaguucagaaacuaucaugcuugagggcccuuugcagucgcugacccagacucucucggagggcaagaccacccauuucacacuuagucuuugauuuuuccaguacucgauuguucgggcccaagggugcuuucccuucaagccucuccacguucugcuuucucugcaucucgaagaguggcauaagggucgcaccgcauagagaaauacugcccugcugaaaaucuguaaauaaagaagugagcgauucuccccucuugacugacugccaguacccaagcuuccccugcaaaggcagacgacagcuccgugcuaacggucucuggaucggggagcugucacaagugaauuuaagugcuggugaccgggcugccagaaaaacauguguaacuccauucuuaucaccgccacccaucuucagacauuaaaauuuccuuguguguaaaacauaaugacaaaugaaagcaagccucaguucagaaccaguuuuuuucuuuuuuggugcaaguuugaccaaagagccucucuguguacauuccacguggacaccccauuaugcuccuuuuaauagaucuuuucggagugugcacacaagacccuggaauaacaucagaaagaaagaaagaaaaagagaaaaagaaggaaggaaggaaggaaggaagggagggagggagggagggagggagggagggagggaggaaggaaggaaggaaggaaggaaggaaggaaggaaggaaggaaggaaggaagguaaaggcaaaaugcuaguagaaaaugcagccauccacacaggcugcagaacuggccucucucugccucggggacccugggaaucagccaccguacaugucuucccuuuggaggcugggguggggaggcaaagacugucauggugugaacaggacugguguccgcugcagaagcaguaggggcugaccaaaggcuuuguucgguccacgcacggcggcagacagaacucuuucccugcucugugugugccuguguaagugugggugugcacgcacauugguguguguggagggcagagguugacaaagcaggucuccugcagccaccucuccacuuaaguuuguguuguuguuauuugguuguuuuuguuuguuuguuuguuuguuauauuuuuuuugacagagggucucuguacugaacucggagcaggccacuuggcucggcuggccucucaggauuccuccuaucccugcuuucugagauuauaggugugucucccucugucuggcugccacauguguggugguuugagugaggauguccccccaccccaugggcucccguuugaaugcuugguccucgguagaaguauuugggaaggauuacgaguugaguuguccaguugaaguugugucaccagcgaaaggcuuugaggugucagaagacucccaacaguaccagugugcuuucucugcuuugugcuugugaauuaagguggaacuucucagcucuugcuccagugccaugccugccuuccugccaugccaugccaauaugccccccauccugauggucauggucuuggacucuaacccucugaaacugugagccccaaauaaaacucguucuaauguaaguugccucggucacgcugucuuagcacaauaauagaaaaguaacuuaguuacuauggacccugggggcucaaacucagguuuguuuguguagcucaaacucagaugcauguguagcaucugccuuacugacagccaucuccccaggcccugggcaaaacucaugugcaugcaugcgcacacucuguuggccucuuccaguaacccuagguucucaccaucuucacucaguuuaccaaaucagaaguuccaagcacacgagagucugagucacuuucccuuugaaucauguguuagguagagaauuugagcccaagauugucugcauccagacacagagaagaagugggaccauuugcuauugccgcucugcugggguucugugcagaccgccugcccagucugccuccccaaguuguuugcaugcugccgguucaucuggguggccagcucgggaaccuggaucugcuucuagauguuucuccccagaguuaguggucgugguggucagccaguaucucucaggcuaaauuauucugggcauuacuggaaaguucccaaccaaagacuguggcaguuucccacagagcuauauuuuuuuuucugaagauauuuuuguuuaaauuaggauucgggaagggagccagccuccacagugcuaguaggcaaggguuucugucaguggggagcagcuggggcgagucucucucugauaaucacucuggcuggucuucgggauggccugugacagacuccaaagccucagcuucuuggugaugggcuucguauccacuuucaaucugacuggaacuucuucauuuaccagaauagaaagccgacaucuuggggccuaaaacagcucgucgguccaaggacaggauguuccagaagcauguucuuucucacuagaguucugucguccccaauaaaauggaaggcugugcuccaauucuucaguguuaaaaguugagacuggcuugccauaaaggacguggguuccuaggagucccuugccagccagcucucauuggccaggggcuucauuuguccugggagggaacugcaguugauagaggcuuuguauuaaucgaguugugcaauucugaagguuucuagaacgccguuuuucaucacggguuucuauuucucgucucagcuuucugucuuugggauaauuuaaauaaauuuggcucaauuucaccaagaaaaucauacuaagauguguuuuauuuaaagguuaaaauaaagguuuucuauccuuauuaaacauuugaggagaaaaaucuuuagcaaaauuguuuauuuuuacguuccacuggaugacuuucagaaccggagcuucuaacccgggauauuauauucuuggauccauauucuagaguucugucuccuuuccaucuguagaagugggugggcuauacauuauuaaaauaaaacccaaauuuugagggauaaauuacccagaauaccaauguguaaauuauagauuaaucuucccuuuucccccuagcucagcucugagaguaauguuuuagccaucauuucugcauccaucuuugcucaaugugagaaguccacccugguccaugcaccgggggucgggguggggugucgaggguggggugggguccuguugcuuugcuuucugcccagugugaaccccaggaaagacaacacagcgccugguuuucccugcagcuuaugcucuucauucuggucucuguuacaaugguucaugcccguuuugacgaagccuacccacucauuguucuucuacccuauauauuuuccagcuuaaaacacagagaaaccacacuacaggccauuuaauauaucuagaaacaccagggugguaacagcucgucucuuacaaaaucuuuacuuuuuuuuuuuccuacuuagcuuuuuaggugaaaaucuucuuacaugacauuaaaauacauuucaaaagaauaucauacagcaauccuguaucaaacaaacaaacaaacaaauggccuaugucaauuagugcaggauaaagcaggaaucagcacauuuuccuguaaagggccagaaagugaauacuuuuugaaugaacucucuuugcaagaacucaguuuugccuuuguagcauggaaacagccguggguaguguauuccaauaaaacuuuaguguuaaaagaacugugggcaguauguaucaauaaaacuuuauugacagaacaaccaugaacagcauacaccaauaaaacuuuaccuacaaacauuccauagauagacuucucugcaggcacacuauuuuaaccaugggacaauagcccacaaucccuccuuuaguauaaauaacagguuuugggacaucagcugcauuuagauuuaaauuucagcucuauuacaaguuccccccuuuuuaggauagagaaucacgugacugguuaugaagggcagacacauaaagcuaaucuuuucguggucagcuucaucauucuguaaaagcugccucgggauacuuauuaugugggagaaggaggaauuuguguagaaugguaugcuguaccauuuucugagaaauaccucuuuaugggaaacacccuguguccagguaacacccugaauaucauuaaauaaggaagguaccgaaccgaagcuguagugggaacuugaaggcauagaaugauauuggugauggcugcuguuuaucaguucuuagucauuugucuuauacagcuaaggggucagaaggcaaaaagaacuacggugucucccauuuguacccaguucaacaaauaauacauuuuacaggucaagagauuuaagaauccucuuuaaggucauccuagccaauagcugguaggcgaggcuagaucuuaaccccaaaucuccacggagcucagcaaccucaacuauuuggaaaauaagagcgauccaacuuauuugggaaaagcacuguguagcacaucucccccccgcccccccaaggagguuugucccauuaauuggauggaugacagcccuugccuacugggaugauuauuaaggucaccucaaggucagaguugaugcuuugugaagcaaauuuucuaucagugagaggagauuuguuuugcugaguuaccuauaaaggagguuaaacaggcccaucagagcagaggcucggccccucaauuaagguacccagacuauuuucuuccaaauguuuaggaggugccucuccuuggaguccccuuaagcagaaacggcagcuauuugcuuucauuuaccauugaagguauacauuuacuccaaaugucaguguucauuuccccccagucccuaccugucuucaaaaugaugcuuaucgguagacagaggaagaccaaagggucauuuugcuauguacaccucugaaacagaaccauuauauucacaugcaaacucagcucugacuccaacugacucagggccauccugcugacugagguacagccucuaugcuuacugauguugucugcucaggucucagagaccggcucuaauuucuugugucuuuauugauuccccccaccccaaaccuaugccucuguaucucacacucguagaaacaucccuaggcucugcacgcuggcucuagccauuaccucauacugcccccucauaccugccugucugcgcagggcaugaccauggguuucuacagagccucccaccuccuuccuuuccccuuagcuccacuucuguaucaacagcucauuucugagaucagcuguucucaaccuuccuaaugcugagacccuuugacacagucccucguguuauggggacaccaaccacaacauuauucuguugcuccuucauaacuguaauuuugcugcuguugugaaucgcaauauaaauaucugauaugugacacccccuccucaaaggggucaugacccacagguugaguaccacugucuuagagcaucaacaacacacccagucaucccaggcaauacucugggauguuuccuguuuucuguguugacuuuugguugcuauuguuucaccaagccccagggaccagaggcaucauucucagauuugucucugacuucauucugugucuuuauucuguugccuaugaagaccuuggcagguuacucugucuuugugauccucaagucaguucauggaugaauaugaggagagacagucaaagcacucuagggucauugagagggugagauagcauacucuucucacaauauuccgccuggugucugguguucagucaguacagaauccucaucuuugucuaucucauucucgucuucugucguauccaucacugccuuacgguaaguacagagcaguugauggauggauggauggauggauggauggauggacgaauggaugcauggauggauggauggauggaugggaggggaggaggaugacaaacugaaggcauauggacucauuuggagaaaauucauuuuuuguuuguuaauuugggggccucuuuuugaaaccauguuuuugauaguccaggccgggcuugauccuacuaucucuacuugcccauugcuggguucuaacaccaucugcauuuccaaacuugacuuuuaaggcaccgauuuucuaccauucaguguucuugaacgaauuaucccccucgugccucgugcaguguuaagauggaaugugucuacaucuugggaaauggccauuaaagaucuuuuuaaaaaaauuauguguauaugugaggaugggaguggagauuucuguucacaauuucaggagcucuuaggcucuagcagagaggguuggcuccucuaacugaaguuauaggcaguugugagcugccugucaugugugcagggaaacaaacucauguccucugcaagagcagcagguccucuuaaccacucugccaucuauuuagccucagaaacugcuuuuaaaaaggaaucguacuugccaugauuauuuuagacaaacaaacuaaaggugccccccuaggaaucuguggcaauguagcugcaucaaagagucgaagcucccugaucuggccacggacccuguguugccaccagccaggcacagcucagcccaugaaaccuguucuuugacccuuaaggagaccaccuagccugccagcuuugcagcaaauccaugacaguguuaauauugggucacucgaggagcccuagauuuaugugagaccugcgcgaaugcacucuagcaucuguuuuugagccgugugcuccuagaguggcucaugaaugccaugugaguucuuccccuuauacaguucuuuccaaccccauugucaggucaggauuccacguuuacauaacugacacauugagacaccgugcuuaaacacaucugaauaacaagggagcaacuuucauccucagucaguuguugagaaguuaauucuuguuaaccuaaaaacuugaaugugcacuugaaaucaaucggcugugcuacccggugcugccucccgaaaguccccaaggaagauuccaugugcagaugugccgcccuguuuugaguguugugcgugcuuucuauucuucauuuggaagcaucgauucggaaccuugucucucaaaagcacaaacgggucuucucaauuaguagccccaguucuucacuucacuacuugaccuggcgcucuaguguagcagccgacugauucgugauaagaaaaagguaccagacaggcuagcuagcuugucucagaacaagcccauaggcacacucaaguuggcauaacccacacacugaugaccagaaacaggcagcaagauauaucugguugucccaggaguguguaacagguacauugacaaaugguagcuucuggaagucacagugagcagaaugucucuaaccucaaaggacagcagugccuggauugcuuacggucguucuguaaagucugaagagacggaugcagccauucuuccacuuggcugcuauagaaccaucuaggaauccuuaagaaacaugaauauaccagugccacccuuagccguucugcccuguggcccuuggguauagauagauggguagacaauugaaagaagaagccccuauuagcuuugucaauuugacagcucagagucaucugagaaaggagagcaauuggauuucucaagucagacuggugugugugugugugugugugugugugugugugcguuuugggggugaagagggaggaauuagcuugauuguucauugauguaggaaggcccagcugacuggauggugccauuccaugaacagguggugcugcucuggauacaaggauuagcuaagcaucggcccagcuugagccagcauuccuccaugacuucugcugccagaggcucuaggggcucagagcaaggaagccuaggaugcuugccuagcuagcccugcacgacggggcucugauggcuagccccacacgaugggacagggcucucaugguagcuguuuuuacugacagaagcagcuaaagaaugaaggguucauuuuggcucauaguuaaagguagucuuaugucauagaaggcagguuggggugccugcaccugaagcaguugggugcuuguggucauagcaucucacauuaugacagaccaugaagaggggcuugagccagaaccaggcauggcuauaaccuuuaaugccuauaugcacagugaccucagucugccagguaggucccaagaucuaaagguuccacaaccuuuuaacauagccacggaggugaaaccacucccugguguggaaguagcaagaguucuaaggagcccuuccauugguggucagggggaacuagaauguggcugggaagugugcgagugagugagcgagcgaaugagcaagugagcccugggcagacagacaggcaggagccaccugcuguugucuauuacuuaucaauccuagcuuauucuggccuucauugggaaugcccuauuccuucuggggccuucugagugauggaaggacagcuacaucuugugauugugugcguuuuuuugugcaacuucuucagacuucacauuuccauggaaggagggcauauacauauaugaugagcuuaaugacaauucaugucucuucuagaaguaccuaugaaggugagaagacagcauagccucccuucggcccucaucuacuguguuucuuccgcuccuuucuuuuguauauuguuuguuuuugucccuuccuacuugcugucauuuuccucuuccucccaagguagauuagauguuuuauuggcugguucugugugucaacuugacauaagcaggaguuaucacagagaaaggcaucccuugagaaaaugccuccaugagauccagcuguaagcauuuucucaauuagugaucacgggugggagggcccauuguggguggugccaucccuaggcugguaguccaagaaagcaagcugagcaagccagcggaagcaagccaguaaguaacaucccuccauggccucugcaucagcuccugcuuccugaccugcuugaguuccaguccugacuuccuuuggugauggaagugucagcugaguaaacccuuuccuccccaacuugcuucgugcaggaauacaagccuugacuaagacugaugaugucuucuuguguugugagaggcauguugccauauucuauguggcuuuugccuaacuugaacucccaggaacugcugcacccacugauguuuggccucucaagguucuaacacgcuccccaggauacuaagugguuccugguuauugggugagagagcauccaaagcuccaccccuucccccaggguauaaacauggggugaccgacuuuuuuuuuuaauugucuagccuccgauaaaugccuaugcuccuguaaggaaccccagcuaaacucauugguucaccaagcaagauuugaguagaauccuuccaguguucuauuauugauguccucccuguggugaauacaaguauucccagggggaaaaaucccaauaaggugucuggcugaaucccacuucauuguuuuauaaaguguuuuucuucauugaucuucucuggacaccggagacaauucuaaccauuccgugcuggcucccuuuuggcacuggugcuaguucagccacuuugaaccuggugggugauaagggaggcaccuacaaacccaucgucgacugcccggacacaugcugcucucuggcauggcuguauuucgucauuagauauucccagagccugcagagucccagaggauaucagaguccauuaauuuuuaucauaacauggaaucucccaggucugaauggcagcacauagcugucaggggcuuucugaacucuauuauagcuccauauaucucuaggcaaaacagaggggagagucgucauuggcgaggaaaauguacaaaaugcaugagguccuguacuguuggacuugaccgucuugaccaugugcuucaguacaugguauacacacuauuucuuucccuauuauccauacagguucaccucuguggcuccuuauuaaaauucuccccucugcccacaagagaacuucagaguguguauuaaauauauucucuuugcaucaugcuaaugaaaucaucaaccaauaguuuucaacuauucuauaaauguuuuuuuaaaaauaaauaaauacaugaguguuccugucuuaugaauuucuaccagaauuuauccauccaagguggugucgccuggaauuuauaaauaauggaucauuaugcucaauauugcuuuauauccacaaaacguacuuuuagggggggauguuaaugcauguccgggccaucuaguuauuuggccauuccuuuuauucuacacacuugucaauaaagugaaaugcuuaaagguugcaauuuaccuggaaaagaggagacgcugguauuauuuucggggcuuucagguccacuguggcuauaaggaagauggggcucauggggaaauguugcucugcacugaaucacaccagcccagugugcuucauccacuagcgcccucccucuuaccuaauacuaaugauauuuguguacugugaguugaguuguggaaucuaccgcuguccauuguggccucccaagugauuuucauaccguaaguaaaauucuuuaggaagacaucacaauuccuuugucccuaggaacccaugggggucuaccaagagaggcuugaugacacugccuuucuccccaguuucuggaaguuguguucaaaugugugugugagaugaugugagugguccaggcugcuguuccucacccuucccucccuacuucuccauauucugcaaaucauugauuuuccauuuuauaaaauauucccuggaagcaggaacacaggacaguaaagugcuuaagugccuagggcagguuuggaaauugcuagaaucugcaccagagaguccggccugcacuguagcuacuacuaugccaaucugccuaagugcgcaauuaucaaaucgaugccuuuuccccuagaaaagcguguuggggaagaugugggugccacugugcuugacaccccugucugagaaucaaugcgauugcgaucucacugcugggacuuaagaugaugggaugggaaaaauccaaucaagauaauggacaggaggcaaaaauuugagaaaaucaccaaaacaagaguguuuucauuuucugcuaauguacugacguuccagaaucuacucuaagaaguugcaaauggugcaugaaaugaaaaauucccgucggucuccaggggacagagccagagcuuugcucuccuccuggugauugccuggauuguuuucucuauuccagcugaaacaaaaagaaaauaguaauuaaguguaacuaaguuauugugacagcagaauccacuccuggcuaauuauuguguuaauggccugugguguccagcagguucuugaugucuuuagggccaugccccacccuaagcacagcugaugagcguugaccacccaagcuggucuugguauuauggguaauggccccuuuugccugcuuucuuuccuucccuaucuauagagagaaucuuacagagacuccaagugagggaacuuggaacaaucuagggaauguggagagcaaguguguauguauuuugugugcaugcauucuugguggguaccaucuucccaaaguggagagucccggguauaagaaacaagacgcugggcaaaauguuaguugccugcuuuaggcaacuuccccauuaaggucaacgcagagacauuguacaugguuguccuuaggacuuacuuuaaucauuauuuauuauguguauguguaugugucuggggccagaaggaacacagauguccagugccccaggaggccaaaaagaggccacuggauucccgaggagcuggaguuacuaggcauuugugaguguccugauugugcgguguuaggaacugaacuaagguccucuggaagagcaguaggcacuauuaacaauugauccaucucugcagaucccguguguagaaguuuuucacuucucauaaauagcagacacacuggguauagcccaucgcuuuuacaggagacacagcugcaacucaguguauuacuacuucuaaguuccccuugcccgaugagaggcaaacccaggcugaagaacacguuuucugugucacauagcuuaaccucucuggcuuucuggaauuacaucaaucaagagaauucucucgugaaaaaauuaccacacacacacacacacacacacacacacacacacacacacauacuucuaaaauagagacugugcuucucagucgccccucaauaaacugcccaucauuucccauggaagacuuguauaaaagauauucgguacuugcuuguucuuucuaaauaacacccuuaguagcacuucuguuacaaugcaacucuucucaaauuaaaucaauugaacgucauaucuggauuauuauaaaaucaaugcuucuguaucguaguauauaggacuuagugcuaccaagacuugaaagaaaucuuuuguaagaccauccuuuaaacugcaguucugacaagccaguuacauauauacccaaugcauuauacaauauaauuuuuaaaaaauaaucuuucucauauuuuccccuaaauccucaugaacuguacccauggccuguccacugcauagcuguggucugggcaggguccagaagcauggagaauuucaacuggguggaggcagcucuagaagguaacuacuguggccaaguugcugcugccuaucaugaauucagagcaaaccaucgauguuaauuuaagccaggacccaccuuguaauacuauacaguccucaccccuuccuucucuggcagaacacacugcuagucacaaaguaagacuuccaaauggguuucuuaauggaacacggcuccauauguccuuugcaucaaauuucacaguauuuccaaauaguaugaauucuuguagcucacuugagcaguaccccagauggucugacauucuguuucuagaaggaaguggaauauauuuccucuugccggguguuccaucuaggucauucuuucguuuguucugaaaugggacccugcaaagucacaacuccagcaucaucuagaaggguacuucuuaaccuagaacaccgcaauucaucugucaggcaugcuauuucaucuucacaacgucacugugacaccuccucauggugguggccccugcugcucugagacuccuuuaaagccccauucuucuuccuuucucacaguugacauucugggucuucuuguguuccuggaaucaugauguaucagucuugucuucagagcauaaaugacugucauauuuggccauuuguacucaccaacuuaaaucauuuuuagguaauauauugccaaagaugccuauauaaugcugcagggaccaaaugucauaaagaauauagcauuaguuccgaugcauacguucagcuuacuugcuuuuaaaggcucauuuuuuauuaugauugugugugugugugugugugugugugucugucugucugugugguuauaugcucauguguauaggugccugucugguccccuauagcuggaguucugaagaguuaugagcuaccuagugcgggugcugggaauggaccacugauccucuggaagagcagugagugcuccuaaccauugagccaucucuguagccccaaggcuuagcucucacugcaugccaugcccucugagaacagacuuaccuccuccugggcauugcugucuaguggcacagacggacuaugacucaugguagaaagugugaagaggugugggaauagccccccaggacaggcugcgccugagaaacuggucauuacaguaaaugugggggugagcuauguguggcucacuuguuccuaggcacuaggaaauaguugagaagggaaguggauguguugacgauacguaaugaugggauuggcucuacucaagaaucaccaucccugguaguuugaccuucauugaggacuuaaaagccaggaauuucuuggguauccagauuuccaguucugugcugcuguuuauuggcaauuaaguccaacaaccuugucaucauuguccuccuccuccuccuccuccuccuccuccuccucuuccucuuccuccuccucccccauuccuccuccuccuccccauuccuccuccuccucccccauuccuccuccuccucuuccuccucuuccucuucccccucuucccccuccucuuccucuuccuccucucccuccucuuccucuucuucccccuccucuuccuccuucucuuccuccuucucuuccuccucguccucuuccuguucuuccuuuucuucuucccccucuuccuccuuuuccucuucuucccccucuuccuccuucucuugcucuucuucccccucuuccuccuucucuugcucuccuuccuccuccccccuccuccucuuucuucuugacuuucuauuggucuuauuggguugaccuggucaaagguguagacaaagccuauaagaaccauugaaaagagagcccacuaagcuucaagcugagcaucaaggguaaagaaauggucaagaguucaugagacuucagaauagccccugggaggacaagaguguggcaaaacgugaaaugggcagagcuggaaggguccacauagugcggggacagcauucacuuggcaauagcugguguauggcgggcagugaaagagaacggacacaugcauuggaaaacuaaaguggguaagcagacagaggguugucuguuacaacgcaaaccugcucucuaaccucaggugucucugucuuuuuagcccucuagccucucugucuuucuuuguuucuccuccagugauuuuccuccaguuuaaugugugugagaauguggagguuggaggacagccuuaggugucguuccucaggcucuguucaguuuuuuaaacauccuuuacuucaucucuggcauuuucacucacauauacaauguaucuugaucauaucuacucuaacaauccucuccuauuuuucguggacaucccagaaccuguccagcucugcccaugguguccuguguuuguuaccuaugauuccacuuagcguugccuguuggaguguugucugagcuucuguucauguaaccauaguugcacauaguucaugaguacaauggacaggucaccucuagaagacagcaccacauucuuuuugaggcacagaccuggaagucaccgaguaggcuaggcuggccggccagcaagccuuggggaggggagaggguacuccugucucugccugcccagaucuggggauuagaaaccggggacuauggcucuguuuccccugagacauggguuauaagaauauaaguccauuccccaagucuacguagcaaucacuuucccaacugagcuggucucuccccagcccugucugcaggguuugaugacguuaaugcacagcaggaaugagacaauagagagagaaugccugaaauugggacaggcagggcucugaggaucgaaagcucagcucagccguuccuuaucugguuagcaccagccucuggacaggaccccauccuuuccacucacugccucuaccagcucuccuuuuaggagaacaaaccaguuaaacucggcuacugagagagccuggcugcauggucaagaagccucacucuggucacucugaaggguaccuacagagcuacccacugguucaucauuaggacuccaccuaccagggaaguggaggaauuguuguaugguccuuuggugacacacugcuugccauguagagggggcagggggcugccgccuuucaacaccaucgcaggagcuugaugccuugcaugggucuacccaucaggcagagaagugggcaguuucuccaugagcagaccagagagcaggcgauggguuucuccuugucguaaucuccagugcugcacauggaugguggcccuuuccacccccaucacccuucccaggucagagcccaggugagggugaaaucccccuuaaggugcugacugauaauaucuguucugggcucccuagauuggucuuuacuuccaucccuucuucacaguuugauccugacuuugcucugggcuccauugauacugucuuuauucccaccccaucuuucuaguuugaucuagccuuuucuuugauggccuguaaauauucaucauccaaggcgcguuugaaucgccguggcuuuuaguuaaaaucgagugaaauguuaccauuugaauaauaaaaaccucauuaaaggaaagcuaaaagaauacuuuuccuuuuguacaagccaauuagguacccucauaauuuaggaaaaaagaaggcaagcacauuaugguuucauauuccauaagccuguuuuaauuaauagaggugacaagguuucggugcuagguacauagccugccucugguguugugcaauuaaacauuaaugaugagaauggaaaugggagagcuaaugugucccccacauccgcugugcauccagacuaaggucuccaguagguuuccaugcuugggaacacggcaugaccaacggugccuagaagaggacccacggccacugaaggucaccauggucacucugccucaaagcaucuaaaagacaagcagucacagacucagguuuucuuuuuguggccaaagggcaaugguguagagauaccaccggcuggucagaugcugggcugugcucaucgccaacuugcaagcuccggucuucuguucccaguuucuaaggggaggaaacggguuuacauggguucaccaaugggucaugaaccugcuaagaaaguaacugcccuaggcuagaaugccaacacuuccaccuauccauccuggcuugaauauuauauuaguuacuuguagcugugacaaaaacaccugacggaagcaaugugaagggugaaggauuuauguggacuugcucuucaugggauuauaguccauaaaggcagagaaggcauggcaggagcaggagcaggggcagggggagcaguucaauccauguuacuuguagcugggccccguguggccagcaggaagcacaggaugggcauugaagcagggccagguuguuuaagccuugaggacccacacccagcacucauuuaugccaguuaggcucugugccccaaaugcuccaugcucuguaggccuacauuuuuugccacauuuaauaaggguucaaccucuucucuagcccaccacccagcagagguaguggaggagaaaacuuauuaggauauggggauguggaccuguucagcuugaucuucuugggcagcaguucagucccauagcaaacaucaaauaugauucagcagcugcagaccaguccucuagacgggcagacaccaggcgcgaaccaacagcuacaauccaguccuuucagcaagccgacaccaggcagcuguaguucaacccugaagaaacccccaaguuugccaacuggccugaggcgaggauguggaagcagcaagcugcaggaagcucacuagccauucuugggcaaguuuuucucaaugucagcguuaacacaaguugagcucaacaacucuauguaagucaaaccaauauaugugugucauuaucaaagaauagcaaggcggagcaaaccaaaccaaugcucagugcuugucucccacuguccaugggguuauauuuauacuccuucaucagucguccuuauacauguuugcuauaucaaaauaucccuuuaccugugucugcuucagaaaaauagucuuucacauauuugcuuuagcaauacauccuuucaccugugugccccagaaaaacauuauuugauauaacuaacuuuccaaagaaaauagaaguuuccacuucaguguuccaauauggcugcugcugaugccuaaauucacaaccccgaagcuguggguggcauucuacauucgaacuggaaucaucuuuugccuuguucuuauccagucauuuguuuacugguuuacuuuuguugacucaaaucuuugaaucccaaccucaggaaaguugccucuaauuauguuauuaauucuauaauaguguaaugcacaaaccuauccugacugaacaauagcaacaagaaugaacgccacccaaaguuuucaugaaaguuaaaugaccuguguaccccaauucucaguggauguuaaccggaccaucccaaggccaggggcaugggggagaaaacagcuuggagaauugaccaaauguuagaguuauaauaaaaaaugagcucagauguaauaauacgcuugugugucugcccuuccucuaaugucacguuuuccaaagagucugcuuugcucguaagccucucaggcacagacuuugcucuacuuugguguaaagcaaggcugaugcauacagcagggagcugcugccucagagcccucaaauccagucuucagaaaggaauggcaccauuuggagcuguuuaaugacagccaugaugcacaccauguauaagaaagaaguuauccgggacaaacccagcugaccacaaucauuucaccacgcuuauuuuuaaguggugacaaguuggaaaacagaucaagcaacagaaacaaaugccgugaucuccuaacaagauccagauugccccaugauaaugagauuucaugaauacuuaaaaaugugauuuaucagauauacuucucucuagcugugcugugcaugcuuucccccccaagcacugaaccaaacuugacuaucaguucuuuaucaccuugccaagaacaugggcaagaagggaaugcuuccaaauuccuauaagaaggcaguguuagcuagaugucaaaaucaaagucuucagaagaaaccgacggaccagcgucacacaggaacagacacaaaaucuucaacaaagcaccagccaaccaaaugaaauaauguacaaacaaaaggauuaucuacugacugacucucuagggacucagugguaaauauucagaaauuaaucaaugaaagaaauagaaaccaggagaauauagaauauagagccaucuggauggauacagaaacaucauuuguaaauaguucaguacacuuuguugacuaaaaaccauacucaggcuauuccaucaccucauuaaugguaccuauagaaauuaauggugccuauagaaauuaaugggaccuauagaaaguccaccacugauauauuuacaccgaaagcuuggaugaugucucccuaacauccaaaaaugggacagggguguuagcagccagaacccauccaaacuagaaaggaagaaaaaaaaaaaucaaaacugccuuccuugcagaaugaaucacuuugcaucuuaggaacucaaauuggaaagggugacaacucgcagccaaguucaacccgauugugaggugacugcucaacaugcagaagccauuuugcuuccguguaggagcaaugauaccgcuccaaaggaauuagagaaaaucauucugcuugcaguaagagcagaaaaauaaaauagagaagccguuuugacacauacaaauguucauaaauguaaaaaucaagaguuaugaauguaugaaauauuguuagaagagauuaaagagcacucagaugaaugugaagauagcccauguucauggauuggaagguaggaugugguguagacaucaguagcccucaguguuggaauugaucuugggugcccuguauucagaugcugagaucugugucccaaggucagguuacagucugggcaugggcauuguacugaccaaugugcuguaaagaaugcuccccaguaaucgccuauuggacacugacuuugcuggagagagaagaaggugggacuugagauccaggggagggaccaggaggguaagagcaagaggagguggagaagaaguucgccauugggcaggguggaccaggaacauguggccaggagaaguucacccugaggacagccaacucuagcagaagcugcccgggagauacuaaguugucaagucauggggcauucauguggguuuuaacagcauggaaggauuaauauagcucagaaccugcccagcauagagugaacagcuuauuaguaaaaccaccaggugucugugugguuuuauuauucaggaucuauacgggcuagagagaggcagaaacccccaugaaauuccuucuauaccuucagacugaucuauacugugaauucaguuuuccucagaccuggaguuuugguugugaacuucacgugagaaugaaaaaggcacuggacagacaaacugagguuugaaacaaagugugaagcuccccauuuucaguaauuuaacagugugacgugucaugaccauggaucauggggaacugaauagcacugggauuccagaauuaaacccuuauguggcugauuuuucaaaccucguugcuggaauaacucagugaguaaagauuagucuuuuccauaaaugguuccagaaccuguggguguccaccaugaaggaaugaagucacaucgcuuuccugcaccauauacaaaagugagcuaaacaggaauuaguggccuaaauauaaaagcucaaauuacuacaucccagaaggaaaauaugguaucagaauaucuuuaugauauuagaauaaauaaugauucgauagguccaacccagaaagcacaagggacaaaagaggaauuaaaaacaaaacaaaaugagaaagauauuugaaaauaucuugaaagggcucauccaucauauauaaagaaaauucaaaauucaacaauaagaagauaaaccugcuagcuccaaagagggcauaaaugcugaacacauauuucucccacgaaaauaugcuagcugccaaugagcacauaagagauucucaguaucacuuagccaggaaugaaauucagaugcaaaucacagugaagucaucacuuggauuugcuggggagacucagggaucauuguagaaggggaggcagaaagaucggaagagccaggggauaagggaguaacuagaagcuacacccauaaagucuuaccagugggacugucuaaauaugagcugaacaagaacaccagcaauagacaugcuaacauggaugaguaaaggacugucaggccucaguccuacaaaaagacccacaagcaacuaaggaaugcagaggcugggagaaacugucuuccccaaggaagagcacaccaguuaacuauacuaaaugggcagcccugaaaacaugccuauaaguaaguaacauuauguaaacucagccugaagagguuguauuuguguauuuagugugugugugucuacauaacaacaauuaaugaaagaagaggccaugaauuugaaaaggaacggcauaugggaaggcuuagggggaaagagagagaaggggguaaauacaauucuauuauaaucuaaagauauuuuaaaaauaauuugaaaagaauagaugaaaaaagaaagggagagagaaagaaagaaggaaaaaaagaaagaaaggaagaaaaaagagagagagaaaaaagaaagaaagagagagacacacagcgagagugccagaauuaccacaaggugggggaguguaaugaaugcacgguugguggggaugugggggacgugucucacuuuggacggcaguuugauuccuccccagaaguuaaacacagcauuaugcugugagccaacaguuccauuugcaaguacauacucaagaaauaaacaaauacgucuccagaagaccuggcaaagcaaugccuguuccagcaguauucacauuagcccaacacugcaguaacccagaucccaucaaaguagcaaaggacaaaaagaugucaucugugcauccagcagagaggucucaggcuuaggagggugggcagcguccauuuuucagacagcaugaaaccucaaaacauugugccuagucaaagaugacggucacaaaggaucacauguuaucuuggcuccaugcgaugauuguguuagacaaauccauagaguagaaagugcauauggguggucaccauguaauuaccaacagcuaacgaguugcuuucuaguacuuacaguuacuguaaagguagaaauguggugauaggaugcaacccauacauauucaacccagaacacacgaaaaccccuggacuaugcgcucaaaugaguuuuauggacgucagucacaucucaggauuagaaaacaggaagcacuagcaaacaccuagaaggaaaaacaaguuuaaccauccccuccagaccucuugccagucuuuauuuucuuacucagugacugcauauggagaagucucauuuuuuuccugcuucugguuuuguuuugacuccauguuauuaucacauguauucauuuauuugugugucuucccucagaaggugugucuguguauaugugggugggugccaaggcugggguguggaggugggaagucagcuugcaggaguuugcucuaucuuuucacccugugggucuggggaaugggacucaggucauccagguugguagccaguagugucuuuauucccuaagccaucuccacagccuuggcuuggguuucuugagacaggauugcacuauguaugccaggcuggccuagaguucacugugugccccaucuugggcaccugccucgagcuccuuuaguacugagaugacugcugggagccaccacgccugggugggcuuucccuuucuuggagaaagcucuaugacacacauugucacacaugcugacccuugccucaguucaucugggaaggucugggauccucuggauucacuguugcuuuccuaagguagaguaccgcaacaugggugguuuaaagcaacagauucauagucucuccuagggcugggaguccaaagacugaagcccagguaucuacaggguuacuccuggccuggcugggggagccuccuccuguucuccuggcuuccuaagguggcgcacagucauuagcuuuucucagcuuccccaucugccauucugguucgcucuaucccacugacauguacacaauccuauuauauauuuugcuucauaacagauuccaaaacaaaguggauuuacuugcgauugggcugucagcuucuuaccauuuccacgcauccuacuccauggggcaguuaacuucugguuuguugcuuuuauguuuugauuacggauacaguagaggguccugaagauucccucauugugucauagcuguucauuagaguuucuuugaaguaaaaauauaucuuauucggauuuagggcuuucauccaaaugaaaggguuacauuuacuguuaaauuuuuauucauagcacaccuccucuuauccccgggcuuauuucuaacagguucagauuuaaucccaaaggaagauacacacacacacacacacacacacacacacacacacacacacacacagacagacauugagauuaggcucucuuuuacccaaagauagccuggaaaucacuucacagucugagaugacccugaacuccugauucuccugcccccaccucccgggucucaggguuacacacaugcuugauuuauuuggugcugaggauagaacccaagucuaaauuuauacuaggcaaguguuccaccgacuuaugccuccaucucuaagacaaauguauugaaauacucugugaccggcucuguaaacagaccauauucucuuugauccauuuauuuaguauccacuaagcauuaggccccagugucaguuuuucuuguaguguaucaguguccuaaagaaaggaaaucaaaagaccccugguguguauuuguggacuauuuugauugaacauaaaagcaguaguaauuguuuguauuagaaagcacaguuaaccguuaaccagagacagugugucucaacgccagcgaaccacccucauccugacauacccuguaugauucuggguuagcaugggugucuugcguccugggaacuucuuguugcuggcaccccaaagucacagcccauucagagcaauguaacaucccgccuugucucguuucucacugguuggcaucuugacaacccagagaaauggguuguuccuaagugauuguauguauaucaucgauuugugccugaugucaugcauuuccucgugcaggucucuucacgugcuuguguguaaugcagggacguuugcucugcccuggggccucacgaaggauggccuggagacaaccuuucaggugaaccaccugggacauuucuaccuuguccaacuccugcaggauguucugugccgcucaucccccgcccgugucaucguggucucuuccgagucccacagguggguuugaauuugacuucauaucuuccaccugucccuucauuugugccaccugaaauucccuucagggugcugaggcugaagaaagggcucaacauuuaaaagcucuuacaaguucagucccuagacacuaggccaggugacucacaaccaccugugacuccaucuguagaggaugcaacacccucuuuuggucuccaccaacaccagcaaccacacacacacacacacacacacaaauaaaucuuuuaacaauacuacuuuugaccaaucucacuaugagaaacaugaguguacacagccuggcuucauuaauuuuucuagauccuuccaggugugugauccuggggaauuguuggggggggggcugucuagagcaauauagagugauuuuacaauuauaccucagguuccucauugauuucacucagagauggaauaauaauugauuaaaucugaauagcacgaccuuuauugauuuguaauucaacaacuucaaagucucacugagaggagagcggcgguuuuucuagcaggggaaacaacgcaguuaagggccgagagaugaaauccaauuguuuuauaaugagaaauuagggaauucaaugcagacauuagcagcguaauugcagaaaggaaaggacuguaguuagugcggauuggaaaucuggccaugccucuuucgguuagaauuucaauuuacacaucagauggcguugcuuucugauugccauuagacuauucagucgacaaaaaagacaucugaaaacaucaccguguuuucaacauauuugugcgggaguuggauaaacaacucucugaagugcugaggaaagacaaaggauuuucggggcuucggaggcaagauuuacagcuugugagggagacuuccuucacuucccuguguucuugguuguuggggguagaaggagcuuugccuucuugguaaaguagccgguacaaauaaauaaauaaauaaacaaacuauuuucuuccucuucuucuccaucuuaaguccugaaauguuuuggugacccagaaugcagucuuucucucucucucucucucucucucucucucucucucucucucucucucucucucuuucucucucucucuuuaaucauucuuccauaaaauguaaccccugggacuuugaagagagagaccagccaaggguuagcuugaacccuuuaucacucccaaacacaggggcuuacgguguaagugacacgccgcagacagauuuacucuugccaguuuaaauuuaugauggcuucaaugaaagagaagcucgcguaauaauccucccccgcccgggaagacacgaaacaucuaguaauuaggcaguaacaaaaucuggccaggcuuaucuuugcaaaucacaccggguuugugaaagaaagggagcccccccccccccaaaagcaaugaaggaggcuaccaugggggcaggcaggagagagagcuuuagaaauaaaucugccagccacaaucgcuuaccagauguggagggcaccacgggauauguuuaaaugagcugguauuuaaugggagacgguguggaggugucagcugcucccuucccucuguacagcuccaucuuggaugcuguuuuccugggacgccuuuguucucacuggaaccacaguguaauuucugccuacuuggagauccacauccuaguuucauuuucaagaugcgucuggaaggaaagaccuuggucugaaugagauccguugcuauuucuagcaaggccugacuaaugugugugagaaaggccugcaugggugugcugacuggcucucgcuguccacuuucuucuuauuaacauuauacaaaauauuaauuccuacaagccaaacuguuuaucacucucuugugguaucccugugcuccagagagcaagcaugggugccaggcacacagacaacacuggaucauggcagaagggcccggagccuaaaccaaacuguaaaacacaguguugcucucuaauuaccuccauaaaccuuggcggaaucucuucguuggagucaagacccccuguuaggggaaaaauaaaguccuauguuugcagaaaauaucauacuggaugcccuccagcgaaauauuuauuagccuucucucucucucucucucucucucucucucucucucucucucuccacuguguuuuacauacuuaucuggagucugagcaagugaauugaguuucugccugucuaaaauauaucauaaugaaaagggaauuuggccuccucaauguggaaauuuuucagauaacaauuaaaauagaaugagaagaacagaguaccaguugcacuguucccaaaggccccagcagcaugaggagacagagguauguacagccagggacagucgcacacauacagcuacauacaugcacaugggaccucacacaaccacucacaacuugaguucuacacucaaucccuccccacagucuuauauguguagaauaucacacacaaaaccacacacauguagauacacaccaucauacauaguuccacauacaaucguaccccacccagcaaccucacauauguaaacucucagacucauaaacacacauaaaaucaugcacaaucggaaaaagaaaaccacauagaaccacaaaguuauauuaucucacccacaguaccauacccucacacgcacacugucacaugcacagccacacauuuugucacauacacagucacacacacaaccacaggaagccacucagagcccacagagagacauauaucccagucacacacaauccaugcaaucauagagaaaagccaccccaucauaagugugcccccacgcagccacauauguacgcuucaucacaaacacacaccauacacguaguuacacacaugcagaauuucccaugcaagcuuauuccugcuccucaaacauacuagcugaugucugugcaaauccauucucauuaucuuaucuuuggaauuaagaauuguuucggcuuaaacagagacgugggacauagaagacagggacuccucagggccacucagugucuggagagcaggugucagcuggccucuguggaugacagagacacugcucagaccuuccuuggcuuugccagacucucaacuggaagucagagugguuguccuugaagagcuagcugccuugcugccucuugaacagccggagcgaugguucccaucccuggauccuccuucacuucugauuggauggacauugaaaugugcccagcccuccccacuuuguuaaaaacuggcagcauaaacuagugggaccucccagagccucuggucagugaggcccaaugucucaucugcagcaguaaagaagcaauagauaguauacaugagcccagugagccgcagucaugaagcugggaccccauccuaacaccaggagccacugccugcaaauguguaacccagaacuuugagauggugauccucacgggcagcguuaacuuuauaaagugagacucagacccagauuuuuucuuuuuuuuuuggcaagggacacuugccauuugucacugccauucccuuggugacauacacuuugccgguugcagaaucucagcauucagcaucugacgugggugucacugaguccugggagagggguaauuaacuugcagggaugugacucccacuacacugugcuggcuugaaugagaaauguccuccauugucuggacauucgaauaccuagcuggagccuagaagacaagcuguguguguugcagaggguggagucugagaugugacccaagccccuuggaggagccuagaagauagagagugaaugucauauauuggauaccgaguuauuuauacuguuggaauuugguuuugcuuuguucagauugugacugugcccugcuucuuggcucuugaaguaagggaguauuuaacuuuguuuugguucugcaggagcccguagaugaauggcuaaauuuuaggggggauuauggcuuuuaaaugagacauugaauuuuugaggagacuguauuucuaaagacugugaaacuuaaaguuauuuguguuuuucuugugagaucuuggggaugaaugagaaaggaaaggaaguggcuuaacaguguguguugacaaauuguuaauuacgcugcauaguuuuauaucaacugacacaagccaaaaucacggagaggaaggagagaacacaccuccagaagcugggguuguaggcaagacuguagagcauuuucuuaauuagugacuggucggggagggcccagcccauuguggugguaguucuguauuguauagaaaagcagccugagcaagccaguaaguagcucuacuccauggccuccacuucagcuccugccagcagguuccugcccugugugaguuccuguuugauaaugaacaguguuaagaugaugagcauaauccaaauaaaaccuuuuccuucuggucauguuauuucuucacaguaguaucaagacaaaccaggguccucuacaaugcgcaaaguuaacauaaugaagccaaguguggaggaaccuuaaacaacuaugauaauaucuagaacauucuuucuugguuguuucuuacgaucuguguuuuguaagacaguuuccuuuuuauuuauuuuucuuccuuuucugacuaagagaaaggcagguauaacugaagcacacagcugguguuuaauggcucugucagacucuauuauaaaacaucacuuaguuacuuugauuugugaguauccaugccaugccuguacucaaaaaaugguagacucagccagaacccguuucuggcuuuguuuacauuuaauuuuuacacacgaaagacuucugauggcaccucaccaagguuacaacccuuuuaugaucauuaauuuuuaaucuggaaaagagucuuagaggcaagauggcucgucuguauuaacuuggaugcucaaauggaaacacacagaucucuuacauuuggcuaaaauaaucaggaaaacccugccaaagguuaggaaugugauguuguuuccccaaugcagucaccuuuuaucuaaagcuuguuucuauuuaauuauccuugaagaugguugaagaucuugagugcacacacacacacacacacacacacacacacacacacacagagagagagagagagagagagagagagagagagagagagagagagaaugagagagagagaaugagagagagauauuucgacuuuugauuucauaccuuucauugaaacucagccuaguuggaacucaugauagcacaggcuagccccaaguucagggugacugcccugccugagcuuuuugauugcagcuacaggcuugaaguauauauuuggagguucagugaaccuuggguuuauuuugccuacugaaguuguggguguagguuucuccuuccucguuggaucaaaguaauuggccguguguuaagucaccaucugcauuuaggggacaugauugugagguacucuagaucagaucccuauaggucggucagacuucaaacaaaccccaaagcccugugagaagccgaaucguuggugcuccacuucaugcucuuuguuuccuagauuuacagauauuaaugacuccuccgggaaacuugaccucagccgccugucuccaccgaggagcgacuacugggccaugcuggcuuauaacagaucuaaacucugcaauauccucuucuccaaugaacugcaccgucgccucuccccgcgcggggucacauccaacgcagugcacccugggaacaugauguacucagccauccaucgcaacucauggguguacaagcugcuguucaccuuggccaggccguucaccaaguccaugguaagugugcggcuucuggaaccgcccagaugccuucagucgccgucacagaagggccuggaaacccagacccacaugucuaguugugaugucauugucaccggcuguggugggccugggauugaguacacagcaucuagccuguucauucauuagcaaaagcucuucaauacuuccgucacguuuagauugugucuguugcucuaccauagucuuggcuuggauaauagaugcugguugucaguguuagguggagaacaccugaaaaccuuggagguuuggggugagggacacaauaaugguuuguuuucucucaaugugauuucugcuuugauucacaaacuacugcaaaauagaacuugcuacgugugcuguguguuaguugcaaauguggauucgggaguguuaguaggcacuuuucuucuugguucagugagguuuuuguaucggauguucuagaugcuucuuauaauggaggucuggguauagcuccuuccuggagaaggcuuuguggcuagagugugguuuauccuucauaucccugaagacaaaucucuuggaggaaucucaccgcugcgguuagaacugaaguauucacaaagcugaauaugaagguuuuacauauuugucgguuguuuuaucaauggugugugaaagcuuuucugugaauccauuagcccaguguuacuugaauauagaagugcauguugcacagcauccucggucagucgcccuucugagcucggggccagggaaauggcuuagugggauaagcguguucugaacaagaauuaagaacuagauucagacccccagaagacagaugaaagcugggaguagcuuuauguguuugcaaccucaauguuaggguuccaugauuggaucucucagggccugaaguuccaggugcagugagaagucugcugauagguagauagauagauagauagauagauagauagauagauagauagauagauagauagcucauagauacaguagaggguguuaaaagaagaacccaacaucuaccucagacauauguaaaaauaacuuuuauuugccugaaguaauugucaucucugagucuuacugccucugucugcuaaccuauaccucguccuggaagcuucuaaccucuguacaauccuaucuaggccuagaauguuuucagccucugagacuugcugcugaauccgcugaccucugacuuguucuuucugagcucuggcucaaauuccuuucccuguaggcugauucaaucuggauucucuugguguccuacugaagugcucugcuuggccucauauugaccgugucauucugcucuaaucuucuggcuccuucucauccucuggcucguucugucuucaccugugucuagcuuguucucucucugcaaucugacucuguacaacugucugguaaaacugccuccugucuucuuucuuucuuugcacugcccccaaaguagcuuucccuuuccucucuuuucuugugagaguuggccauagucuguucugucaaaucuuuuucugauuugucacuuugucugccacucaacuagacaucgcuuucaggcaugguacuuuaacuaacuuugcuuucauuguuuaagauuaaagguguccacuaaaggcuugucuguauuccagcuagagggauuaaagguguguacucaggcugagccacaccaccacuagaaauagcguuuucuaguaaacagcacaaucuuggguuuuaugauguggucaaauauccugcagcggauuuauauacaugaacccauuggugugcacaccaccacacacauacauacauacauacauacauacauaugaauguuccacaaauacacacaugagauaaauaauaaaaguauuuuccuuugaacuuauagauccuuggcaguuacuggugcuguuuuuuuaaaugaucaaaauugggucuuuaggcauauaaguccagcuauccuucuggugguggcaaggacagccaucggcugccuggcacaguagaacaacuggcucuccuuagcauuucuccuaaucaaguuccaguguuuccuguggccaucaagacaagguagggaauuugucucaagcauccuauccugccacguuauaccucaaauaacggacuccagaacagaggauuugucuaguggucaccaucuggccauuguccacauauaguaauugagaccuugauauauguuguacagcuggggaaauucugaauucuguucaguuucaguuucaguagucauacaugucauguacagggugcuguguauagcaccuuuuuuuucccuuguccuuaguuucuuucgauucugugagcaguaccugaguguagaaaguucucgugccucaauguagaugacagauauaacaggggacaugggcuaaaauugauaauaagugaaauaauucuauuugcugugacuauagugauuuuaguaugauaaauagggaaucugcugguggguauaggaggagguugaugucucugucucuaccuugaucacuccaggaguaagauuccuggcaagacaggaaaauggcguaggagaaccugaggcgguggccucagaccuaucuaucuggucucgaggcaacccuagugacugcgaguuuccauucuccuauuccugauuaacuaggaagcaggacuugauaucucaucagcacacauuagcuacggcuguugacuguuuuucuuuguuuguaugugguuguuuuugagccagggucucacuauguaggccuggcgagcauucugagugccaggauuccaacccuagguguagagauuaacaacaucguggggcacagagucuuguuuagguccucuuugauaucagugaccugucuaaauggccggugguacuuugccauugaguuccauauuguuggguucuucagacgggaggauggagcucaagaggagggaggagggaguuuuggaggaaggaauauggaguuccaggaggagggagcucaugaugagggaggagagcagagggagcccaggagaaaggagaagagaagacgcccauauacuucucuaggcuaggacuccauuuguccuucagaguuccuuccccaucucaccuugcuaaaagcauucuucccuguggcaugggcauagcuuggguauacucuccauuguacaaggcccaggaaagaagaaauaccacccugccuggcgcucaggaagcccagccccccuccucccugcagccagccccuguaagcauuaaacagcaguguuuuaauaucaacgucccuucuuuauuugcugugacucgcugugacuauggugauuuuaguuaccguaauuaggucacccuucauggagucgggcuauuuuaaguggcucuuuaaggacuauuguugcagaucaguaauuuuacaauuggaugcucucgugcaacuuuauuaaauguaauaugucuuuuaaauguugcccuuuuacaguuauacguuucuaauuguugcuguaaaugcauuaucacuuugaaauuaauuaauuuuugcauuugggcauccugcaguauaauaaucacuaaugagaaacucacggggacuaauucuuagcacagugcccccuaccggcaaggucaugucucugccgcccucuuccuccagagggccacaggacaaguguccuaggaguucugggagaggugauuauuccucccgccucgaauuuaugauaacauaaaaagaaugagcaaaauggaaauacgcuguuuuaaauguuguuuaaaccaagauuuuuuuuuuuuaccaguagcagucccuaaaaugucuuaaaggaaaccaaaguuugcugagaguguucgcaugaugaagucacaucaccaaggaguuuuguguugacaccucugccucuaaacugcguuuuauguauaguaaugugugugccagauguuagcauacaugauacggcaaggugugcaaaugacaucauaucaguauaaaccugaccugugcuguuaccuaacggcguaagagauuuaccagggugguuauggcuauuggugugugcugucucguuugagagcuucgaagcucucagcugaggggcaccuuggcaacuugcaccugaccucgagacaccucagguaucuaucugccuguuuuauuuuucccucacaacacuucugcagggucagaaugaauugcaucugugccaggaaaagccuaccuagccuguucaagaaaaugccauccucgccuccagagccuucgccaacuccuuccagcuccauuuccuuagucaaacacaccguagcgccccugccaugugugucugauugugucguuauguuuccucuuuaaagcauuugacagcaccuucuugacccacuccccucuuuuuuuuuccacauuaguuuugaacgcugguaaacaaccuccuugccagaggucucagggccaagccagcccucuauggcuccgaguguaaauuucaaguugagcacagucacgugccuugaaggguguuuggagcaaccaaauauuuguguuggcagguaacugucggaaagaauaucauguguugggguaacaagagcuuagcagauguuuuagggaacuguguuuucauaucaguucacuuuuuuuuuuuaaaauggcuugaguuuguagaucuucugaaaggauuggguuucucuuccuguagccaugaaaaggcugccauuguaaggagcccuaacagauguguggcuacccggcuaauggaugggccugcaaugcuaggucccguugcagagcuauaaauuacaagcagagaaagcacaacauagcguucuccuaaccuuacgcagugccaagcuggguaacucugcccuuggauaacccgcggccuggugauuuauagucguacaacuuuaaagcauaaugaagggccuaauaaauguugauuuguucuuuaaauuacuauuuuuaacaaaauacaucccucaaaggccuguagcuggcuacucugaaggugcauucaaggacccaccucaugucugaauccuuauugguauauuggcgugccccauacaaggagagacaggacuaacagggacuuuccaguuucucucucucucucucucucucucucucucucucucucucucucucucccucccucccucccucccucccucccucccucccucucucucucucucucucucucuuucuuucuuucuuucuuucuuucuuucuuucuuuuuuucuuucuuucuuucuuucuuucuuucuuucuuucuuucuuucuuucuuuucaguugagaaaagaaaacacacccugcaacauggaaacccauauuccuuguugaucacaguauuuugagccuuccaagcauggguggaauucgcugauuucuguguucccccaagccgagguauggcaggaaaguagacuuuggggaccucugcggccgggccacacaugagcuuucucaccacggcuucuccagaggcucagcucuccucuuacagagggcuaccucccugcagccuucuuaccugaaggugaucauuauuagcuuagggcucauuagucagcuuuccauucugcccagagcuuuaaaguguguggcguuugcuuagucccaaggcccgggcauguggcggguuucacaagagccaagaacuuggaaucuuuaggcaguuguuuuaaaguuucguuccccugcuucucuucagucguuuuguaauaauucaaccugccuugggucaaaugucuguauccgugcggugacuaugagcugugagcuccuaauucacauggaaagaugguuggaauaagaucuagggggucuucuuuaauuuuuuucguagauucuguaacccugaggcauccagagguaugcuuggucccucaagugggaagugccuuucaaggcugucucggcuuucacuucaugcuuccgaaguggcugcaggaguggugaucacugcguccugaacacauucugaaagcaaaguggggccguaucauucuccaccccuuagcucuuucuccauaagaagaggauucugacucugagcugcucugugagucaucuuucccugcucccacucuccgaaauuaagucgaucgucccuguuccuggcggauggaugaugggaggcuaacaaaacacagaagugacuuuuuguaaaauagaagaaucagccauccaguggcuuagacugucuacccacaguguggccacgagaacauaugagaauuaaucagaggguaccuggguucucgguuccacaugaccagccccagcucuagucagcccagccaugcguucuuuccuaauaaauuuuucauucuagaauauuccaucuuuuccgcucuuauccacucugcucuccccggaagcauuccaggucucucagauuagaacaaggguuuugucacaugaugucauaaaaaaaaaaaaaaagaaauucaggaaguacccggagccccucaaaagcacaggcuccacucugacuaaagggccaggguccaaacaguucuaguucccaaccuuuccacagcugugaccucagaagagagucccugugugcuuucauuugauauucaaacauggcaacacuguacgucauuguaaaggaaagaaugcugugugcuuaugcaggagggucaguagugggcucuuugccgcuagucucccugagguggggaaggauugcaguucagaguguguaagaaauggugaggccaggucucacagccucagcguauccaggguagcuagggucagagccaaaagcccccaggcacuuggcuccaagccacagcaauggauucccucagaaaagcauguuuggaaggaagauuauucauuuugagaucuggagagcucuagaacuguuagggaauauucuagaguuaggcgacucuagaaauaccagcuccccucuguccuaacucaugagcaaguuuccuaccuucauuaagacucucgugaaauaccaggacuugugcccaccuuauggacuuauggacugcacugaggaaaugaagggcagcaagcauuuauagauacuugauaaccaucacugcccuguugugagaaucuggccuugugaagguuucaugucagcugcauauggaaacucgcuguguuaucuucgguccacaucacugugauuaaccuagauggcaugguggcaaacucuguuccauggcagaguaagcgugggacagcuguuucuucuaugguggaaacagaacuugacuggaaguagggaugggcuguaaucccuuccccagggcuccaaaaccuaccaucaagugccacaagccagggauggacuguugagacaccucacagccaagccacaacacuugaugggcaguugcugugccuuuucuccauacaucacagcuucaacucaguuuugugggugugugauugauaaauacaaccccgucucuuuuugguauaaacacauacggugaaugguuugcccugaugaacauauuugcugacucccuugguuauugaugugugugugugugugugugugugugugugugugugugugugugcgcguguguauguguauguuauacauauguauauguuuguuuuguguauguauauguguauacauguauauauauccauguuuguuuauuauguguaugugcgugcauguuugucuauauguguuuguguauuguguuguaugucuauguugguauauauacagauacauguauacacacagauauauguaucuguguguguacauguauguauguguaugugugaguauguauauguguguguguguguguguguguauucauguuaagaacuuaaaaucuauucucacccauuuccacuuccaugucugugauagauggucauguuacuggaauuuggaauuuggagggguucccuuagugguuacuagaugaucuggggaaaacuggggucagaguagacucaaauggaagccugaggagacuuuuccuggcauuuaaaagaaaaacacccagggcaaggaaguggcuaaggaaaagguguacaacucacauacuuaguuuuugagacaaggucuuggguaguccuggcagacuccgaguagccuguguugcuaaggaugacauugcagccgccugaucucccgucaugcuggaguuaagggccuuaggucaguuucaaccuuuugggggccaauugcuuggucccuacugccaacacaccucaacuuuaaggagaaauucucucugucuauuuaaugaagguuaauuugugugagcauacuuccgaguucuacaggcugacuggcuuucuuucucucucucucucucucucucucucucucucucucucucucucucucccucucucccucccucucccucuccuucucucucucucucuuucucucccucucucucucucucugucuguuugccucugucucugucucucugucucucucucugucugucucucugucucugucucucugucucucugucucucucucuucauuauagcguuucaagucuuuguuccugaaugaacacccgagaggagaaaagcaaccgucugcccuuaaugugugugacaaaucauuuaaugaacauuuagccaagauuugaaagccaccagcuuuaucucccucucuuuucucccacagacccacuggcaguuggguagcgccgccccuccgcaccucguccuugcccuccccucgauucucuacucaagcccuggcugccuuugauccucucccccucagcuuccuuuucuccaauuucauacuucuuucuaguaauuuuuggccucaaugcaguuuagaugcuggaggccagcacgauuaaacaaaugcacagagcuugcguugucccacgauuuuccggaauguucuuccacaagcaccaaucucuguauaacuugcuggauacauugauuccccucccccuucaccccugcccgugaggugugaggugauguuuuucuaacaccaauagagaagacucaaacccgaguuccaauuuguuuucagaacaacucuguucucucgcaguaagaaagguauguucuauaggagccggcuaaggguuuaccacuucaucucuggucucacuaguggaaguuuagagucuucgccauuuacauagcguccaaccuuacagacaagcugauaguaucucagugaacugaacagugagucaaguauggaacacagaacucuuuagacacauugugcaccgagggaagggaaagacagugguauaaauugugaggacuacacagggcuccauuguccccuagccaggcaaaaaaacacccccugcagacggucugacaccuucuauauuguuuguuagauaugaguccagggauucgcgugcugggguuaggaggaaggggagagugcgcaucgggaaauaucuugcagcccacccacuacugugugaguuuccuuaagugguuugauuuucucucucucucucucucucucucucucucucucucucucucucucucucucucucucucucucucucucucucucucguccuuguuacuguacucccguggccagagcccucacaggcccugacccagagcuccuugucugaagccaugguacuuguugccaaugcuucugucacgccucccacucccgcugaucacacccuuccugucgucugccuguaccacuuccagggccgagagagguguccgaggcacccaguuccuuuccuauguauguuuaugcauuuccgcuuuguggugggagauaagacagagccccuuaauaagaagucuagaaggaugcagacauugggugucuaucccaaauugcaucccaagugcaaagauguggaccgucuugcauugcuuuauuauuuaacugacagccagcuuucucuucccaaagaaacucacauugcugacgucggauaggaauuuaaaaauugcacagaaacuuaauuucuuuuaguaaaacuagauagaucuugccagucgcucucaagcccguaaggaguacgauucugcuucucaaggcccaguacccucucuaagaucaguuguuacuguucagggcugcuguacuauuugaacaaagaacuaaguaaagaaaaaaaaaacuuuauuuauuuuuuauugcucuuuacuuuuuuucagaaaaaguaaguuggauuuuaaauguuaaagguuucuuuuuuuuucuucuccauugccuauaccuacccauugcuuugccuaacaaaauaucuuauccagucaucuucagcauucucaagaaauaucaagucauuucgguugaguggaggcuuucuccucccucgugcaucagccaggggguuaaucccaugaccaacauuggcuucuugaguuuccugugauguggucucuuuaagucuauugaaucauuuacauuuugagaaagagagagagagagagaaagugaaaugcucuuugagaagucaaagccauccccgagaauauaugguguuuguucagcugggggaucuuauuuauuugaagaacagagagaaaacccuucugacugaucagaaaagugggggagggagaaaaaacagcgucaguguccaaguaacuugagcuacaaaguuccucguuuuggagaaaaguuauaaaaagcauauuugcuagauccaaaaaaaauaccguccaucaacugcugagcccagcauaauguuuucauaguauucucacucuuuaaagggaaagaaaaaaaaaaagccauaaaaaccggggaacucgaaaaccuuuuugauauuuuaauauucuuaggcaggugaacaugguaagucuguuuuuccucuccugaguugaguaucgacgcuuggcuccugugugggccuugugucacugaucccccauguugauucucagcagcuauaauaaaagacggagcuaaugaaauuagcguguuugagaucucaccguuaacccgauaaggguuugcgaagauguucaaaagaaaacaacuacagcauccuuccuugcuucgggaggauuauguucuccaguaagcuuucuuccucucucuccuuuuguuccaaggcccaggaaaaagcuggcaggacucuucugcuugcaagggauacacccauucuccugggcucccugauucgaagucacuggugcaggauaccugggcgugucuccuuuucccucccuucaccagggcagggagagguucccuuggguucaucuuuggcccccaggaugauggaggccuuuuuagauccaaagccaaaacaaacaaacaaaacccaucagaaacugaacuccagcucuaccugaccacugcagguuucccacguguaauugaauuguuaauucauuguagcagaggguccccugagaguuguggcugauuaagaaguucugggagacaauaccaucaccuugccuuuacuaggacugacuguaccaagcaucuuuccagcaucugacugcuucucaggucuccaagguagaugggagagggggguggaguguguuuaucuccauuugguuaagaugggagucagauggagcagaaagggcugugcauggaccuugaaccugaaggaggcuccagguucugacuggaucccgggaggccuuucugugugccgugaaacagagaagacauugggcaccuggagguugucagaggugaaggcgaggcucaaaccugggccaccuggcacaacuugaacuguucauuugcuccaaauugugccaccacaguggccuuucaugaugguccagaucacagacaacaguugucaaggaugcuguguauuucaggaaggaguugaagcuuugugggggcagagugcccuuucaucccuaauugcaagggaugucucagaggaccaaccacaccccuuccuuuugaugaugaccuuucaacaggauuugcuuuggggagugcuuaucucucugcccauuugcgagugagucuuuaguguguuuaacuucgaguuuuggggagcuguguaaagcaggcuggccuccaaacucacagagacucaccuaccucugccuccugagugcugggaugaaagguguguaccacuggccaaggaucucuccauacagaccgcaagucacuuuaucaugaugucuucuuuuggaaucuucauuuguguuggccacauuaagcaaaagagaucguauaaugauagagugugcucuauaaacuagagacucuaggaaaaccauuucugucuucagaaauuuaggaagugacucauaauaccagcauuugauugguguucuguguuuguuugagacagguaaaaaaaacuuaagccuggccuggcuuuugaccuggaagcuuaugcucagauaggcugugaaccuuuugagacaucucucauuggccuggagcucaucaauuaggcagcgagucccagggauccuccugucuccacuuccccagcccugagaugacaaucagguggcaucauguaaaugauggucacuuugaucuuuuggaauugcacccacagguuggucuucuaggugauucuaaauugagagcaccagccaccacagagguauagguaacagauaccaccaaaggcuuugugaaggauuuggggucuucgcucuuguugguguugaggacaguggggguggugacagugaggacacagagucagguuaaugacuuugaggacagagauuuuacagcagaggggacaguguguguggcugaauuuuuaaguuagccaccuuuuauugagcaccugcuaugugccaggaguuaaggcauuucugacuuuugauucuuugaagauaauauccucuuucuuuucuugauguuagagguauagccucaccuuguagcuggccuccaacuuaagaaucuccugccugugucacccaugugcuuggaugacugguguauaccaccacucaaaagauaguauccaauacugucagaggagcuggaaugggcuaauagcuuugcccaaggcgacuccacagucugcacaaauauaagaggcauugugcauugaaggcacagaagugggagaaccagcgcccaugacacucaggaguaacuguagauggaacaagauuuuguagcauagugugaccacaagcacuaggugggcagguucaugugggauaugcucguuugugaauguauuuguugaucuguacaugugcucguguggcuguaaauuaaccaggaaggaagauagccgaucuuuaagugugauuuauugcuuaacuaaauauuuuucugucuucuguuuuuuaugcaguagaauuaaauuucucuaaccugaagaauaucugauggaucuagcacacaacauuauucuaauguaauuuaauguauauucuuccauuggauagguauauuguuaauuucuacaaauaaugacuucacaugugacucugcccucucuaaaacgucuugauagaucuuuguguugaugacuauuagcuaaugauguaagaccccaggaagaggauuuguagaagacaacacaugucauuuuuuuuuaauauguauaccauuauuguggccguuuguuauuuaaauagccguggccuuuuagugaauuccagcauuagcaaaccauguuagcgugacuuaaaauauguaaugaaauucucgaugccaucugaugacggagcuaucaaauuagcacuccuggcauugacagaucgccccugggaagauuagcuugcauuguuuggagaaaaaaaaagaugcauguuccucguggucuggcaacauuucugcaggcacugcgguaggugauacuaccggagggaugguuuauuggauguugaaacaucacacaguguguacccauccuacaauauuaaucuccacuguauacaagggacucgaaguauguucuggcugacuuguagcauucccucugagugcacgugugugcauacaugcacuuuucaugugcucgccugaaccuuuuguuuccuugugucacugucaucaguaacaggcauuuccacaccuuuucuuagaucuccuguuaaggcucucaggaugggaucuuccaccaaagcuccucagcagauacagcacagaaaguuuccuguuggcucaguuaguuguuuuauucucucagaggaacaucuucuuaccagccuuugaguaaagagcauuagcaagugucacugugagaugcgucauauucacacaaaggugaauuccaucaaagcuagcagucagugguucagaaucuuuucuuccucuauuuuuauuauuuauuuauuucaugguuuuuuuguguugccuuaugcaugcguauguguuuguauguauuugugugcauguguauguggcugcccacagagaccagaagagagagcuuugggccuucucggggcuaaaguuagagggggauguaagccgccagauguggggcuaggaucucaacuccaguacugugggagagcaguacgcaugcguaacugcugagccggccucuagcugcaucuuuucuugacuuaguaucauuguugucuuuaauuccccacacgugauguuuuauucccaagaacaaaaccaugagagucuaacaggcacuuucgugaagugccugcuucguuagcauuuauggggaccccaacagcacaagugguuuuccauguugggguucuccucuccuuguuuguaggagaaaaaaaauaaccaaacaaacaaaaaacaaagucucaggagauaaagguguaugaccuguccucagcagcugugacccgagagcugcauucuggcucucauucuucccucauaucgguguccauuucauauucaaacagaacggccuuccauuuacucuccccuccccccauuuaaagcucaguguucauucgaacuaaaaacaauaaauuuuagcauucacgcugugaaggcaaucugacauuaaaauauaugugugccuauauuugcaauugagcacaugcauaagaauacauauguauaagcucacacccauaccaguggauuuccauagguggaaccagguuucaucuguguguaauuuugagggugggauuagcuuggagaaguugaauucagggaggaguaggugaugaaaacauuaguguauucuuauugggucuggggaauagaaacacgcacacacgugugcacacacacacacacacacacgugugcacacacacacugguccauacuucuaccuuuuacugguuuauccugucuauccaccuucauccuccucgccauacacuguggcuacggaugguuucugucacgucaccuguuccugcuucuguguuuucuuuaacuccgaaccgagucucauagagucuuaaaggcauaucuaugguuuaguuguauccauuuggccucucucccucucccucccucccuucugcccuccugucccccuaccccugugugugugugugugugugugugugugugugugugugugugugccauugaugaggacuguuacuuuugccaaugaauguucuaggaacuugccuucugguuuagaccuuuaagaauaacaccaucuaccuauuugcauuucaauucauccuaaugacccacaaacauuacaguuagaaaacaaggaacugcuuccccauccuaauuuuuaucuguuuggucaaugccuuaaccaaacuucagcuccgaauccuugagcauuuccuuagcugcccugacuguuuguguuuagaaggacuuucacccucuuaguuccaggauggauuaaaaaaauauuuuacauaucuaguguaguguucucucucaaugcacauaugugcacugugugcaugccugguguccgcagaggucaaaagaggucaucacaucccccguaacugaagauuaugaaccacugcaagccaccaugugggaugcugggaugagaacguagguccucuggaagagcagccaaugcuccuaacuacugaaccgacucuccagacucccagcaaaggacauuuauuguuuuauuuauaauuuuuuauauuugcauauuauuuucuucuuuuauuuguuuuguaucaaucuaguacagaaaucuccaacacuaucagggcccaauacuaaaguguucguguuugugccacacuuugaggagaaugguggagcuuagaguuucccaaguaaauauuaagaagucauauaaaauaugcuugcccuguggacauauuuuuauugucauauauaauuaagaaaguaggagagagcaaaggaaaaauguaagauagaaaaaugucucauuaugucuuuuucuguaauucaagaauaauuuuccuauagaaaagcagccacucaguaccgagaccuccucgucuuuaaucaagugugaucgccgucuucagcugcucaaggucagccagugaguguguaggacuucauccuugugggaugugccaagagcuagacgcucagugaugcagacgggaggguauucauaaagccagacugcguguuucuugggaagguaaccccaccacaggcuguuucucuuagugucccuuaaggcaaaucugccaugcagcucagucacuggacauuggggcauuuuugcugauggucuuaaauccagggcaauuuauuauuauuauuaucaucaucaucaucaucauuucagcucagccuuuuauucgugauauuaaagagcagcauuuucaggaagaauuaaaaacccagucuaucacugccccccacaaaugccuuaccugugugacuuuguucucuggugucacuuggcacagucauuauuauuauuuuaaugaguucuuuaaaaaauuuuuucauacagcagguggggaggagauggaguauuugcagcacagcagaauuguaaauacauaccacagcccauaaccuagggaagaaaauaaugcccugugaauucugguguugcagcuugggaucuccuguuguuucgaaggaguuggcuaagggugaaagcaaagaauuacaaggcaucuucaugcuuaugcuggucugggucaccgccagccugugaccaugaauauuaaugugcgugaucacauuauauccaucccauccgucuccaugcccagauuggccuccaguguuggguaacuugggcauuccuggaauaugcuguuucauagugucuaaguguuuucccuuaaaaucgcauugaaaucugcauggaugcuuuggaauugcuuagucuggacuguucucagugaguguucuuagcaucauuucucauuggcauauagguaauaaaauauagagaagaagccuuuguugaguuggcagaccacggaccaagaauuguuucuaaauaagccauucuguuuaccuuccaucaacauaagauuaugaauuauuauacccaguuuacaagucagggaaucaaggcucccaaugaccugccuucaucccagagauggaugcuagaugauggagcagauaaucagauugaaguaucugggcccggaugccgucccucaaugucugccuuggcauagccuccccguguaggccugggcucccaccaguccaucucugacugcaggcucugugugcaccauguagcuggacucgcagcagugugacauuccggcugaagagagagggacuugugccucuggcauuugggauccucuguggccaggaauaaggaaggagcuguguggcaggaaugagccccgucuugccuucugggaugcaaucaucaggccguuucugaccacuccaucucuucccuggacauagaacucaacagaaaucagcacaagccugacuuuccugcuuacccaccauuuuaccgggagaaagcagguguggccuauggcaggcgugacuugucgccugcuucgucuuuucuuuuacaaauuuaaaugagcguuagauauaaccacguauuaaacguguggcacaauagaauauucuggaccacuccgauacuguagcaaggugggguggaccuugagccauucuggagacccuguaaauagaagcuuucaauugugguguuaugagggcaaauacugggugguucucaagagaaaauuuggaaguguuuuccuuggagggcaagguuugagaagcagggccuucagacagcaagggaggcaugaguguuggccaucucacuucccgacugacuucacgucacagcugcuguccacucuguucuccauguuuauuucugauuaguggcuguccaccuguguugguggcgauuagccuaucaagucacugcuggaagcuuggugcuauccugaugcuaaagaaucccauguuugauuuauuuccugaagcccaauuaaaacaacacccuucacucuguaagaaugcuaaaaugcuaacuuucguaacucuggaguacuucgacauuagaauucaaacucuuaguuugugugcagaauucauucuaucuccucuagugcucugugccugccugggguucucccagcauucccugucaacagccucuguccuuccauuuacccaaaugaaaaggugguuaauaaugucugaaagagcaagaugagaaagaaaguuagagagcacuacauacaaacaagaaacaaauucagagaagccaguaguaggcuaggcgaccacuccagggcucauuuaaugcaagaagaaauaaagacaaaccaagcaggucccaucacagggcuucccacacagaucuguauaaccuagagaugggcaaggcagccaggagcugcuguuauuucaacccaguacuguuuucagaaaucuuagccauccccauaccaaaaacccuuuccugaauucauugcaugugccccauguaaauacacccuaggaguggauggaacaugcccugugaauuauaccuuauuuauuaucgcagggacccuccuuuuuuuuuuuuuuuccuuccuuccaucaagcuuuggaauuaugggucggggcaguuuuuaauacucuauuuauuuuagggguggaaaauguuuuucuugcaccguaacauucaugcaguaccaacugcuggcagccuccccggcauguaaggaaauauuguuguaaggcuuuuauguuccauacuucaaucagcccggagccagcagcauccccacagaaggacccucugcaggccauuugcagcauuuugcuacaauuaaacuccucugguuuuagcccucaggcaauuuaguaccuuuuuacauaugcacauuaugaacuuuugaccagguucucgcagucauauauuagagcucugcucuuggaagcgggcuuaacaaguuccucugaguauugggcuuggagucaguuguggaaaagguaauugaagcagcuugcagugagggccauucaggaucucagagaugauccuaaaucucucucucucucucucucucucucucucucucucucucucucucucucucuucucuugcucucuccucucccccucucacccuuccuuguuuccucuggaagcugguagcaagagcuuucaaaguccgugauugaucuuuuauucaguagcuaacgagggcugugauucuauuagcgugcuacaaggcaggagaacagugauuuaaugaagugucuagugagccggccauagauuuauccuguugucgcuaauuugcggcgcaguggcaagcauaaaggaaacggugcucacagccacuauuaggcagguauuucccuuaguaaauuguuguaaggucagguacaguuaucugagccaaagcaaugccuccccucuucagugucugcagaugacagccgccgugcugagcgcucacugaaguggaacugggagaucagagguccgucucuaagucgcccuuagcggaggcaggagcagaugaacugccaagaaggaguaauagagucauaauuggugauuagaacugggaaaggugugauaacaucuuaauacaaacuggcguguguuauaguuacugucaguuguuguaaacucgccccgccacccaggacuaguucuguuccccuugauuagcucugagaaaugaggcagagggcacuggaaggaccauacugauggcaucccggccagcugugacugcuuccuugggucuuguccccaaccccaggguuuuucuuggcuaccuaugccuguccccacccaggaugcuaccacaguauccuuugccuaccaccuuggagggacuuugacccugucucuuuccgggcacugugucaugguugcacacugauuuggaggcuggcuuuccugccaagguacuugcaccucgacaaugcugcucccugcugcaguaaugcauuugcucuugcuuugccagauagaaaacacagacugcacaggccagagggaugggaaccuaugcguuaauguugcccaggauacgugcuggggguguccucacaguguauauauagaugguguccauccuugguaaagacaguugaagcuauucuuaagaugcuucgugaaaugcaaggcaguugacaagggccaccauugcaaagcaaggggugcauguucauguugacacaggcaggagacguccccgugagauguggcgugaaguggguguuguuuguuaguuuguuuuuacuucauaugagguuccagggucgucuagacaggcugagaagcucucauuauugauaaauccauggcuggucauuuguauuggcuccuugucgccucucuugucacuagauuagacaagcacgccuguaaaccuuuguaaaaggaaaggcguagcuugucacuuacaucgguuuaaguaggauaagccauaucuggaugccugggacaggaaaugauauaacaggccuggaugcaccuuaccuaccaguugcccagcaagggaaucucuuucccauuuuuaaacacaaagcaccuuaccacaaagacuggcagacuuggagcaguagugacaaaugucuguaaugugcccagugcuucccaugugcccacaucuuaucuagucuccuucuaguccuucaaggcccccgcauugacugacugguugguauagcugaagucuggccgcucuguuagagaagaaccaggguuuggacuggaacccaacuguguuuucuuuuuaauccaucgguagggaaguaugccccuugcuuggaggccucacuucccagggguuccccaugcauucugagagacagacauugcaacccuccuuucagcuagauggucauguugauuccucaagaaaugcccaagaagcugggcgugguggcgcacgccuuuaaucccagcacuugggaggcagaggcaggcagauuucugaguucgaggccagccgccuggucuacagagugaguuccaggacagccagggcuacacagagaaacccugucucgaaaaaaaacaaacaaaaaaaaaaaaaaaaaaaaagaaaaaaaaagaaaaagaaaaaaagagaaaugacugagagaggaaaagcagcaaguguuccaugucuuagcacgucuuacguuucuuccaacaugguuggaaaucauauagaccuacagaccgagcagagcagugucccgcagugguucugagagugcacuuauuaaggaaccaucaguuuggggcaggggguaugaagauugucugguggagaagaaugcucccuuugcaagcaagagcacaugacuucagauguccaacucuuauauaaaaagccaggcaggagccguauacaugccuguaacuacagcagcuaugagacgagacagaggcaggaggaucucuggggcuugcuggcugccaacucagguccaaguucagugagagacccugucucagaagacuaaggcaggagcgacagagcaggacacucaacaugcuucucuuaucucuggaagccugugaguaugcacaccccuuccuaacguguacacauauuacacacauacacacaaacauauacagaacuauugguuuuaugaccccuaaaucuaauaucccuuuuaaaaaugacgucuguguacccaggaucucuuaaucugaugauuccuggacuauggcuguauuuuccaccuauacaaccuauuugcucucagaccccauuugcacacuccauggcaggugaauuucuaaacuuccuauauuuaaccucauaaguaaugucccucaugagagggcauccucaguauaagcaauacaaacaguuuuguuuuuguuuuaaagaaagcauauucuguuacauagauuuguuuuuuuuuuuuucuguuagguaauuuauagaaugagaguuguuuuuuguugggcuuuguuguuuuagaagaggacaucaccccagacccaggaggucaccccauaugugaucccacuuaggcagacuguccagagcagucaaauccagagagaccagaauucagaucagagugguguccagaggccauggggaaaggggauacgggaaggcugcuaaugggucugaggucuccucagagggugacagggacauuuagagucagauagcaauguugacuacaugcauccuugaguguacuaacacgccacaaaaucagaugcuucaaaaugguuaauuuuaaguuuuaagaauuuugccccugcaacaggguggggagccuaaagagaaauguucugaugaagaggccguguucagcuguuuauuuccccuuuuccaucugcaaugaacaguccaacugugacagcacggcugagaaaugguuggacuucggaugaugccuggcgagcagagacaaacacggcacccaucccacacggugcuucgcgcagccgcagagacacucgccugucuuaucucuugaccacucuauugauuaguuauguguuugccugugguauuaauaauguauaccuugaaaaaaaucuaugugcauuauggacuuugaucuuacugugaauuucaaagccaacgauuccauuuucuucucucucucucucuuuuuuuuuaauuuucaaagaaguagacuagaaauaauuuuugaaacgucuuuuuccuuuccugacaaaagauuuuugaauguuuuguaucuauguuaauaagauauagauuaugcacacuuauggggcacacauauacaugaauauauauugauauauagucauccauauauauauauauauauauacauauauauauauacacauauacauugcaucugugcacacaugcaaggauaucauaagagacuuauaaagcgcuugcaguuuaagcuuaguguauuccagaggugugggauaucugaacacaauucuuacucaucuacuagauuaaaacagaaauuaaagccuuuggacuaacacaggaucaaagggucucuuuucauuguucuuuuauuguuuauuaacuucaaaaagacuucuucauuuaaacugacuuuaaugucucuugaaugcucuuuuguaaaaugacuuugaaaacucgaggauaaugucuucauuaaguggaagaaaaaucuuaggaaaaauauaagcggaacuuggcuuucauuaggguagagggagauaaagcccugcuuaauuaaugucuguuccccucuguucggaauuguaaggaagaaagggaugaaauuaguacuuauaaaagcguaaaggagcgcuggugcuuccugccugcgguccaggaauuuagaagaacauacuucacuguaacuauggcaggacuagaauaugcuagacagggcauucauuugggauagcacaugaauguaaacucuguggcuugagucacuccggcuucuuuggcacguuguuccucuccucuccucuccucuccucuccucuccucuccucuccucuccucuccucuccucuccucuccucuccucuccucuccucuccucuccucuccucuccucuccucuccucuccucuccucucuucuccucucccuucuccccuucccucuuuuucccucuuuuuccccuuuucccucuuuuccucucuuuuccacucuucuucccucuuuccucucuccucucuccucucuccucucuccucuccccucuccccucuccccucuccccucuccccucuccccucuccccucuccccucuccccucuccccucuccccucuccccucuccuucuccccucccuccuccuccucuuuuacuuucuccucuccccacugucucucucuuuuggcuuuucaauucaggauuucuguguguggcccuaguuguccugaaaagugcucugcaggccaggcugaccucaaauucacagagauccaccugccucugcuucucaaguggugugagccaccaugccaggguggugguguuuucagaguuuuuguuucucuaauaccuguuuagaccauugaguucuaaauuugagggaccuccuuucuguuuaaagacaaaauuucucaccucuuuucuaugguaccaauucacaaucuccuuucucagaaucugcgcucacugccuagggaaauguuucuguccucuaggugccucggaacuccauggacaacagauauucauuuguccaaggcuuauguuuuauuauuaccucuauuauuuauuuaucuaaucggucuggaggaugacguggaguucaguucucucuuuccaccaugaggaaggaccaaauucaggggcccuuacccucugagccaucuugccaguccuucuaccucuuuuuguagcuucuguuuucuagacugcauucuacuccuuugauguaggaacacaguuccacucugcccuuccucuucuuuaaacuccauagggacacaaacacgagacccccaaagguaaugcuucuaccaaggugccuacuagcugaccacacugcauccuccuccuacccguccccuuacaugaccaaagagguaacucugcagagaaggcacuggccagccaacugcaaaccaaguuucuaaaccccuccuuuuguucuccacggccaguauaaggcagucccucacagggccagcucauggcacucauucaguccucuucaaagacaucuugaagcugaauucacugcugugcucaacagucccagcugcucaggacuuaagaggacuaugucacacaaacucauuggagaauaucuuguguggcaaagugagacaccuagcuccaugggagcggggguaggagauggagaggacgagagaugauaauaggagagagaagagaagggagggauugagacuucaacccaucccagcuucuaagaaagaaagaacacucugguaaguagaagaaaaaaacaggaacaaaauuuggaauaaggcacaugugaguacaagugugguuugcugcuuauuauauugcucaucugccuaggaugcguugcugagcugguuugagcaucagucuccucaucuacaaagugaugguggcucuguuuacuguaagcaccgagguuuccuccaacgagaaugggcacagcagcaauacauguucugauuucuccguguaacagaucuguucuggguuuuucucuugaggucacuaaggccacucucaucaccugccaccccucaaggacuuucaauagugaagcucccugguucugcgucuuucucucuacugauucuaacuggcuccucugugcugauuguugauggaggguuggggguuggcuuugcuuucacaacugugcagucuugcuggccuuacucuguugugaaugcucaaaugccacucaguccuagauuucagaggcagaugcgagcagccuggguuguaaguggcauggagucacugucacuguguuacguaaacccucagggauguauacgcccucucccuagaagagucauuuagccuccuaaccacccacuaaaauuucuacuuguaaaauauuuaaggacugcuacuguaaagacacgucccuuccacagcuuuuugcacauuaagaagggggcaaacaaggaaaugcgggucuggguaccuaauaaaaaaagaaaaaccaaacucuuaaguuauaaaauguguuagcugacaccagcucuuggaaaggggcuaaaggcaaagagaaaaggagcaaaaaaaagagacgagguuuucaauuaagauggcaggcucccuaaugcagugugauggcagcaccguaaaucacccauucaacaugaagcuaacuuccccuagaagcuauccugggugugcagcgggccuuuugaugcaagagguuuaguaaagagaucuggaaaacugaaucuuaaaaauggaacaggcugccaagacaugccuuccucccaguaaggaagaauguguggacuugccuuauacugugggcauccaggcuuggccauguuuuccccaagaagacuguucuugcagguggaugaaccacagaucaggugagccgaugcugggccacaccuagagaugcuccucuggguguuugcuugacgcaguuaaagcaaaccaacaugugcgguccagauuaacauugauauggggauaauauucucgggaacucugcaauguccacauuuuagguugaugucuuaauaaaggcagcgucaaacaagcccacacaugcauacagguucacauacagagucuauuuauuguuuccgggagggucagaguuacucuuuuggauuucuaagaagcugccuucacaauggcauccuauggacccaggcuccugccaucuuguugcucugcaucccuccacucauugcuuccaccgcuguccugcuugucuguaugaggguaugaguuuagugcuggaagcaagaacacauacaguuauggagggaggggaccauuugggggaacuaauaaauguaggagaggugaauuucuuuccauuauaggaggccagaaaauaugguuuuagcuaugcacccaagaagaaguggacacugcaggucuuagcucuggcagaaggacuaguguuuguuggaaaucacuuuggacucuugauucucuuuuuuuauuuucacucaaguuguuuguacauuuaacucuaaaacagccauagauaacgaacaaguauccaugccuuccaugacuucagccuuguuagcuccucucuuaccgcccaucauauuaaauguucuugccuaguuucuccuggcuuggcugggaaacaagauacuucauagagcuccuggcaacaugggauggccauauggaaagaucugggccaaacaaguguacgaggaucuauaagaacuucugcauuagguuuucugcuuuccaggagaauuagaaagguguggcuagugguuuuguucucaauuucuuccaaccaggaauacagauucaguuuccaucugcugcuauuuucuugauuucaugaccuaacccaagagugacagaauucaaagaaaugacagaacagccuucacacuggagagcuacuggccauucuuagcaucugcauaacagucagccauguuucuuuaucugcuuucccccuccugacaauucaugaaccacaaauuaugaggucagugcuacuugcaguguaggugcccagagucugagagcacugugggaaugugacggucaccccucaccucgcuugucuagcuaggcauccucaaagaguaaugaaguuuugcuucagcgagggaaugauccaguacagugcuuccacaacauugccaguuacaacuuacaaagugcuuccucccucuuugugucuugcucuccaacacauuucccccuugggugguuuugggucauguugaucucagaacuguugaucaugcaugaaaccuaaagugcugcgugaaccuuucaccguuccugcuacucuugucucauguuccucuucgacuuuguaccaagacacacugauauuauaguaauugccuagaaaucucuauuugggccacauuggucggaugauaaaaagagaaggaguccuugaccaucgcuuggucugaacgaagcuggcugaggucuuacaacucuccaucccagccacauccucagcagaagcagcauucauggacaccgaggaucacaauaguaacauccaagaaggaacguuguaaauacccucaaggugcagauguccuacaggaaagaaaguuguagcucuuuuaaaggaaucaauuuguaaacauuuuuuuccauuuauuaaaaucauugcagauaaucugugucaucuuuugacucuacacauacauauaucaaauauuauaaagacacuuuagguuuuaaaaguuauauauaugcauguauauauguguauauauacauacauacauauauacauauauauauauauauacacacacacacacauauauguguacauauauguguguguguguguguguaugcacaugcauacccaucuucccaaaugcacaugugguucgcucauggaguucagagaacaaccuuccaaacuuaguucuauucuucuaccucauggcagcaugucacugguccugcuguauacccuauaccagccugcaagauucuaggugguuuuccugucucugucucccauuucccaauagggaugcugagguuacagaugugcuccaccacaacuggcuuuuuaucuugacuucuggggaucaaaaucagguccucagacuuucacggcaagggcuuuacccaucaagccaucgcaccugccuguuacuugcuuaaugcagaaauguguacaauucagauauuguaguuacgucaguaaagccauuccaguuagacagagaucaugggcuaaucguggccacggcuauuccuagcagcuuugcuuacaaaggccagaggauugauggagagaggggaagccaacccuguaaauacucacgucuguguguauuucuguuucuagccccagccccucagaggugcaagcacacagauuugacugcauguugcauucacauuccucaaugcauugacgacgggauuaugaccagggccagagggaacgugaccugcuuuguaucucagaagccaaugccaugugucucuaguauugcaugugccagggucaccaauucuggaaacuucugcuuauuuguaaauaagagaaaagaccuugauaacuguuuccaaagaaaacauucagaaaguuuagagccacuuucugcccagagaaacaugcugaacuuacuguucaguugagagcauacaacuuagaauguauaucacuaaguuuauauauuuggagaaaauggggccauuuuguucucagagaaggcaccaucaccauaaaccaagcaugcagagggauuacuggucuaccuagcuccugggccaacucugacccauugccucucucugugcagcuugaaaaucaagagcucauuuuauauuuuaaaauggcucaaaauauuuuaaaaggaaaccaguaacuuuuaauauaugauaaauauaugagauucacauuggaauaucucuaaucaaguuugacugugguacaggacuguagcucugugggagggugauugcuugccuagcacgugcucggcccaggguuugaucuccagaaccacaggaaaauggaguaaaguuauauuggaacacagccuugucugucccugggcuacagcagcauuguagcagcagaaguaaauaguuguaacugaugugguuuggcccccaaagcuggaaauguuuacuuaagacccuuuucaggcaaagaguacuuacucacugugagcagagauuguguuugcuuuggggccccuucuccuucagcaaacugugggaagguggggguguuuaccacacuauugaucagguucucuuggccauaaaaaaacaaaacaaaacaaaacagauucccgcuuuucccccuuucuucucuuuucuuccuucuuuccuucucccuuucucucccuauucucucugugucucugucucucucuaugucgucugcccccacccccacccccgccucuggcaggaucucucuauagcugaccuggaauuuacuauauaggcuggccuugaacccacagauauccgucugauucugccuucugaaugcuggaauuaaagguguguaccaccaaucucaaucaaaaugaauuguuuuacauuuauuuauuuauuuauuuauuuauuuugagugugcugugcauguguuuagcaagucagcaaauugugacccauuuuuaauauuauuucuauuuuuuauuuuauuuuauuuuauuuuaaaugcucuucaccaaguucccacccuugacuuuuccccuuugcccuccucuuuauucccaggccuuugcaaagcgagcauuggccaagguguuagucaaggguacugcaugcaaggaguggccuucagcaggcugggaagagugaccuuuaagauucccgagacaggagggccaccaucccagacucuauagucgcaggauuaauuuaggggugacaggggagggugcucccuuuuuaucuguuaacuccucugggaaauucucugcagaaugaauaaucuuggaauguguaauaaaguucccuaucgagcccacuuuuaccgagagauuuaaaugugauaauaagauaacagagagggaagugacuccgugagcaucuucuuuuauaacagcccuuggucccgacuguuaagcacaccguaaaaugacuuucauacauuuauggauugaaaugguucugcugaaauuuuaaguguuaauguuguucaaacuuccauuaccaaccccucucgcacgguuacaaaacaauuuccuacuugacauuuugaucacacuaccccaggaugggaaagcccuggucucgugccgucuaaagccccugcagauuuccacuggagcaccuuucuucagaagggccgccaccgucuguuugcacauuuuacccuaaagcauccuugaccaugaucccaagagaagguauuuuguagagaaggagagaagaguaccuuuaaaaaaaaaagauuuaaauggaaaagaaagauugccuuuuuuuccuguccucacagugguccauccccucuuuauccacguuugaguuauuuugucauauuccuuaaaacuaucccagaauccaccuacaguucauaaaccuuaccucacuuuucauagcaguuuuauugagauaugagucacauaccauucaaucagacaaaugugcauaccugucaauggcuuuuaguguauucacagagccgggcaguaaccaccacaaucaauuguagaauauccuuauuacccugaucguggucaccuggcaggaugcagccuguuuccucccuggcugccaaagccaccacucuuccuguucugugccucgaauguaauuagucauccauuccccgucgcuccgucugugucucuggcuucuuuuaggaccgugaagcugucagucaguauugcauuauaaugcccagccucucgcuuauuaucuuuuccuuauaugugcaaaauucuuaaaauacauccaugcagagauaccuauaggcuuauacaagcauccuggcucuuuugaguuuauugcuauagacgccaugguaucuagagaagcucacauuguguauguaaaugcuggguaaagcuaaugccaguuaauugggccugagaaccucccucaauacaucugucaguacauguaggggaaaagccaacucgcuaaugagguauuuccagaaacugcauuguaggcucuguccguuccuccauguuugaagcugcuacugauuuguuucccuccaucuuuccugagaacugagagccagggacauaugucccuguguugucuugccuuccauauuaaccagggaggagauaccgguaaccuuucucagaugcugcuguggcugagacaggagcugguggaagguggauacauacauacauacaugcauaccauacauacauccuuccuucauguauguauguauguauguguacauacauacacacacacacacacacacacacauacauacaggaaagaaggauuaagcugucgcuugguucuaagauagauuuuggccuguuugaaggagacuaacauuaaccaaagauaacuggagucaugagaaguguugaacaaauagguauuuugugagguaaugagggaaguugggugguguacauucuuccugcccuuccccgggacuguccucuguucagaugccuguguccugguuugccaagaauacacuccgguaaacacagugaaugucccugguauuaccaaauccagguaaaaauaagacaggugguguggauuugcccauguaaccugagaaucgguuuuugucuuuuauuucaagaccugucucccauuaucacggaggauggaaagucugcuuaaauuauaagcuagcuaauugcuuccucaguugaagaccuaaaugaguuuuaaagcgaaaugcauaucuccaagggcuaaguagccagcacacaauaggcaauugagauagcaaagacuaauuuagaaaagucuuugcucucucccuccccgcuccaguaccaugccucuacuucucccuccucuuuccuuccauugucccuccaucccuuuuucuucaucucccuccccuuuuuuucucuucugucccuccgcccccuuucauucacccucccuccuucccuuuucccuuucuuccuucucagccccauuucccuacuuugacuccuguuuccucuccucuccugccccuccccucccucuguuuccuucuucacuugcuuccuucuucuuucucuccccccucccccaccgacccccuuccauuuaaccauuuggaaugcagcagaguuguaucuguggguuucugcuccuaauuaaauaaaucauuuaugcauuuaacacaaucuugaguuacuaggugaucaucugaggcacucagaagucuaagagcccuugaaagccauauccaagcauagauauuccauagcacgucuuacaaucuaaauauugcuuuuaguguaaucgaagcagcuagagcagucccagcaguugauggacuauuuuucaaauugauuucaaaaauguauuuaaggggaugaucuucuagucuagauuaccuauugauuuuuaauaugaaaagcucauuauguaagcaguaacugcauauaaaaaccucgcaaaccuuugcauaaauccuuuaauugaauuuccagagccugugguucuccuuuuuuuuuuaauuaaaucuauuucuuuuuuuaaguguuacuguguaauuugcaugcugugaagaggcccugucccagauaaagugccauugauccuuauuaaaccucaccucugggcuugcuuaaaacuaacuggaaaaauuaaaggguucaugccgcacugcacuuacagcgccucugaugggauuaugggaaaaaauaauaaaacuaauuuccagcagagaauuuguaaugugagauuuuauuuuuuuuucaauuugauaauuaauaguaaaaucuuaucacagauauaaaucauauuuuagccuauaaagugaaauggcaauuaggaaagauaauauauacuugauguaagcccaucauguuacggacucuaaucucuuugaucuuucgguacuuuaauuuuuuaauuguggaaggaaaggauuauaaaugcaguucaaacccacucaauggaagguuuccuugggaaagucugauucuucugugguucucagagggauuuuuaaugucagcaugagggagcauaaaagauaaggaaaagauacccagcuaugcuuguacuaaaauguauguguuagaauuaccaggggagagaagaauaggaagccugcaauggguuuuucuauuuuuuaauaccuaacauuuguuauuuuaaaagcaauaaaauccccuaaagaaauauucauaaucaauaagaacacaaaauauggaauauauuaaccgaguuauaaaaauguuugugguguagcaugaaaugaaaaacacagcaaguuauguacgguuuaaaguguaaucaauuuugagguuguauacaaggauauaaaugauaaacacaaguaguagcguuuuuaguaaaggcuauuacaaaauacuguauuuauggccuauuccauucuuuuuauagcucauuaauguagaaaacaaacacaguguauccaucuucuccgacagcguaaaauucuccuaaaugauguuuuuaaauggaaauacugggcuuauuugaucugcuucuacuuuaagcagguuagguugauagggagcaugugccacguaggggguucuuucucagacucugcaaaggaagaaggauaacagugacauacggcccucacuccacacaagaagaugguggggggggggcucaucuaacauguguaaaaaaugcuugggcagcuacucccuccucuuccagggcuccaugcccacccucuaggucugauccccaccccaaaaagagccuucccaccuauggaagaugcauuaauucuuccaggccacaagggggcuguugaguuauugguucacugcguuggcuggugggggaguuuuagugccaguuccaaagguguuuaauuuccugcagcgccuaugaauaugcauagggcaugugcucagcaaucuagcaguucaaaagagacagcuggcuuugguaauaaggauuuuuuuuuuuuuuugguuagucucucuuuuuuuucuuuucuucuuccuuuuuuuuuuuuuuuuuuuuuccucuucucuuucuuuccccuucucauggacaagcccucccuggguuagcugauuucauaauguaauuucauuaauuuaucuccaauguuugaaaguuugccaugauggucccaucaugaguuucuuucuccuuucauuuccacauuccacagaaacccuagguugucaucaucaauggggcagaugcccacgaccauggagucacaggcuuagcuauccagccuuccuaaaauauaaguagggcuuacuagucuagccauauccaaaaaaccagaaaaacucuuaggaagcagggaaaguauugaaaguucucuuuucucuuuauuuggacugaagauuucucuagcacuacacagcuccauccaucccaucuauccgucuguccaucuguccauauacccaucuauccauccacccaucuauccaucuacucaucuguccaucuacccaccuauccaucuacccuccuauccauuuacccaccuauucaucuauccaucuacccaucuauccauugacccaucuguccaucuacccaccuaucuacccauauauccaucugcccaucuacauaccuacccaucuauucaucuguccaucuauccaucuguccaucuauccaucuguccaucuauccaucuguccaucuacccaucuguccaucuacccaucuguccaucugcccaucaguucaucuacccaccuacccaucuaucuauccacucaucuauccaucuacccaccuauccaucuacccaucuaucgauauacccaccugccauuaugguuucucacucaaaccucuguccaccuauccuuccaucuaccaugacuccaacacccuuccuuuucccauccauccauccauccauccauccauccauccaucauccauguauucauuggugcaccaaucuacuaucuacccaucccacucucagcauucugacacccuucuaucucuucucccaacccauugaccucuccauccauccauccauccauccauccaucauccaaucauccaauacacaucaaauaccuacugugaaucagguaccacuucagucagcaaauccauauagauaugaauuuaggucagucaaugucuucagggaucucauuauguguggagaagacagucuuuugucaguaauucuaauagacagaagaaauaaaggccuaucucagcccgagagaagaugcauuuugugaagucuuucauuuuaaucuugcagucuaauuguuaaccucuuaacuauaguuucuauggacuuucuacuuuauaacuuaauauugcaugggguaucauaauaccaagugcuauggagaugaagauuuuagagggacgucucuuuguggcauaaaacuguugagacagguacugcuuuacaacacaacugagauaagacacaccagaucccugccagagacagccuuugguuuuguugucuccugagaaucauguggccccugucacaggaaagucugggccagucagcauauccaccauagaauucuaugcauauaggauuguccauaugcauacuggagaugaggcaccaucuccgggcaccaaauacaaaggcaauaucuggccugggaugcaaggccaugguuagaggccagauucaucugggauucuagacccaaaucgagaaagaaagcccaaguagagcucgccuuauauuagaagcuucuuguaaugcugacccauuagugccaucuuguuuccuacccgcuucuggcacagagaagccaaaggcaacaauaaugaaucuucccacugugaggcaagaggaccaugaggcugaaggcagagccuacccuuauaggagcugccacacauccuuccaauaggcuaauggauggucagccauccaguauuagaacaguauacccucaagaacuuugucuucauaauauuugaaauguaaauaaguaaaauaaccaauaaaaaaaagaaaaagaagagcuuugucuuccaguaugguggucauuguaacauguggcuguuuauacgcacacuaauuaaaauuagaaauucaguugcuuaguccugugucacgugucccauagccauguggcugggcacuauggaccauuucaaacaaagcuucuaugucuccuaggguauacaucacauuuauccaucaaccucuuccauucaguauuggaaauaugggcacauucagcagguggcacagacgcuuucauuugcuucgccuguguuucaugcacaucuuuuuugaguauccuaugaggcuguacuguuacggugcguauuuuauaggcgaagaagcaaauacacccagcaaggaguuagcagaguuuggacuccaacucagacaguucaggccaucgacucucagugacugcauguugauucccaauuaaaagacuguauucuucauggauacaggacaaauauguugacgugugaggccucugauggucaggagcuguguguguaagcuguguaagguacugcaaaaucagcuugucacguggauagaccccaggcgaaggguccauggcagagccaccacuccuuccccacucuccauggacuuuaguggguuguuuuuuuagaaaugucuguaauucuguuggugccaggggauguguaugagugugaaauggguugagauauagauaguuuuguuucaaaugaaaccuccucacaaacuaaagaggggcuuggaaagacuucuucacagagaccagaccagcacaucaggagguacccaguacagaaacccaggcaagcuguaagaaaaggguagacuuacacagccaguucuucacaugagccuuucaguugguucaagguaaagacauugcaauuugauuggaucuuagaagaaagucucucucucucucucucucucucucucucucucucucuguguguguguguguguguguguguuguauaugugucacacaugcacaacacacacauacauacauacacacacacacaaucuucacuaagucuaagcuaguaaauaaauaaauaaauaaauaaauaaauaaauaaaauguaucccguuuuuaaaagaugagcaucauugugacucuaggccaugccuagagacagaagccaacagaaugauccaugcucuuaauuuguaaauaaguaaguagguuuccggagcccuaugugcccuuaagauuuuuccaacugaugaaagcuagcaauugagaucagccuggagccucggggauuguagauagacuugguagucuuuccaggucuguuugugauucugcccuaucuaccccgaaaaacuugaaacacuucccccaggagaccuggacaccaucaaaggcaagcuucuguaaggaauagggucauggcauaaaauggcggagagaauugcuuugggggagauuuugcugggugugauuugucauuaacucaggacaguuguccccagcccccaacccucaauuuaaaggucuugaaagcuuuauuuucccccucaaaugcauuccaacauuaacacaagaguacacugaagcuagcugauagaguucugaaaaagaugaagauaagaguuucccccuaaaauacucuagccauuucaagaaugucauaucuucugcuuagagcagaggguaugcguagauugcagugugugugugugugugugugugugugugugugugugugugcacguacacacaugccauggaaaugccaacaaagcugcauuuguauguagauauaacaccuacccgugaaccuuuccccaugcauccuuuuagggcuugagucuuaaaguaaaauccugcagucuccaugcagaaaggacccaaucuuuacccaaagaguucuccaugucuccuggccugguucacgcugagccagccaacaucugcauuucugauaacaguuugcuuccuuaugcuuuuugagggcacuuuuaaaaagcuccacagaguaauuugcaagcauguccuucaccaugcuguuucucagaaguggugaccugggggacaggagaccucugcccguguggcaugggacaauggauauucugccacuucguaccccacaaugucacaaucccaccuacaaagaagaggucgaaaaacuucacucauguucuugcucggcaucaaauaacuuuuuaauaaccaacacucccugaauauuuaucccuguaucaagugcuuuuaaguuuuuuuaaguugcaaauaauaguauugcuguacacuuguaagcaaggaaauuaaguuucagggaggucugauggccagcuggaugucacaccauugguaaaugacagacugccugccagcaccaacacacuucccgggacuguguuguaucucucucucucucucucucucucucucucucucucucucucucucucucucucucucucucucucucucucuuuguggaugggguggggaggacccaucuuguucauccauauccugaaucuaucaagagugccagguacacagaagauccaugauacggucucaguaaagaagggaagucauaacuauacauguggucaaguuauuuccagagaugggggcgggugucuuaagucugcagggaaugaagcuuacgcguguuggggaccacuuuauaaaaauagcaccuagaagugcgucucccugcgugggaagggcuucgcauucagcuucauguuuaguagcucaaagguugagcucuauagugcaaaaccaaccuguaggugcuuuaaacaaucccaaugaaaagauccggcuucuucccuuucucuccagaccuucaaaugggaaaggcauuuuggaauuccuuugaguuugcugucgaagcuuaagggaacaauagucuguguugacucuuugaaauggauuuauccugaagagcaugacauaguaguuucugccuuccgggagagaagccagcuccacgggaagaggggccucuguguugagcaaugcucaccccaaaaguuuuguccaguaucggggacucccucaagguuuacuuuuuuguuuaaaguggguagaauuccuccucuccccuuuuggguaguuuuuuuuuuuuaauggucuuuagcaacugaaguaagugacaguggucaguggaggcggacaguaagauuuauaauguauuugugcuagcugauugccaacugaaccggucuuucccagcggugcuguacgcagacuuggaaaaucaauagggauuaaccucugacccacugcacauacuuauacuguggcugcaucgcuuaccaauauuucaucuguuucacuuagccgcuguuacuuauucaauaacguguggccgaucgcacaagauacuaauuaauuuuuuaaaaugcaccaucgcuugaagcucugaugaaauagcccaccuuuggaaauuaaggcccuuuuugguuuauuuauuaaacucacauuaauuagcccuaauuuaaaaaaaaguuaugggacagcauuaugauauaaagguuugcuuuguuacaaaacucgcugugguugguuggcaccaggggagaugucuggcuggagaagagcaggugucccuugacugugcuggaagauggcucccguucaguaaaauuugcugguccuacuuuuugagcauacuuuuuuuuuccuuucccauuaaagggacagcuauagauaaacagacagugacaugagcccaaggcuucauuacuuuaaagaaucaacaucacugucaaugcauggugccugugugcucaccggucugcaccuguguguguuucugguaugaacugcuuuuaauuugucacagcaacaaaauuugcagugauauaauuuuguaaucuuuucccuuuaaucuuuggcauauguuaaaguauugugcaucugucuucaaauugaaaguauuguauguuuucuucauucuuccucuaagacucuuuuguuugcguuuuuuuuuuguuuuuuuuuuuguuuuuuuuuuuuuuuuuuuuguuuuuuugcuagugugcuuacccccccagaguuuacuuacaguuuguuauugauccggcagcuggaguuugaauuggucgaugcgcucuguaacuuguuuaagauacccuaccugagcuauuagcuuaaauaauguauucauaaauugauuaaucauuacaguaaaacuuauuagccgcauuuauaucugcguguuacccacaauugacuuguagucuaaucaucgcgggugcuuaagcagaggcuggguccacauuacaauuuaauaauaaucaggcugggaaacaaugguguuugcauggagaccgagagcggaugcaggcugagcucccgggggcagcuucucaccuucccaucagucuccugccgaaaacgagcugcagggaauagacccgagauccucaggagcaagugacugugcucacaauggccauucuauucugaaagccgcguucuugagcgugaagugaaggaagacugucuuucacacucccuuucuccagcagcuccaucauggcggcucuccgugcaugacucuuuucuccuggcuccacgcagcuuguaaacagaguaagguacgcucuacucagccauacaguggugcccacaaacacagagcaguuguucagggucuugcugucauugaauaccccgaaccagugugcaggcuuuccaccuggcucccucaucagcaggcggccucucgccucuauacauggggcuggaggcaauguguucuaugucucucuuaauuaauauacuauuuucaaguauguuauuauuguguguguauguauguauuauguggucaugcacacaccaugacacccguguggagguccgagcacaacguucauaaguagguuuuucuccuuccacccuggauuccggaaaaugaacucaggcugugaagcuugagggcaggugcuuugcgcuguccuauaaacuaauuuuaaagcaauuuaaacuccuuugcaaaauuaguuugcaaaaauacaguuugucuaugaccccugacuccacaaacauaguuucuucaagccacaugcccuucuagcccaacugcaagcuaguuaaaagcaauaguuuggguaauagaugugaaauuuuagcucauucaacuaaggcacacccaacuccuugauuugcuguguuucugguuuguucuuggguacagacucuucaagauagcccccacgcccuaacacacacacacacacacacacacacacacacauacacacacacacagagcuucuauaacaacuggaucccuuuggugggagagucacuuggccucccgaugggauugcucaacuuuguaauucccccuucaaaauguuauucagcaaccugcuagauuaauguauacugugaucucucaguagcagcgaggggacccugucucgcagcgugggucuguuuagucucgugucucaagagugcugcucuccgcaugaaggauaucugcucacaagccagccauugugccucggauucagggcagcaccucggccccaaggucggcuccagaugaaagacagauugccacagagccucuuuccugaggguccccccuucccaguaugggacuucauacauuauugagcaaacccgcuuccccaccaguccugcgugcucgucuucugccagccuuacucagaaugucagcaugguucacuuuucuacaaaggcaugaaggaccagucagggaccuucaguagaugaauuauuuacaguguuuaauuauuaucgcacagauuuauuaaaacuucgugguucccucggagcccguguggcugcugacaggaguuuucuaaacuuggaaucaugagcauuucauugggaagcaaggucucuuguggaugcuguugccacacaccugauuucuugguggguguugguagugacagugugccagcacagguguggggaguguguuucuuacugggguauaaaugcccauggcccuggcugauuucaggcugccaacauaaggucauugaauguaaaguugcaaaaacuggugcagucucacaccaguacgugcacaguaggaguucugcuauacagauacaaugcaugucagcaagaccuagaguauauauugcaaucaagcauacuagaauuacccacagguguuaaguuuugacaaacucucaucuuuguauccuuuguuccuuaaucauucauuugcaaaacguauuacauauauauauauauauguauauauguauauauauuuuuuuuuuacauuugugugugugugugugugcaugcgugcacacacauauaugcucgcucaugugcgugcaugugccucagggcacagguggagauuagagaacaacuugaaggaaucaguucacucuuucuaugagcuggguccaggggaucaaacucaaugucuuccaguuuaacugcaagcaccuuuacccaccaagccaucucgcugacccacauaauuaguauuuaacagucuagauaucuacuaacuaguucaugaaaguuuugaaaauggagcggcgggcuuuccugggcgguuuggcucuaccugcagcacacccaagugugaacguagauuguaucuuaggcucuggugcaguucuccaucucuuccuauuuccuaauggggugucuuugcacgguuuuccacguggguaugacgagccaguuggcaaagcugcugagugcccucaacugcaggcagacgcauuuacccugugcggcacauucccgacaauucugucgcccugauauuaagaacaacagcauuuugccagaagccauaacaagaugauuccguaacaacagcugggugacaccagacuguguuuugcaauuuucuuuuaauauuuaugcugauaaauaauuuaucccuuuuuggguuuuuuuuuccccuuucuuuucuuucuucauugugaacguguugauauagacaggugcuggguuuccugaaugucuaaugccagggucugcugguuucccucccugaugaagcagguucaucaacagaguucagccucugggaauugucugccccgugcugcauuucuccuguuagccugaacuaaugggauccauuaagguccagcccacauauuugaaggaaucuacucauuaaagcccuguuugugcauagcauuuggacaugagaaccaugaucuaggaaguucaaaggcaggccucauccauucaggacugacuggggaugcucagccuugguccuuccuuacugacacuggaaacugcguccuauugcuggguggcugucugacuuguacguuggaaggaguuugcuaacaccccuacccugcaccacuuagacaugaauagcaacucccccccccccgcccccaguggcaauaauuaaaugcgucucuccauaaaucccuugggagugggcagagucagcauugucuuggccaggaagcaguucuagaagguaaggacuuagugcuucaagcaugugggcaaggggcuaugggauugccucuccacuugcaguuaucccucccugcaacuggcucacaggaucuccagaccccagaacacugaaacuguccuagaacucacucuguagaccaggcuggccucgaacucagaaauccaccugccucugccucccagguguugggauuaaaggcaugcgccacuacugcccggucuuaggucaacuucuuaaucugggccuggaccagaggaaaaaggacguuucuaaacagucacuguugccugugccucagggucaucuggauccaucccccaaguagguggaggugagaauuuuauucuuuuuaggucagugguucucaaucuuccuaaugcugugaccuuuaaauacugguccucauguuguggugacacacccagccauaaaauuauuuucauugcgaccucacaacuggaauuuuugcugccauuaugaauugcaauauaaauaucugauaggcagccccugugggguggagacccauagguugagaaccagugcucuaggcuguugcaugcuguggccacaugccaguuucuacacaaaguaguaaguggguguaucucccuaggaacugggcagugugaucuuggaaagguaggaguauuccugguacauuuggauguggauggagggaccaugggagauaggccuuuacugggagaaagcucuuuagccacucugguguuggcacucagagaguccagaagugagaugccauguuauuccaugacuguucaaguccuugcugauccaugauaccaauuuugcacagcucauuuuuagguggugugaucauauuuguguucuuagagcaaugccaccccucacccauauaucacccucaagcccacuuuccaaaccaugaagggcugaccuuaaguuuucacugaguucucuucuugcccucaggcaguugauccuggauccucuggaacugcgguggagggcacuguugggacuccgugcuuaccagacaucacuggaaauacuguauaugauguacuggacugacagugauccugggauacuccuguaggccacacagguccuaugugacucuggguauaugacauugguucuaagagucuugguuuccauucgugucaauugagcauccugguggauccauagaggaauagugcgacaugaaccuaaauaauaacuagggagggacucagcuauugaggaccugaguuccauccucagauugcacauaaaagccagaggcagugacccaugcuugcaguuucagugauggugagauagacagaaauagaugggcgcuugcuagccaacuagcccagucaacguauugacauuccagaccaauaggagaccccaccugaaacaauaagugaaaggugccagaggaaagacacccaggauuguccucugaccuccaccaccaaaaauaugcaugcacacacauacacacgcgcuaucauaaaagaucaaauaugaaguaagccauuagaacgucguccauaguucugcuacguggcugcuucccaguugaaaguggaguauacuucacuuuggguuuuauuuccaguuaagacauuccaucagucaagggcccugggcuugugccucccugccugggaggaccuugaguggccuggucuccgcagaucgucuggaaucccagggcaaacaggccccuucagaaagagucagcaucagcaguuacacgccucccucuccaucugcaaugggauuuugugcucguuaccaggagaucaauagugaaagcugauucuguuaggcuuucggcggcgggggucauuaaucuccuucagccucaguuucccuaucugugaagugagucuaacugggaugauaaugaagaguuaggucaagugagguuggcagccagacaccuaccaccagcuggaacacaagaacauauguuuccucuacaacccaggucagccgagguccuccuguuuagaauaaugaacugccaugucuggagucuucucucucuucucuuggucgaauauucaaguagaaacugugcuuuguucgcccgcugaccugcacuucagugccagugacaacugggagaaaacaagagggugacaagcgauugucuuuccuaugcaugggugugcagaugcaugcauguaaugucaugugcauguguguguggaugcaugcaugucaugugcauguguguguggaugcaugcaugucaugugcaugugugugugcacggaugcaugugcuaucauauauauguacaugcauguauguguauauguaggcccuugggugucauucaguuuuugaaagaggaucauugccccggagcucaugaaauaggugagauuggcuggccaucaauccacagggaucugccugucucugacaccucagugcuaggauugcagguccauagcaccauacccagcuuuuauuuuauguggguccugaggaccaaccacacucaggugugccaucugcaaggcaagggcuuuacugacugugcccaacccucuuccuuuuuuauuuuuuauuuuuucuuuuaagcacuuuaccaguaagacuuacauuuucaucaguuccugugaaggauucacauauguguguaugcaugcaagucauguguauuuuccauguucaagcacuuaaacugaauucaggcaaggcuuguauuucuagaaaguucugaucaccuagucuuccucuucccaguaaagcagaauagagaugaccauaagcuaaggucuggagcugaggguuaucgcagaaggaaggggacgcaacgugauauuggaauggucuaagcuggccuuggaaaccccuacagcuugcuggccucacagugccagcuggaauacuugccucuugcugaugauaaccacaggguguaucuugguguggguaacaauuggggagggggugccaggccugacagauagugggacaauuuuaguguuuauauuccacugggguaagcacuaacaaagacccgccauuucccagauaaccaauucuuuuaaaagaacaucuguugaaacuggcaauuuacaaucuucuuaaaauacugagcgacauaauuaacccuccagggagacuaauauuaguuuauuagagacaauuucuacuucuguuuauuuuuuuacacuaaaugauuuguucagauucgggggagaaugguuuuggauuuuuuuuuuuuuuuugguuacgguguuguuguugguuuuuuguuggcucuuccuuucuuuuggauuggguugggcuggcuuguauuuguaguugaauuuuccuucuuaaucaaggcuauggaagguaaauugcuaggugauaguauugguucccauggccaucagacauaauuggguagaacucaacuguggagcucaguuuggcuugugauuuugaguaacugggggccacacaagcuuuaaggcaucauaauuuaucuuaauugaccucaagugcuggccaugcaucuggucauuuauguggcugccuucgucugcagccauuggucaggcuucuucuaacagugaagcucucuggugauggaauucucuucuggccauugcuacacagccuccaaaauuauuuacaccuuucacaaggaggucaugaacccugcuauuucaacacugggcuaaugucacaccuucaguuugcugaaccgaguagaaaggagacaggacaccuuuugaccuuuuuuuuuuugagggggggcacacuuggcccucacuuuugcuugauuguccucuuuagaauugcaaagcaccuaguuggauaccuagccucugugcuccaaguucucugaccugcaacaagccagacuuuaacuuggcucucuguguauggugacucugcagaguccccaauccccuucccauauuagacaguuuucuguuguggaaaaacaccauggccuucugguuucacaggguuagaccccaugugacagagcaaaggcacuguggcagggaccaggugagcacucacauauugauccacaagcaggaggcagagagcaacacugggaauggcaugagucuuuugaaaacccaaagccuggccccagggacacacuuucccuaguggggccacaccuccucauccuucccgaaaaguuugacugaauggggaccgaguuuccaaacauaugauccgacagaacucaucuuagucuaagccaggagauucuaccuucccuucuccaagcuaaguuacuaaccguccagcguaagaaucaacucagagagcaucccgcauagcugucugaagggaugcccucaugagcagagagcagagagcaucccacauaacugucugaagggaugcccucaugagcagagcuucauaaaaccaaacaugaaauacauccauaccaaagucaccacagcacccaugcuuauggaauagcccugacugucguccacucuaccuuucuccccacccccaccuccgugucugccuucaugacugacuuaccgcuuuaagaacaaugaacugggcucaccauggucaucuaucccugaggcuccugucugucugccuccugguaugucguuacacuugccuaaaguguaaacaucuuggauauaccaaaauauaguucucagugucggcuuacccacaaaaucuugacgagaccuucccucacuuagccuguuagugaccuccuuccuccuucucccagcauccuagucucaucuguaucccaucuagccaguaaaauagaggccuauuggacagcaugguguggccauuugcaguccuagcccaugaccccgugggcguucauugaacaguuguugcauuuaguuaucuguccuuucacacuguuguggaaauacgaggccuacuauuucuugguaucuucuuuucaauggagaauaaggauucaguaagucacagaaucuuaucugauuaggaaauaucggcucacaccaccagaaaaucugaacauuaaaaagcaucuuugaaccagucaacuugugacuagcugaugggaugaaggcuuaaggcuggaaccagagaccaguagaaguuggaugaggccuuaaucaugaggguguguuuaugugugugccuuccaauugagucaucuuuuauauucaccagugagugggcaaguuggucugcggcguggccuacuggagaaaccaccucaguaacucuuuagcaacuaaacccguuccuguggccuccuagccuugcccuccucaucuagaugcaacaugcacuccacagugaguuagaauauucaacauuccguacacaugagauggaucgcggguagcagucagaauguuggcuccuuggcauguaagaccauggccccgaucagagacaucuuugaccuuaaggacgaagacuaggaccggcccccaggaguuauuuacaagaucuccaucucuucacugucaagggagacuggauguauacuuaaauuuugucccuguguuagcucagagaaauuuauuguaccgcuuacauguccugagugacucaaauugucuuaacaaaguuauccaggaaguaacugguucugagagaguaugcaccacccaaucagaaugcgaaugaauuggcuuugucuuuuuuuuuuuuuuuuuaauccccaucgucagguaucuucuuaugaccuaccaguagcccauugcccggugugugaagugcuugggggaugggcaugggaacaauggguucccaggguaaaugcuuccauaucccaaguggaacaugggauaccaagaaggacaucacuaacuauucagccauccagacuacuaauccaaggagucacuaccuauagugcuuauuuaguaugggagacauuccuccuuaucauccuagcaaagugacauccugugugagugugugcguaugcguguguguguguguguguguguguguguguguguaugugugaguguguacguaugcgugugugugugugugugugugugugugugugcacucaccuguguucgauccugaggaggccugagguuggcaucugguaacgcucucaaucacuucuccaccuuauauuuugaggcggggucucacugaacugcagcuugucauuucagccagguccccuggccagcuguccccugggauccagaaucugcuugucucugcucucuggugcugugguuacagauguggguucucacguuuuccuccauguucagcaagcaaccuaucuauguccuccauguccaaagggacacuccgaugaaagccgccugguucuuugugcagagaacaaacggggccucuuagccaauggccuuugguauuuuauucuccguggucuucugcuguuggaggucagccuucucccagggagaaguuuucuucuagaaaaacuucccaccaguaauagaugggaauaacuggugcuuucugcugggcgcugccuccacggguuagacacucacucuccgaagcacagucuaugguaagggucucuaugugaugacuggcgccagcauugcucuggccucugguucagaagcuuccauagaaggcuuuuuuucuuuucuuuucuuuucuuuucuuuucuuuucuuuucuuuucuuuucucuucuuuucuuuucuuuucuuuucuuuucuuuucuuuucucuccuuuucucuccucuucucuucucuucucuucucuucucuucucuucucuucucuucucuucucuucucuucucuucucuucucuucuugcguugcauugcauugcauugcauugcauugcauugcauugccuugccuugccuugccuugcagugcucacuucgguagcaagcuuaccuuuucauuucauuggacuuugauuucugcacacacggguugaugaaugugcaucccauguagcugauccguggccccaucuguguuacagcucacaggggcacuugcuuugagccauuccagauguccagagugccagucauuuuacaaagaaucuuugagaaauuggaggaaaaucauuccucuuacuacagguugugauuaaacagauaagacugaaacccaccauaauucacgcauaugauguuuaucugauucuugcccagcucuuaugaauauauagcaugucaggucucuccgaauaccacauuacucaguuuuagaguugggaauccugagaucgaaaguacacagcaagaccaggaacagacaggggcaauguuuguuuguuuguuuguuuguuuguuuguuuguuuguuuguuuuaaccaucuggggccauguucugauccagugcaugauaugggauuacaucagcuuuguucaaguacacauguaugugcacauguguguguaggccagagggcauccucaugugucuucuuuggugcucccccuuagccuuugagauggagugucucagugcacaugugguuugcugauuuagcuauacugcuggucuccguauaacaccugaguccuggcauuauauaaguguguguugucucugcacucagcuuuuuagccuggaugccagggaaucauacuacuguccuuacgccugccuggcgagcccuugacugacuaagcugucucaccagccccugaucuuugccuucacuugagaaaguuaacgguggcuaccucuucccaaguaccuauggauucuccacuuguauagcaguggccagaagcuaggcuaaaguucagaucaaagccugcaaaugcugucuuccccuccgcauuuuggauggguugauacauaaacguaacaccaacacaaagcugugagcaaaaccaacagcaacaacagcaaaauugugccucuggaagguaauuuguauggcggcacucggucgagcugggucguugagccaggggcugccucugugagucucacaagugcccagagugcagaagccccaucuccuggguuugcguggcccuggcuuaauggauuaugcauuggucuuguguuuaagaagcagcagcaacgugaggccggggccaucgguccuggagacuuuacguggagcucucugucaauuaccccucccccccauccuuaugguauggccuuuccuguaauuacagucaagauccuauagccggaggaagggcugucaauugaguaggaggcagacaggagguugauguccaucguacagugacaggccauucagagggcuucaggcucauccugagagaggcuaccggcuuccuccuuggguacucgacugccacccggucucccaccaucagaggaacggaugcgcuuguucuguggcugagccuggaggucaggccccuuggacgggaaguggagaugagccaucgaucuacauuuuuaaaacugagaagcauaauuuugcaggccaaccccccgcccuuaaaggagaucuaaaaagauggggaauagagugcugauugagucucugccccggggagucugucuagguagaaagccauagacaaagaaacaguuucuuuuuucuuauuuuuauuaguucauugagaguuucauacaaugcaauuuuuaucucauuuaccccucccccaucccuccuagauccaucuacuucccuacccacccagcuuuacacccuccuuuuucuuaaaaccuaccaaguacaauuuauacgacacaucgacccuuggauauuuggccuucaccagauggugaucugaccaccaggggccacaccuccuaaagagaauggacauucuucccaggagcuaucaacaggccauacauagcuccuuugcuagggcuuugugaguaccuucucuccgcgcuggaauuuuuguccagcgugaaccugugcaggucagcuuguauugucucaacugcugugaguccuuaacgugcaacugcucagcugugcccaaggcacacugguuccuuuguagccacucgucccccguggcugucacauuaugucccccggcuuucugccauaauggacgagcucucagcaguugacccuugaucggccgugggucuccauauucucugccaucuacaaagagagacuccuccgaugacgcuuggccacugcacuaauuugugaugaagugauuagguuuuacuuuaaaccaagcauguuuuuuuuuccuuuuuccucucaaguuaacauagauuauuuucauaagauugaaaauaaagaucguugaauuuacuucucaugaccagagauuucaugggggaugggggggaggcucucaggucagcaaacaaagcaaugggcugacucacugcuguuguguugagaacuuccugugcucacaucguuuauacuccccucuguccugaccccuccuguguccacccucucaaauucaaggacagucaccuugucuuuuaagugcccagagagguguguaugcucccaacagaagaguuggcgugcuguagaugggaagcuauuuggacugaaguagacuagacuggucucuuccuucagggccauagcuacacagcuuccggccaccaggacagugaaggaacaaaggcucugaguuaagucacaggcucccugcucgugaggccucagaaucuguuuugggggaggugauaacagugacuagcuuucuaugacuggccugaggacagaaauggcauaucuaccccuuggucucccgcagcuuaauaaauacauguuccuuggggcucaaggcaagugugggagcucagacuugccuuggugggacuguggcugggugagagcccgguuuguggcuuagaaagagauaccagacuuccagauaauuaauuuaagagaccaauauucugaggggaauuugaaaagaaaauguuuaauuaaaguuaaaauuuuaaaucagcauauaaacuaucaguaucauaauggcauuuaauuuuuaaaauguauuuguaguguauauauacguuguaggaggacacauauacccaagugugcacuuagcagucagaggacaaguugugggacuccauuuucuccaccguguggacuccgaagauugaauucugcucuguccaacuuggcagcaggcaccuuuaccugcugagcaucucgacggccccgugauggcaucuuagaacaaaguuuguuguaaucuauucucagucaguucuccuaucucccucucccuccccucguucuuucuggcauuuuuaagagagcauuaauacuguuaccaugggauggggugggaaaggagacucugagaggcuuaacacguucugugguucauucuuaccucuucgagccucucaaauuagcgagguuugucacaggccauucagagcucauaugagagugaagggaaccaggucucagcaagagucucucacaaaggugacuagaagcaaggggacauuggucuguaaagauuuagcaugagagugacguuaguguuauggggaacccuuucuuugugcuuaacuauaaauggaaccaccugggugaccuugccuuccuggacacugagagaccggcgcaauaaugauugagucuggaauauuauaaaggcuaaagaaauaauucugcgggcuuucagucuauuaacuaucugaggcuucuuaauaguuuggcuuaaggcaaaagugaucuuauucaaauuucaucccaguugagucaauaauuaacuuaacugacuuugauuaaaacugaguuuucauaaguauccaaaccauccaggccuuucuuuuuccauacgaaaaaugguggcagagaacuugguagucucuccagauggggcuagcccacggggagccuggcucuccacuggucucuuuguaaacaccuccuguccaccucucugcuuucuccuuagacagcuccucuggacacgugaucauccugguccccuggggacucacuuccaugucagggaccauggugccuuugcugucuuccacauuggguccauggcacuggcuguggggucuccuguguccuucacuaaccuccuuuagagacuccucccaccacauggugaucuccaaguaucugauugucuuaaccuccuagacuuguucuccuccaaaguuaagaccauuuuucauuaucauucaccagucucauacaugaguacaguguauuuagauuauauuuacccuucccccccaacuacccccagaccucucacauaugccucccaacuucuugggguuguuuuuuauuuuuguuuguuuguuuuuguuuuuugggguuuuuguuuuuauuuugguuuuucaagacaggguuucucuguauaguccuggcuguccuggaacucacucuguagaccaggcuggccucgaacucagaaauccgccugucucugccucccaagugcugagauuaaaggcgugcgccacccacugaguccaaucaguuuuacccauccaugugugcguggaugugggcccauccacuggaguaugggcaaccuaccagaggccguaugcucaagaaaacucucuuucuucagcagccguuaccuucucuaagcaucucagcuagggggauggccuccugagccccuucccuaugucugcagggaggcugauuggccggaccuugugcaggucuucuaccugccaccacagcugcuaugaggucaugaugcaguaguccugcaaguucaugugucuuucugcugcagccccuguagcaaaccugggacucagcaccaacaggccagagagcacacccuggaaggccuuugugucucagaagcugagaaugugggccuccugcuguggccccuccucacugucuaucuccugguguuaugcuuaggcucuuguggguuggucuaaccaggauugagaggugcacacauaaaacuauauacgugcacgcauaacaucauaaguaaaugcauggcgcauuuggcuuaaaaaaaaucaauuacaaaaaggaaaaaaaaaauaaaagggagcugagagaaaagccaauugaaauuugguugccgcgcacaggaaaagauaaacagagcagcuugacuauaaacagaaaagacaagagcagauccugguagugcugauggcuuuggaauaugaggcuaggguaugagccugcaucccagcaagcauaccugcgagaugcagaauucugccagcccagggauguuaauacuuauauccaccacugcagcacucccaaggcccaggcugcucauugcaggggguuggggguggggugugaggcuccagaaugaaacaaaagcauuugacacagguucuaagucuccaucuccacugcugagauuacauugaauuuucccggagucguucaguuuuccucugugcagaacguagcuagcauuucccccuaucuuccccccauugucccuuguuuuguuuuguuuuuuaauuauucuuuccuuucuaucuguuuuuuuuuuuuuugucugucuuuuuuguuaguguugcaaggcugcauauggccacauagagucaaccacaguaacacuucccucauggcccaaacaguggcaagaugugccaggcacaugcugcuggaacaccuggcugaggcccgggcaugucuucccaugccugggaguggguacauggcucauaauguuuuacaaaacagggggcuccaucccaaugacuugggugccaucccaaugacuuggagcugucuuccagcuggacgggcugcccaggaacacauguauguuugugcuggaagccccaccaauaucauaucauccaaaagcacuuuuuuuuucuucugugaugaauuauucaggcaauguuuuccaaaauugucauugaucgguacagacccagagagaguguuacaacagcguugugcugggcccugugaggggucgauauuuucuggccucauagauguuccaaaaggaaggagggggaaaggaaagaaaguaaaagacauugugggguuuuuuguuguuuuuguuguuguuguuguuguuuuggguuuugguuuucucggcacaguaaagcaaugcagguaccacuccuggguggggcacaugguuagcuuggauugaaacccagcccugggaacucgaggccuggcuggggugaagguggggacacaauauccucagcuacucagcagcaguaauguggaguaggaaaaggagauuccuacauggcacugguugaagaccccauuuaauucacauaaaacucuaggucugaacaagaaugacuuccuugaacauauacaaggauguguaugugugugcguguauacacacacacacacacacacacacacacacacacacacacaguugaaaacaaaaucaaagguguuuuuggaaugauaccugugugugguaagaaggcaggcacuugguucugauaucucugucaguggaaacacuauggggguuuugguaaauuucauugcagguuuugguaaauuucacugacgacauccugccuuccacaguggcccacagacaaccagugaaaacucggccauaccuucagcguaaccuaaagggaugaggaggagauauucucugagaacuaggaagccggcugcugaucucagccagcuuugccuucugaccguauucuagguguuaggcuggcucacaacccccccccccccaacagugguccucagguucagcuggacaucagagucaccuggggacuucuuauagagcagcgaugcuccaggauaauugcauccggaucuccagggagcuggggagcaggagaggaaagcagucagggugaaacccgcuuuaaucagaauuuucaucacuagcugccgaucugaaagaaggaaagcugagugagaacccuuuggaaaaguaaauccagggcccugcugaacccaggucuccagagaccagcacugcaccccgcuucgucuugguguuuauuuguuuacucuugugauuugguuaguucauuuuuuuuuuguucuccuccuuuaaucagggaaaugugacuugcccuggaacuuugcagagccauccgccccuagccuuccauggccuccuuuaucuuaccagcugaauggauacagaacacuuuugccauguaagccauccauguaaggugugugugauccaguugcuuuaguacaucuacaaccucagaacaucuaauuagcucuaaaaaucauccugcauccuuagacaccucaaucacaccacacacacacacacacacacacacacacacacacacacggcccuaggcagugguuaauuuccuuccugucuguaaggacuugccugcugugggcaccucggaaaaauggaguuauaguguccaugguguucuguguguuuucauucacuugguauccugauuucaaauuuuucuuguuaacagcuucuacuaauaccauuuuauuuuauuuuauuuuauuuuguuuuguuuuauuuuauuuuugaaugcuauucgaugguagggaugcauccauguccuguuuguccguucaucaccuggugagcauguuuaccuccgcccccgugaacuuucaccuugucaguaucaucuccaucugacagauaucuugaaauacuuuacaucggaagcaaaacgugauuagcaacgcuggaaacuguggcucuuuucacuccacaacugaggugcgagcgaccuugaaccauuaccgauguugcuucuccgucaaugaaggagcgaggggcgcucauccauucccgacuucuucucuccuucccaagguggccagaggugaagggaggguguuuccagagaaaaggaggggcuccuuuaagaucagcgcgaggccgucaguauuguuugcgugauuaaugaguccauggugccgaagcucucauuuaauguaucugcgccuucuaagaacauuucguuucgugcgcuucgacuggguuugagauuuaugaggccuaacuugcaagcgaugugcgcccggauuaagggaaccugagacugucuauuuaugucugacccgaggaaauucccuguaagcugcuuaucggaggcgcuugcuaagggcaugaugggaagauggaguccuuuggucccugguaaaaucugggaucugcucucuugcguuuucauagugcauucagaaaguaaguccaccuguguguaucugcccgaugauccacugggauaaauuuaguuuuaaaauacauauacucugcgacucucuguuugacugcaaaugcgacucucaauucgacuccaaauaccaacucuucuggguacaugcauguuuaauucuucguugucaaacaccaugucugaucaaggugauuuugaagaauuuaaugcaacucuuuacucuccaucuauuaaaacacgcauggacugaacucuuccuaucugcuuuuuuuuuucuuucuuugaaacuuuuuuucacacuguaacaauuaggugucucuaaaaucuugugagaagugcacgcauuuacuguuucuccaccagggggcacugugguucggcugcccauuuaaacagccggucuucuauccguuuaccagaaaauacacagaaggaauccuaucuggacgcaaacagaugucaacucuuucuccgcacuagcaagcgguaguguugucaaguuuguuaaacuuagcucgcuggagauuaacaugcaauguauaaugugcaugugccuaacuguauaauaaauaguaaaucacauuuuuaugcuuucucugaacuuggaggcuugcaaguuauuauuuuuuuauucccugggugugaugaaauaaauaaccuuaaaauacauuuuaaagaugucagucagggaggggaaaaaagugcuuggcaccgguauuugauagauuucuuuugugauuaauucucuuguugaguuuuaaugacuuuaaagauguaaaagcuagaaacuacaaaacuagacaugguuaauaaauaaccagaauagcagguguggagagacacaucugugggaaacugaaauaaaauguaucucuagguuguauuuggaaauagcucuuuggggggggggggagggaguuuuaaaacagugaacagcaagguugcuuuuauuuuuuuccagaaaaauucuuucagagaguguucucuaaaacccacacauguacacugaauuauuuuaugaccuaauguuuauuagcgagauccaugucuugaaacgcauaugucuuccuggaauuuuuggaaaguauucacaaacaucuucugguauuuuuuuuuucaugccucuuuacccagcucccuuuccuggcucuaaugcaaagugcuuugcugaugaacugccuuuaacaggcccagagagcugggccauuccagaaaacagaauuguguggacuguguuucaguaauacuaucauuuuccccccuuccuuggacacucagaauuuaugaacuaugacccaguuuauccugagaagcucucuguggauccaggaggguggaagaauggaugccggucuccagacagcaaauauaaggcccuucacagggccuuuugccuugucccagauguguaaagcuccugucacccuauuggaaggcuggauccagcccauuagcuccacccccaccccucaccccuacccugucacaggcagugcugggguauugacuuuccuagaacauuucaacuugaguucuuaagcccagcaguuuauaaaccaaacacacauuaauuaauaugaauaaugacuuggaagagucacaggcccccagaagaagaauguauaaauggacauauuugcacauaugcuuuuguguccaaaaggagauaaaugguguguugaacacaaucccgucuccuccgugaagggcuauuauuguccccguuuuuuuuuuuuuuuuuuuuuuuuuuuuccgacucccccaaguacaauaggccaggcacauuucacacaaggcagcuucccgccccaaucuccagaacuucaaaguuaaaagaucuuuaaaaauaaauaaauaaauaaccaacacaggucuuauuuuugaaagcucuggauuguaaaugaagucuaauuaucuaccuuccccguggcuggagggaggaggcagacagaauauucugcccuucucuuuguauuauuuccuucuaaaugaacacacuugccaaguguucaaggcgacuucugccacuacugcaccuuaucuaaguagccugcuuucuagaaggaaggcaggcagcauccugccaggcagacccuuguccagugacuuuccuaucagcccuguucuggauaagagcagcauaaauaagcucacacacacacacacacacacacauacacacacacacacacacacacacacacacacacacacacacacacacacuccuuucccuggaaaaucaucuucucuuuuuaaggaucugggaugggggguuuagcucagaagccagugaaugugagcauuaauauccaagcccagagaaucacugccugacaguguugccugacaguggcuugccuaaaaagagcaggcuucuuucucauuccugccuagggaaguuggcggguccugcggucagcaacacccuccuucccaguccuggacgugccuuccagaucuugcuagcacacacacacagcauguagacugaaggcuggaaggcgccccaaacauuuggccaggaagaggcaaacaauuccagcuggcccacgugcugcgcuuuaaaaauuacccagaugaacugauuuuguaaagagcggguggaggggacuccagggcugggggggggguguggaggggacuccagggcucuggggggugugggggggugugggggaucagggugccgauucagccucuacuuagucacaagcaagucaugauucugagacaggcaaggguuggcucugcagagcacauugccuuggcugaaugcaagagacaagagaugaucugguaggaagguuuaccaccuuggccuggccccuuccagaccccucacaccacagggucugcuugaggaugacguugguuugccaaagagguaugucuucgccaacagcugccucccagagccagaaacaagagguuucgaguuuggguggggggggggggggcagggcuucuguggacgugaaaaggcugccucagaacuguaaggcaucucuccaaaugugcuuggacucccugcucucucguucccccacggacgacugacaggccgcauucucuuggccccaugcccaagugaguucuuggcacacaucaacauuguacaucgcuuuugcuucagagaaaagucggcucggugacuuagccgcucugucgagccggaagucucgcuccugugcuccuaaaauuucauauuaaccugagaaagagaagaagaaaaaaaugaaagggaaucuuucacucuuuuuuuauuuuacucuguccaguccucagaggugggcgcucagaaucuccccaguccuacccaccuacuggaauacccugugaccggcaagggaccgugugucucacugccacaccuguccaguuccagcaaugucacguucaccagcuggcuccuguuagaagguugaagcugauuaauuauaacuuaccagaggccuguucuacaguaagacucgggcccugucuguucuguaccacuguggaacacacaggagaagcaagauucuucuaacgaagacaaggugaucucagaugaagaggucagcccagauagcauugcuugcuaccuguccacccaaccaugagcaaauguguaggcuggaccagcccguguucugauagaagagaacacuagcgauuucucugugugcugcucuguuuaaaggaacaaguaacgguaauaauaucugaauauaaauuaauuuugaaaggauuggggagguggcucagcagguaaauuguuugcugaauaagcaugagaaccugaggucagaucuccagaacccacuuaagaaggcugagcacuuggcuccagcugaggaaaccuagguagagauagagacagauccuagggucccuggcagccaacugagcugaaauggcgcauacugaaucaaagggguaggggaaggcauguauagagaguaguagaggaagacaucuaauguugacucuguggggaauuggugugaacaucacgugcacacgcauacauauacacacuacaaaugcacacaaauauaaaaccguacugaagaaaaagcaaagacgggagagguggcucagcaucaagagugcucauugcucuucuuuuaaaugacccacguuugcuuuccagcucccguaguaggcagcacauaaccaccuguaacucuagcuccaagaacucugacaugcuccucuggccucugcaggcagcuacauacccaucgcgcgcaugcacgcacacacgcacacucucgagugcacacacacacucacacacaaauuuuggccaagccacuauagaucuaauuuuaaaugcaaagucugaguuaugcccaggaaccacggauauuuauuuagagcaacugaccaucguggggggggggggggcacagauacaacuggcaaaggcaaccaacaggccccgucucggacaagugccaggguacucugguucccgucuuguagaugugucccagcugcacccucuccugggagugcuuuggaagauggcuagugugcucagcucauuaaaucugugugucucugaugugagguuuugcagaucccugcaaacaagcccccagcgggucacaucgggucccuuauccuugaggaaacaggcacauggcaucuguguuucaguggacauccuaucuggggcugcaccagcauccugccgugguccugucccucccuagucaagccugcacaaaugaugucuccugauacugcauguggaaagcaugcagaaaccgcauguggugucauggaauugagacaugaugcacggaggugauggcggaggaggcggcugcugcugcugcugcugcugcuccugcugcugcuccuccuccuccuccuccucuucuucuuccuccuccucugugggcugccuagagagagagagagcagucucagcuugaugaaucaauauuguuuuugccuuuguaaugauagcaaauaauucacaagaagauugcgauuuuuuucucauuuaaaaauacuuauuuaacuuuuaaguaugugcacauauaugugccuauguguggguaugugcacaugagguaccagucgagggggcagauucucugaagcuugagauacggcucacuguaaauucuccaaugcgguguugggaaccgaaccucugcaggagcagagagugcucuaaccauucagccaucucuccagcuccgugauuguuucuuauuaaaacaaaacaaagcaaaacccucuaaggaguagacaaaagcuaguggggaggccgucuauugauagcccugucaacggggacugcaguugacuacucucuauaguggggucuauucuucccacuuucuuugugggccuaccaacucuuccagauacaacuuucugauaaucuucugcuguuguauuucaggcauugaucaccagccuguguuucaaagggucccugucuguaagaugacaacacagggguuuguuggcagaaucuccuggugugugugugugugugucuacuuguguacuuuuguauaaugcccacuauguucacucugaagggaacucucucccuacauggcccuggggcuaugcaguaacugaguuauucaauuaauaucagagcucugugcuuccugcauuuuucuuuucuugaaaccacaucugaccauuaccagugcuuuuguagccaaguccagcuuguggccgcggggucaagcugggccaaggauagauguaaaugcuucccaaaacaaacucaaacgcccacuucgaguguuugaagauaccguuuuuuugaaaauuuuguuucgugacucaaggucgugguucucuaccgagaacucuguagauggcaaaaucauguccuaaaguugaaagguugguaaagagacuuccgagguccauugcguuccaaauaguggaaagauguaaacacaaucagacccuguguuuaaggauauugccuugaugucuugagagcagccauggcaggcauauuugccccacaggaaugggcaaaaccuacacagggaagcaagauugcuuuaucuauguggucuuaauggagaaagugguuacaauguucccauugcagaauagguuguaggcuaacuaacauaccuguaccuauuacaucaugaacgcacagaacaccgaauuaaaaacugacuuauccaauccagcgaagaauucacucgcacaauggaagaauguguggaaugccagaguacaugucucaguguucacacuaagugauucacucugaaucaucaagccacacucagagggguugucacuugcuccccaggcugggccauagcucagcucuggauacaaguguuugucacaaaucaauaaaagcuucccuugagccucaguuggcuguguggcauuuguaacaaacaguuuugcaugucucuuacugauaaaggccacaccaguuguccuuugcacuagagagugugugacagccccguguaccuguucauacgcucucucuuguuuucagaaagccaguuguuauauuuaucagaauauuggguccguaucaggcagcugcaggauugugccugagcgucugugacacugggagacacaacaaugcuguaaccuuugucccaacuccccacccccacucccugcugaggagugcucagcuucaagccugcaguucuaaaguccuuacuuuucacagagcaaggauccuuuguggcuggcgaaucacaaggucuccuugacuuccucuugauauuuacagcccaucuaacagccggggccaaagcgaggaaaugucagaggcuggcuucucuugcuccugaaguagauagaugucuaccaacccaacacacagacugcccgaccaccagcagugagugauuccauucccuuaacucaagccuauggccuuugguccauucuguccuuugaagggcuggggaaugauguauuucagcaauacucaucccauacagaagaaagcaagaugacacucugcugugccauaggcagguacccuaggacuccuaggacauggcagcacguguaaucugaagauuaagugcacauugucugugcacaugugccugugugugcaugcuuaccucuucaugugugcaaggacguaugugccacagagugcacauguggagagcacaagucaaccucagauauuggcccuccuuaacguccaccagcuuucugguggcuggugagcuuucuagggagucuccugucucuaccucccaacucagcaccauccacugggaguauaaacaugugcucucacauuuggcucuccauggguuucuuaaagcuaaacucagccccucacccuuguggcacgugcuuugccacugacccaucucuccacacccagucauuuauccaacucagaucauuccuuguccuaucgcucgugccaaguaaugccuaguccccuuucaggggaggggaggggggugauuuugagcaauugcacuccacuccugcuucucauacauuucuuguuauucuaggcaaguccugcaugcagacagagguugccaauaaaguuuauuguaggagccaagugucaauaucuguagcaccccccgccgagggugcuuguaauuaaaaugccacagauagucugggagaggcaugaaaauuugauggccaauugauuucagguucaucuugaaguuuguccucagcuggacucgauacuccuggcagcugcgagauggcuuuugucaaaagggucuucgagaaugagacagagaugucuuguucugaauacuaagcaccgcgugccguuuaugacagguuaugcuuagugcuggguugcacagcuccugcucucccacaaucuugcccuggaaauggggaagaugggcucucaggacuccacuguccacacaaaaaggaagaguacguacgcugacaagaucagugacugucagaaacaccgcaucacagggagcggguucugucuaagacucugcaguucacagauauaacuugcaucugcacagcccugggcgucgugguagucacgauaucacgacaaggaagguggcccugcagaauucucucagcauagugugcauuggcaaaagggaagaagagcccauagaaauagaugaaaaggcaugucuuuaguaguuuaaauggcaaacuccuauaaacuugcauuucuauaucacauuauaaaggccacuccucgugaacaguucauacagaaagaugcucuaaugauaagguuauuaaaaacgcaggcuuauuuccagaauuuaaacuuggaagaagcugguaggaaaauaaaaucuucugugcuccuaacuaaaaaagggagagagagaaagaggaagggaggcauucuuaaggaaaauuaaauguguucaagaaagcccauaucuaauucuuaauuauuugguaauuguauuuacuuaagagccaaugcauaauuagaaauagaacuuaaaggaacacuguuugaggcuggagagaugacucagugguuaagagcacuucucgcucuuacagaggaccuaggugugguucucagaaccugcguggugguucaugaccgucugagaccucaguuccaggggaucugauacccucuuaugacagggccccaggcaugcauguggugcacauacauaugugcaggcaaaacugccaaacacagaaaauaaaauaaaucuaacacuuuauuuuuaaaaagaacaauauucuaaucaagcccauucauucauucauucauuuguucauucauuuauucacuuaacaaauauaaauggagcccuugcucucugaagagugaaacuauaggaaaagagauuugugaaucagaauauacugagucuccuaggcugcggcuguauucucauauauagucauguguuaaguaaugcaguaugauauaguuuacauaaucuauauuuauauaauauuuuauauuauauguaauuauaauauauacauauggauaauuguucauccuaggcaauuuggauuuuuccuuccacccagccugcccccuccggcagcccaguacuuaucccgacagaagagagagaaggggagcuuagcauaugcuccugggccaucaaagccucuuggcugcgcauuccagagauauuuauggaucuuuuauuaggacaguuuuuacggcccaggauuaaaagguaaaguuaaauaguaaaaguaaggagcaugcgccuuccgaggcuccagcuggcuuguguuuucuuuccuucugcuugucaugguccauugugcccuguugguagcacuaaagggugugggggugcuuugaaucauguuuuggggaaaggcaggacuaugaguugucaaaucaacaaauuacaccucgaagaggugaacauguggcuuggccagccauucucuucagauagggaaugaaucuguccugggaucgggacuggccacaagauuaaauuauuuggacagggcauggugagggaugcccuugaucccagcagucaagauacuggggcagaagaagguuaaauuugcaucuagccugggcuguauagugaguucaaggccagccugcucuauagagucucccaccucaauagauagauagauagauagauagauagauagauagauagauagauagauagauauguguguguauacacacaucuauguauacaucucacuguguaaauauauauauauauauauauguauguauauauacauacacauauguacagauauauacacauauguauauauauauguauaucauauaugcacauauaugugcagagagagagagggaaagagagagagaaagaggggagagagagagagagacagagacagaaagagaaacagagagagaguaauuuacucccagaaggcaggggugagacaguguaucuauagccuguguagagcgcugugguccuuguguuccaucaagucugaggcuucccagugucuccgucuccuuacuguaaaguguuuccuuugggcucagugaaaagcuucauguuaagaugagugaaccgucuauaggagauggcagucaucugaacggucuguaggggacagcaguuaucuggauggcccaugggggauugcagucgucuggccuggguugccguggcucccccugaccuuuacagaugggcagguggggaaaaggauucaagagagaaagcuuuucagaacuucagugcucaccaggucauugucaccuaccucaguuacaggcaaggacugacaacaugucccagauaguuuucuguagccguucacuuaccacugcacaccugugauggugaugaugaugaugaugaugaugaugaugaugaggaggaggaggaggaggaggaggaggaggagaauuuccugugugcuuaucagagccagccucagacaaaccaccuaggguccaggagaaugcugccguucaaacugauauaaccaccuacauucuugagaacaggaguuuggaaaccucuucaugcccacggaccuguuacagguccugggucccacagcacugcaaggaauacaacgcuauuccgugugauguucauaaacaaaccucuccugaaaauggaugaugccgugucacccaguucgcaguggucccuggguaucucucugcacagagcccucagggaguggggcgcaggcagcgugacuuuccaguucagcaagacagcccaagccguagaacauucuagaaggagcagacuuugauaucuucacuaccgcacuugcuuugacuccuucuuuuaguaauuagauaauuauguauaauuagcacauuaauuacgugcaacagcugcaacggaguaugugugcuugagaacguguguguguguguguguguguguguguguguguguguguaugugugugugugcauacccuuguccaggaccagcauaugaguucacuaaaagaucugucacauuuuucuccuuggcguauuugcacuauuaauucaucuggaagaauucauaugcauguacaaguaugcauagaauuacacacaaggagauauggugguauaagccauuuaguaagauagaaaaaaaaaaaagucaaagugacgcugaccuccccauggcuucucuggcacaguuagagaaaaugugaccacccucccgagcugccacuugccaccaguagccacugucugaccaacuaagugcacugcaucacugcuugucccaggaccaaauagagaggccccagugccccgaauaucaguggaagucuuguuauauauuauuaagcgaaaccagcaauuuaaaaggaacagaguauaggggguugccaggcuguauaaaaaugcaggaauagaacggagauagacauagauaauaucacccugggugaucuaucugcuuccuuccucuucgcagucacugacuagacagcucugaugugccccugcuguggacgagccagggauaugacgcuaguaagucagcuauaaucuguggugugggaauaacaggcauuuugccauucauuuuuuuccccuuggggcuagagauggcucagugauuaaagugaggacaggaguuuggguuccccaggauccguguaacuccuggauggaccaugauggcccuucuggaauuucacccucagaaggcagggauccccagggcaagcuagguagcaagaccaucugggauagcucuggguuugauugagagaccuugccuuaaugaagaagguggaagagggguuccugacaucuuuaggccuccagauauagcaugcaaguacauacuuacacacgcacacacauguacacgcacacgcucaaaaaugggggaaacacauuguuuuuucuguuauugaucauuuucuguagugaaugucacuuuuauugaaaaacaagauggcacauugggagggggauuaagauacaaguuuugguaaggacagaagaaucuaguaggagcucccugcaugccaggcaagcuaagcugcauucuguuugaaaacaacgcguagaugggcagaaagcucuucuugcuugcuuauucaccucuaguaacuugcucuguggucaccucccuuaagaggaccccgggggcagugggugaccugcacagggccugggcuucucugcgggagccucagcagacccgcagaccccccuguucaucugcucuuggagcuuagagaacuggaaaauuccugucagcuuucuggcaucgcggucucugucugaguggcuuccgcaccugccuuagcaccugccggcuccgccuggcuccucugcaggcucagcacuugcggcccucauucuucugggaagguggcuuuggagaaaguguucuucccuaauaagucagcacauuccugugacacaaugucagagugccccaguuuggccaaguuggcaaaguugaaagacuccugauggaguguggccuuugaccagcaagcucuuuuguuuuuuguuucucuccucucuuccucucuuccucucuuccucucuuucuccuuuccucccccuccucuuccuccuucucuuucuccucuucuuccuccucuacuucauucucugccucuuccuccuguucuuccucuuccuccucuuccucuucuuuuucuuccccucucucuucaauuaacaucuucucacaauuaaaggagcaaauguacuucucagagccaaggacuacaugccaauauucaaggacaaaaccugccccaucccacagucuccaagcuagccauccuggcuggccagggccuacagguaaaggccaccggaggccccuccuugucauucuugcucuucucccuccccuaauguucaucugugcugaaccuauucucugcccuguccaugcgccauaaacugauucucacugcuugucuccccgauucccuccaggucaagggacacagccaucaccugccuucuuguaacugcaugauacaccucacuauggcuacuucacaaugcauugcaauugcguagcuauuuucaacucucguguuuggagguuuggggacauucgggagcaugcugugagcguggaguccuuguauagacuugaaauguuaacaaugucauuaggcuuagccugccgauucucuuguuccuuaagcacaauccuucucucuuuuggacauaaaccaccucuauaaucccuucaagcucccuccccagucaauuauguauauaugcacguaucuauguguauguguguguguguguacugucucuucugcgaaacaggagucacacacacauauaugaauaggcaaaugucuagcugaaagaauacuuacuuaacauaauuuaaacauaaacacuuucuugaggcuacuucauuucaauauuuuaaaauuuagacuauuaaaaaaaaauccaugucaaggcauugaacgccuggacaggagaggaggccauggcuccauccuagaacuugaagaccaggcgcacgaugccaucuguagcugaguacaagccacagaugaggacucacucuguauucugcugccuuugcucuugccaucuuucuggacacaugggucugauuuguaagaagccaucuuuccuccuccccagugguggugaacuugauuugauuuacacuacauuaucuauuggcuuucuauguguauauuuuaaagcuucacacacauacgcaaauccuacaugcauuucuuauuuaggaaaccgggguggccguccuucaaauaugaaccagauaucuucuaguauuaaacucuuagaucagauuuauaguagcgugaaugauacucccgaaucugacguaacguggaacaccucaucugcuauugaauuacuuuuacucugacaaaauauguaucagauguaacugaauacccuaccuucucccugcuaaacuaguaucacacacaugcacacacgaugcccccgacccuccccucaccccccacccccgugcacacacuguucuuggucuccuaguguaaguauccacagagguggaauaggaugagccacugaaaauugccagaacuagaauuguuuugagcugugcuuuaagugcacacgucuugcccuacccaguauauguauuuugacaugauaucauaauggugucuuaaugaaugucugcugaaucauuaugggaucuagcagagaugaggauacgguuggguuucgauccuguaacugucguguugugguccagagaaggccaacacugaaauauccccugguauuaauacgccuauccaaguccccagcccuccccaggacgcuggguugcuggauuacaggcuccucugaaauugaucaggaugcuguacuuuuuaaucuucuccucaucagugagugaacacuuagguacacacagagauggaguggacagauaagggaccaccccgccuuuguauccagugcgcuugccacuagcuagacauccuucaacuaggauauuaaauucuuggggcccccauuucuuggagccauuccuuggcucuugcccaagggcucuagcaucuucuugguauccugcaagaguaacgugaaauacguccuuaaagggccuggcauggugccuuuuaauuggacuuuaguauguggcaguuguugcugguuuauaucugccguuauuaaaguuaucuuuacguaaagcauacacaguucccccgggaguaauuuuggccguguuguuucauuucuacacaaguagaaacucacaguuuuaauaucaacaaggcauauucacaaggugcccagauuccauuuauuuaagaaaaccguagaaacgucagcuauguaccaggcgccgaggaauguccugggaaaugggccagccacauauaaaaguucccagccucacagcaagugugcccucucccucugaaggccuccauuccgcccaacggugucugcucccuaccagggcugggaucucccuuagcuccaagucacaggugccuugcgugugacuucacugagcguaaaguagcguuucaguucuguaccagagcauccacaacuauccuguggugcuauaggcaugcuuuucuguaggccuagcaaagguggagugcgccauacagaaaaucucaggaaguucucacguauccugagcuggaucucucacacuguuuacuccuggccaaguuguaaaucucauuuuggcugagcuguuguucugguuugagguugucauuggaugguuagggagagacagagacacucucugaagcaucugaaguacaagugguccugaccuugauccgugcgccacugucucuucuguggaacaggagucauaguugcccaagaaugagguuuaaaagcgcucaugcuucauugcucaggggcugggcaucugagacacagugagggauacccaggucuuggagguuuguuucuccuguuagcagugcgguauucugauaaccacuucggucaccuguuguggccagucuuuucacucuuccugccuuguccauuucaaaccccucuaugugggauaaaacacagcaaucugcuuccuccacacuucguguuuguuccuauucuguguagaaugcauauaucacauauagguauauguauaugaaacacucuugugcacacacaagugugugugugagugugugugugugugugugugugguauacauauacuuagaauuuacuaugauuggaauguuuauuuccauuauucagaaugauggguugaaaucccaauucacaugggggugucuuuaggaugucauugagucauaggguagagucgucauagauucccuccccauaaggcucauggaacacacuggauuagggagugugacuauuguaagagacggaagucagagcagacugggacaaaaagaugucuucuggauaugacggagccauuacaucaggcauucauaguaccuaugguugccuggacaagauuuacccaaucuaaccagucaacauuucaccccggaagggaagggacacuugaaauccccuccccuccccuagcugagggguucuuggcaguugagcugggguggagggaguucauuuuccuuggggauacggguccaggugguuuguucauucuuacaggcaauacccguuccacucaguggaccauggaucaaggauguaauauuucggggagaccugggggaaauuucagaacagugggaagcagggaguggccgguaaaugugaucaaacauauauaugaaauucucaaagaaaaccuacaauuuuuuaaaagaaguacgagaaagauccucaccucuccuaccacaugaagugaggaggugccuuccacacccuuagaguagaccaaauagacaccaaaucuacugcacuuugaccuuguacuucuagucccuggcggaguaugcaugugcaugacauuuuguuauggcagugugaaugcauuaagauagggcuuuuaugagucccucccccacgcaccugcuugauauaaaauguagggucugucuaugcauaaagauuugaauuuugcucuucucguaagcaggagaacaguauuccuugccgugauuauauccugauuccacauccaucccccaaguagagucuguugggcuuucacuuggugucugagguuucucccucugugcaggccaugaauagugauguagucagcacccuugcccagucuagacugaugcuuugauuccccgauggggcguguucccaggugugggaucgcuaagccagacuuuaaacuuuuaaaauggcuuuuuaucauucuaauggacuguagugagaagagccaaaaaucaugacaggaacacugggagugaaguuuuuagauguaaaagcagaugguaauuaagaggacacacauuaaagaggguaauuugagcagcauuucacaguauuaauugguuuuaaugucucgaagacuuucaauuccauuuuuuugaggaugaggaagcaggugguaauuccuaggcucugcucgcugauuccgcacguacagagcagagaggggacuccuuaaucuugcuggugcuugggcagaacaaaaaaauaucaugccaagaaagacaaauacaaaugcaacaugggcaaguaggauuguccagagaaugggacaugggugggagggcaguggaugguagugguguucccugugcgggacagaaugccaagacggcaucgugaaucucugcaucugccacucaugcagagugaagggguuugcccucaccaggcccagucuucuuagagagacuuccuuuuuauccaaagucccugaaguucagcuuccugaguccagggagaggcuccuugauggcaugggauagaagauugauggguuugugcuucaccgugauucacacauaaaaggcacagagagcgccagggcagugaugcuuggacaaauaggcaccucguggaagacggguuggcaggaccaaggagacggcugguucuagaagcagccggcaaggaagcacacugcgugugaguacacagugaagaauugacagccuugccuccagaccuuggguggcucacucgcacaacuugauuauugaugccagggaaccuuagcgaagccucaguggucaucucguggaucgucucugcuuuucaacccaguguuucacugugagggaguaggcggugaugggcuguccuaagaaagagucagaaaggaggagggauguggagaaggcagaaaacgaucaaagguguagaccaaucuggugcugcuaacaucuagcuauauuauagaagacuaccuauauauuuaggcuccauccuuuguuggguggacaguuuuacucaugagggagagaccagacauacacacccgucagugauguaaacccgcucaucuuucuaaguuaaauucuaaacacacauuugcccucuuuagggaguaugcugugccaguuucugacuucauaggcguucucaaaaugcuuuacacuugcccccguauugcacgagaacaaauggaaaguccguuguagccaauacugagggccagaguuccagauucugguguuaucagaguuugggacuuuggcauagauuuuuccacuugaacaucugaaauggcacuaacgaaaaaaggcguguaucuuaucaucuaagguaagcauuagugauacuggguucucagguuggguugcuuagcucuuucccacagcuggauuucucaaaguaucagauaguagucagucacugauuuaaaaaggagcauucuugguggcaucagccuauuugggaauaagucucuguggcccugugagagcacauaugcuugugggggcagggucggguaauggaguguggaaagcguucaccuaggucuuccaagguguuaacaugcuuuugguucucgacggggagaacgacaguuguaggggcgauucaggaaguccagggucggggagaagaagcgauuugacggaacccaguugugcucccauguuggguuuaccugaagcuguguucuuuucacuccccugugcauggccauggagggaagagacagaaggaaacagaaaacagacaucacaaacucaggacaguugagauucacccaucucugcuguauggccuuuauuuacuaaggcaggaagcgcagucaugaaacccacaaggggcagaagaaugaaguucagauuaaaaacacaaacagccaacauccuggugucuuugucauucuuuggcagcaacaaaacccauccuuuauuuagaccguuccucuggccuggcaggaaccacgguaugcgggccuccgguucucucccguguuggguggcaacaacucuccugacccuugggcugcucuugccaucucccuagucccaugucacucuccccugccuccucagucacuguuaaacgaccucuagaucucucuuugccgcccuguauuaccauuagaagacauccaccccgagaaauugcucaguuccuguuuuugauuaauauuuuaucagccacaggaggaaaugguauucugcagcaacacuaauugagcagaagagaugcucucacaagcuuagguuaaaacagacggggcggacugcaacuucggagacugugugagccuugggauauauagaguccagcuucagcaccgagggguaugguagggugaaaguccaucacggucccaacaaaaagcaagcaacauucuuccuugaguaguaucuuagaacauaguagugguggugacagugaugaugaugaugacgauggagauaaaucaugauaaagccuuuuguaaaaagcaaagaacauaaauaugaacguuaugguauauaacgugugugccacucuauguaaauuugagguuacucagugaacagccaugaccugggucccugcgucacucaauugcuuaaagccagcucacccuggucuuuauugaaaugguucuauagcagaggaggcagaguagcuaucaguuaccuugccauccgguaauuaccgaaucauaaacauuugaagggcugaaggucacgggcuuagaagcgacccucguccgacucuuugugaauucuaaauucaugcauucucugucuggauggugggauuuugauucucacuauacagucugaugugugcggguguggguguguguuuguguguguguggguguguguguguguguggggggguuauccaucacuuuuauucuccugaaaagacuuuauuuccuacgguguaguacaggcuggauggaaauggcuuuaucacuccgugggcugacuguauuagaaagaugugcuguuuacccucacucccgauguccacuagaggcuucugauuuaugggaaggugagccuagggcagaggaaccagcugcucgaagauuccuugaaggagacccaggcucucaagggaggaggggaaugcgggauuggggaguggggaaggcucagaguacagccagcagcaggaguuugggggccacgaaauuccagguaagaacauagcacauuuaaagaagcagcaggggugcgcucuucuaccuucccuggauauugcauugguguguggugcguggcccauggcgcguggugcgugacccguguggcucagcuuaagcucuacacucaaggcuguguucucaggugucucucggaagccaucaucacauccuggcaauuccaauuugccuggcuaucaacuccgcagcagauaaagcacacgugugucauccugcaaagcaucccuuccuaagacucucgagggcucgagucaguccacgcgccucccugguucucgauacaguugccauuguuauuauagggcugcugguauuguugguaggcugauguuggagucauaauggggauuucuaucuuuuggugguuagauauguccuuuucucccacaaggcacuucauuuuuaaccuucuuccauuaaaauccagcuuaauuaguaagauuuaaugaaccagaaaguucauauuugucuuuuagcugaugaauuauuagcagcauguaacggauaauauuuaaaauguaauaaaaagaaguuuaaaauaccagcucuuuacucucuggugacaauccagagccaacuggaaaagauuuuccugugagaaauagcccuuacauuuuggucuguauugauuccugaaauagacuguggugacucgguuuuguaggggagagggggcccgggaagcugccaacaauguguucucucauuguccuguuucuaggggacaauggugucuuggaguaaaaugaugauguggcugcccugagccuccaaggcuacaucaucucauuccuccucccugacccucuccauccccguccguccuccgugcucuuggcagggaaucgcgguggccuaaccagagccuucuuuaggagcuuuagggaggcaugggcuauuuuaagaagguacugaauauaaauuuucccuccuaaauggagauggaaaacacagaggcaugguuuuauaccaucugauuuggacaccguaguuuaugguugcgaagcacacgacccaucugccugcgacauccaaucagcagcucccgcuucuguaauuuugaugaaagaccuuugucaagaguauuucagugcaggcauagcacacagcccugguuguuaacauggccuuggguguccacauuggaguagaggaugcucagaccguaacugcacugcggcagaggaaggaguggaggaccacuccugacacugccugccucccucccccagccuugaagaauggcucuuugcuuccaucuacgucaaggaaucuggugagugguaggggaguugggagagucagaaggacaggugauguucuaagcauaggggccagcuccauuguucugccagacuccagugugcaagcucagacuuacacaaacaagcaugacuuccagcauggcaccaguuccugaagugcagacguggucucauaccacccuggaccaacccuuguugaccagaaaagcucacugccauaguguggcauccccuaccaaugccuccuaagaggacagaaccccgaauugcauguguagcaggaaagcugcugcuauccaguguagugcgcacaugaucuguucuucuugcagggugacuuuaaggcaggucugcacuugaaccucucuccuccuggaguguuuggcacaaaacagcuuaagcauacagcagaacacacccuggguggaugcuuuagagaccccuacgcuuuauaggaaugggaggcuccgugcaacuagaugauucugaaucagcucgcucuucuuugaagcugaugccaggugcgucucuuagauuugauccgugucccuuaaucaguuuuaacuaucuccaauuacauccguuucagccucguagugucucugaagacaaccuuuuaaagcaauaugugugaugacauuuggucuuuaugauggcuuggugugaagacuuguuugucuagcgguucucaguugggugauuuggcuuucgcuuaauauuuggcagugucuggagcgaaaagggacuaggggcagaagcuccagccaucacccauuggauggagaucaaggcuagguuugauacuacuguauacaggacaucccuguaccccuaaacgucagcaccgucuagguuacggagcucuguacguccagugugggaagguucaagguguguauguccugggacaaguugacagggcuuauaacauggcgcuagcucuccuucaaccucauuuacuguggguaauuaggagaaauuaaacagaagacugcugucacccggugccuaucugcaaagcauccaaggugcuaauuagaguguuuuguugccaguaaaaacaagagucagaguccaugauugauucaugauuauuuuaaaauuaaugccgcuauuaucauacaaagccgcgguaaguggggguaggagacccuguaccgggggaugcuaagucaacauugcaguaaacacacaguaaacccauuugucucgggcuuaauacuuuguuguuucuucuaagcacuucuuagacgcccaugggcuuuuuaacauucuuugaaaguuguaauuuauuaauuuuuuuuuaauuuggcuugcaagagugaacuuuagugacggcucugaagagagugaaaagaaagagcuguuuguguaucagcagcucuggagcuuggacucuaaaagucaacccagcagggaaacuuggaguuccuagacucugggcuuucucacaccccggaggaggagucagccgcucagcaaccgcgaugccccgugacccgcucagacauguccucacauaaccugguggagguuagcugucacaccaaaccauuugccuaugguccuugaguccccuuuguuuuauuuuauguuucguuuuauauuuugcuuguuuugguuuuguaucuagggacucaguugagacaaccucucauugcuuccauaaaacaccuuaucggauuaguccagggaagggaaguuuuauuuggguucaugccuuuggcccauuauaguggggggcggggagugcagaguucaugaccaugagauuauauagaggauguguuuuaugucaggaagcucugaaugcagagagcuuggaacgugaaccccaagacgcagccuucggaggaaacuuagcugaaacagaaagauaaugaauggccuacuugugggcagauugucccaacucugggcuuuuaaaucauaauuuuccugaaaauuguuauguuuagggcuaaugccccgcuuaucaguuuccccuuucucucuucuucgacuuguauacagggaaucagacucgagccgugugcguuagggaguaguacuccaccacagagcuguguccccgagcucucucaagcuuuugagacuguccuugaucacacuccaaagcccagucaggccuugagucugugauccuccugccucagccucccgaguuguugagguuacggguuuccaccgcaagcugcuuuguaccaugaagccugcagaccucucccgcugcuucucccgcugcugucucuuucccccacccaucuccuguaccaggcauggggacuagggacagacacuagaucucuuuggugagagaaugucaccuggugguucugccucuugcagcagagaugagugauucguagugggggacuacacuagguuaggucuccguggcccaggagacaguuguaugggaaucagccugcuuugucuucccugucugcaacucagcuccaacuacucgcucugguggugcuggggcuggguaagguuugguuucuggaaagagucaggaaagaagauauuuaagcccuccaccaaguaagauuuugauuguguccgaugccucugaccucugaagucgcuguuuaaaggaugccuuccuaggcucauaguuugauacuuugaaugugggagaucagaaagccaguggucucugucccaagaugcacucaagaauucuacaaucucuguucccacgggagucgggaaaaggacuggagggaauccgacucuaguacuuuagagcuauagcagagcauagaacuugcuagagcccaguuuuccuggguauaaaguagagaugagucuccaggguaaccugccgugggccaguguuuucagacacucuaagagacugggaccugccuugaggacacuggaguagcuggcucccaagcagccuuugacugcaacguugccugccaguccacaaguauuuagcuuugagcaugcucugaccugggucugagauguggaacagucacuugacaguuuuugccauagcuugcuccuaccccuuuaugucccccuugcagauagggcugugcucauggcuacugaauucuuccaugagucucaauauggaaccaccaccaccaccaccaccaccaccacauauguguacagcaaguaagcauggagauacuuccauucagcuugcuggauuggggucucagaggccaauagucacagugggaaggaaaagaagccaucggcuccugcuugcuuagguggauuaucuuucucuuccuuguaucaauucauaaaacccaaaggugcaucucuacaaucacuuacuagacauuuaguguacgcuggccucaaggccaagucuuugguaugcuaauuucaaccgcccucccuccccauuucucucucucccaguuaggucugucuguucucuguccacucaucuguugucugacuuaauccuuggagccagccauugauauccgacauauauuucuuggcgggcaaguaaaggccacauccucagaaaugucuccuaagugugugaguguuuguguguguguguguauguguguguguguagcucauuuucuuuuuaaaaaauauaacauuuuauuaauuauuugauaauuccauauacccauaacaaucucuuucgaucauauccaucccuacuccucccagcuccaccccaacccuuuuagcuuuauguccauuuuuuuuaauaacacacugaguccaguuuuuguugccuaugcauucucccaugugaggccauccacuggauugugguagaacauauauacuucuaaagaaaaccgucucucuuccccagaagcugucaacugugaguaguccgcagcuggagguggggacccacgaucccccuuucccuauccuugcuggaguauucacuggcuuugccucucgcaggcagccacagcguucgugaguucaugagcgcaucagguccuguccuuaugaggaguuuguuuucucaccgacucucaccagugauaccugcuaucagaacauugacccuuguauuagucaggguucucuagagucacagagcuuauggguagucucuauauaguaagggaauuuguugaugacuuacagucuguaguccgacucccgacaaugaucagcagcagcuguggauggaaguccaaggaucuagcaguugcucagucccacaaggcaagcaggugaagaagagaagagaguaaaucuuccuucuuccaauguccuuaauguaggucuccagcagaaggcgugacccagauuaaagguguauaucgccacgccuuuaaucccagaugaccuugaacucagagaucuuccugccuuaaucuucuggaauucauagccacuaugccucaagaucuccaaggccaagauccaggucaggaacuuguaucucucagucuccagauuaggaucacuggugagccuuccaauucuggauuguaguucauuccagauauaaucaagcugacagacaggaaugggcacuacaacccugaacucauuuuacccuucccaccauuauuugggcuucagcauuuucucuugcauccugcaguccacuuuggccucauugccaugcucagccuuaccguuugcaacucgaagucagcccaccuuugaaaucucaccugcuggccaagacugcaguagcaguggaguacaggcaucuggagccuagaggaugacgcgugugcuacaaagggccuggcuggagaagugacccaagcccuuggaggagcccagaagaucgugaguuggaucccagacauuggacgguuggagauugacuuuugcuuuugauugugacugugcccugauauuuucccucuugaaggaagaaacuguuuuagugaagcccacaguuaagagacuuuuaauuguaaaaagacuuuggauuuuaaaagagauggauauuuuaaagagauugaaauuuuaagaauauguaaagacugugggacuuuuaaaguuauuuagaauggggaugaauaagauuguaaggguugaagcuuacuagugauguuuuuguuuuuauuuugaagaucuaaauaacuuuaaaagucaaucuccaaccauccaaugucugggauccaacucacgaucuucugggcuccuccaagggcuugagggcggggaggugaguuaugucaagcacugaagucagauucuugguccccacucccacaguugcuggaaggguagaccagagggucccugcuggccuguggggaagcuggcagauguagcugaugcugucuggauuugucgggcaggugauugcagagggucagaacccucugccuguguuggaggcacaccauuggccuuaccuuucgaggaaggucagcgcaagccaguugggccugcuuucccauuucagcagcuuuggccuaucucucuauagacuugcugauaaucaggaaaugaaauucaccuuucucccacuuccccgaggucugaaagaugaggggugaguuacagggcaaaucacaaucacugucuuucuccaaccuuggaggugcaagcugagaaaauggggagggguaggacuauuuuauuugggagagcacacucaaguucggcaguuacccgagagaaaauuaaguuccugauuacaagucccuccucuggccuuccaaggaagauagauuauaaucuuuaauuaaucuaucacucacaccaaaaaguaugugugugggggggaagaauggaggggugucaguacccauuuauuuggaguggcuaguguuucuuugagaagcccagguagcaauauauaggcucagcugugaacacucuacacaugacauuuguuuaggauuuuaauuuguugcugagaccuaacuggcuucaugguaugcacgucugggcuggguggcugcaccguggccacgggguuuuccuccuguaaugaagauggagcggcuguaaggaugaccuuucucugccuuugucgguggcugcccuccucuuuaacagaacaccuucgcaacacucccguucugaacucuugaaccacucauuccgcucuucgcacucacugcgggggcucgcaguuuaucacgauaacccuccaaagacuuugccuuccccacguccgacauggagauagaauuuuucauaacccuuuacuagucauaaauuugauuguuaaaggacccggguugaucuuauuucuaauacccucguccccugauuuaggggcauuuucuuuccacuaccucccccaaccccccccaaaaaaaaaacgcuugguagggaagcacauaaaauaugucaccugauauuggaggauuguuuauuucuauucauuuuggaccugaauaguaccuaugagaugcaucugaaaacuuaucuuguuuauacauuuauucuauugccauucucccauuaccugaaacagucacuuugaacagccagcaaagcugugcgugcccuugccuggcugcgagccacccagguaaaggaucuuugcuaacaaugcauuuuagugaccacagaaauggcacguggcaagaguuauaauuuugcacugucauuucuuugccccucagaucccacaccugccuuucucauagcccuuuauggaugcacagagcugcuucguuccguuuucugcuaggcuucucuuugcuuggcacccaguaggugcuggggaaauuaauacacucguaagugcacugcgguguucagcaacacaguacacagaugaaaauccccacagugagccaacucggcucuacucgugaggggguuuugugagaauucacugaaaucauucaaccggacacccgccagccccuuccuauaggcgaccuucgcggaaacucuugcagagguuccagaaagaaaccuccugaguaacugaaggcgagagguuaggauggaacuuuucaaaauccgucucuuguccacgagagccgcugaucugcuucuauaccaagcagacauggaguccccuguaaagcgucuaguuaauucuuguggacaaacgaagggcuucugacccaaagaugguuuuuuuugggggagggugcguauccggggucuccgaaccccgccuccauggguggucaggugauucuuaagcaggcgacuacgcugcucuugaaccagcuucuaagaaaggaaacacguacacacaccucaccaaagaguguguuuugucuaaagacaagcagcugaucaugacuaaugcgaagguccacaaguaaggcgaaccgaccaaugaaccacacuccaaagagguuguauccgagcuggaccauguuccccguuaaacaguuuacucucuccuuggaaacaggaucggauccaauauaaauaaauguauaacaccccucuuucauucauauacaaggaauucccacuuccguuacuaacucacacgcaugcacacgcgcacacacacccagaggcauacuaagcuacacaucagcucaccuagaauaucgaacuacacccugcauuccuguuuuuccugcaguuucucugcccugcggucagggucgguauuugccaucugucucagugaauggguggaugggagccgguauguuuagacauuauuaguaagaacaaaacaucacagaacugaauagucgugcuguuggggguugggggcagugaaaacggacucaggaacccggguguuccacauggaaauguaugcuugaugcuuagccuugggcagaaucguacagucgcgcugccuggcccagacuuccccacauaucaccauuggugauaugcagacccauuuucugauugcagauucaucugucccuacaugugagcuugucugagauucauaaaaaagcaggaauuugggggcaaaggagaagggaucagcuuccuucuuuacacacaaaugagaugucauuuugccaaauguucauuagagcugaugcuugcucuaggugucaaaccagggaacaggaauguggcuguggcuguggcugcaugugguggcugcacucggggcugcuuuauaguagucccuuccuaugcacuguguuuccucugagucuucuaagcauuuccuuguuuuacaaaguggagggcuuuuuuuuuuuuuuauaagauguguacuccucacuguuaaguauagcuaucuauugaauugaaggaguguagauaaaaugaaaaauuucaaaacauuuauuuuauucucaaggauguauaaaucuguguguggguaugugcguguaagugcauagguagccauggaagccagaaguaaauacaugcccugaagcuggaguuacaggcaguggaugcuaguuacuaaaucaaugccccaucucuccagccccuuaauuuaaacuuuugaagggcauuaagacuauucagggaagggcuggugggauggcuuaguggagccugcuggcaauccagauggccugaguucagucccugggacccacaugugugaagaaccaaguccuacaaguuguccucugaccucccugaauaugugagugugguucguguguauauguacacagacacacacucuaaauuaagagagauauucagagaaguaacauauauuaauaguuuacauuuugaauguaaaaagcaguuuaugaaaaugcauguaccacauuaaaaucauuauacuaauacacguauaugcauaguacaagauucugaacuaaauacacauauauacacacaauauauguaguuauuuauauauauaaauauauguguguauauauauuugugcacagguauguauauacaggcaugcguagaaaaagcugcagaaagaaacacaugagggucagagagauggcuuagagcacugacugcuuuuccagaggucucagguuugauucccagaaccuacauaauggcucauaacugcucauaauucaugcauguggugcaaagacauauaugugggcaaaacacccaugcacauaaaauagauaaauuaauuaauuaauuaauuaauuacuagaucaguaaagaaauuauuuuaaaacuggaacaaaagaaacccagcaaaaugucuguagccccauaggacgaacaacaauaugaacuagccaguaccccccagagcucccagggaccaaagcacacauggugggacucauggcuccagcugcauaugcagcagaggauggccuaguccgacaucaauggaaggagaggcccuuugaucuaugaaugcucuuugccccagaguguggggaaagcuagggccaggaagcaggaaugggugugguggugagcaggaggaggggggaggggauggggacagauguuuuucugaggggaaaccaggaaaggggauaacauuugaaauguaaauaaagaaaauauccaauaaaacaaaugucuguaguuaccuaaugaacuuggucagauagacccagguucaaaucugucucuaucacucauugcccaugugaugugacgucgacucugugguuugacagcauccuguuuuccuucuguaaggggacaguuaaaaaaagaaacacuugucucccagggauacacgucacuggccuauguacacguauggcaccugaaugugccaggcuagaguuuagcuagagcuuuuccugugcccuuccuuuguccuucgcuccucccacuggaagcaaggguuacuuuuauaauaugaaaaaugaauguagacuuagccaagggcuggugagccuauuuccauggucugguaucuugcuugacaccagagggugucuccaaauggaggauucucgugaugggaauugggcagagcuagucuucaauccagauuugauccugauggguuuccucacaucaucccuccuagaccucccgagcucccacagacaccaauuguaaaagagcagacaucaccugccaaagacacucacuugacgaugcuugaucuccugggaccuagcuguggaaacucgaaugaagaggggaaccugacucuguagggcgugauagggccuguguuccuccggcuggaaagaugaagaauaucacaaggaaucugaaugaaggagaagaaaggcguucugcacaguaccacaguggauguugccaggucuaaacucacucucucgcucauucagccuuugaauuuugguaggaauccuuagaguccaagcacucaggaaaaccauguugcuugcaauugucauggagcaaaacugagguagcaaaagcccgucugcaaagguggaaauuugccuuggaguuggaccuuggcagaaggcuacaugaggccuuagguaauccaaaaggcagguguaugcccaguuuuugguuuuugguuuuuauuuuuuauaaaagacucagcaauacuuugugaguaaaugguuccuacaucaaccuucuaaacuggcaugaugucaaaugauaauucagggaaggcauuucuacaggaagcagagauaauaagccccgagugcuuuuguuuucugccuuuguuucuuaaugcagggaaaaccuucagccucccaguuaaaaacccagaugaggggcugggagucgucacagucugaccccugaggacauuaguccaauuuuguucuguaaccagaacaaguagcaaaaugagacaggacaaaagaaacaagagauaacauuuacuucucgguuuaagggugugcaugugugcauaccugcauguguguguguguguguguguguguguguguguguguguguguaguggguagaauaggggguugugggaaugcuuuuuuucuuaccgaugucauagcucuccauccaguguccccaggguuccucggggacacaggcugauuuccauugugucaucugguacaagugucccugauugccacuagagggcgucacaacagcuacaaagugcuuuaaucugagguguccuaugucacuggcucucagccucucagcugccuauuggcuagacuugacuggugucuccagggacucugauguaagaccucucuauggucacaggggggaagaaaacaagacgucacauccugcaccuuuacuacaggguugcaccucagguccgggagagacuggcauauagguugauaugacaaaguggaugacaaggccaaaggacaguagcuuggccacugcagcuuuaaccugcacuauaaacagaagcccagauaaccccauaggaacauuguguuggcugcaaagcaugcaucuaccaagugcuauggugaacacuucaaaucccaaauggcaugcaauauaagaaucucaacccagcacugcucccugaauuaagggaucucaaauguccuacuuccucgaguccguggguccccagaccuuaccugccaugcucuguggauuguaaaggaccauauccccuuagcauacccucaugaucugucgauggguguugaaugccucauaggguuauauauagccuggcgccugguagcuacccugucuugcuguuuguaacucagaaacccuguuucuuugugucaaggacaguugaagcuuuaaucaucaccaugcugcccguuuccacagccuucccugaauuacuugucaaagaagggguuguuauuagggcaguguaaugaaagguaaucugugcuuacaacccuggcuuugaaagccuguggugguagugaauggggguuguuacaaugagagaagccugagcaaguagagaugccuguuuucuaccguuaaggugucugugacucaaaauacuuauauguuugguuaaacaucuagcacaaacucuccuuuuucuuuucuuuuuuuucuuuucuuuucuuuucucuucucucuuuucucuucuuuuuuucuucuucuuuuuuuaugguuuuucaagacaggguuccucuguuuagcccuggcugucauagagcucacucuguagaccaggcuggccuugaacuuagagauccucuugccuuuguaucuggggauuaauggcauguaccacuacugccuggcaaggcucuuaaucuucagugaauaaaaaucaaguauaggaaccaaucauuugguaagaaaguaaagaaaaggacacuaauauucacucuaguucuaaugguaaacacuggacauuucucaauaagcuuucauuccauuuguuauuaaugauauaauacaagccucuuauuacaaugcaaucuaaacaacgauucauugagggcacuuuauggagcauguugaagcagguacuuacuaguccccaaccuuuugauguaggcuccaucucggccuuucuuacuaagcagaugguuccggcuaggcagaugcggaaacagugguugacggaaguaagugacuagcaaagucaaagagguccuaggcugaagaacucaggugcagcugcagggcugcgugacaauccagaccauuuuccuguaccuccgugcccagcgagauuauugagaaugggauuauagaucugaggagguggcucgacgagcuaagugcuugccuugcacccugaagaugugaguuggauccccagagcccaugggagaggauuggguuugguacuguguguuuguaauuccagugcuggggaggcaggggccagaguaucccuagcuugccggcuugccagucuagucaaaucggcgacuuccaaguuuaaugaaaggccuucucucaagaaaacaagaugaaaugaagaaagagacgugacuuuaaccucugaccuccacauaaacauauacaugcauacaagugcacccaauacacgggcacaugcacauaaauauguacacacacacacauacacacauacacacacacacacacacacacacauacacaccacauacaaagggggagggauuauuucuagaauauaguaggcuaacugggaauucagcuuucauugagaucugaaggcaaaguagacuuagaagucacugacguguucuccucuccugcaaagagcagaucucccuccaggacaggggagggugguugaauaggcagugacuuucuucccuggacagcaugaugucagaggucagaaguuucccggaagaagaaguguuuucaugaagcgcaggcccaggugcagcaugcaugaggccuugguuuugauuuuugcuucugaggaagcagucacuuguguaaccagcauggcuuucuacccuggagcuucuuggagcaugucuucuugauucaugauuuucaaaaaaaauuaaaauuuguaaacuauauuauuuaaaaaaaaagccuugcagcuauauaaaaacaucacacacuaaaauuacccauacccaagguuuacacaacucaauggacugcuauaccauuuacaauuggcauuaagacacaagcugugaaauuuuauacuuucagcaugaauauauucuaugcauguguccacuaucaaaaucaaggaaguccuugauggaauuagggcuagaaaaacaagcaucuuucuauuuucuuucauaauucauguccauucccugccuccaaaauguaagagucaucuucuuacauucagcuuuucuuguucucuuuucuuuaugccauacagcauuugcauucacguguguuaaaaagccccauauccuccacccaugcuuacauacgccaacccaucucauuguccuuauguaaagcaagaggcgagcaaggcccgugaacccaagguagcuacugacuggccuuggaagccacauucuggaccagguacugugugaauuccccgggacuacuauaauaaaaugccacaaacagagaggcucuagacuucuauguuuauuaucucagcauccuagggacucaagcccaagaucaccuugcuagcaaaugugauuucuucugggaugucucccucuuugcuguacaggugauuaugagucgcacacggucaucaucuggccgguuggcacacauccccgauuucucucauacuuuguguuguuugaguaugccaugggugugcuugcaugguauccauguguuugugcacaugcacaccuguuagugugugucugucgaggccaggugucaaccuuaaguaccaacuauagucaggacgcagacagaaaugaaagcugacacucauucaacucuaugucuacuuuuugggguuuuuuuguuuuguuuuguuuuuuuuuugggacacuggcccgugcaauguuaguucagggugggucuuccugcuugaguuaaccuaguccagaaacuaucacagacaugcccagaggccuacugccuguuuuuaaauccaucaaauuuugacaucaguauuaaccaucauaggcauaaaaccacugaugagucccugucgcuaucuaugaauccugccccaaagaccuugaugcuaucacacggcuguuuagacuucaauauagaaguuugagaagagauauaugggacauauuucuauaucuugguacuuuaaagguuuccauggcucaagcucugucuacuuaguuucuuaacugucaguuguguuaagaaacuaagaucauauuucguccaacugucaugcaugaaauuaaucacaacugcuaaaauaauccagagggccuagaaaaggcaguauggacauggggacauuccagacuuccugagucacagagauguucauacaucauacggaugccaacccaaaggcaucuugcccaggacuuaggaagaaaauauuucagagguuuuuuuauuauuauuauuuaauacuuuuugguuuuguuuugcaaacuccucaagagcacaugacugccucauuggaugaaccauauuuuuaccuuugacuuccaucaacuugaccacggcugucaaggagccaacgggccaguugacuacaaaaugaguuugccuuucaugccauguuguuccguccgcuggcaacaaaaaggauuccaggucauuccaauuuacucaauuaauuucaaagaugaaauuauccugcccaguaacuagauugcuaauggcauuuauuguaaugguucgguucagguuugcuggucggaaaauaaacgccuucauuucaauauuugccuuuugacugcagcccaugagcuugucauaugccaugaccucauuaccaccacagcuuaauuguaaguuaaugugcucuuaguugugugugugugugugugugugugugugugugagagagagagagagagagagagagagagagagaauaucaggcuucuauccuaacugucuaguugcucuccucacuuaugcuccugaacugauauuucugacugauggauuagccagcacgauagagcccagacuucuggacacuaugaucguacaaauuugaacugauucuuuuuuuuuuuuuuuuuuuuuugaagugaaaguagagggcggggccuugacccacuagugcacacaugaccgugauuugcgauuuguggagguacacagcauuuguuuucggaagggguggcuggggcuuaguggugggacaaugggugggacaauggaaccucuacagagucagaggcagaauuaaaaucugcaugugaauagcuuugcagccagucgugaacagauucauucgucacaucccagguacauaaagcuuauuucagaguaaauucuggggagcagcguucgaccugauugaaucuaccccgagcuucuguuaauauauuuguucuagucaguuacacucaacagcuguuuagacagaauaucacuuuuccgccuuauucgugguaaugcaguccccccuuuaaucuccucgcgguuucccauuaagucaugaugcucgcuucagagaagcugaauccguuucagauuaacagaugaacuguugcucacgccaucuagaauugugcccaucucuuaaaucacccacuuggcaaggagugggacacuugggcacuccugagcaucccauccaagagcccucguuaggagacgaagccauuagcccaaaaggcagcuuuuguggcgacgaaguaaggcuacuuuuguagaaucacuacaugugagcaucaagcuuaggagccgaaggagaguccuaugugauccaccucacacaaaaguccaugacauaccuuguggaguacaugucagagacugcauguaugagacaguccaucuucauugaauuuguuucugacuggacacuguaauaaaaggcagaguggaucagaaaaaaaagagagagagagagaaagcgaagagcuaaaaggaagaggaagaggagaaugagagaagcaaggaaagagaggggagggaggagagaaaagaaaaaaugaagcaagguccguuuuguuuuguucuguucuguuuuguuuuguuuuguuuuguucuguuuuguuuuguuuucuucuauagccaugggacuauccucaagacacaugauccauuugagguugaaugaaccuggcugguuuaguuuuaauccugauuucaaacacaaguuuugagucugaaauguucuucgacgucacuuuuuuuucuacucuaagcccaaaugaauaaugcccguauauuguuaccaaaauccucuuucuggacaucccauuauugucacagacagaacaacaaaguagacacaagcauuugggaagcacagacaccaagcuucaggcuggaacaggauccauaagcgcuaucacggcuugauggugaacguugggcuuuggggcccccaaggugucuggcagugcuaggaaaccacagggcacagugagugcaaccacugacaacacaucggcaaacugucaggagcaugugacaguaaaacuuuauugauaaaacaagcacugaaguggauuggccagaaggaugugguucccaguuggagaaggcagcuacagcagggggaugcugaaaacuggguuggaaaggggccuuccgugccuguucauggaggggucuagccauucucuccuucauccugacucaccucucuucugguacauugccuccaguuccuuacggaaggaaacggagucaacguaucacggaugcggagauacuuacaucauuguugaucauagcacuauucacaguggcuaaguuauagaaauaaccaaaguguccauugcauaaugcaugaugggauuuuuuuuuuuucagccauaaagauuuucauuuggaggacaaaaaauguagcuggagaugaucauauuaagugcauugucagucucaggaagacaaaggugcuguguucuucucaguuagagauccauaaaauucuguauuuacaaaugacaggaaguaaagcuguccaggggaaacaaagggcacuggaaagaggcaggauaaaggguauggaaaccagguacagcggauuaugcccuggguauauuguauauuaaugcgugcacaaaaauggccuuauguaauccaguuuagggcaauuauaaaaauggcaaauauagaaaugucaccgggggugucacucaaagaugcagucacuccuugugcggacuccaaaaauccaaccauaaauaucugcaguuaaagcugaauuuguuucaccuuuuucuucccucaaaagauucuguuuguagcauccuucuaauggagccaucuugcucuguacacuaucauccgacuuacagggagccaucuguuggcacgcaaguuuauuugggauccaggagagaaggagacacaucugcaccuuccacggugucugaaccuuagugcagcuaagcagcauccacaguuauuuuaaaagggaacagugaaauucuguuuauagccugauacaguuuuauaaacuaacuccacaugggaugguuacugucaguuaaaugaaggaaucgcccuucggcugacaauccugaguaagcgaguguggucagagaggugacagagagggccuggaaguccacuaaucuuggaccauugggaggaaggucccaauggccccugcuuccugauuagcuauggcuacuuaagaagggccuggugugacuuugucuuucauucugugauacuugugauacgccuguggauggguaugcaaauggaggccagaagaccagcuugguuuucuuccacagauaaccuuguuuauuugaggcagucucucacuagaacauuggcaugacugguuuaaggagauagucacccagucaauccgacaaaucugucucuuccucccccacacuggaaugacaagccugagucaccacaccuaucuuuuuuuaauggauaccucugauccccauguaugguuuguucaauacacaguuccacacacagaccaacggucuuuucaagccgcaagagccacacagggaaaugcagaaggaagaugugagaaagggccgucacugugguuuccacaagaaggagggacaagacagagcaagcaggcuuaggauucccugguuugggugaugucauuggucucugggauacagggcuugugugugugauugguuaguaccuggacauaggcuaaaagggcagauggacagacagugggcugaaugugagagccccgaagaagagcugaaugguuccccugggaaaacccugaaugagaauuggcuuguaucuggguaauugauuugccaugucuaggaacugacugaggucuugguaaagaagggagaccugacugggagcuggggugaugauuuaagagagucaggccguccccaauagagagaggggaaggaaguguacaacaagacaagcucccacuuaaucuuaggacagaaaguggcuuccuacguucaggugaguguaggaagagaaggguaggcagaucagccaaggccuuauccagcaugccgacuuggugguccucgcugguguuguggaauauggguguaucuucagauuguuuguuuguguguuuauguuuuuccuacugcugugauaaaaugagggaaacaguaacuuaggaggacgagguuuauucuggcucacaguuccuagggaagaguccauuaggacaaggaacuugaagugguuggucacauggcauccagaaucaggaaggaaagagagauggcugccuacuaugucacucagcucuuucuccauucuccacuuacacacuuuaggauugcagcuagggagugacaccgcccacagugggcaggacuuccaaccucagugaacacagugaagaccauccccgacugauacucccuggagucccaucucccagugauuuuagauugucaaauuagcagcaguaaccuccacaggcuguguggagaacuucugccugacugaaauuggaacacaggaguuuaggaguuuccguuuuccccuuagcugaacuuaguuuagcuuccagugaagcaucuagagagguggaguccaguaaccuccugggggugggggugggggcuuugaggugaugggagcguuucccucaggcucucugagaagcuuugcuucagaagacaguggaucucgguuugaaacaaauacuuguagcgucuucuugucacacugcaggaaagcaauggaggccaauguguuaccccaggcuuuagcaggaguggaggagggagggccugaccaccccaugggagaagaagauggagguucuugggguucucacugcugaguccauaaaccugauaagccgaaguaacucuggcugauggguucgcagccauaauacauacauagguaggacuggauauaagucaagguggaauauauguagacuauacaugcaccucauaagugagcuuuccuacccagaauauucuuaugugccccccugauaaagccaucucuuccugcgcaccgcugccugauuuaugcaacaccaucugucuccaugcagguuuucuuugggauccaggaagggagacacacaugcaccaccugucuuugaacaaaaaaucacuuccaagacaaucuuguucggucuguaaaaccauacuguccaaagagaccgcagaggugacugaaggcaaccugcgcauggagccccgguggcuagauuacuaagccuucugugguugcgaaucucgcuggcacacuuggcucccagaaaucccgugcucaccaggagcaccugacucugcacagugacccggugcuuucugaagaugaggugggggagaggggacgggagagcagcagggcccuggagacauccacuccucucacagaaacuauacuuaucaccaaagcccuaauuuuuuguugagcaggcaucugcuucccacagagcauugaccaagaagaaaagggggcccacaaagugguguggccugaagauggcuugccacuuaagguccccagggaaagggggacaucagcagggauguaggagacuuaagaagagacccuuuccuggcuuuuuguuucccuuguuuccccuccccuugccuuuuuguucauaugcuuuguuuuaaguugguuuaggacaagguccugcuacauagcaauggccaacaccaaacuguccuccaugccccugcccaaccugccccaugccaggcuuacagccguggaccuacgucccaaguccuccuuucccccuauuaaauaauuuuaguuacaagcacacuuauugcuaugaauugaaaaaaaauaaaaccaauccugugguuuguuggaucuccuuggagacauguacaguucuaaaauuaaauguguucuucuacacugucugggaaaggaggcauuucucagccaaaccauaagaaaggaaaagcuaaucuuccgcauuugcuugcccacaucucaauauguuugucuuuagaauuacacacuggcacaucacuguugaaugguaggaaggcagugguggagagcacggcaaggcagacaucuggacucgcaacuucagggagaugaccuccuuucguuuauucaccucaguuuauucaccugaagaauggggucaguagcacugccuacacuuccgauguuccucauguacuuaugaagauaauguggaggcaggccuuuuacacacuucucaucacauuaauaccauuuauuuuauuaucaguuuuauuauuguuacuuuugcccccccccucccucagcaggggcaaacuuugcucuuuggacuaagaacaaaacccccugcaauucuagagugccuuacaucuguggcaauuguccuaggaacuggagccaucucuugcuuuuuuuuaguucaaccucggaggccacaggaggccucuucugagagaugccaaaaggagaaaaauggagaugccagcuuccacaaacguuaucccugucccugcagaaccaugacgucucugaucucuccaguguugacugcaggauauuuauuauucagcgauaauaauaaaucgcugcuuauaaaauccagggaaucgagugucgcggaggggaggaaggggagagcugcgagagccagagguccagccaggcccaggcuauuaaucaucgcccuccauuauuucucgaagauucauucauuguuccauagguaccuagagggucaauuagagaccacagacaggcuuuuucaaagacacaggagggucaauuaggcccuccuuauaauuuuaugcuuuaccagcaaaugccagcguauugcacaucagacucggggagguuggagauaaacaugguauuuuuuccccuccuccuuuggagagaaagaggaucccaacaaggagaaauggagauggguaguaaccggucggucacacacggcucacaggcaguaagucuauguaugggucaguggaaggcaacaggauuuggugaccaacccugacuugugaagagcaaaguucucguggggucagagccuccggaauggucagggaccuuccgugauggaaggcucucgucccuuauuagaggugguucauuuaucuuaggugccaucuuaaccgugcaggcaggagaguauaauuguaagcuauaacaaagaguauaaguaguacugagcccauggugauuugagucaggagagacuggccugacccgggcuugagucucggugcccaccauagccaccguucauguuucagaagaauugggccagugucauacacauauuguuuugcacuaucuuacgguucaagguuggcagcacauuuacauguugccacagauuacaauaaaaaugaaagaaagaaauuguuccuaguaagaaauagacgaaggccgaggacuauaucuugguggcuagcaugugugagguacuggguuugauagaggggaggacauagaagagagaauaucccaagaccagcacccacaucgacugcuuuuccaaguagaagauuacacacugacucugcccauuccuaaacauucagucuuguuaacaggucuuuguauggauuggugcaucucucugccuggaauguucuauccaaagcuagcugcaggucuuucuucuucuuccuccucuucuuccuccucuuccucuucuccucuuccuccuccucuuccuuuuccucuucuuccuccccuuccgccucuuccuccucuuccuucuccuccucuuccuccucuuccuccuccuccuuuuccuccucuuccuccuccagacugagucaggcaaguuggcauccucuguaguccccacaguacccucucaagucauaggaccaugugauaucuguuuacuagccugcugggcaucauacacugccacccugagcaugugugugccaagagauacaguugagucuggcaggagcccagcaugggagaaggaaagugguagaggaggagccaggagauagagcaaaagucuccugacggcucccaagacccagccuacuguagauccucccgucaugggaaagaucaucaccaggaauguuuaggaauagugcgacugucagcagaaugguggggugggugucaagagcagugucgucagcuguggaagacauucuccagacaaugaaugaguggaaaugacuucacccacuuccccuuccucaccaggacccuugcaucaccuuggaucuagcaucacuugucacauaugucaggaaucaaggacucugggagcaguguggucagcaaaaggcacaauuagucaugugugagcguuuuguguauuccacguagcuuucccuuuuuuuuuucuuucuugaacugcuccccucgagggaaacccacuuccggcaugaguuucuugaugggguguucuaacuaagggcuuuagucaugugaacauaaacaggaagguccucaccccacccaucucacagacccggagcaaacagacauagaccacaagucucacccaaccuucucuguuuccucaguguaugcccuggcuuacagucuaaugcaggagggccaguucccagcuuccucccaaagcuacauuuuucuguuugucugaaauaacucagaucucaggaguuugcuguuacauugcuucacagaaaugagugaguggugcucucucucucucucucccucucccucucccucucucucucucucucucucucucucucucucucucucucucugguauacuuuggguauaagaaggaacuuacaaauccacuccuuuuucccuucucucuguaguuugacagauuauaggaggugggaugauauuuuuacguacaaauauccauugcagagauccuuuggacauaguaacauagaagaaagcauauucuuuuuguagccuaaauccucaauacuguugguauaugaggauguugauuucugauuuuaucuaacacuuggcaugggaaaggaauuucacuagcuacuacuagccugaacucacgccugccuagcauaucaccacugucaaggaaaauaacagugauaaguauuguuuuggaaccaaccuuuucuaacuaaaaaaaaccagagcuguggcgauuaggguuuuaugcucuauaggaacagugauugugaaagcuaauaaaaauauuuaaaaaaaaaaaaggcagaagagaaguucuacuuaggguucuuuaagcuggaguucuugcuuucugcucuguuugugugugcgccaucccuguguaacaaaucagcauacacuuggcaacucuagcccauaucaauggcugcaguucuauaggucgaaaguaagggcccauuauagcuguguuaucaucucugaaccucaggaagaccguggggcaucagcuggagcugcacuccugucugcggacacuggagggaaauccacugccacguucguucaagguguuggcagaauuuagucccuuaaagcuacaagacugaggcuugagguuccucuucagucauagcagguggcugccgucugcuaccggaggccacccacccgugucccuugacaccccaggagaagcagcagcgacccacagaugaagucccuuugagguuugaaucucccucacuuucucgacgcugcugucugaacacaaauagagggacuuacgugacuugggcaccgaguuuggagcuuucgauagcauauguaaaaucuguuuagaauaaaugcacugacagaucaaugccugggagaagcccauguguacacggugggucucuucaauggcugaauucaacacgcugucuucucugugccacagaguuccccacuuggaaucaugacauggaggauugccgggaccaucgagugagugguugucacuuguuagcccugugguagcagacaggcuuuccacagauacccucccaguuucccuuucagcugugcugguuaggcacagaacaaugugaggcaggagaaaaaaaauaagccuggagaggucuggcaugugaccucuaccaugucagccuugcacagugcucugcugagauacgguuucaucuuagaacaccccuucccccacaauuaugcuugaacccccagugcagccaggugacaucaguaugaaaacugauacacccaucccacaccccuuuacucacacccaggaggggaggugccucuccuuuguucuauuccaauacaggagcagccgggccuggagggaaugcucgaggcauccaaagagugagucugagcuuggaaguuccucacgcuaggugugccccccccccaugggacccagaggagccugugaccaaggagagccaugaacacagugccccccaacacacacacacacacacacacacacacacaaagucuaagcuuacuuaaaacaugugacaguuuugcaguuugcuuugcaaauugauggcacaucucuggacugaguucacagacaaagccuuuuugcaacaccaaaaugucugcucaggcauuccacuugccccgccccagcagguggcccguggaagauguaucauggccucccaucauaaagaucuggcaccaugcauagcuuuuuaacagaugccuggacccggugaguccccacaugccuuuuuaguucaucuaagugcacagaucuucagccgacucaccuuaaguggaugagcuuggcaucgugaccacuggcgcagggaagaccguguggguggaagcugaaucuucagcauccuaacacaagagcagggcucaaaguccucccauguaaaaccucacagcaugugagucccugacaaggagccacaauugguuaauuacaggaagacaaccccauacacucaacagcuccucuugcuucucacccuacugcgugccuccagauccuucagagaaggauuacagauguuuucuccaccacccccaccacccccauuucuccuucuaucuuucuuucuuugagcucucugcacuccacacuucaagcuaaauauaauguaucugauuucccaccauacauacuaaucagaauugaaaguugucuucuggggcuuuaaaaagcuagccaagagcggugcgauuucuccaaaaggaugucugcaaucaagaugauuacaugggaaaauaaaucauaauuuauauugcugaaaaugccauuugcaaaaaaaaaaaaaaaaaaaaaccacucugacaaugccucucccggucuacuuguccguuucuccgugugggauaaacgcugcccuuuugcagcuaucccucuuuccuuauuuauuuauuuccuuuuaacacuuugaauacuucagaagcaaucgccauuucugggaggcaggaaguuguuggggaauacaacugacaagcuggaaagaccugaauugaacaauauggauucaugcgagagagagcacaaggauguucuguauucaggaugcacgugcggacaugugggcaucuuucuauugaaaaagaacuucaagccgaacucugaaaccaaaggcucucauccacccacaugccuuuagagcgaguagacauaccaagcuaucuaagagaauugauuagugaucagacuugccagucucccuuggacuuaagaacuagcuccaguucuacccugguugacaaauaucagggacacaggagcacccauaguuaagacucaaggcugacuaaaaguggcccuccgguucucaccccucuucaucaugggaauauccuugacuguggagugauagcuugcccuaaagaguccuggacaccccuccauggcccuaaccaacagagagcaagcaugauucuggugagaacaugaaaggugucuugagauguugguggcaaacaucuguaauucuuguacgcgagaggaaauuaaaaguuccgagucaacugggcuacauagguugaaagacauuguuucugucccacuccacccccaaccccaccucccccaaaaagcaacaaggaagaagggaagacagcucuuucuguauuggugcucuuccccacgcuccacuugaaacccaucuaaagcucugaugaacgagccuaccaggcaccacaaagcaacagccaggacuuaaaaauggagcugccuccuccccgaagccugcuaagcucucacugcagaccugguggaaccggaggcuaaauccuggcagcugucuuauguuugcggauaauuuccuacacaguagaaguugcuaagggugcaaggaggggaacaagggaacaggaagcaaggagccaacugcuuccuccuccuuauuguauucaacugggcccuuugcagaugcccugugaaacugucacacauguugacaugagaugucuuccuucauugccaaccaccuuaguuggagucuuaugcuggacacgggaccuagacuggcugauccaggaggcccggggaucccccugucuuuguuucccuugcgaugcaacugcagcugcacucugccacaucuggccuugaugcugcugcuagggcucuaaacugugguccuuacacauaugaagcaagcaccuuaccugcggugccaccuccucacacaacaaucuuaggccauccuaagcauccuuagcaucaaaugaagccuuuggugccagagcucuucgucauuauggccuuuggaggcagguaaaugcucugaagcaggagaggggugcacucugccugccugggauccaucccucucccacaacuuccaggccacaauccccaggaggacaggccccgaaguggagcuuccuacuuccuccuuguguuccugucggggagaggaagaugggcagugaguggauggaugaggagcagauugcuuccucauccaucaaagaaaggaaggaaggaaggaagagagaaagagaggaagagaggaagaaagaggaagagaggaagaaagaggaagagaggaagagaggaagaaagaaagaaagaaagaaagaaagaaagaaagaaagaaaggaaggaaggaaagaaggaaggaaggaaggaaggaagagggaccagugaaguccugcagggaaggacauuuaccagccaagccuucagcagagcagccuccgccaggcccauaaccagucccaaggaauccuguggccagccugcaguacaucccacuucagaggaaacagcaaugcuuuccaguggcucaucaggggguccaugaaguugauuccucguuguauuuaaugggaaaugaacagccccauucaaucuuaggcccagcagagcuaguaccaugaaagcuaccagaugcaaggagcauggugagauuaaaucuuucagaauuacuuuaauauacaaaaguuaacauuguugugguuuuaaauauguuuuuauuaauucuucgagaaugccauucagauauacaauguauuuugauugcggucaucccccccucaacuucuccaucaacuccuuccagagcccacccccacccccaguuuacguccuccuuuucuuucuuucuuucuuuuauaucucacugaguucaauuugugccgcccauagacucaugggugugggaccaugugauagauaguuuuaauuaucagcuugacacaaccuagaaucaccugggaagagaguuucaaugaggaauuaucugcauugaguugguuuguggacuugucuaugggggacuaucuuaauuaagucagcugaugugugaagaccaaguccacugugggcaacaacauucccuaggcagagagucuuuaacuguacuuagagaaauugaacugaacaugagcaagugagugacaauacaugcauguguguauguguguauauauauauauauauguuccugacuguggauaugaugugacuaguuguuuaagguuccugacagcuugacuucccuguugugacggaacuguaaccuggagcugugagcuaggguaaaaccuuucucccauuuguucuuuuguagugguguuucaucccagcugcagagaugaaacuagagcaguuauuuucuauuacagauuuuaaaaaaaccagaacagcugaaaccuuucuuaugugugugggucuguauauagguauagguguuugcaugugugugcauggguaugcaugggugugcgugcacauguaugugcauguaugaagccagagacagcuucagguaucauugcauucgagcccucuaucuugguuuucuuccccuccuuaaaacaagagucuuucuccgggaccuggggauugucaaaucuacaaagcugaccgaccagcuaaacccuaugauucuccugucuuugaaucccagcaauggaauaacuggugcugcacuauucaaguguuuugcccaaguucaaguuccagagcuugaacucagcuuuguauuugcacagaaaacucuguacuaacugcaccauauccugagccccagacacuacucccuuaaaugacaggauaaccaccuguuagcauaagaucaauaccaguguuuccacguguguuuucuuugcuuguuucucuacuugauucauaucagcuuuaaaggcugucaguggaagccgccaccacuccuuacacucucacguucacacccgaggucuuacuuucaccucccaccagcccugggaaaagcuguguaacuggccuuggcuugucccucuggcuuguagcagacacuccaaguagugagauuggaugcaccuggugucugccuccgagacugguccaguccaagaggguggagcaaaucucugggggagccguggaaugcucacucuugcaaaacacggucugaaaugccaagagaucuggggacuauugaagagggagcaacgugagcgaaaacaugacucucuuuagaaaaaaaauguugcucccaaccagaaaaguuagauacagaaagugcgcauauuuuauaaguaauauacauauacaaauauacauauaacauacucguuuugacacagggucucauguaggcaaggauagcuuccaacucacuuuauaguagagaugagccuugaguuccugcuccuccugccuuuauugcugacguucuagggaagcaccacaaugccagucaugugacagaccuuucgguguuauuauggcaucuuccguguuugccccaauacuuccuccccuauugggucuccauccuaccuguguuccuccucccccaaacgguucaccuuaccucccacccuagucuguauguguaacauguauaugugauuauauauguguaacucuacaucccacgcacgugagaaagccgaucacugccuucuccccucucccaagccucucugguuuccaguuaaacuggucgaccuguugucgucgcauuaaagccacaucuuuuucauuucuggaacuuucuguuuuacuucgccuuuccagcccagacaacuaccguugaguuugucgcaagaauuacuguuucugucuccaccccccauuccccagcgugcucguccaucggcugugucuucuaauuuauaccauaccuuuggaggagcagcugggagaaggugggggcggcgguggagaaaauguaaaauguuaaugcuucuucuccuaacugcggcguugucagcuccguuuuguacauauaugauuaugaagcaauuugcauuaaauuuacaccuuuucaaauuuugaaaauugcuuuguugagagagaaucgcggcacguucucaauagcaggcugauuaaucacaguucuauggaggagacauaacauuuuuauuaaacucucagugagcaggaaaaugaacaccuccugcaauagccauacuaaugucauuagugaacauuuucauuuccaagaggccucucccucaucccgaaccuuccauccuucccacauugaccacagcgucuccucuugagcaggugagaaacuguauucauaaugucaugaagccuauccauagacuccugccgcuagccugauccaucuaggucuuuaauguccaucucuuccucuugucacuugaggcucucuaugcuacgucucugaauuucauuuguggucagggaggguuuccauccugaagagccagugacugacagguucacacacccccauuacccuccccccaaaugcccaaguggauagaagaaugaggagaaaaccuaugauucguugauugaugcccaagcaguuucuguaguggaggcuucugguaaggacagagcacacaagcgaccaggaggggcuuguggaccuggucagcuauauagcgauucaaagauacaggucguggcacagauggugaaguaguuuggugcaggcaugaggguacugaguucagauucccggcacucaccugaaaagccagguguggugguggacacuugugaucccagggcuagagaggcagagacagacagaagggucccucggguuuacuggccagccagucuagcucaauggccaacugcagcuucugcaagagacccugccucaaaaauagguggagaacaauugggggagacaccugauggaggccucuggccuugauauacauacuguacccuuugcucacucguugcugguauuaccuuuuaguguaccuuguuuggaugcaaaucauuuaacuucauuaauaacuucccuggcgaugguuguaaucuacuauguugagcuguagauagcaccggugccucucuuugaauuccaggugucccgaaaagugcauccuacuguuaaaaccaugcccaaacucaucagucugaaggcccugcaaagcaaagcuaaugucaauaauaaacuaguccacaaacaccagaacgggaacauauucaauagucuagcaauuacaagaguggaagagguguggagagucaggcaucuuccacuguaagggagagguugucagcaaguguugccauuguggaaaaucguugguguuagcuaaugaaguagguaauaagcgacagauaaugcggucaguggaauagauuaagauuauggaugcuguagcgaaguauuugaaauggcaagaaaaucaaaacuccucaguguccacccucaguaaaacgggggaaacggcguuggcauacauauccuccagguacagcaguagacagcucugagacugaaugaauuucuauagccggaaucaacacagacagaucuuuuaaacacauccuacaacauacgagaaagacaaguuacaugggauaauuaauacggcgugguuugguuuaccaagguuguagaagcuuuaggcaauagacgcuggcccuauucuugcucuaugaccagauagccucaugcucccucugccacacuugccccaccacgagggaaguguccccuuggcauccuagcgaaaauaagcccuccuucccuuaaguuguauuuaccagguauuuuguuacagcaaaguacagcugcccauuuccugcccagcccugggcacagagcuguagguggcagcccugccucucuaagguucaucccuaggucaccaagaaggccaggaaacagugggauucuaaaccgauggcacaaacacccaguggucuucuuaugcuaccacguccucagguccugagguuuggggccuugcuuggugccaagguuuugugcuuccgguugcucucccuaagccgugcaucugccuacuguguguuggggacugucgcagaccuugaugggguucuggaacccaaacaccccuaaggccuucaucugaucauuuuauuugaugauuuuuaauaguaaaaagaaaaaaaaauucauugacucaaacuacaguaauucuauuuacuuugcagccaaacccggugaaguuaucagacggugguggcucccucgccucacagauagaaaaugccuagauaaauacaguggaggacauuuuuaaacauguaaaaaaaaaaucaauuuucauaagguuacaucuuuuuaccucuuuauauaaaacaugcuguauuaaaagagagauuaaauuuuacucugcggacuaaaaugcaaacacaaaauuauuuuuucauuuuucagagcaugcacuggauuaucauuuauuuaugaggcuuuuuuuaaucuagaauauauggaaaucuuuuucuugaagcacaauauaauauugaauugggaaugcuggcugacaguuccccucucacgguugcggagaaugauucuccgguaugaauuuuuaaaagaaacuucaaugcccucugccucugugagggaaaaugugugacgucgucccgagacaccuuugcaaggcucccucccaguuucgaguccguccaacuuuuccgccggaggugaugccuccucuguuuguccaaagucacaaaaaaccacccacuuggcuuucccugguucaaagguuccccuuggcgggccggugagauggaucacuagggaaaggggcuugccgccaagcuugaggccuggaguuugauuccagggucaacacgaggaaggagagaucugacuccugcaagcucuacuucaaccucugccaugugcaccaugacacacaugugcacccacacccacacaccccaacacacacacccacacauacaugaauauaauuuuuaaaagaugggguuaaaagguaaacuuggcaaagaacuuccugccccagaagaccuuucucugccaugcaguaacggaugcgccuuugugucuguuuccuuuguacauauuuuucugauucggaggcaccggccgccgaagggugcuaguggacuuucuucuaguguguucugaggcaaguguccaucucagaacuuccaaacaucagugaugaagugucauaauggugagagcugggggcacacguaucuaccugugugugcacacuugccugugugggggugguaggccuuuccaugugcacguggaggccagaaguccaccuuggguguuacuccacaagugcugucucucuugcuuauugaaaacagagucuccauggccuacagcuucccaaauaggccaggcuagcaggccggcaaggcuagcgggccagccaggcuuagagaacagcaucuucccacugcucggugcuaugguuauaaguacuuaccaccacacucuccuucuuugacauggguucuguagagagaacccaggcccgugcuuucaccacaaucauuuuacuggcugagacaucucuccagccucugauaacgucucacucccacacaagguaaugugcaccaauuaccauguuguugaugccuuuuuguguaauuagaaauaaucuuauaccauuagcuuacucuacucacauucaauuuuauauuuauguacuauaaauauguaugaauaacaagcuaaacgcaacauguauauauaguacaucgauacauauuccaaauuuacagaggcagaaagacucaaacauacagaaaggcaguugggcaauuguuauaaaugggaugaaagaaauucauccagacucccacugaaagacaagaaaugagacuaugaccuuguauggcaccuguguacuucccuggcccuugauaaugcuuugugagcaggggugaaggugacaguugguacaguugguacaggcugguuugccuucguuuucauagcaucagccacuccaccgggggguccuuuagaaacagaucagcaugaugcauaaacaaaugacaaugaacacagccaugcugguggcaccugggucuguguacuugagggggacugagccauaucuuccuggaaggacagccacaaugugucugggagcccugugacagcucuaguuagccuuacaauuccuugugagcugucuucuuuuccagagaccccacugccaccacaagagauggaauaauauaauaauaaauaauauuauaucaugcccauucguauguccuggcccuucauggauuucuacccaggggguucugguugguuuccccucugcccuaucauaucauaucucccauuugcagucuuguguggguuuucuuuuucuaguuucuuggauguguuuaaaacuuauauaacuuggagugcggcuuuaucagugugaaugagaauggccccauaugcucauauguucgcaugcuugauccccaguugaugguuaggagggauggccuuguuagaggagguaugguacuagaaaugggcuuggaguuuucaauggccccuugccaggcucagcgucucuccugccugcuagccaaaugggauguagcucucaguuacaucuccagcacuaugcuugcuugacugcagccuugcuccccaccacgaugauaagaggcuacacucugaaacuauaagcaagccucaguuaaagucuucuguuguauuaaagaugccuuggucuuggucuccacagcaacggaacagucagcaaaagcaaaaugcuugcucuccaggcacgagggccugaguuugauucugaggacccacauaaaaugccaagugugguggucacacagaacgucacucuguuagaaugguuaaaggggacaggagcucagaggucaccuuuaucuccagcugggacagauagaggcagggguugggaaauaacgaccguccaaccuucucaguguugguauacaaaugacaucuaccuugcaagguagcuucagaacugagguaaaggggcuucaucuucaugucugacauagggauuccuggaacaugggaagacuugagagaaacaaacgcuucuuuccuguuagaaaugaaguugcuggaaagagucucugcagccaagaggaggggucaccauuucauucucucuuuaaaaaaaaaaaaaaagauuuauuuguguauuuuaaguacacuguagcugacuuuagacacaccagaagagggcaucagaucucauuacagaugguugugagccaccaugugguugcugggauuugaacucaggaccucuggaagagcagucagugcucuuaacugcugagccaucucuccagcccccaccacuucauucuuaaccuacagaugccaccugugggagggaaacaugcaaaggaaaccaagcaagcccaggagggacaaggguugcuuccucucuguucuuuugucugucucucugucucggucuguuucucucucucucucucucucucucucucucucucucucucucucucucucucugugugugugugugugugugugugugugugugugugugucuccuucuccauuacuuugcaagcccuuuugaaagcaaaaguugucgauucuguuuaugaaggaacuuuaucaggguugagaaccaguugcaggcugauccugaucaccucuaaauuuccaugugaacuccugcccaucagaacuuuccccccauugaaccuuccacccccucaacccccgacacuccacccccugcacccugaccaacccauuguggacagagaaccaaacagaaggacggagcaaguggcacagaaaugacuucuuuagccuaagcauuuucuaccacauuagcguuuucagccaaaagcucagcuguuaguaacacucucugccccacagagagaaagagagagagagagagagagagagagagagagagagagagagaggcagagagugaaggauuuaaaguucaaagccugccccaugaagagugaaguggucggugaggagaaggaaaggacuggcccuaugugaggugguuuagaacgacugcccacuuucuaaugcuguucguuuaugauggcucucacuugaguggauuccuaacggaugcucccacaucuccauguccuuccuccuucaaacacucuuuguagccuauuucucugcuaucugcccauccagguggcgauucuuucucuuaccugcaauuuaauaaaguuucuaaaggguaucaaugaaccggucaugagaaaucagcccuuggcccuguuacaauggguuugaauggguuugaugacuuaaaaauauauauaucuuuucuuaauuaaacgcuguauugguaauuuuuuuuuuuuuuuuuuuuuuuuuuuuuugguuuuucaagacaggguuucucuguauagcccuggcuguccuagaacucacuuugcagaccaggcuggccucgaacucagaaauuccccugccucugccucccgagugcugggauuaaaggugugcgccaccugaugccuggcugguaauuuuuuaaugcaacauauaacaaguauuguuuuuuuuuaaaaaauauuuacaacuccaaucuuaaaaagaaaaaaaaguuacauauggucauuugaacuaauugcaaaacugacacuacauuaauuagauaauuaaaagucucaagcauguggccauuguauucaucgggcuggaagccagcgucuucuagagcucagaaaguggguuagcauaauucaauauucaauugcugcaccgguuuuccuaugaauagauaauacaggacgagccuuaaaucuggcuguggagagcuaacaggggcugguuuuacuuuaauugaguuuuaagcacuucuaggccaucucauugucuucacaguuuaacccuuuggaguugucacuaccuaccugcuggccgugccaccucagaccuuaauggcgaugaucugucuagacuaucaagugaccugcgggaggggcgggugucccacguauggugggggcacuugcaggcuacugcauauauaugcauagaggccagaggaugaccuugagcgcuggucuucagcuuucucacccaacuugagacuaggccucuguuguuugcugcuguguccaccgggcgagcuggcccugagugugaggauuugccagucuccgcuucccaucucgucuaggagcgcugcaauuauagaugcuuccuaaaaggccuagcuuuccauggguucuuuagguacaaguucaaggucuucacuuuuggguaauaaggucuuuauccacugagccaccucuccagcccuaugaauauguucuugaccaauaaacaccuugccccauuuguucuccccacagagaacccaggcugccaugaacggaaguccuucccagcagcauacugucugugccuuagcacaucaagguuauuugucagggaaauucucucuuguaauaccagguccccuuuagauaacaggacuuaauacaaaaguucuucccauaccaacuagucacguaaguugauuucauauccuuuuauuucauaaaguuuugcuuaucggguuugucgucccgaauuugaaauuaaaaugcguggucuccagaugaccuuaucgcaacugacccccaaaucuaaucacuccucgcaucugcgaaaaaucgacaaauaugucaggcauaccucgggccaucaaaacaauguuuuaaauauuucauuuguaggcaaggcaaagaucaucuucagguuaguccuccgagaagggacagcacgcacucgagugucuuuggucucucugagcuauaaucagcgcugauuauccauggcucuuuauaagcagaaaauguacaguuguauguuccacuugagugaguuauugaucgcauuuacggccagaagaacgccucucaguggucaauaccuggccagagcgugucaggugaagguagaaaaugaagugagaucuauacuuuggacagccauugcugcuccgcuaggccaugcuugucacuugagguugcuguugaguguagauagaaauuauauuaacauagacggcacuguagcaaaguacgcaccccaucaauaggauagauuugugucuucuuaggugucaagaguuauuuuuccaaaagucacauucccacgucaguuguugcccaacuuacuuacauacacuugacuucgguguguaaagaccuuucuaaaaauuuggggaacugggaggguggcucugucaaugaagccauuguccugcaguugugaagaugugcucugaggaggcagagagauaaagucucuggugcucaugggccagcuggucuugaugagcuagugagcuccagguucaucgagagacucucaaaaacugaaaggcagaggggaagacucccaacacugagcucuggccucuacauacagguacauauaugugcauggacacacauguucacauauacaauaacacauacacccauauacaucauacacacggaaugagaaugcacacaggugccauaggggcgggugauuuaaaacauuuagcuaaacaaaaaccaucuacuaucuuaggugucugguauuuucucucucucucuuugucugucucucucucugucucucucucugucucucucucugucucucucucucucucucucucuuuucucuuuccauugguaguauugggaacugaugcucaaacuucacauauucuagucaagagagccuugaacuuguaaaccuccuuucucggccuuuugaguaguggggguuauggggcgugcaacuggauguuguuuguuucugauucucuguugaccaaugaugauuuuacagaaauaucauugguccauuauuuguuugucaguagaaucucagucucaccugggugucuguuucgucuuuaaucauuaagcagcaaagcacaugacccugugcuucauagugaacuaguucauaggagggucuuuauguuggucacuagacguacuucaucugggucauuucuguucgugcaauuguuugcaaaaugucccugugaccuagucuuccccaggucacuuguguuaggcccuuucacugauguacugaggacuuccugugugccugaacucugcgggugucgaaacacagagaugaugaaaacaucugguccugcccuugggcuagagagauggcuccgugguuaagaacgauuggggcucuuccagcacccaugugcugauuuauaaccacauguaacuccaggggauaggaugcauuuauggccauugugggaacccggcccucgugugguacacagucauucaugagaggggaaaagaaaaaaaaaacguauacauguaaaauaaaauaaauaaaagcuggaaagaagaggaggaagggaagguuaagauggaggaaaaagcaagucccugcccuagagaugucacaaucgucagcauucauuguacaccgaaugcacauuuaaacuauucuccugcgagggagaaaagcaggaauucagugcucuuaucucugcacagagcucuugagugagacaggagucagaggaaguggguccuuuacccuugaaauauuuguucuugugagucuuuuccuuggagcaucuucuaaauguuugggaaaaaaauguguguuuucuaauauccuagucuccacgcccagacagcugcugggccccguggcucaacaacaggagcaggcagagccagggccagagcuagcaugggucccucccugcccgguacaggcaacgcuggcuucaaagcgcaaguuggucucucaggguaauucugaugaccucaguccugcuuuauggagccauuguagaacucaggcugcccagugucagaucaggggccacuaugaugucuuccaauaaauguccuccuaauggcucucuacucagaagagauuuaucuguuuccugcagcagaaucucuuguuacgaaauagacugcagauugcaggcuguguggcaauguguacugggaaggagcuccuaggagaggcugcaagugucagagguguacauccucccucccaagauggugcuaccugaaugacggcaugauaauucgaugugggagcauaggggaagggcuugggaccugcaucccuagagguaggauugguaauccagaggcucugaguugagugcuuuugacaugcagaagcaagagucaagggcaaagcugccuuugaaaggcuauuuuugaggcgucuacugcagaugcacuugagcuuccuuagagcaaaaccaguuaguacugcaugccuagcgggcaaaugcgugaggcuccuucacaucacggcugugugacauugcuaaagguucccagccugcuugucugcuuguucucugaacguugcccgagcuuccacauucacagaagcccacaguagcauaucccucccucuguggucgcaggauucagcuaaaacuguuucuuuucuaucuucugcaccagaguuuaagauccaugaagucaagggcccggccuggcuugaucaacuugguuuccucagcaucaaugugaggccugguagcaucguuaucacguucucauugugauggcuaguauugaccgucaauuugagaggaaauagacucacccaggagacaaaccugcugggaugcuugugaggaaaugucuagguucagugaccuaagguggaaaagccuaucgcaaaugugggcuacgcucucccaggcggcugggauccugggccaaguggaagaaagugagcugagcacugacauccgucucauucucagugcugacuaugggugccaugugaccggcuuccucgcgcuccugcugccaugacuucccccgccaugacugacuauacccucaaccugagagcgaaaagaaccccuuccuuaaguugaucuucccacauauuuuucucacagccuugagaagagcaaguaacacaauugcugcgccuagccuaauguuuguugccauggauggugugacaaaacuaauaggguagccagcgagaugguucagcggguaaagacucuauauaccaacccugaugaucagaguuuaaucuccaggacccacaugguggaaggaguaaagcagcacacacaagacaagcuguccucugaccuccacaugucagguagaggacagcucucaaugcuuauacgcaugcauguaugaauaaacgaaaaugaaaauaacugaagcaaggaauguaucucaguggucgaucauuugccuaucaugcuccagaucccauguucaaucucuagcacggccaaaacuugaaugaaaccaugcagacugcucuaacuuuucgagcuggaaauaguguuaacaguaaagcaccuaucugaccugagcgauacucuggguucagccccugcacugagaaaacaaacaaacaaacaaacaaacaaacaaacaaaccaaagaguucauguuugccgagaaacuggcaucugcacucuuaggucgugagcccuaguaugcucaucucugugcucaggguccuggguuucaccauuuaaacuugguuggcucccagcuccucuuuagucaagcagggauaccauggcuucucugcuggguucacauucaggauuaaacagaaagauuauucugaacccagcauccaacaagagcccaggauacggcccaguauaugguggcaggugugcugcuagaugcuugacaugaguuaucuagucauugacacugcuuguauaaaagucaaacgcaggccuggcuucaucagaacagagcucaccuugcuaaaagguagugaucaccgccugggggcggggugguagucuuccggcacucugcguauccaucaccuuggaugaugugaauccgugggcguacacacacgugcccauccgugaggcugaacacacagugucuguguaucagguacacaucagccauagcacagaguaaaacugagggaguucuccuccugccucaaccaaacugaugguuucuccaacaacugauaugcccugaggguggcugagacuggaguggcaaagcuggguugaccuggcugcuuggccccauucuccucaggccuaagcccugggacuaugcaaaggcaguuacagaucugcuacucaaaaccugaacguaaaaaagaaauccuucagccgugucugcgugaacuaaauauaguguccgauuuccgaggcugugggucugaccaccccggggcuauuucugaccacagggacggcuucaacagugugguccacgaaaugucaucugcgagcucuauuuagggccaggaggagaagugcuucuguacuggggaggaucccgugcugaauggggaucggugcccuggcugcugaccagaaagcuggggcccuuggugccuucuguucugucccacacgagggugagccuuuuaguggaggaguugacccacaccgccuuggacucccguuccaaagcugaguccgugcaugugccaaccccccaacccccacccuccgcugccaauuuggaguuuugauggcaacagagaauugcuguuagccagucagcccccaaggaggcucucaguacucucugucuuccgcuucucuuucccauggcggucaccgaaaguccuugagucauuugguuccuuucaagucacuugacuacaguuggcuccuagagacccagucccuguccuuucccugccuccacccccccagaccaaggcaaauccccuguugucaugaauacucucgcuacguccacugaccucacauuauuccuccacuccuggauugucuugucuugugcacccgauucuagcugcaagccuucccaccugucuggaccacgugucacaaccuccucaugaugucacuguuccagugaccugagucaaguccccccaggccucuguguccuuccuuauacauggagcagaucuccggcucuuccauuuuguuccuccugcugaaugcaagcuggcacgccaucccaucucucgguugcuauaucagaugcugugcugcucaguauugaauuuacuuccucaacagccuugcgcuguacaguuccugcucuccagguuacaagugagaaaccaggcuggguauguuggugccauacgccuguauucccagcauuugggagaugauagcaagcucgugaguucaaggucagccugaacuauaaagguagauccugucuccauacugcaacacugcacucacacacaugcacaaaaguuagaaaauaugggaugaaauauucaauaauuuauucauggugcaccagccggaguuauggcauuaggaaugaaugacacuuccugacggccuucugugcauuugggaauauacuaggccuaggauaaucuuuguuuuuguuuuguuuuguuuucuucuagagugccagggugaagauaccacugugcuuuuugacauggggaauuuugaucgagaaaaguuaaauauaauauagccaaaugauauacccagggacaucugccuaucagcagggacacauuccuuucagaucaggugcauuuugggcucccuaaauaccacaccucaucucuccuuccucuugauggaagcucugcccacacuuguaauucuucaggauaccaucccaagacucuacagugcgaguuugaaaaauccccacuaaggcauguggaaaucucgcuauuugguaaugauguaauguaguuagcgcacgucguaaaauuuuuaugacauuucagagaaaccaacacaaaauggagcccaacucucagauaagaguuugaaaaacaacccauacagcaacucuccuaucgaguuuuaucaucaucccauucauaauugauuccaaacuugcaugaaucuuucaagauaagugucuuauugauuaucucaaaaaacaagcgaucacucggcggcauccugggccgcucaccgccuugccucgauuacuguaaacagagagguugaccagaagaaaugucacugucuuuggcacuggacacucgggacauuccgggguacuggaaaugggaagcagagucaaggaagggcccaacucgagagcugcucggucgacggccauugcccugccuuggacauggcgaggugugagcacagucugggcaguggagucagucuugaacuguucgccaucucugaucaacaucucccuccuguuagaugugggaugggucccaacgagagccaaaccauggcugucaggaaacauuaagucucuuagguaguaucaauauccugcucuuugcccacgguuaugugaaucaagcacuccacccccagcacacacacacacacacacacacacacaguugccucccuucuuggaaaaggcaagaguguuuacaagggacuuaagcugcucauuugcaguugccgaagcuauacuagaaaugaacugaacauuggggaacuuugccugcccacccaagggcuguugcaccacccuagccuuuuugcagggaugccugcgggccuugugcugguacaggguauggucaggauugaccaggggacuggguaaaaggaagucuccagggcagcuccugaggaagcccugaagcacucuccacaugacaauaguccuaaacugaacagguugggcacuuggcaaacaggaggccugacuccuggggcuuugaguacagauaaugaagauucgggccauuuuguaaaauuggcaccauaccucuugaggaugcccacuggcaaaugcuuauucugaacccaggggacgggauggggcuacucugcauccuagaaagccuugcugucacaagccccugugcaacagaaaaaucugaucuuuuugauagcugaggguuauuuucuuuauaguuuuuauauugguguuauuguguguguguuugugugugugugugugugugugugugugugugugugugugagagagagagagagagagagagagagagagagagagagagcgcaugugcucacuuacugcuagaggacaacuuucaggagugaguucucuuccuucuugugugaguugcagguuuugaacccaggucaucagguuugugcagcaagagccucuacucacggagccauuuccugagccccagacgucaguuuugaagucgccccaaggugcuccguacagauggugaaauucucuccuuggucgaaucgccuaaguuagcaaagccgcauggaggaacgcuuaguucacuuucugugaggaugaccccuuugaggcagagaacuuaagagucuuuggucuuuaugggauguuuacucugaucaacuccuggguuucccgggugcuaucuaaugccaggcaugugugcugagugaugcguuagaauggcgggucgccucucaacagcacacuaggccaagacaguucccugugaagagguuuuauugggagggagagacaaggcggcagcagaaagaagagagaggagaggagagagagggaggggcguucuccuuacuuauauggaaaaugacauaaugcagguaaaagugggaggugagccaaguguauucugggaacaugguagcugucaucuugacaacaggucuguuggucgcacugucaccuauaugauaucauagguuugggugguccugaugccaacacugagccaauguugggaguucaucuagcgucauuucauuuauuccauucaccuauguauuagugggggucaugccauguguacaggucagaugacagguuauuagucuugaugguaagugcuuuaacucagugaaucaucucuccugccucagaaaugccccuuaaaauuaaaacaacaacaaaagguauguauguagguuugugggugggucauugcacaacauagugugccugggaaggucuggggacaaguuuggaaucguuucuuuccuucuaacaugugggcauauggguugcagggauuaagcucaggucaucuagcuggguggcaagugacuuuauuuagagccaucucacugggccugccggcaucacuuuguagccgaacauggugcuacacauaaagagcuaaauccagaaaggacucuuuggaaaaguccaggauucccuacauuugcagauugugguggugaugcugaugguguugaugauguugaugaugguagugauugugaaagugggauuggaggagaaacaaaaggguggggugggguggaggaagaagaauuggcuuucccagaaagugauuaacuucuuccuuuuuuccuguacugcucaguaggcagugcacaaggcucuuccggagagcauugccaccuugccuagacacgcacaccauccaaggcagccaccuaaugccggccucgucagauacccaugggccucuccugccuuuaucugaaucucuuuggcugccaauuacacuccuccccacucugguuuuucaaggaaauguuucucuguguaacccuggcuguccuggaaucaauuuguagaccaggcuggccuugaacucacagagauccuccugccucugccuccugagugcuaggauuaaaggcgugcaucacuacugcccagccugcuaccaacuguauuugaacacucaaguuugaugguguuugugacuaguguuucuuauggcaacuagcgagcauguagauucuuuucuucucuucucuucucuucucuucucuucucuucucuucucuucucuucucuucucuuuucuuucuucuccuucucuuccuccuccucuuccuccuccucuuccuccuccucuccucauguauauguauguauauauauguguguauguauauauguauguauauguguauauauguauguauguauguauauguauguauaucuacauacuauauauuacacauuagaguguguaauauucucuggaaguccuguggaggauauaaaugaggaucacaaagagcucaggcagcagcccucaacuuuacugucaguugagaugcuuuuugaagacuaaauugggcugucccugcuggggagguaggugggacuuuccaaggagcagguuagaggagaaaaacacauagcgccaaguguguugauggauggcagagcccaggguagagagacauaggcagguacucuuguagcuaugucuagagaaguuaaagccuacagaaaaaguuugccauucagggcaaggucucaaaaccugaggcuucugaagagaguaaggaggggacagggcccuagacauugccugaaggaauuggaagaccaaguggagaagaugagcacuaguucucgugggauucaucugcaguacaggacuuccagauccucauggaagccucaggugaaaggugggccugcucugccuucagagaagcaguuuaagaaagcagcuucccacccgaaucuacagaguaccagucgcugcccaaacccuuggcauucccaguguggugucuuaccgcauaugaaacguauaaaccagaacaccugcucuggugcgcugaggugaaccaaagugcagucaaacaccagcccagcgcucagggcuccucccccauagugggacagcaugugccacucagcugcaggagagaguuggcacggucaaagaacagagcagauagcaucagcuucugccucugugguggguuauucacugcuguagcugugcccagcacugucaucagacagcccguggauggaggaagcgccuucuggccucaugugaacaggggaguguuucccugaagccuuccgacacaccacaucucucuggaccugcccucaggcaggaugguacucagugcuacugaggacucggcucucaccaucguccuguggaggcucguccugagccuuuuggucuccuuccuccuacauucugccuuccccguucucugaccuuuaccucuauccccaggagaccagguugagucuccuuagcaagacacugguguggaagacucauuccaaagucaacaccagacaacuuuaaguuuuauuuacuauuguauguguugggguagggauguauguuuguaugucaucacauggugcacguauggagguuagagggcaacucuauguagcugguucucuccuccuaccuuuacgugaguuccaagacuugaacucaagacuccagguuucaaagagucuugaguucuaaaccugcugaaccaucucgacggcccacagccgaguucuggauucaucuuuggaaagcuaacgagucacgugagcucgcaaaggccaggcuuaccaacccggaucggggagcucacaugucagucuuucccguuauugagagaagagucugaauuauccaaaugcaaacaauucuagaagcuuucuggagaugcagguuaaacuccuacagagaggaaugccuagaguuaucaaccucacaagccgaauguggccgaccaaacugaggugccuguaauuacgcugaggagaaggcacgucuggcuccauucuucuagagaccagccaccggccacccaguguacaaacgcacgcacgcaagugacgauaaccguaaguguuuauaacaauaugccgaucgacuucuuauuucaauagauauccagauuuauuaucccucaagguaagcauugauuuuaccuuugucuccgucaauauuuaccuccaaggucaauauguguggguauucaccucagcgccagucaauagcuguuccguauuacaauauaugaugcucauaugugagaauggggagccguguggcauuaccaaaaaaaaaaaaaauguuagucgagggagccucucgccaaaugaauguauuucuguuucauuucaguacauuuuggcuguucagaggucagauucuaguucacuuauggaaaauggguguuuucugcugcaggcugggguuucagguaaggcuaaccaugcaagccaacgcuuaaugauagagaacuaaaugcaggguuuuuuuuuguuuuguuuuguuuuguuuuguuuuucugagagcuccugaauuuauuauagcugcgagauuaugcacacuucagaagggacaagagugggagcauucacgugcuuagggcguggagguaguucucaucucugguuugcagggagucagggaaccaauauaaggggggaagaugaggagggagacacagagacuccuugucuuguguuucugccuuuguuaccacuagaguuggaaaggaggccuggcuuacauggcccgggccagguaugugccaggaaguacaugugccugcugguauaaggaucugacuguaauaguccgggguugguuguuugguuuguuucuuccuuccuuccuuccuucuccucucucucucucucucucucucucucucucucucucucucucucucuuucuuucuuucucucuuccuuccuuccuuucuucuuucuuucuuucuuucuuucuuucuuucuuucuuccuuucuuccuuccuuccuuccuuccuuccuuccuuccuuccuuccuuccuuccuucuuuccuuccuuucuauuuggguguacaagcauguauaggugcaugugugcauauguacacauggaggucagagaccaaccuuaggugucccuccucccuuuggccuuccaccagugcaucaauuagguuaggcugucugcucagcaagcuccaggaauccuguagucucugauuuccccagagcucagaucauaaacacacgaccccauuuccugcuuugugugagggaucugggaacugaguucaggucuucacgcuuaugggacacauguuuuacagcacucuccauccugccuuuuugugauuucaaggcagggccucguguauccaggcuggucccaaacuugcuacaggaguagcaugaccuugaacaccugaucuuccugccucuuccuucugggugcaggauuacagguauggguguucacacccauauacguguacugaggauuggacucagguuuaugugaaugcuaagcaagcaucugaauguagcaguaaauucccaguagcgcucaucuggccccagcgggcuuagacucugcaucucaccggcauuccacacugcccauccugauucuuuuggaauucccuuuauuggauuuuuauuguaauuuuaaaagauuuauucauuguuauaaaugagugcacacugucugcacucgggcccaugagccaccguguacguauagaggucagaagacaaaucaaugaggcuauuucuauuuuuguaugaguuucugaguggaacucaagccauuaggcuuguaaauguguguuuacucacuagccaccucacugguccuggcuuauuaauuauuauaacuaacauuguaucaguccagcacaucuuucuugccacucacauaccuguuuccagcauucuguucucuuucgagacacacccgucuccuuccuugugacaagauaccagaccaugaagcacaaaagcacaacucuuccugccagccuucgcuauaggaagaggccuaaggaugaccagaagcagcucucagucccuacagcaagccugugagcguacaaggagccaugauaccaaguccuuccagggacucguccugcagucgguagaggcgcuuuggcacaccugugcccuacacagcucacauccugccacuucgaugcuguacugucuucccaggcaccacaggaaaaggcuacccacugcagaaaaauaaauaaauaaauaaauaaauaaauaaauaaauaaaugugaccugcauagaaagagaaccagacagagccagcaaaggugaaggaggcccagagacaauuggagcccuugggaucaccagcccauucguuuuucucuuaagcugcaaacaaaugacgucccugcauuucuccccuagcagcggagaaguggagcugccccugaagcccauugcucuguccagcugugaaaucagaaacccuguggaagucucagucuccucucccaccaaaugggaaaauaucaaucugaugaugagauccgacagugcucauaaaguccccagcaagagcuuuauaaagucacuucccaacaugcccuuccugugucuuauuaaugcccauccuuuaaccuguccucggcuuuaucucuuggcauccuuggggccuuuuuaaccccacauaugaaacuaacccaugggcaucucuauauucaaggauucauuuuaccccacacagcaugcaaagucaguugccgagauuuccccagacucuccuccuccuccgugaucgaccacagcagcaaaaccccaaaccaucgcauccuuuuguaucaacuauggugaaaaccugaccgcuccgagcauuaccugacccuggaaaaaaagaagccuaaggacagacucucuaagccuuucagccuguuuuuugcuugcugugugaagcugacccugauaccccucacccccgcucccauccagaaaguccaaaucuuauacuugccacaaccugcuaccauucuaguauaucccaucuccuuuccuuccuguucccauaggggguugauauucccacugcauuucugucuccugcuuuuaaaggagccccagauaucacaugcccaguacaagaucuaauacucacaggccacccuuggcuccuuuguccccuuuacaacucauaggcuguccucaacuugacacucauuuaaaguguuuauuuauuuauauggcauucacagaacuccacaagacccccggucccuugagauguaaauuaaagcaacuucauuuucauaguuucucccauuccaaaucccccauuguuuauuuaaauagcagccgaugcaucuugcaagaaaaggaugauaauuaaggaaagaagagcuggucucucagggaagcuguacuugccuuucacggcauccucccagcuuugcugucaaaggccagugcaaaagagcuagugcccggggagccagagaggguuugggggggagggaugcuucaucaggaggcuggauguagggggaaaugauacagaugggccugccacaggagcucagccacccagaguagaaccagagcgccuccaauauacagaugugcuuugcagucuucuccuucuccuugucuccugccauacacccagguggcagucacaagccucccuccuccauccugcauacugcagacaacuucugcugggacccugucacaaacaggcaggccagguuguugcaggaaauguguucuuccgggccuuucucuggcuguguccaaggcucaccucaagugugagguucucaauugaucuuccucuccacuuggucucccuagcagagaugaauaguguccuucgcauugagcaggggagagccaucuccaccugaccagccagugaggaagcuugacgcaguuaacccagcccaaguagaugucgggugguuccuugugucgcugcugacaaaucccugaaggcuguagaggaaaaaacucuacacuuccguguucgaagcuggucguguauagacggagaguguuugcauuggggcaggugaugguccuaauuuggggaauaugaguaguuuuucauucuuuauucuuucuccuccuuuucuuucuuucuuuuuuuuuuuuuuuuuuuuuuuuuuuugagacagguuucucuguguagcccuggcuguccuggaacucacuuuguagaccaggcuggccucgaacucagaaauccaccugccucugccucccgagugcugggauuaaaggcgugugccaccacgcccggcuucuccuccuuuuuaaaaucaguuuuucuguacuugcauacggcauauguauaggacaauagaguggacuucauuguuucgugcaagcacagacugugaagugaaaaccauagcuacaguugucuugagggaucuauaugcuuggauacugacauucuugucuguucauuaguuucuuguaauaaacaugaaaucuacauggccagggucugcugaugagucuuguuuuucccaagggucacuugucagggucacagccuuuugagaacguauuauacacagaggaaggucugugcugccugcugccugccagguaucgagacugggugucugacccaggggaggcagaggggcccauggcaggaauagcugggugccucuuagcuguuaaaaauaaccucuaagucaauauuaaugggggcacagagaugaggagggacaggccaacugaagggcagguugacaaagcuacugaacuuccugauggcagggcccauuuagggcgaaagcucagaccaugccauuagaaguccgcauagagauucaguugggaguuaucuaaggggaggagaaaaccugcuuuauuaacuugaaugcagagaacauggggaaugcacacccaucaaaauaaaaucaugggcucagcaggaggccggcgccucugaucuuucugcucugaucucagcagugaugacugccagcuuugaggaauggggauuccacacagcaucaauccaaucucaaagcaccccaccccucaccccugcugccucugacaccuuucucacuaaaccaacugcuauccaccucugagcuguggagcugcuuuuaaaagacaaaucccuugaguccucaacaugcaggacccccuucugcucugaauucuugcuccuuguucucccaaggcucgcagauucaggagccgcugaugcacuuugggacuuagcaagcucucaguggggaaaagcaaaacccccuugagcucuagaagagauagggcccauuuccaugauccauuauccauguguucguccauccucuuccuuccuuccuuccuuccuuccuuccuuccuuccuuccuuccauccauccaucugccuguuucuauugguuucucacucccucguguguccguccaucugaccuccaucccuccauuccuguuccaauugcuuucacacucucuuggguauccauccauccaucuauccacccacccacccaucuaucagauacuauuagccccaauugugucugucaagcacugcacguacuauuauauacacugcugauuuaugugguuggauacccugguugaauuuuuuuuauuuuuaacauuuuuguagaugguugcugccaguauuagggcagccuuuuacacuuuacaguuuucuaagaggcacccggauguaccuccagcauucuuccucuagacccuaccgugcacauuauuuucugcagugaccuauuuuaagaaagacuuuucuggcacccuuuaaauuaaccucauuaugcacgcuuuauuuaccuuucucccaucucucaugguuuuagccuuucugagcucuuacacuguggcguuacaaugaucuuccgcugugugacucagucguccgugcuuguuuauaagaaucacaauauaugaguuuauaauauguauauuuuccauaaauauaccaaauguucaccaaguuucacaugccccccuccuuuuuuucuccuuuuuaaauucaaaaauuucuaguuguguuuauucucaccgucagcauacuuuaucauaucaaagccuuuucaggcacuguaaaacuacugaguuauguuugggucauguuuugcggugugcccuuuaauacuguagcuuuagaaaugcaauuuucaaccucugcuuauuagaauaugauaaaguauucccggucuauguccagcuccacuaaucuccagacugcgcuucaugaauuaagcaugaagauuuuagucaaugugcuuucaaagaccaauguuuagggaaucauggauuuucuacaagcugaggggaaaaucuauaauaggaggaacugauuuucaaacaucauauucccaagaagaaauguccaguucuggcccagaaacagaaaauauuuugcuaucagaauauucuagaaccauuuacgagcgcauuguacggguuaguuuauuaaagggacgguguuuuuaaauguguaaggccaucuaucaugcaggaggauuucaaaugcuggcuuauuuugggaaagcucauucagauuggguuaacaucgaggaaagaaugcaaauugaauuuguaagguauuacuaacuuacucucugccucuccaccaccaccccugccaugguucuucuugcuuuauguaguuuagcaaauagccagagaucucuuuacaggaugagagaucccccuuaggggagagacuuagagcacguccguaggccuuggugaagccacauugaagggagauugcaucagagacuaugugauucagaguuugguguguuucguaauugccaacaggcaaucguuugagaagggcauucauugucuuccggcaucaccacacuaaacaaaauggaggcaccucuccaggagaauguagaagcaauuaagaucuaggaggcuguggaauaucugggaggagcucucaggcacucgugagacucacgucagcccuggaguccuggugcuguuuggugagacugcucuuggcucucucauacuuacuuccaugaucacugguaucuuuugugugugugugugugugacugagagagagagagagagagagagagagagagagagggagaaaacguguguuuauucaugcagauguaauuauacauguguguguacuuacauacacauggaagcuauaccacaagaucaccuuugguauuguacauuccccccccccccauuggcccagaguucaccaaguagcugaucaguaagcccccggaagcugccuaucucugacucccugaugcaggaguaauaagcaagaagccaugcaagauuucuuuuaggcaucaguucuggagauuacacucaagucagcuuuaccaacucaguugucuccccagccuucauugguaccuugcgugggacaucuuucucacauggagcuugaucgcaagagcucacucauaucccuguuugcucucauggcagccgaggccucaggaauugcagcuaguugcuuggacaguuggaguucggcagaguuaguauuuugcuuccaacgcucguuggaucccuaagucaacauccagguccugcuuggugguucucagacacuacuccacguuuggacaauauuagaucgcccaauagcguggacaccggaugcaaccggaaagcuaugcucagccagguuucagugguugcugaugacaauuucuccucuuucccaaugcagagaucaagacaaaaauguaaaucaucuccaauuagggggcugcgguugaaauguucccccuuugaggaagacaggaaaauucucggccugucuggcuuuaucugugaaccgacgggaucucucaggggcuuuaaauuaaucaaucaauccaaagacauugaacugaaucucuaccucuagucugguacuuugagauguguuuuaaaugaaaaggaagcaaagggcuggcugccuugcuccccgcauagcccaaggcugccugcccuggcuggggaauugccagucaguucaaucacacagccgcucugaccgguguuuuucacuaaacugaccccaguuguguguagacacggucuccagagagggacaucaccuccuucccagcccucaccaucuaaucgucccugacacaagucuuaccagaaaugcagcaaaacccagcccugucaaugaccauuaccugcuccugagugucagaagagcaccuugagacaggugcacaagggcacgucccuagacaucuguguuaggaagugcccaguguagacagugaggcaggggccacugagucuccguaguaacggggaggaugcugaaacuucuuaagggggccucgguccacgaguguucucagaauaauguccauccccaggaaaaaacuggcugugcgugacagcugcugaacggcggcgacguagcagucuccuggaggucacucuauaagugggucaaagaaguuggauauuggguucccaggcaaggguuacagcugcagcuccagccccguguugcuguaguugcuguguuaggaaagaaauguugagcagagguuacaucucagugcuggggcauguucuuagaaucugcagggcccuggguugaagaagggagagagggagagagcuugggaaggcagccugucuccuaggcucaggauuugcaugugacguccgcccacuuuaauaccggccucucauuuguuccuguuucuugcuucauauuuauuuguuugcuucauuucuuuugugugccugugcacacgaauggaggucagaggacagagugcaaggguggguucucuuagugaggcggggucugucagucuccaguuucuguuucugcuagagcuccuagauaauccaguuucugccucucaucugucccccauguccccuuagaggugguaggauuacagaugugugcaggauuacagaugugugcucccacacccagauuucugugcggcuucuggggauagaacucaggcugucaguucugagccacacucacuuuugcaugccaaaccaucucagcagccccugacuucauuauuuucagcccugcagaggccaaaagucuaugcucccggaaggaaagacaggggcaaaagggcagcaggugaccuccccuagggaccagcaccuucauuuuguuuaggcaaggucuaaagagggggcggagaaucugcaguauccaugcagcuagucuguccacucucucugugcagcgacuccauggaguugaccuacaaagaaugaggaccuucaaagaauaaaucgcugugggguacuaugagccucucucugguguuuuggggaggagucuguccugccuugaagccaucacagugcugggggggagggggagggggcgggggcggggagggacggguauaggcugccgugggcagacuuggggauagagaaggacaugcuucuagaaucuccacuggaugugaccaucagccucgcuguguggguguucaggucauucaguuucugcugaauacauaggaaauagaugugaaggcucccacuugacagaucaggcaaucaggacuuggggaauuaccauagacagccacugccuucugccacucuaagcagagggaugggcggagccucucugaaucccgccuacccucuccgccuuugagacuggaccaccuaauauccaccuccuaguuuucaacagaugggaacugagcccuucuccucuugggaauuagaaaaaaggcggguuucaaggauccaagggagaugccgccucagcugaggaguuuucccuggcagaguagaagagaaaaaaauguuaagggauaacuccucuuugcuccuugacugaacacagaggaagagaaaugggggaggaugagccaugucauuucuaagucaacauccacaccucucccccaccuuuguaaacaaacaucuuuuuauaggggaacgaauagcuuugucuguggugugcaaaauauauacuuccucauguaaaucaagaagcuguuacuaccaaauaagaacaugugcaugugugaauuguugggguguguagagggggaauacucagaaccagcaagcagccuuuuucuucaggaggaacaaaggauuaaguuggggagaccuuacagguauuguuagcaggcuacugcaaugacugucuucucggaagaguagagaaaggugaaauuccaacugggaauauuagccuaugcagaucgccacccggggggaauucagcucuguuuaaagcgccuagcuccgucuugccuuaugauccaauuguuuuauuagcgagaucauugcauguuucauuuuuugcuacaguaauagcucagugucugucuaacgauaaauuacagagucaggcaaacaaugguuuuguauucgggauaacaaugaaauaucuuauuaaaaugcuggcuuccuugggucccugaaauuagagucuuauuugaaagcaauuccuuggaguuuaaugcaccgguuugaaccaaccacaggaagagaaucauuauuuuagucagagguacugcggauaguaucuguuuccaugggauuuccccauuccuauuuuauccacacagucucugcuagguagaucuucugggcuugacaaugaaaggcacugggugaggaacuacaucccuuagcaugcaaaagauaaauugagaucucaggcagacgugugcuuccugcuaggcuucuuuuuuucuuucuuccucucucucucucucucucucucucuuuuucuuucaagaagauacuggcucugagaaucaucauguuaucaacaagugguggagcgggagcucuaaccgcccccaagaaagguaaaguguggccugugacauuuuaaaagauuuuuuuuuauuugugugggauggggcucucuuauucguucucccccuucccccucccuuccccucccucccuucccucccucccuuccuucccuuucccucucccccucccuccccuuucucucucccccucccucccuucccccccaggguguuggaggaaacaggaagcagggucaagugcuccagagccacaguuccaggggguugugagcccucugaugugggugcugggaacugaacucuaguccuccgcaggaguagccaggcucuuaccucccgguccaucucuccagcccugggucacacuguuuuuaucuuguggauccccaguaucuuguggaugcccaguauccuuuucagagcugagaagacagaggcuuauagagacaauuccccggguccuguaccuugguaaccugugauguggagguggugugaugcggucugaccccgguguacuuuucacuccuugaugcugaaucgcuuucauuugucuccucuucucccggaugagaaccuuuaugcguucuuggcugccaccagagauuuaacacucucagccacacaccguuuucagauugugaaagggggggaguuagacagcugggucggucagccugucuucuccuggucuugaggcaagcucauggagaaccagggcugaccucacgcugguauggccaucacacuuaguuuaugcuacauuaagcguugaaccucgggcuucuuccugaauguuaggugagcauucuuccguacgagcgagccucauccagcuacgaccucagucccuuuauuaccaaucucaguucaucacguuccuccugacuucaugcucugugucuuguguuccccgcuccgagcccccaaccccaucacucacggacaggucggcccucacuaugcggugcauuucgggaacagaacuauuauuuucacuggcaucugaagcucagaguuuuaaaucuuagauccgauccagccggugacuuggagaugaaggcagcggcucugugccugcucaaagguuguccuuguaugagccuuaccugcagacuuugagaggaccgggaagcuugacaaauuaaaaagagggucuagaccuagagaagaagcuaaaacugaaaacccuucuguggcuuaacugcuuggacccuguggaguuuggacggggucaaaggagugacccccccugcuuuccacccgacugaaugcccguuggcaccuucaaacacuagaaccaagcauggugaggcauguguggaaucccauuauucaggagucugggaauuacaaauuuggggccagccuagacuacauaguaugacucugucuaaaaaauacaagcaaacaaaagcaacaaaaaucuccugagacagcucaguuaauggguacagggccaugccacacacaccugaugacccaaagcucaauuccuaggacccaggugaaaguggaagagggaaccaacuccauaaaguuguucucugaccuccauaggcaucacacacgcuaacaacaacaacaacaacaacaacaauaauauaaaauguuuaaagaaacaagcugaaacgaacccagguguuucugcaccuggcuggaccuggacccagcaguacuucacacaugugugccagaggugacacuuugucacacgugugugccagaggugacacucugggacaccuuuauuuuccccaccauauugcugcccacgaguccucaggagcauccuccuucagaccagcccuguguacacuuccaucuugugggaacaaggcucuucgcucagcaaaccucccugagccuauguaugcucagcucccugcugaggaaaggagagaggagagaacugccaucucuccagcccaaggcucccgaugacaacauugcccugacucuuagcuaagagaguaacuaaauaaacuagcuaacaucucauacgcgguccgaucuauauaaagugauuauuuaguguuauguaucuuucucucuccagcacuauauaguacaaguuagcugcuucuggccucccucuuuucccaguccucugccuccuucccccuucccacucauucccuccucccuucucuccuccucccucccuucccauucuauuccugucuucuuuuucccuuugagacauucugauuuuguuuucuuuguaaaaccucuaagagacaaaagggaaaaguacagaugcuugccuggccaaugcagccucccaaggcccaucuucucagcccgugucccuguaccuaaucuauacuugugacuugacuuccagcccaccauacuuugccaucaaaacaaaaucuuaugcucacgacacaagagaggggucaccuccagggagcacccccuccggucucccauuuucagugaaagggaagcaaggcuaaucccgaguaugccagucuccucuuaccauuguacugaacagaacaaacaguccaaacugugucccugcuuuaaaaguagccacucccaucccuuauaagacuaaucuauugucacuuuaaaaaaaaaacaaaaaacauuugauuacauuuguuuuucuauuguguguauaugugugugcacacacacacacauacacacacaaguguuacaccauggcucauguguggagauuagaugacaaacuugagagaguggguucuccccucccaccaugcaggaucugggacugaacccauauugccaggcuuggugacaagccucugaacccacugagccacauugguggcccuuuaaacaauuccuauaaaaccuuuuuaagaaaugauagcacagcccagaauccucgugcuggcaccuuguaccagcauguguggggcaggggugggggguggggggggcucucuuccagcacccuuuauuuuaugcaaaugcccagcuaccuugguuuguccaggcugaguuacucaggggcccugcgaaagcccucaucccgauggagugagugugcagcgcuuggucaucaccuugcucuguuuuccgugugcagguguggguguguggggaaagaaguggaaguacccacucuuuccuguggacucagcacuguggcccugggugggccgcucuggcuggcugggcagaaguccucaaacucuuaccgucagguaccuucuuguaaggagauacacucuucucagaggaauggccuggcagauuaaagacauuguucacugguacacugguauacuuaagaguaaauguccacaaccagucacugggauuucuuguauggaguuaagauuggcaccugagcuauuauggucacauaaacaucuuaaguaacggcaaacacaaaacgcaugucgacucugucuggcuuguaucauagucuucugauuuuccauucuccagucuuuuagaaaaggugggagcauuuaagcauguauauagucucuaaaucauuucucuuuagguuuguagaaaggacacccuuugucccauauacaaguacacaugaaucucuucugccuuuggagucuuugaguguggcgcuacaugucucuuacaaacugauugucgaggaagaaggaaagaggagagacagagaaagaaaaggaaaaaagaaaaaucgcauccuguuauaccauccccugaugucaggaaauuucucacccccuucauaggagccccccggaacaaagccgaguccucuugaccucucagcauuaaaaggcuaaaaguaugcuagacuccgaaaaggcaaggugggggggaaaaaaagcuggaaauuagcagcauccaguugaauucaugaauggauccagacaaacagaggcagcguguuuggcagagugaaagaaagaguauuuccccgaagcgagggauucuuuuucuuuucuuucuuccuuuuuuuuuuuaaguaggggcugccauugucauucagaaaaccccaggcuguucugaaaacaggcaaaaaucaauagcccacuuguugaggauaagcaugugggcccaugcugaaaauaaggggcuaccugagcauuccaccggcagggcuugcuggguagaggaaacaauuggagauauuguccuuccuuguccgcagcgguagccguggcagauuaacuguguccaguggccauuuggugcaggacuaaugggcagaauggauuguguuuguuuuugucugucuacccgggaccuggcaaacugaauaguguucucccucaaagcagccaguguccucgugggaaggcuguggaaagguguugagaauggggaccaggcagaagaguaaacgguuuuaguuauuaaguaguuaagauauaaaguaauacaacaugaaauaaauacagcgacuaggaacacauuuaagaccccguucuaaaaucauauauacuaaugugguggcucacauuuguaaucucagcaugcugguaguuagaggccagccugaguacuauagcaacacccucucacauauauacauaccaaaaaaaaaaaucauacuaauuuguuugaaauuuguuauauuuuauaaaauauacuaaacaaucuaaaaaguaguguucaaaugcuuucuuuuuauuuauuuauuuauuuuuuuucuuuaaaguaaggucucacccuguagccuuggauguccuggaacucacucugauagccaagcuggccuugaacucacagagaucauccugccucugccucuugaguguugagauuaaaggugagcaccgccaugccugguuucugcaacacaacuauauaacaucuaucaacagugacucccuugagccaucaagacggucuagcggggaaagauguuuucugugaagccuacuaaguggaguuugucccugggaccuacucgaugguagggggagaaaaaagacucccccaaacuguccucugacuucccacauacaugcuauggcacguguccacccccaacauacacaucuacaaauaaacauaauuuaaaagucuaaagagugguggucucgucggauauugauaugaaaaacauucuuggcuucucucuccucuuucuuugccuucgaguggagaaaaguggaguccuguaaagaaaagcuuuacuuuugcaugcauuuguggcccuggaaaggugcggauguuuuaguugguaaugaggucuacagucuagcaaggccuagugcccgaagcagccgaaagggucucagugugaacgcuugucuugaacugagugaacagccuucaagcaggugaccccucagacccaagcugauaccauaccgggaugguaacauggcugugacauuggauucuaagggguugccgauguguaugguagagugacaggguccauccuguuuccuuuucuuucaaaaccuucuuuuauaugaauccaguuuauaacacuacuagaaauccccggaaugccauagcuaaauaauucuguaacuuuagccuauguucuugcccuaggcaagucagcuagaguccaggucaccucuucaaaggcuaggcuaggcuaggucguuuccaccuguccuccagaggcuccgagagcuucucugugcagaaacacacagaaagaguuaagugagauaaauucucggguuagacccgagcagacccauaauguggaagggucaaaggcaggccagaaccccucugucuuccuguaaguuggucucaaagggaacagccuucacugaagugcggggaccuuucccacuuccagccucucccuuagaugacucuggaaccaggaagaccaaagccggggucgccugcccuccagggccaucuggccugggauggcuuuucuccucuucaucuuuagccuuuauagaagucacaaaugguaaauggucuucauuucaagaucugggcguaugaaucgucugaccgcuguaacugugugcucuacaugcuauuaccaacaauaaaaucuuuacuuuuuuuuuuuuuuuaaugacaugaaaauagaacaucuuuggcauccucacaucugggccuccccccgccccaauuuuuccauaauggguggaaaaaagugaauccauugcuaagagguauuucaacccccuccuuguccugugggcccauucgcccagcagccaucacuggaggucuguuuucagaaggcccucccgugcccaaggauuguauuuagugaagacagccagguuugaacgccuaucagugcccaggcucccugccaauauuucacugcuuucaccuuggaaguaaaccauccgagccuuuuuuuuuuuuugucuuguucuguuguugaauuugucuuugauaaugucauuuuuugaggggaagcuggugcuggcacauuuuucccccuucuucuucuucuucuucuucuucuucagggaaaagaaagagaaacaagucagaauuuccaccagaagagcugaagaacacucaguuuaaaggaauauuucuauuuucuaggcaaaguucugacaugauuuuuuuuuuauuuguuuggguuuuuuugguugguugguuaggcuuuuuuuguuguuguuuuguuuuguuuauuuguagguuccuguguucuuuuggaucgaguguccucaggucagccuggcugccucuggucagacucauucuuaaagcuuagccuguaucuggguacaaguuuggguuuugccucgcuuuguaagucugagccagcaaagcauacaguuuagucaagaaaauaaaagagguagaugggccuggagcagugcaagauguaucgcggggacguaaaucauaucccuaaccugauuaucuccgcuacuuuuucuugcugauuucuguccaccuggcaucccaacccuuuccgacucuugcgccucaguuucugauggaggcuuuguucguaugugugcauacacgggaggggggggugcuagaaccuaaaugaucugcaccuccccucggccuccaccccccuuccacccccacccccaguaccagugacgcaaacgaccuuuauuuagcaagagguagcucugcgaauccgcugaauguccgauugcgaucucucuggaaagacugcugcuucagcaagguuucuuugcuggucuguggcaagguccccgcuucauuuucaagguguccccgcuuggugccuuugaaggguuuuuaauggauucgcuugauauaccuuccaaauggaguacuuugugcguuaauucaguuugugauaaagauuccuuuuacccuccuuuucauaauucuucccagagauaugaaguacacuagaagguuagauguggcauuuaauuuuuccacaaaaccuauccauggagggggggaaaaaagauucaauuucauuacuauucauguguaggaauauugaaggugguauacuaaaggagguaacuauuucuucuucuaucaaagggagaacaaaucugccuuugaacaagucgcucgguucuuauuuaaaagauaaaaggucaccuacaauaucaucgcuuucaagcuguaguguucaggugggaaggaagcugucuuaccuggauguauuaauuuuacaauucugcuugaaaaauaauccuucugugcauuuauugacugugaguucugacacccuauaccuguuuccccuuauccuaaaaugaaccccagccccgcccccaaaaccuaacaaauacugauaggagcaccugguuucuagauucagugugagaauuacaaucagagaucuaacguggaucuaucuuaaucaagcucuauaccaggaccagggauauaaaccugauauuacuaaaagugcagauuugagagcaagcccccucugugagguccuugucacugucaaucaauaucauucauuucuauuuccaaguauaguaacaagucaaacaguauuaacgauaggcagggcacagugucucgucgcacacaggacucugagaacagcaucauuccauacccauguuucucauuuguuuaauuuuuuuuuaaccaugcaggagccaggcaaaguuguaucaugaagaacaauuucaauuauauguuauuuaauugaauuuggugauuaaauguguauccccuccgcauguguguguguguguguguguguguguguggucaccaaagaaagcauaauagcaaguuguucauuauuuaauuaagagauuugcuuauugaaaacacaaccauggguggguuugcccuugggcagggaauggauugugaucuucugcaggaccuuuggugagagacaucugcuucucauuuauuuaccaauauuggugacauuagccuggcucuuuauuuuaaggccucugucaacacaauuagauaaauaauaaugaaaagaaugggagagguugaugaugggaugguaaaagacgcucuuuauuugaaaugaauaaauugucuaccauaagggaauuagucaguguuucuguuauaguaacuaaguccugguguguggaguaugaguucccagagacuagccuguccaccccccuucccuacauauucuaaauaaauauaucuacugacagcccaggacuaaguuugaccaggaggcuuauccucaauuuuggaggauuauuuuggcaaaguauuuaggaaaagugauuggcaagcacaccuuugaucccagcacuugggaggcagaaacaggcagucucuaugcauucaaggucagccuggucuaaauagagaauuccaaguuccacaggaccacauagugagacucccaucucacauugauagauagauagauagauagauagauagauagauagauagauagauagauagauagauaaaaagugauuugcaaagcuggcuaauauagugugugaaucuauauauuucaucuuuggcaugcuucauauucaggacaaauugucuugggucucagugugcuuucaacagccuacauuuccuucucauuugggauguaugucgugugaaagcuggucuugucuggcuucuucuuccugaaugaucuuuauucuaguaugugagagggacaguacccaccuuugaugauuaaucuugauugucaacaagauggaguuggcaagugccuagcagauacaaccaugaaggagcuuccugagacaucagaguacaggaggagacccuuggauauggauggcaagguuccuuaagccuggauagaguaaucagagugggagugggagggggauacuuagagaggcagccuccccucuuucucugcuuccucacugccagcacgggagcagcucuucccuacccacccaggacagacugacaccucccaaaacugggggccaaaacagguaccccucccauuaaguugauugguauuugggucccagcaaaggaacccuaacucccauccugucuuuuccaucaggagcugcuguuugggaagggucuaacagggguuagaccacaaaggaacaguuuggauuugagacagaguguggaccugcuuuucccucucucuauugacugaagccaguggcauguguagagaaggagucgggggauguagcuuccugagaagagagguauagaauggcuuggggauggcauccucgaguuuccaggacaagguuuacugaagacagacagcccaaaccaaucgggugccacauguccuucuaguguaguuugaaugccugaugucucccaucagcucacaaguuggaccacucaguucccagguaguauugccauuugagaaaguuaugggcaggcuaggaguccuaguuucuugucuaaaacucuuggggccaggcauauuucauaacccagaaaacuuuaaauuugggggacagcaacaugcuucauauuuuuguauacaaccagauacaagagcaugugugggacucucaaaucaauucuggacugaauacuguccauccagauaaaguuuuauuaguauauaacagugugacuaucuaugucccuuugcccacaguuugcucauggcugccguuggauaacccaguagagccuaguggucaggacagcaacuacugacccauaaggcuuucauuauuuccuguauagcucuuuccugaguuuguauaauuucacaucccuagagacagcaucuugcaauuaaguauugagugcagaauaucucugugucaaaaugaauuccacacuagauaguguuugguaccaaaugguuauucaaacaucuuccuauagagagaguuucuugggguucauagaguccucuuuggcuuuagaauuguggaaagauagacgcacaaagccacaggaauugcgaagacggaguuauuuuauccauauauaguuguuuacauuguaagauacagaagaauggagagcuggcagguucaguggaaaggaagcugagaccaauuaccuuaagaaugggucucauuagaagagcaagccucccagucaaaggaggccaugaugaauccuuggacuggaaguguuagaagggacaguuugaagugaaaagaguagaaauuucagucuacacaccgauauuauggggugaccugagggagcaggagagagcaagcccuuagagaaguucccugaacgaagcaggauaccugacuuucauagcuuugcaggggguagugggaaccaccaugugauccaguguggcaucacccacgugccauagaacaugcauggagccaagugcuggauaggaccuuaaacuuaccuuuuauugcaagagggacaagcuagccuugcuuuucuucccuguggagaugauaucugugggcucuaaccucccccagcagggcucuuaauucuuuucaaggcauagacugcacaggugggugggcugauuucugagguuaaaaagggaaaaagcuugggggucugugaucuacuaugucaguguuaguaaaaccuggcuugucucaucccgaacacaccuuugcuuugaucuggaaugguuguauuuggcucugacucccugaggcaucuccuaagcucugccugaaguagaggugacagggucgccuggacuacacgggcuagcuaauuaauaucaugugucuuacugaggccuucucugucauugcugaagccagcacuggagaaugggcucaguacauaucgauuucacucuccugcuuucaagguagcaucucugggacguggggggugggggugggguggaagacaaaggugccuggcagaugaaaauugccuauuuuagcccaacuccagggaucucaucuucuuggauaccgaggcccgugagacaguggcugaaguacuucagcugucucuucccugaagcaucucccacaccuaagcaaauccuuuaccaccgacuuccaucuucauucugacauaguugucuguuaaauucguguuuagauuuuuccuuccuauggcuccuugagaugcucaauuuaaucagucaagacauauuuaauacucucucagucugggccgaggcuuucauauauucuugccccaaucucgcccaaggaauauaaggcuaauggcuaguaauuccgaagcagggagugcguucucugucuggggacucuggggucuauguguuagaucauuuguagcaguuuuaaauuuuaaaaugaaacacgcauauuccuacgauuucggaugaucgcuagcuaagcaauaguuuuauuggaggaccauauggacuccucaauguuucauggaauauagccacucauaaagacauaaauaggagcucccaggcuacauacacucuauaucucgaguccccguaccgaguguacaguuggcacaaaaguagucauugaauaaaauggagaaauugccaccuaaggaaaccaagaagauaaucuucaagaacauuaccuuagagggcagcagggauggcuuagcagucaagagcaugcacugcucuuacaaaggaccugagcugcugagaaugcgaauucagucccuaccaauuaauuaauaucaugucugguggcucccaaccacaaguaaccucaccuccugaggcugugaugccuccagccuccaagggcaccugcacacaugagcacacacccacacagagacacucagacauacacccgcacacaugagcacacacccacacagagacacucagacauacacccgcacauaugagcacacacccacacagagacacucagacauacacccgcacacaugagcacacacccacacagagacacucagacauacacccgcacacaugagcacacacccacacagagacacucagacauacacccgcacacaugagcacacacccacacagagacacucagacauacacccgcacacaugagcacacacccacacagagacacucagacauacacccggugagaaauaagaccaauguuuaaaggacgaaaagaaccuuaccuuagccucuucccaucuccaucgaauucuuugucgcuuguaugaggaaugcauugaugacaguuauccuuuccuuucuccugguauuuguauaugcauauacccaugugugugugugugugcaugcgcacacacauacacaugcaugcaugaacauacacauaggcauacaugcacauacacacauaaccacacaugcacucacauacacacauauauacacaugcaugcauagacacacacacacacacacacacacacaugcacauacacucauuuaccauuuccuuugcaauuaguauaacuaugccuuagacugaugacuuaaaaucaacacaaagccauaccucauagaccuagaagcugaaaagccgucugcccgcuucuggucuguagaugcucauucgcgccguguccucacagaguggggggaaagagaacccucucagaguaguguaugaaggugcucuuccccauccccauccccaaaggcucuacccucaugaacucauuaccuuccaaagcccuuccucuuaauaccuucaucugugcagaguuaagacuuuagcauaggacccaugggugaaggagaggcagaccucagugagauuaguggacaugauccaaguugaacuaaaacuggaguggguggcaggaccgugacaaacuuuucuaacguauacacagccaaacgauuaccacuguacuguucucuaaguagacugaucagucccaauuagaaugguggucacaggguuggaaguagaacucagcugguaaaggauuagccuagcauacacaacucuguccaguccucaacccuacaggaagccaaugcgguggcccaugccucaagccuauaagcccagccuuauaagguggaggcaggggaguaagauauuuaaggucaccuucaacuauauugaauuauauugggaguuagagggccaggugagacugccucuguggccuucucuacuguugaaucuguguauauucugacagggcuggagaaaauccccauggccaaaauaugaaucuuccugucaccuuuaguucuccaugggucccagcucaugcccaguaccaugaucucucucucucucucucucucucucucccucucucucucucucucucucucucucucucucucugucucugucugucugucucucucucucugucucuguguguguguguguguguguguguuuguguguguguguguccuauuuccucuggaccaccauagacuucuuguucacgaguaccaacaucacagugccuccuguaccccaggaucucaguucauaacuguguggaugguagaaugaaccugucuuauuguauuuugacauuccugucaaucaaaacaucaaucugucuuuguuuggcaccuuuuuaugugcacagaacucaucuguauagcagacucuuauaauauauaaagacugugacucuccacacucuucggagucuggggagugugaagugccucauuugaggacaaagggcuccacuaggcuaaagucccugugucucuuacccuaaggcucuugcuuuuggagaccuuccaucugccauggaaagugacccagcuguucucaccucaggguuuauauugguccacucaggcuaucaaagcaagcagcaaaauagaaauauguuuucuuucagcauggagaucaagguauuaguuuuuccuaagaacuuuacccaucuucuccugguaucuccacaaaguaguccuuccauuugucugugaugcaaucucccccuuuugaaaggacagcagucagacuagauuuggcuucaccccagugaccucauuuuacucgaaccaucucuuucaaggcccuaugcccaaauacaauagcauuaggcagugcugggaugcuaagaugaacaugagaugcuaggauaugugauucagcuugugagaucagagcaagaucaguaugcaaguuggugacaaagcccgaguugcuguagcccuguaacguguacauuguaaacaccaggcaagccuucccccuccccacucugccaaaaguaaggcucucagagagaagaggcuugggguagcuucccugggaccugcucucaucauugacucaacagucaggagagagccuuuucccugauaacucagcuggguccuacgugucucuucacucaccuaagaaguccaaguuagaggaagauugagccugaacguggcuaugugaaccaagcucuuaucugggcugcugucaccucaaagcacuauguuucucaacucuuuacccaagugaaauacaaacaggaggagcaggaauugaacauccuuuccuuacuggagcacuccauguaauggaggacaguuggcaauuuuucaguagccuagcagccuuuuguguguccacuucuaacuguucuguaguuccuagccucagauucuugguucccuuugcgaacauaaauguuggguaaauaagucgaaacaaaacccaacaccccucucucugccuucucuuuauccagauguuuguuucuuuguuccuggaacaauaauccucagucuagcccaggcuccucauaauccuccuacuuuggccucccaaauacugggauuauagaccuagaacucucucaguggccuucacuccuucagaugcagcuccacucccuguccaucacauaacaugggaagggcagauucguggcugucagucucaucuuccucuucuguccagugcagaagagcaucuaucacuacuagugcacacaggacacccagggcagugugagcuagcacggggaggcugacuuagaggaacacagaauggcgugaagucuugggcaucuagcaaugagggagcugaaaacuugcccucauguagggaccuugggcuguguucacuggacccugggaucagacauuugcccagaggacaggcccagggccucaucccaggcaccucagggugugugauccuuagauggagccucagaauagacugaaugguuuucaugauuuuccaucagcagacacuccuugucuagaauguucuauaucaacaugaaagaaauaggauucuuggaucauucgaggcccugacucuuuuagccuaaagggggacaacaaccauauuauuaggacaggugacucugucaggugucccgacuauagaguagauaucaggcaguaugagacauuucccauucuguccaucaccucacugaggacucuagucccguaccagguuuacauuuggccucgugcuuuaauauuuaucaguguacuuccugcgucucucacccugugcaagaguugauuugcaagaaauauguuuggaauuuuuuuuucauacacugguguuggaaaaugcauauuugcauagaaaucaucuuuagccagcuccacuuucccagugugucaaauuuauaaauaucacuacugcgaagacauauuuuuggaaacggauuuccucuccagguuguuccuuccuccauuuaucaugugugggucaccaggcaccacauucacuugguugggauuuuguuccugagcaauuuauuuacccagaucauguuucugaagaacaaagcagcucccguauuucauuguaauuuucggagcaucaaaauuuccaaguacagcaaccuuacuagugaagccgaacccagggcagaguuuuggacuccagccugucucuucuuccucucuucccaugguccaccaccacguuccucugaagauguaugguuuuaguggccagguaaaggagagcccagauacuagccaaguugcacucacuccugugagauaacaggaccuguaaagcauuagagcuaauggcccugaggccacugggcucagcucaguggcaugggaccuaaggggcauuuuauuacaguuaacugaguccgcauuaucugaucgcgauugcuguucaugcgucuccccaaccaucuguaauugcacccuuucaccucccuccuuccuccucucuucuuccccaucuccauucucugucccaucagcucuccccuacuggcuuucucuccuuucccuugguuuucuuuuuuuuuuuuuaacuuuuucaucuccuuuuauuccuuugcccgcucacaucccucuuguaaugccaucuuucaauauuugccuggugacuuugcauguuuuauaauguccuaauggguauucaugaauuguacuugguccuggguuacacagaagauuuuuguacauuuaaacagaugauauacagggaguauagucccccugaaaacccauucugccccuucuguuggaucccuuuggucuccucaacaauugcccaucuaccuucaugucauauguucauacacaaguucauggcucuguaucaaaccuaagauccccaaaugagagaaagcauccaacacucgucuuucugagacuggcuuauuucaugaaaugucauaaucucuacugguacccauuucccugcaaacaacaaacaaguuauuguuuuuccuguuuucugggagaagacugcacugugcauauaaaccauguuuucuuuguccauuccccuauuggugagcaccuauuugguuccaaaauuuagcuacagugacagaugcugagguaaacucgcaagcaucucugggaugaguugacggugggcauauauuuuuuugcagccuauuuuuaauaaacauccaacaucuucucuugccuaccacccagcagagguagugauggagaaaaguuauuaggauaugagggagguagaccuguuuagcaauagguuuuuuuuugggggggggcaagcucaaucuucuuugucagcaguucagucccauagcaaacaccaaacccaacuuagcagcugcaguccgguccucuggucagacagacgccacaaaggaacaacugcuauaguucagcccuaaagaagcagccaagcucaccaacgggccagaggcaaggcuauggaacuggcaagcugcuacagggaccucaccagaaguucuuuggccaguuucucucaacgguggcgauuccacaagcugagcucaacaacacaauguaaggcgaaucaauacacgcaugucauuaguguagaauagcaaggugaagcaaaccaaaccagugcucucucucacugucugugaggucauauuuauacuccuucaucaagaguccuuucaugugucugcuauaucaaaacauccuuucaccugugucugcuucaggaaaacauucuuucacgugucugcuuuagcaagacaucuuuucaccccucugccccagcacacauaauugacuuuccaaacaaaccagaaguuuccacuucaguuguggugccgcugcgucagaugguagauggauuauuagacuuugaggaaccuccguucugauugucacaccuucccaacuguaugaguccccuauauccacauucuggccagcacuuguucguguuuacuucaugacugucccucugccuggggugaaauggggucucagugcaguuucaacugagucucauguggccuaaccccuucugucauugucuuuguccuuucucuaguuuucuuggugaugucagugugacaggcuuuuguaacuuacugacuaaacaaagauuuugauugcuuagacuucaagugcuacauacauuuuuaagcacacucaugauuaaaaauuguauauuuaacacagaauacccacacagcugauaauucgaggaaaaucuugaaaugccagaacuauuugggauaaauauaggacgugacauuuuguuuuguuuguuuguuuuguuugagacagcucguucucucuuucucucucuuucuuucuuucucucucuuucuuccucucccucucccucuccccuuuccagccccccccccccaguuguguaacucuaagugugaacuugauaugcagaccagucuggccuugaacucacagaaaucuaccugccucuaacucccaagcuaugugauuaaagguguggcccccacgcccaucaagacuuuuuuuucuuaccucuuuuuccuugcaguguauuuauaagcuguuguucacaaugaagugauucugcccauacuuuacgaugaugcccccuucaugucccaucuucugcucuaaagcuugugugguccucuccccuagagacuuauucucaccugcaaaguaagaaagagaugaagggccacuuccugacucaccaaagagccgggaccucucagauguaaggaaagcccuaaaucagacagauauugaaaacggugaaaagccuuaaaagagcaccugagauaagcgccacucuuccucuggcugggaagaagcaggcugcccuguugugagagcccaccuguguuguggcuucuggggagcgagagugacuucagaaagacaggagacgucaguccuauaaccauagugaaaugaguacggugggaacugggcugcaaugaugcuuacugcccuguguuaaauauuguuucauugccgugucugagaaccuuaaaccaccugauggagggaaggauuguguuggcguaagauuucagaagguccuauccaugauggcuggcccuguggacuugacagaggagguuccuaccagguccagcccccagggaaccuucaccagugaccuccuucuagcuaaaccccaucuguuuuuuuuuauuuuuauuuuuuaauugagacaggguuucucugcguaguccugucugcccugaaacucaagccauagaccaggcuggccucaaauuuguagagauuuuucuuccucugcccccaaguacugggauuaaaggcaucugcccagauacccagguaccaucuguuuuuuauccauuucccaaaaaugauaaaauauuagaaauccaucaagggauugaucuauugaugagaugaacacucucaggaugcagccacuccuuaucuuuaaaaaccaagaccacaguauaagagaauauuguggauacuguguggucagaccaucaugccucugaugagacgauagccccggcagacacugauuuuccugcccaggugagaacccaggcagucuugucuugcauuaaacagcauugagaggaauucauucuacauuacagauggauacugccuuucuauggcacuuggcugcagaguaagcuuuaaguuucacagguaucaaacaaugaucucaaaaaaacaaaacaaaacaacaacaacagaaacccaaauaaacaaaaccaaaacaaaacaaaaaaaaccaaaaaaaccccaaaaccuuugguauucacuccccuucucugugagaacauuccaagauaccuaccagaugcuugaaauugcaaaugguacaacaccauguauccuauuucugccuguacaucaugcuuaugauaacguauagucaguaacucagguaccauaagaaauuaaaagcaaaaaugaaugaugaaagagaauuguaauaauacacuauagcaaaauuaccagcaucauuuacacuuugccuuggggccuuuauuacauaggauaaauguuacgggaacaucuggacugugacacucauaguagcagaccuaauuaauaacugaaauugccagcaugagugacuagcgcgcauacacaacauggauaccagggugguuggaauaagcaugaccccacccccccauaggcacacauauuuaaauacuuggccuucagcugguggaacuguuugggaaggauuaggagguguggccuugauggagguagagguaugucaccaggguggguguuaagguuucaaaaucucacgugagaugggugauggucuagccuucccaggucaccuugagaccugcugaggagaaaugaggugacuuugugauaucugagggaccgcccacuuuauagaugagggaaguagacucaccccaacucgcuugcagaacucagcuccgucucagcucucagcuggacucucacugacccaagaggucacaugauucccaccagcucaaggagcaacuagagagcggaugagaacucggaauuacacacggaaucuucugacagcuugucucauuuauuuauuuauuuauuuauuucccacuuuuacuuuucccugccuggaaucagcacccuguugauaagccccugggcucuacguaauaaaaaaaaaaaaaaaaaaaaaaaaaaaaaaaagugcauuugcagcagguaaggccugaugaggcugcaccuagcccugauggcuucuuucuuugucaucacugagacaaggcuuuagaguaugguaacuucuucaucaccuuaauacaaagccagaccuuguuccccucuugcagugaggaaaccauccagaucuuccccccacaggacaauagcuuuaauagcuucucugugguuccuauuuuuggcuguuucuguauaaacagacuaaucuaauagcaugcugaacccaucuaacuuggcagaguuucagaaaaucacucauuucuauggcaagucgggaugccaaaagaggugggguagggggaaccccucgcuuucaucacagaacaauucucuuaagguggccuuucaugaacauaaugcgucucuccucugucuuucucugacaccccaacugaaaauuauuuagugcagaaaagugcaggggagacugggaugguaccauucccuguguaauuucuggcuugagucuuuucgcccgaguggaaugggcaucgugcgaaggcaacucggagugcuggcaggguuauaaaagggcgugcucacccgguaggcauacucacaagccccucucauuuccccuaaaaggcugcaucauagacacccccagcgcagacucucagagggccugucagcucagaguuuggccucagacucuagaacaagaguguuccugggagacaaagcauguacuuauaggcagccgcucccacgugcugccacuuacacggcaugggagggucaggucuguggauggcuccagguuguccuugccuacuaacccuuaggagcagacuagaagcuacucaggccagguucaccuagagcagacccuacccucacagaugacucuguuauucccaucgcugccaggaaaauggcaggugccccacuaagauucugucugugaacuuugauuucuuuaccauagaaagcucaacaaugcucagguuaccugagacccuguccuggcugguuuugugcgucaacuugacacaggcuggaguuaucacagagaaaggagcuucaguuggggaaaugccuccaggagauccaacuguggggcauuuucucaguuggugaucgagaggggaaggcccauugugggcagugccaucccugggcugguagucuugggcucucuaagagagcaagccaagcaagccaggggaagcaagccaguaaggaacaucccuccauggccucugcaucagcuccugcuuccugaccugugugaguuccagucccgacauccuuuggugaugaacagcaauguggaaauguaagcugaauaaacccuuuccuccccaacuugcuucuuggucacaauguuuugugcaggaacagaaacccugacuaagacagacccuaagcaauuaggggucacaggugacacagaugcuaacuaaaagucuaaacguugucccuuccaugcugccuaggaaucagagacaaccugacuacagaccugcgcuaugugcuaacuuuaacugcauggcggagggacauccuccucucucugaaaucuguaagagggagccugaucucuucuaagaguccccaauaggcuacugauucuccuaauucucucucugcuaaaggacaaccaaacgcucccaguugacccccuaagugccuagucucagaccuuauaccaacuugcuacugagagugugaaccaucaggccauuggaaggaacccuuagcaacucagaugcgagaggacagaccacugaggugacaccucagacugcaggccacagacucccuuuuuguuccuccaugggauuuagccaacagcucuuuacagugggaugugauuuuaguuuuuguuuccauuuuuguuuugaauuccuacccucacccugccauccugaccccccuccccagccaccagaucaauauuguaaucucagccuauuuguuuugccucuauaaaccuccuccuagggcuguagagagagaucaguggauaaaggugcuugccgccaagucugaagauccaaguuugauuccugggauguacuuggugggaggagggaacagaaugcucugaguugucuucugaccuucauauacaccccauagcaugcaaacaaacaaauaaauacauaaauaagguaacaauaacaacuaucaaaucucucccucuagaagccauguaugaucgggcauaccugugauccuaacccucggaacugagacagaaggcuccugaacucaugagcagcuggggcuacacagggauacccugucaaaaaugaacuaaaauaaaacaaccccaccaggauaauaaguagcguaggugaauucucucguugaguacuucacuuucugggucaguuuucuucucuuguguauuugcaagaguaccggccaggccacacagccuggucucuuagguaccagaggaggcaaagacaucugagucucugagcugguugcuuggugugaccaagucccucccuuccccacacucuggcaaucuucuucauaauggggguuugucuccuuggcaguuuucugaacgguagccccagcugcaacccagaggucuacagugaccccgugcuaaucauggaacaaucucuugcuaaucuuggaaccgccgaggaggaacaagaagaaaagaugagagcccgacucagagaaaaagagauaaugacuggguggcuacuggggccugaagaaagacgaagaauuggaagaagaaaagaaauaagcaacuucaggggggaaucuuggggagauucugugccaaauaauuaaauaaaugauuaaaagacauaaauacagaaaggaaagugggugacugguaaauggaccuccuuuuccucuuccucuucugucgauuuugaacccagccccucauacaugucagacaagcacuuuaacacugagcuacaccacagcaccuauuuuauuuugaugugggauucuaacgugacuucuaacagccuuagucaacacgaguguucugacagucacaacucuaggcuuacgaacuuucccaggaugguucauagcuauccuucagcagagcuggguccauucccuucaagaaaggaaggagagaaauggcuguaagccuuucuucguggucagacuccagaaagccaauguuccuuucuuccuuuagacugggcgcuagccaccucacaucaucagccucauuuucugucuuaacccuugccuguucagagugcacuccugacaagcugccguguauccuuggagagaggcauaauggacacuuggcuccaggaccugcgaagagggacucaacggacagccacaacucuaggcuuacgaacuuucccaggaugguucauagcuauccuucagcagagcuggguccauucccuucacgaaaggaaggggagaaagggcuguaagccuuucuucuuggccaaugcuuccagaagcuucuccaaacuguuguagcuagcuuuucugcuccuuggagagaauguucugaccaaaagcaacauggcgggaggaggggaguccuuucaucuuauaacucccaguucacaaucucagacagaagucaagguaggaacuuaagucaagaacuuggaggcaggauggaaggaggccuacuuccuuacuggcucuuuuucugucucacgccaguggcucaaacucacccuccgaacucagugcccgcuucugaggggggagagccauguuucccuccuccuuuguaugccucuccacgcaaggauaauuacccagaaaaagcccagaaaaugguuguuguuggaguuauuccagcuucuuuauuauuuuuuuuuuaaagcucucuuugucuagaacuucacagaauaaacaucacggcugccccuugcgugcauugugagcacccugcuggaauggaauuucacuguuucuaauugggggugggggcggggagcugaguuuauugguucucaguaaaucauggaaagaagaagagacccuuggagaaagugugaacgcugaggcaggggaggaguagcccggccgcuccccuuuccagcugguucccugagagcuuaagaggcuggcugucacgaaugaaucccccauuagcgaagccuccggaccccuccucacugugcauuuaucuugcaaggggcagauuuggaggauguugcuguucuguuuuaucuacggaauugcuuuccguuccaaggacuuuuauauaaguauucccuugaacccauuccaaaaaguggguuuuuaacccaauagaccagaacugcaguguuuuaucgugcauacauauuuccaaaugugaguguaaguagauuuagcaaaguuaaaauaaaauuaaaacuuuucaaagggcaccgcgcuugcuuuuccuauguuagacuucuccccccuuggacuucuaguaccauuuuaaaggccaaaaccaggaaguuuuucuuucucuugaguaccuuuuuuuuuuuuuuucuucuaagagggguggguugggaaauacuaaagagacuuccuucucccugaggcaucuccucuccaaagugaggggggaacuguuuaucugcagaguuagcguccccuccuccugcauccccucccgccuccgcugaggucugaagucugaccuccucucuguccugucaggcgcuccaguguccuugucacguuuucuuaucucuucagcaaaagaaaagucaaagcccaggcccagcuuggggggggggcgggggggggcaccuccucuucuugugccacccacugggccuuuucagacugcucugucaacuguccucucucucuugcucuuucucauaucuuaggguucaguugggccauucacuucuuaauuuucccguucacagcgccccuuccuuaccucuugucuuaacccccaacuuuaguucuccccacccugccucauugucuuucuccuccuacuagacagacucggaugcacgugggcagaggugggguuuuagacugaucuguagacugcccaccuccagugagacgccugugagguaugagacuaguugaaugaguacaagaugcaggugugcgcccccucuugcuaccccagcuggaaguaguaucaccgcccaggcaacagcaccucaucugcucagauguaguucucgguggacauuggaaaacuuggauucugggagaggugggggucgcggucucaccauuuccaggucuuguuagaccuugccuauuuaacccuaaacacacgguuugugcagaacacccguccuuccuggaggcugggauuuggccccacauccaaaagugcuuccuauaugaccagccuccaggagaagaauccucagcuacuguuucucuuggagcaucaccggcugucaggacucaauggguccuuacgcauccuugcuggggcaguaaagucauucugggagaggcgcuguuggaauuuugcuccuggcuuccuuaaccuacccaccccuuugcagugauucccuguauauagucugcugugguguugccuggcaucuccaugauagccugagucauucuguucuacacaguggacacacaccguguucccaggcccugacugagcucuguagcguuugccuuucuggucaauaugaugugacccaacaucagcuuaccaggggaaguuucucuuuggguucacaguucaaagggacgcaugcuggaaaagcuacauuggugggagcaagaagcagccggccccacuguuuccaccauagcaugaguguguacgcguggugugugugugugugcacugcgugcauuugagugugcagguuggcauaccugugcaugugcgcacagaagcauagcagaaagucuggcacauugagagggucucccccugaggcgggagcugauccuuucaggugggaugcaaggcugguguguacucucagggacagccuuccuucaccucccagugcuggguuacaggaauauacacagcaaugcccagcccuuuuuagaugggugcuggagauuggaacuccaguccucaugcuugcacaacucuccacugcaccaacucucuaguccucuuuugccuuuuuuuuuuuuaauccccacccagacccccagcuccuggauucgucuaugugucuccuaggugacucaccgccagacagcuucucugccuucccucucugcccuauuuuaaccuaaucaguaccaagcgugcaaaggaaaaaaagaaucuuaucagggagggagccaguuuugcgcacccccauuucacagauacaacacacacacugacaagggcagguuucuaacgagugaagccaauaagccgcuggccccugugaagccacuacaaaguccccugcuuuuccuaaacagcuugccgcaaggcccacagcucuagaaagcaaccugcagccuccugcaugcugugaagugcgaggaugaguuagccgcccucuuucuucucucccuccugugaugcauaaagagauuucugcagggcugguagcugcugucagccuggguugagcucccaugugcaucagacaggggaguggggcugggaguagaacucauuuccuucuucauucagguguaggucaccucaggagagcaggagggucacucuuguggcccucuuuucaggcuuccuguggcugagaacaguucuagcugcuucagccaaagggccacaugccccuugguagucuaacaccauauaagacaagaagaggucuuggagcuuuugcuagcuagccaccgugguuuaaggccguguugugcgggcuaauguucccauagauagcacggugggugugacugcacaugaagucucauccuucugcaccagcgaccuucuuuacauuuggaggggaaguuuuuuccauuaccagagagucccaggagucucugaggccuuuccuuccaaaugcagugcccaggagauuagggguaagauaaauagcugucagcggagagcagacagucugcuuagcauaugacagguagcuugucacaaaucaaaaguucaaggcuauccugggcuaaauaaagagagucugucacaaacaaacaagcaaucaaguggaccuuaaaaauccccaagcuuggaaagggcuuucuacugaagguguucgucuccuucaccggcucccucacucgggcagcagaaaugauaucucucggagugggacaacagggaugugugugugugugugugugugugugugugugugugugugugucugaauuggcauuagggauauguggcaacaaauuagccagcaaccugaaacccuugugggguaugugggucucacucaugaacacuguccagaggagacaagccugaggcccagcaguuggcccacccagucagaagcucaggagcauaggcuuguauggcagugagagauaagggcucaauguguguauucagaaaggaggcaaagcuacccagagcaguagggaguaagacagcauguucccgggguacugugguuucccuugcuguaagggaaaccccaccuuacagacaggaagccucaucuaguguuacauggggcacuagaaagucagaugugacacuuaaguacaucugcugccaaaaccguagcucuuuucauggaaccccugguuuagagacaaacagaucccagacuugcuggaaucuggcucgggagcccccagaauuaaauguguaugaccuuuucaguguagaccccauccccaccccaaguucugugccuguaggauggaagccugccuguaccuguagucugucccucaggaagcccaaggaggaaugacacugaacuugaaugcuaaaaucuuaagcccugucccagggaccaccuccuucuacgccugauaggaagaaugugguacagucagccuugacauggucaacaucaagaucauuaauauuauuaucuucuucccucugucaugacaagcacuggcuaucacaugagagagagagagagagagagaaagagagagagagagagagagagagagagagagcacucugguguuagcuuuucuauauggccucagugaagcccaguuuagaugccuuggaagccaggucacagaggaaaacaccuugugucacacagggcucaaagguagcuguggcaaugcagaggaaacccugaccuaauuguacugguaauauaauucuguaacucacccagccacugcaaagguggguggacaguuccccgucccuacuucccccugcacaccacccugagguccuaggagagaagucugcacucgagcugcaauuuuaaggugccucgaacaggucccugcuauuaagagucggugguuccaugucaauagaagauagauauuaaaugaaauccauguugcuguugauacaaucagccgcucuccagcucagaugaaagcuucgauaacacagaaugcaagaggagggagcuaaggguuguugacuuccuacuacacaucacuggcuccacuagacaccucagaaaccucagcacgaaauaccuugucaccaaaccugauauaucaauaugcuuaagcaucagacacugagagcugaugauuacaauagaggcauccaguuggggcauagucucugcuccuguucuuuggaauaaacaggcucccgauucaaugauguuuugcuucugugguuucuuucucuuccuguuagaaaaugugguggcugcuccccaccccccacccccaccucccccaccccucacccgaucaccccagcuccuuuugcuuacuggaagggaaccucuuuacuccugcucugagacucccuuuaaccuuucugauuaauggaaacuggggaaacagugguugacauccagaacccaagggugguguggcuguaagggcagcauagggaggugcggauaggaggcucagagggaucaugggcagccagccuagccuacuagacaaguuaaaagccagcgagagacccugucucagaagaaaaaggaggcucauggccugagaaugagcaccaaagauugaccucugaccuccacaugcaugugcauagacguucacaugcaccggcacuugugcacacacacacaaacauucuuacacacaaagacacaccgaaaaaugauaauugguggauuuuuaaaaacuccauauuucugaaauucaaagcauccuugcaaaauaagugcccaacgacagacggugacaagaacaggccacuuagccuggaaaguaaaacggggaagacaugccccacccucuccacagaaaagggugcagaaggccuucaaccuccaggccacccugugauaacugcuucacgcagucagagccaaggccuggucgggggcccauucuuccucuggcccuaguuagguaccuacugggcuugagcuuacuccccuggcccugaaggguaccgaggaaugugggcugacagaaagugaaucacaugccuugagugccuaccacugccaccagauucuaccugauccuccuuguugcccuauggcgaucagccccuucccccugauggugcaggcaggcuagucaccagauucccuaaauggaagacuggcugcuuucuagagcuuuuuuucuucugcaugggcagaggauucccuguggcccaaguggacaggguggaacagguggcauccagcaggcucacccagugccugugugguauguggcuucucuccaagacaccugcucugcuaauacacacacacacacacacacacacacacacacaggcacgcucgcucuccagagcucucccaccacucucaagcucuccugauccuuuacaguaaacaccgcccucagcaugucuccucuagacaguuucaagaugaggaaggugccguuuguagucccuauuaauagaugggccaccugcagcucugaagcuggcuggcaaggguggagugacuugcugaaggccccugguggcugggguuugucagugucugagcccaagagcuugcuggagucuggcuugcuuuucuugaaucucgcugccuccuccuuaugacucacuguccuuucccaucuuccuuccuuccuuccuuccuuccuuccuuccuuccuuccuuccuuccuuccuuccuuucuuccaggguuuucucccaggcaggcagcuucagaaagggacaguccugccggccuugggcucugauaagaucugucugggcugccuuugucugggcuguaccugccguuuccugaauggcccuguuaauugcaauugacucucacagaaugcagagauuggugccacuugacaccagauggauggccaugacuuuuccaggugccccaaugcaggcuggaggggagaggggggagggaggaggggggcagggcacuggagcgaauccaguuacaauaaagugcaucagaacuggaacugggcagcuuuuuuguuuccucucucuuccuacucaccgccuccauagugaaaggacuguaaaagaacucuggaguuccucuggagaggugguggagaguuaauuuccugcuguagcaggcuucuuguccuuuaucagcuucuagcagcccugggcuaaauagaaaacccauuuuagugguagacagacugaggcugaagaaccagccugcuguccgaugugcguauuuguuguuuauugggugguacggugggaguggaauagggacugggaaccgagagccgguucagcugagagccccaaggccccuggaggccuucugucgucaccugcuccaacccacggaacuucaggcagggcaucaacguggcagaugggaggcccugguuccaacaguccccauagaucauuuuguaggacccucccaucaaaucuguggggucggaauuauccugucauucuguacaugagaaaaccaaagcuugugaaagguaaugugugugugugugugugugugugugugugugugugugugugugugugagagagagagagagagagagagagagagcauacucacaugauccuguucaaggucacaugacgguucauuagcaaacugaguaaacuccuguuaguucuaaggacaguugcccuggguuccagaaacacagugguuuucuccgauugagcuguguggucagggccaaggcagagcagggaccuuauggccauuggaaaaaucaaaaaagaggauuuuuuggguguuuuuguuuuugagggggggggggauacauuggguuuccuucuuaaauucaguacauuguugggugacuccaccacucaagacacacuccagauacaagaguaagaauguuaagcugucaaacagugacuucauuuucguuuacaccaaggccacgagguaaagauguauuagguauuaauuuaaaaaaagaaaaaaaaagcuuugagucauggcauccaucagggggaccuccaugaguccaagguacucgcagcucuaaaaacagaccuuggacggagggggaggggcggggugggagguucaaguucaccuucagccucuccucugggaggcugagacaggaguuggauacugcuugaacccuggauuaaagugugagucuccaaaagucagaacucugggggugacucucagcagguccguggagagcaucucagaagucacaagccugcgcucuccuaacacccucaaggaaacauuucacuuccaaauucagcuuucugaucuucagcaugggugcucugagcuaggguucuagcacgcaaccuugacgggguggcaccuacaggcuccuccuguagguggcgcugugaccagcccaguaaccacauuguccauuucaccugccuucuucccugcugguacuaucugaccucugggcuuugguauccuagaugccuacuagagaagggcuuugggucugaaggaccggaggcgcgggacuuuucugagcugaucacuauuuugcgucacaugcaaaagcccccauagccacagcaguggggaccuacacuagagagcccuucagagaggugcuaggaagccccucauggguaugguccauguugguacccuuucugauccccacuuccuucagguuuaaaaacaucaaguucagagguguuucgggguaccacugcaggguacaggcugugcuuucugagcaggggucuccucuaacaccuuuccuuaccuuuggauuuuagaaugacuccuaaaggagaaaaaaaaucauccauacaaguuucucucucucucucucucucucucucucucucucuguguguguguguguguguguguguguguguguguguuuguuuguugucuuuucaagucuaaaaucccucuuaagggauuuucccaaagggaaaggcagaaaaacccaaaacucaaugagagaggaguguaaaauauccacagggcucuucccagauagagaagggcuccuuuuuaaauuagaagccuuggaggacaaagccucuaauuguuauacuugugaugucagggcuaucaauauuagggccuuuuucauuaauaaaguggcaggaauaggaacccccuccaacgccucccccccuuaucucugagcacuacuucaucaaggcaggcucaaucgaaaggaaagagaccauagaacucaggggugugcucucugcuggccagacacagaagaaagggagccucuauccccccuccaugaagaugccaggcucuggguuaacccgagcaagagguacuuaaaaaaagccccgaaaaucucaggcgacuccgagaaugccucaauuuguguauggauuaacacacggcggcgauaggcccugaguagcaaaagaggaacacuaauuaccugacagcguuccccuccacucggccugggucauugaaauuaauuucugcuuucagguuuggcagcaagcagcugcaagaucucagcucaacacucaaaugagcggggagcugaaaugguuucuccgcacaggcggagucagaggagugggcuaccaaauagaucuugaucacagacaccgaggagaggauuaguuugcucuuucaucaagugccugaaguccuugggaagcgcggaugggcgggaggagaagagaaaagcagccucaguguaucugagagcuaacaccagacugcucugccagauggggugugagaacucaugguagaucgccugucccccagauaagccguaauuucucuccauucucaacaaaaaguugaaugaauggugggccagcacgcgcuugcgggcacacacacaauuacaagucaggauaaugugauuugugaacauccauccugcagcauccuguguugucaagaugguauuuauuuccuauuucaagguugaggaagucuaugagggagggaacaaagaggugaaagggccugcguuugggcuucaaggaggauacugaaguagauuaucuuuuuagguaagaugcuuauuugaagaguuguuagugccacagacagacagacagacagacagacagacagacagaugcauggguugggcuuugaugagacuucugccccacagaucugaugauguauguguuugggaguaucuccuccucuucuucccccuccuccucuuuuccuccucuuccuccucccccuccuccucuucucccuccucuuccuccuccucuuccuccaugucuuccacuuccucuuccuucucuucaucgucuucuucuaaacuaucuaucuauuuauuuauuuuuagguuugauuugguuuuuuguuuguuuguuuguuuuugaccggguuucuuugcauggccuugacuguccuggaacuugcucuguagaccagauuggucucaaacucacaggaaucugccugccucugccuccuuccugggauuaaaggcgugugagugugucucuucuuauuggucucagagaaaggagaaggauuguguugaaggagaccaagcugucccagauuccuggauagagggaaagguuugaaggaagaaugugggacuccaaggcaugggggaggagagccaugucuagagaggggucauugucauuguaccugaggcccucagaugucccuagacuggaaaacucagaucugagaagugagacuggucaacauccuggagucuugccauuucucuuccaagagcuguaacaggcugcuaucacaggaggguguggccugaucaucuugaaaccucacaccuaaccugaagagucauagaugggauuugaacccagagcuucaaguucaucauucaguaguaccuuccccuuuauguugacuguguguguuuguguguguguguguguguguguguguguguguguguguguguuugcuuuaauggggaggaggguuuggaugugugguucaggccagccuugaacucauuaucuuucucccucuucucuaauauauguuuacagguuagaguuagcauucagucuccugcauguaaacuguugcuuacaauauuauaguauuuucuuuucuaacccaaaaucagaaacacucucgagucugaaacuccuuuuauuuugucugucacuuuuauuguuguuugagguagggucucccauagcccaggcuggcaucugaaccuauaugcagcuucggaugaccuugacugcuggucuuacuagcuccgucuccaacacgcugggcuugcagacauauggcuucaugcagugcugaggauguuaagcaagcauucuuccaacgaagccacaaguccagcuucuugaacuuguaacacugcguaagaaacacaaaugaacaccuuuuucacauuugagccccuugcccaagacaccucagaagucgagugcaugcuuauauuuaucuggcuggacagaaucagcccugagcuauucuucugacucaagaaucugaggcuuuggagccucuguggccagaacagaaaccccacagccaguucggguuuggaccaagauuugaacccccauccgagugucuccaccaagcacaccgacaagucacccaugaguagcaauuaggccuucuucucacacguccggcuccaaaccugugaccucgaggcaaaugauuuccacaucucauuaccacuccccugagccguucagcccccgguagaccagggagguuaaucagccacgcacugaaccugcuuauaaggcuguuucauguacaauuuuuauaucuuggcuccuaauaauggucccauuauaaaugauugucucacuaugauauacugguuccuugccuucuaggaacugauuuaaaaggaagcccuggacuccucgugcccauagaguuuauucauaccaaacucugcuugcucagcagcugaacugguaugggcgggcggggggaacagcucccuccaaaaaaauuuuuuucuccuucccagcuugaggcaguuggcauaauuacuucagcucagcugauggcuuggugaugcccucugaagaccucccuguucuucccagguccccaccccaggcccaagcuuccuauaugaucugcaguguaguggacgaaugacaaccucugggcuugccacccucuuccucauuugcaaucuggaugacuucaaauaccagacauggugaaugcagagcccaguagauauagagaguguguuuucucuccccaaacccaagcauauuuguucaguaaucaguaauuuaguauguaauaggaaccagccuuaugaauauuuugugagguccaagagcacagaagagauaagaacaagacacacacugggcugcacgcugggaauaugggugagaaaucagcaggcaaaaugccugcuccguggggcuuagaaacagagcaaggaucccuaguguccaaauaaaugcucaguggguguugcagccccuugcaaccccagggaagaagcugguuuuccaaacuagccagaucauugaccucuggacucccauaaaagaccuugccacaaaauacaagaaggaggguuggagaaauggcucagcaguuaaaagcacuggcugcucuuccagaggaccugagugugauuccuagcacccacauggcagcuaauaaucuuuuguaacugcaguuccagggggaucguaugcccuuuucuggccucugcaggcauugcacacacauggugcucagacauacacucagacaaagcauccgugugugugugugugugugugugugugugugugugugugggcuggagaauuggcuuagcaguuaagugguuuaugcugcucuugcagaugacgaguucaguuuccagugcccacaucaaaguugcuuaucaucaccuaugaucccaacucuugcagaaucugacaccucuagucucugcuuuugugaacauauacaugcauguauauauauauauauauauauauauauauauauauauauauauauauauaaacauacaaucuaagaaccuuugggaaaaauauauauauacaaacacaagcacuguugcacacgcacugaccugcacccaugugaauauguauacacacaugcaccacacacauacaaagaaucuagauaaggaguugugaagaacaacacccuacggacuuuuccgucuaguugcuauuaguaagugcguggccuuucucucuguuuccuggaaagaaggacuucaugguggcguacugucaagaugaagaaauaccuaagugcaugucacacuguuuuuauauucauauccauaaauuacagguaacuccucuaugacauaucacagacuggagaccacacccacaucccauaagcagagggauccacauuuguucaccuacguggcucuggugccuuccuuccugucccaggccaagaugagguuagccaauugaugcuugagcucucuccugaagcucugccgcuaacuagaacccacccccccccccacgccagccccgauccaggacaccgauguggagaugcauuuuucauggauugguugaaauuauguaauuagcauaugccauaaugauguauuuauuguaauggagguguucuccagacaccagaucuaauaguuuuaaaucagaagccaacauggacuuuuggaaauuccauucacaguaaauuucacgcguggugaaagguuauggaauggguuuccccguggcacgucuuccucaucccgucuaccgcguuccgcugugagcuuucgcaagcuagccauacuaaugugcacagacaaguucaaaguuuaugcucucgcuugcaagccgcgucuuccccugaagauggaaugggaagcgguggcucgggguuacauucaaagcccuuauagcaaugugauucuccuuaacagagcagccccucagcccaucccugacaggaucuuggcuuuucuucuguucaauugauggcucccugacugcaaagccauugcccaucuguucagcaucauauucugggggagguuagacccaccccuucaaaccuagugccuaggugccucacggcucucugcugguguugagaacuagcaaagacuucuuacauuguuuaguaaguaccgaaggaacaccagcauguuccaucccuccuuaaacuguaucaugugugugcauccccagcaugcuuaaacaggagagagagagagagagagagagagagagagagagagcgcacaagcgagccagcccugaggugccgcaagaccguggcuccuuugugucuacagaaaagauauaacgauugaauuagacucuuaauaucuauggcugucagguugaauacgaguagcuauucggugcuuuaagucuggcaggagaacaaguccccuggaggugggaagccauguggguccccggaagugugagcagauuguuaaaacaguuucagaucugggcuggaaggaugccagagucuauccuucaagcccuaucggaggagugaggagaagcccuggcuuucuccuugcuucucacugagaacuuggaugccugcacaucagggaucuaccucuuguuuguccuaaggccagcccccugccucccuucuucucaccagcgcagguguucagcuugagggcgugggugaggaguccagcgggcaacacccccaagccacaaaaacaaaagccccucugcugucagagugguuggggagucagggccagcugcaucccaccaaaguggguuccacggaacuguucuccuaacugucuguuguucuaagccuugguucucucaucuauaggaugggcccugcccuuagccaucaccgcaaagagguaaauguuguauaaaggaaauaguaacuggaugccagaaacagaugguagcuguaaccaauuguauuccugucauucauuuucuucuacgaggaccagcuggcacuggccuggcugggacugacuuaaaggaauguggagagccgggugaugauaaguccgguauccugaagaagcuugagagcaagaccccugguaacuuagaaugcauuugcaagccagguauagcacauauggccacagacccuguaacaaggaagcccuaauaaaccaggcauaguagcacuaauggcuuuaaucucagcaccguaacaaaacuuccacuuucccugagccuacaagaagagacauucccaccugcugauggugcuacccaccuucaaucccagcucuugugaggcaaaaacagguggaucucugugaguucgaggccagccuggucuacagagugaguuccaggauagccagggcuacacaggauaacccugucuggaaaacuuaaaaauugauuaauuaacuaauuaaauuugauuaaaauaaggagagacacuccccaacacauaaacggccagauuuauucggcagaacucucaucagagcccaacgcagaguuugucugucauccucuuucugccugucugucuguggcauuaacaauuccucuaauaagcuucuuaccuaaggaugauccacuucagaguucuccuugaagcccaaaccccaggacuuuucaccucucagcagcucgccugccuuccuccccagcucccuagacacagccauuucuccaucuguuuggaguccccagggaccccacuggguaguaggauuagucagacauuuuaguugucuucugaccaaauuucccccagccaaagcacccugacucugcaggacuauggcuggaccacacccccaccccaauuuguagagaucagccaaugcucuggauuaccauggagauaacgcacacgugcauguggcuccagggcuuuuauguguguuggcgugugugugugugugugugugugugugugugugugugugugugagucauguagcaucuaauaaguuccucacagaauuacauacacaguguaaaaaaaaaugcaucgugucuaguuucuuuucuuaccagauuuggacuccucuguaauaagagcuaauagguuagcaaguauucuuuuuaugcauacagcuguuuauauagcauugugcaguuccuaacauacuaaugaccucaguaaauuauuugaucacauccagcaucugauuugacugacacccucuuuucuuuuuagacauucauucuuuuuaaguguguguagguauauguguauguguaggaguguguguguguguacagggguguauuguaugucuacagggguauugugauugggaguauguguauuacuauaaguguaugagugugcaggagugugugucuagaugugugugucuagaugugagugucuauaggagugugugugucuauagggguguguguguauguaugucuauagguguguguucuauagggguguauauguauaucuauaggagugugugugugugugugugugugugugugugugugcaagcaccaacagaggccagaagaggcuuuuggauuuuuccagaguucgaguuggcuccaagccucucagcauaggaacuggaaacuaaagucacgucucacaaaagagcaccacgugccaucuucccuguccuaggcuuagcuuccuuuauccccagcaggauuuaacuuuacaugcuuguguaagugcacgugaacaggugcauauggaagccaggcacccucugguaucguccuuaggagcaccauccacugccuuuaaggcaggguccgucauuggccuggcacucacgaguaaggcuaaacugucuagcccgagugccucaggaguccacaggucucugcuucucuagcacugggcucagagagcacuggaacuuuuauguugguucugaggcgagagcucaggcauuccuguuuacaagcugagucuuuuaaacuaagccauucuucagacccugguuagauucuuucauucaccuaucccuugucacuuugaagaaucaaauuucaugguuuugauuuggguaguagauaacaugaaugguagaaagaugagaaguagaaaaauuuagaaacuuaggcagaggaaaauuuaaguguucuaucaauuucauuacucugagauaaauccucucaauaucuuguauauucucucccgaaugcuagcauuuggcaagcugaguucguaaacuaucuaucauauaaaaauguuugaaucauuaaacacuuuuuggaaaauguuuuaaugacucuaaagauggcaccauauggaagaauuguguuuuauugaaccauucucuauuuuuuuauaguuaugguguuuacagucugaauacugaauuuuaaaaauuaauugaggcuguuuauuacuuguuuuaucuuaagcauuucuuuugauacagucucuccugccuuuguagcugaggcuuguuuugaaccuacuauguagcccaggcuagccucaaacuuuccaucgucuagccucaaccucaaaaugcugggaccaaagcggggcacuacuguacugaacuggcuuagcaauuaugauggaugacucuacauauccaccugagaaacgugugugccagccagugguuggcuaugcaguagacucaugacccauaacugaccagugaauguggagggcucagagaggacagccucucugagcaugugugcauguacaugucuauuuaucuaucuggauaugugugucggugucugugugucuguccguguguaugugugucucuguguaucuccaccucccccuagauggagaaggacuguuugcuuccucuaguuguugguucaauuuggguucacaggggccaucugaugcagaaaccucaucaccuuucagcccgagguaaggccaaggcugauggggaccauggacagagugaaggcaccuaggcucaagguggcauuauuggaguuccugauacaguacuagccgugacccccuugucucugggguccagggguugcagaugagcugcuuggacuuggcuuugaauuguggcuguuguuugaagaggacagccucucugagagugugugugugugugugugugugugcguaucuguuuaccuaucuguauauguguguguuuguuuguaugugucucucucucucucucucucucugugugugugugugugugugugugugugugugucugggggagaucgugauggaugaaugucuguguaggccagaggauagucuaguuuugguucuuaagaggugccuacccugguuuuugagacaaaggcuuaguguggccugagaucacugguuaggccagguuggcuugccagcgagccacaagguucuuccugucucuaccucccaacacugggaguacaaauacauaucgucacacugacuuuuuaaugaguccucaugccuggguggcaagcacuagaugggugaaaccaucuccccaacccaagacccuucuucuaagugacacuucugcuccuugaagcagcaugcugucccucagcccucucaaguccugacuaaugacaugcuauacucaggacuuauaaugucccugcagaucccaauggccuggccccucgccugggcuguggcuguggauaagcuucccaaugcugagggaucauaugguuuuguuaauacacagacagcgggaauaacaaggcguaaaucccucugugaaaauaaugcaugccgugggguuuaucaagaaccugguauguaucaaguuuaauguuaaaucugaacaagacaccguugaacaaagcagaggucugucucuuccuaugugguuuuuauacacuaaugaaauuucuuuuauauucuagugaaguuuuuauguccuaaugaaacagauaaacaauaaacacggcacuuuggaaaagggcccagacucauuccaauucugauucucaaugauuuaaauagugauucuggguauacaguagaauuauucucuaucuaucuaucuaucuaucuaucuaucuaucuaucuaucuaucuaucuauguaaccaucaucuucuauuuaucaucuaucaucuucuguuuaucagucaucuauaguacaucuauccaucuaucuaucuaucuaucuaucuaucuaucuaucuaucuaucaguauaguuaccuacccaccugucaacucucuuuugcugaauauauacauaauccaauauguaauaaaaacaucaauuuuauauccuuucuuuacauagaaguuucuagucuuauuuauuuuauguguauacauguuuugccugcauguauaucugcacacacaggcacccagugccugaggaggcauugaagaccuugggaugggaguuacagauggcugugagcuggcaggcaagugccgagaauugaacccuggcccucugagagagccacacauguuaugugcugagguauccuuccagccuucaugcccuuacucagcacagaugucaaaaguaaggaaccuccuuauacuauuugauuuuugcaaaaggaucaauguucuuguuuugcuuuguuuuguuugacacaaggccucaauagccacccuaggcucaccuuaaacuuguggggguaauccuccugccucagccucuuaaugugccgggauuucagauaugagcuaccacaccugacagaucaauauuucugaaacuggacuccaaaguccuucauacacugucucugagcagucuuccuugggggggggggagcgaaggugaggauggaugccugagacaucacacauguguguauguuauugauaacugaaaggguuggauugucauguaugaggcauucccauugacacguucacauguuacagguaagggcaaccauaucagaauguguacauaugacauugcaaguuguagguuaccucacuguaauuacgugacuuuccccaggucuuccacauucuuugcacauacuuuuuuuggccagguugcucugcaccggguccuuuccugccuuuuauuguaaacaaggaacugaggcccaaguagagaccaugauugacaugugcccagggugacagaggggagccuugaacucuaagucuuuuguccucccuucucucugccuuugcugccuaccccgccccauccucuucaucauggugggcauguaaacugaauuccauguggcugcauacguuaaauagcuuacaaagcuauagagcgcugccuuucuugucucagaacuuuucaucauaaaguuggcucggccuccucagccuguaucuuaggggaacaaguaaauuaaacaaguaauuauauccauaauguuuuuagaaguuagaagauuuaaauauaugaaucucaucugagcgugcagccuuuugucugcgguguuuccugccaaaagaugucuugacaggaaauaaacauuaaaauaaucuuuaaucccuugucuggucuauugccauuaacaauugaugcacuuuaauuuugcgggauuuuaacuacaaaauggaauggcuaaguagugauaauuggguuuggaauuauacggccauuuauaucaacagagaugcaagaggcagggaggggaggugauuaauuauuuacuauuuccuggcugugguucccauuauagaauuuucugauacguucugccgugaacaauuaucaccaaguaagaauaaacaaagcugugauucgaagcuuagaacuuagaccccaccaaggugacguggcuugauuuccgcagucccucuggacuucgugugauccuucccuccccccucugcccccauauuuauguguaagcuugcucauguuucugcguguugcuugguuuucuucuccuuuuucucuuggguuuauugguaagggcugcagcauagcuuaggacacucccaucgcgccccaccccacccccaaguucugggguuguaagugugagccacaauguccacccgagucuuugugugucuuagacuccaacaggcacacucugagguaugaaugaccgcuugucaaguuaggacaggaaguuggggcuccagcaucgauucuuccuccucaaccauuucccagcauaacugagaaacgagagcagcacgcggcgguacuugucacaagcaucccugcacaucugugauguucacuggagugaugccaucagaagggagcauuucuaguaguagugguucugggugggggaaaugugugcaucuuuugaggacuugagcgauagcucagcaguuaagagcucuugcugcuucuucagagaucugggcuggcucaguccccagcucggcucucacaucacgcaacucaaaaccaccucuaacuccaucuccaggggauugaacacccucuucugaccucuggggauaccugcacacaugugcacauacccucacacagacacagacagacacacagaaacauauacacacacacaaaauuaaaaauauaauauuuuuaaaauagccaacauugaaauaaucuguuuagcacgaguugccaacuuaucuaaaaugucacagcagucuccuuucugcccuucccacggagaaaugccugugacgucccaggacuuagcaccaacuacaaaggagauugaaaugacaggcaggucuaguaaaucgggaaucugcagucuguuuuuaaaauuuauguaguucucauguauuuggggguucugacgcugucacuuuguaaccguuaagccugauccccaagucuugccguugccaccccugucuauauugcacauugauuuucugugugacauuaucugcuuaauacaaagugggauagagcagcuguuuguccggauuugucccguuccuuaucaaagguuuaugauuuaccuuuggccauaccuuccagcaagguguuucuuugucauuuucacuagagguaggcuuauggacaagccuguaauaaaucugaguugaggguggugagacacugaggaguggcaggaaggcagagcggguggugugcgcuccgcaguugggaugcacgucgaggagaggcugcagggauagcugcuggacagcugccauccuggggguuuguggaauauuagaacagagugccccagagacaacagaacucucuucccggcuuccacucugaagguuggagaguccagugucagaugaguaagacacaucucagccgugaaggcugaaucccacgcugccucuugucugaacauggaauaacauguauaucagagugacgcuaaggucacaaaggccacacucaucccaacuaugacuucuucccuccucccccaguggaaacccugucccuuuuagcagucacucugugucuuacuuagggcuuuaaugcugugaucagacaccaugaccaaggcaagucuuaaaacgacaacauuuaauugggcuggcuuagagguucagagguucagcccauuaucaucaaggugggagcauggcagugggcggagcugagaguucuacaucuucaucugaaggcugcuagcagaagacuggcuuccaggcagcuaggaugagggucuuaagcccaugcccacagugacacaccuauuccaaccaggccacacccccuaauagugccacucccugggccgagcauaugcagaccaucaugcucugcuuccaccagucacuaauauuucuuucauuuccgaagcugugugggauggggcuuuugagggggcaacaacugaaccccauccccaaaaaaugacaucaugcaaauaucucagugaauaccaacaaaacuguagguacagugaucgccucgacucuggagcugaaacuuuuggccugugcaaaaggagaggaagcagccacuauuuuugaagucagggugguaggugaaggagacaagagagucaguagccacagcacgaggccacugaaacgcaaaucuccuagccucuugcccaaauccuggcaccaaguuugagccgaugccagggacaccccagacacacacuuauggagagguacagucacguaagaagugauggguagaagagccaucaguacucauuguccuggugccccgagcugccccuuggucaggcaugcuccuucagucuuuccuucagagugauggcauuuucacaagcagggaauccaaacuugaaaaagaaauguuuucucuuuuaaacagugaguagaaagaagagcuugcagugucaggaccccgugugcaaauauuuuauuauguucccuucugcaaauggacauagccugucaauaucugaguguccucgaaaagccagccugccuguggagcagucagaaaagaaucacaguguggcgauccauuaugucccccacugaauuagguucauugagauucuguuauuaaagcaggauuucucuuaauuauuagcaguuaaaaauaggaaaauagauuucagggcggggguuggggggggaggaguugcaggcagccagcgucuaauucuaaaugugcguaugugcggaaaguagaauuugccaaacaugaauaggcacuuacaaugugacuagaauugguucugucaugugucagcguaauagccuaaacccugguucaauacaaugaaccuggggagguuugcuuaaugaaagaacugacguuuucugcgugguggcugcauucaucagccugcauccuguucauuacgguacaaagggcugccaaugggaaucggugggaucaucuauuagggaaacgugauggggacaaaagauaguagaggccagggcccugugguauugucuacugcggucaggguuacccgagcccugggcuguggucaugggcaguguguuucuaagcccgccugagggcuuccggagccaugggaggaauccuuucuuucccugucugguccuggucaccacauccuagggcaggcgaggagaauggcuauuuccacuuaguccuggguuguuccuuauuucuguggagugaguucacaauuguaauguauccccgugaggucugaagcaguuccuggguccgaggacgggacccugagccccuggacaacauagaugacccaguaugaguugucugacaaggucaccuuggggagggcccuggguggaucaaagagcagguguguuaauucuaggggugacuuaggucugcccucgcugccucuccccugaugagacuguuuaguuguguuuuuuuuuuuuuucuuggagagaucagugauugggaggagauuugaagaagagagauagauuuuguauuuaacuucccuguauggagcugcagaaggaggugccauaguaagucugaacuuaagacaccaggcagcuucuccuaagccuggauguccagguuuugagauuucaauaagaaggggcuucaaagggauguagaagaaacuagaugucuuaccuguuugcuugaacccgaaaauccaugcuggcuaaaugaaaaucaugcccccuccccccaaaucaccuuauguaauugugaaggaguuuagauagcugacuuaguuaggguuuuacuucggugaacagacaccaugaccaaggcaacucuuauaaggacagcauuuaaucagggccggcuuauagguucagagggcccacccauuaucaucaaggcuggaacauggcagcuuccaggcaggcauggugcaggaggagcugagaguucuacaucuucaucagaaggcugcuagcagaauaccaacuuccaggcagcuaggaugagggucuuaaagcccacacccauagugacacaccuacuuuaauaaggccacaccuucuacucucugggagagugccacucccuuggccaaucauauacaaacagugguuguaucuuuacuucucaacacuuuauucaaggcuaaaagcccagcuuucucccuucccguacccaccaccuucaguuccacaacuggcacuugccuguuggucuucccgcuuucucauuagacucucuuugacaaggucauugcaagugcuaaauagagaaauguuuugaagugcugaagacaguggccagcagacaggcagucggugccacuggcacugcaagcacaucugagagggaggacaaucccaggauugcuccucgccuaccaucuugauggagauggguucguuucgucacucagugccuauaccagagcccuguggcuuccaaggucccuggggcccucccuugucucuugccuucagagcaaugggaggaugggcaugggcuccagcaccugguuuuacacaugaguucucaacucaggaccucaugguuauuuggcaagcacuuuacccaauaagccaccaucuugccagcucuaacagauguuccucuucuuagaauuuaagggugaugggcuuuggucauggcauccccucguagccccagaagagcacaggacugaccaagcagucacccgcuagcuguuuugaaagcuccuuguuuuuaaagauaguaucucccguguagcccaggcuauacucaugggguaacccaagaugauuuuggacuugauucuuuugcuuccaucuccuagaguacaggguuucaggugggcucuacuccagccuacuuguuugcucuuauaccaagauucaaugugucuucucccagcuccaagaucccuggcuauaguaucuuggguggaggggguccucaaagcucagaauccuuuaccugacucuccccaguauaaaugccuccaagaagguucucucuuuggaacuguccuaagcuguuuuuaauagcuccaaguagauagccacagacucuagaaaacgaccaaacuugaccuaaaucuucauuuuucaaagcuuaaagacucugaggcccaggcuaagucaccugacuucucuaaccccaguuuccuugucugagauaagacauuugguaaccaugccaaccaguucaugccaucuuaagaaaccccucagccgggugugguggcgcacgccuuuagucccagcacucaggaggcagaggcagguggaucucugaguuugaggccagccuggucuacagagugaguucuaggacagucagggcuacacagaaaaacccugucuagaaaaaccaaaaaaagaaagaaagaaagaaagaaagaaagaaagaaaggaaggaaggaaggaaggaaggaaggaaggaaggaagaaagaaagaaagagagagagaagaagagaaaagaaaagaaagaaaagaaaagaaaagaaaagaaaggaaaagaaaagaaaagaaaagaaaagaaaccccgcacuccaucaggagcagaaaucagacagguucaccaauggauuccuucagaauuuguuggcaaauaugcaacugagugugcuugaggcaaaaugaaccuaaggaucaugcuaauuucacgauuugguuaucaccacaaagagcuuuuguguaaaacguguagcagaagacucagcauagcaagcuguugguaaggccucccuggguauagcaggcaggguauauacucagcacaggcccucugguggaacauguucgcucacaaacucauuccugguguucucccuuccccgcacaguuuucaacaacucugaaaccugugugcaaaagaaugccccaagguccacucucauauuuaauuaaaaaauaacaagcauagcuuuaaaaaagcugccauuaauacaaacauaggugaucacugaguaguucugcuccguucuucuuauaaaagcccugccuauagcuuuucuguugugcuugacagggugaaguacaccugguuacaugcuugccaacaaauucuguaggaauucauggaugaaccugucagauuuacgcuccugauggagugacggguuucuuaugacaucaucucuagaccgacccgguugauauguuuacccaaagucuuaccuaauguuuucacggggacuucuuuuugguggaagauaacaacugagaguguuuuaaauaauaaacgaaggcugcugaagaggaggcuaugcaugcaucccaugccuucauugugugguacugaagagcucacgugagcacucucccugugucucggcaacuccugccauaccaagucuguuugcacauccucugaggcauggggaauugcuaagcccuuagugcuugaguguucugcuuccugcaugccucuccucauccugcucuggcuccucccucugcucucucaccuagcacuuugcucuggucuuauccaaaguucuuccuaagcaaacuagccaucaggacgcccuauauuaaccaguacaucguucccucuguuuucucuaauugcuuugggccuccacuuagugcuucaaggucaaguucuaugagguagcacaacaucagacaguaaggaauaauguuacaauuuucuaucccuuccucuaaccaucaguucaucauauauuuucucugauauaucuaggguuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucugggcugguagucuugguucuauaagaaagcaggcugagcaagccaggugaggcaagccaguaaagaacauccccccauggccucugcaucagcuccugcuuccugaccugcuugaguuccaguccugacuuccuuggugaugaacagcaguauggaaguguaagccgaauaaacccuuuccuccccaacuugcuucuuggucaugauguuugugcaagaauagaaacccugacuaagacaaggguauaaccuuacaucauuauauucuugcucugaccuaggcaccaaaacccuuaguaugaaucagagcccugcagguuauauaaggcccauggguaaugaccacaucuucaccagguaccagagaugggagccacaagaggcuugguauagaggaguaaagauuuacccuggggagaaugccugcuuccccugaaaugcagugaaaaugaauuucccuucucuugcauagcuuuguuugaugcuucaucacagagaggucguguuggguugaaucaggaacugagggagguggugaagaaggguuaagcugggaaaggucaguacugugacaacagagagcagguuacuggagacaucugggaacagagucaucauuuuucauuaccuguaagcccccagcuucacacacacacacacacacacacacacacacacacacacacacauacgucaaaagucaggccugaauugcugguguggaaggaugaaagcacuaagggaaaaauguuuaccuaaaaaauuggggagaauuuaccaugcacaauaugggccucagcuuuaagcuggguguuuggagguagccuguccugugaagcugagcagugcagagaaauuggaaggaaugacuaucagaguaaaggaaccugcauguucugagacccagaguguguuugagucugaugagaugcauuauagucacucgaaagauaacucuagugagugaaucaucuaugcucaaagcaacauguaagaaucucuuccuuuaaguuagacaugaaggaauuuaaugaaggcauuuuggugcuuacagaaugauuagaaaaccagaaggagguauuugaagucgguguccaauaaugccucccucaauaauacaaaacuuacccuccagggaccuucuaccacugaagcaacaaucggagcugagcagaaggggaauccaaaguugucucucucugauacuuguguaucaccacacggcugaaaauagguucagaauaggaggauaggaagcuccaguuacacagagggaaaucucagaaugagcaggauauaccacucccuugaggcuacuucccaggccucaccugcuagcaucuagccaucaaggggauagauuuguaucugggaucauagcugcaagggaguccuggaagaauagguuuuuagcuuuuuaaccucuccaccuagaauggcagaagucaaggcuacuauuacgacuucacaguguuugcaauuuauuuuguuuuguuuguuuguuuguuucaucauaccugaggauagggagggauacuacugguguaguggguagaaaccagggaagcuucuugguuggacagccccaaccaagaaggagucaucugguucugaaugccaaagugccaaccucuagcaagagccuauuggaagacaagugaaugaaguaugcccuccacccacccccacgucucagugcuuccuugggcuugucucacuccuauuaugagaacacaccuucuagagaaacauuuuucccuuagugcuuucauccuuccacaccagcaauucaggccugacuuuugacguacgugugugugugugugugugugugugugugugugugugugagagagagagagagagagagagagagagagagagagagagagagagagaagcugggggcuuacagguaaugaaaaaugaugauucuguucccagaugucuccaguaaccugcucucugcugucacaguacugaccuuucccagcuuaacccuucuucaccaccccccucaguuccugauucaacccaacaugaccucucugugaucaagcaucaaacaaagcuaugcaagagaagagaaauucauuuucacugcauuucaggggaagcaggcauuguuugguccagggcagcaggacugugaagaacaacuuacuggcaacuuggcagaucagggaacagcuuagaauggaagcaacucugggcuauaauccucagaaggcucucucucagagacacacaccaaccauccaagucccgugugucucccccccccccccccgcccauuaccuucaaaauggcuggaggccacacugguucaaacacuugaaacccuggagggcauuuuauaugcaaaguacuauaaguucuaacuaucuggaucuugaugggguuuaagccaggcuggaugucuuucucuuacuccagcuccaucaggugagccucugcaccauuccaccagagcugccauuuuuaaguuugauguaccuggcucauugcuaggguuuuuggagucuugguguucuucccuuaaaauccagaucucugcccucaccgaaguaagcuuuuuaagguccagacagcacauguaaagcacuggugucugacucaggcaggguaaguggccaauaaauaacuucccugauuauuauugcuguuauuuauaauauaaacaauauuuauauuauauuuauaauacaaauauaaauuuaagaacguacugucaauauucaguugugcuugcuaauaagaggaacaggggcagggacuguaaagaagggagcacuuugggagguagcuuuacacauuaaacugucucaagagagacaagcaggcccuaagccuggagucuuguaaguguugucccuuauuccuuaaaagcuccucugcuggacucagaucuaaacugggacgaggguagaaaccugcaccugacagccaauagagagcuucguuugcuucucugcauaguuaagaguuaaguuuugcuucaaacuacagaauccugauuaaaagccagccugucuucugcugucagacacucccccuuuuauaaaaguuuggaauacaggcagaauagaagauguauuuuaaggacauuauucaagugucauguuuaauuaacucccaucuucaaaagcaagccaaaaggauuuuuuucagagaguucucucucucucucucucucucucucucucucucucucucucucucucuccucccuguuugaggugauaauuguaccauaaaaacuuccccaaacucuuauaaauuaaguaggaauauuuaauauauauuauuagaguauauauaaauguauuacauuguauacuaauauaauaauauauauggcacuggggggcugaugggccuauucaugguauacucuagaacaucaagugugaugaucugacaguguguaauguucaagagaccacuaaacaggcaguuagcguguggugccuugcacugggaguggaguguguguguguguguguguccaugcauuccuuguguucagcaucugugaucacuuagggguguauacucauacugacagggagacaguuauuagacccagaauaagcagcaagcgcauaggaagggggccauagugucuguauacagggccuaaauugucuguaaccgguuccuucccaacggcauaaccagauuuguaucucuugcaagaacagccgaaaagauacguaaaucaaaaugacgggaugaaauuuuaaaagcaagaaugaccagcaagaucccuggaagaccacgguugggcccgagccccccauccugagguccaacauuuguacugauuacagccugacagcuuuugagucuccaaugauaacagccaucugacuugaucggaguucaauggauuuucacuaaaauagaaucaucgccucggugauggauagaaaaaguaaaacaauacauccugauaaaugcgcgggcugccuccuuccucucgccggcagugaccuugcacaauccauaagacagugcagacagagccccggccaucgccucagcuugucagggcuugaaaauugaagcagcucugaaagccaucaauggggugaagggggaauggcccgagaaagcaaugaaucaagcuuagagggcucggagggaaauaggguacacugaaggucagcgugaagaguguccggaggggacggcaggggcucucauucucauucacgggaggugguggcccuguggcgcgagaucagugggaaaguacaauaaaauggcgauuuucaaugcauguaauuucuucucugaagcaaaagacaccuaagaaugguacagaauaaucacuaccccucaagcuucgugaucucccccccccacggggucucccuccaaauggcaaggggcaggcaaauaugaaaccccuuacucucucugagauaucaagauugcuagccugguuaucuuagccaacgggauauccacuugcuagccugguuaucuuagccaacucuggauaccucaaauguuauugaucccgcuccccacaccccuccccccgcgccccccccccccccccccccgccucgcucccaguaacaauggcagcagcauaauaugaaaagaaacccaucuauagcaggguguucuggaaacucacagaccccuuccauccauccccaaugaggaugagaaagaaguacuuguggaugguugaaggccaagaaguuagauguuggcaggcacuccucagugcggguuacaacuugcgaaaagaaaauauuaaaguaaaaauuagaucauaaauucggagccaccguuacccagcccaaagugcaaauugccaaacaagucaagagacucauuagcauuuauguaaaucaguuauugcuguuccccacuuccuuaauuauccauguuauuucaauacaacccuuucuuugaugucccaauucuauauuuaaauagugcaagauuucuaucguauccucccgcagagguuugcgccaugcaaaaaacaugccaagggcagcgcuuucacagacuauggggaaauguuuaauugguucaucccaucugaguuaugagggcguauuacuaagcacacauaaaaucagaaacacggacaggaccugcaagaggccacugcaaauucugcccccaagacuugguggauucucaccgggagcugauucaaaggguuugcaaacuucauugaaucuggcuaaacgauugauuuaucauuggaauauucggaaaucaacgccaaccgcucucuuccuguuggcagugagagucauucucuuggcuggaugaagagggcacacagggcggggagagaggaaaguagggucagaaaagagggcagagaggugucuccugcccaacacgcaccaccacagauuugaaaaguaaguuugguuuuuuuuuuccuucuucuucuucuuuuccuggaguuuucuaaaguuagggggaaaaaaaccuucacaaauuacagacaugaaugggcuuucucuaauaaacaugcuuucgaaaugacagcacagccacugauaacuucacaggcccuuccucuuucugugaagcugagcgcgcccacccucgucaccugccuccggacagacucugugaagaugaauugugaccgaagauaaaaaggaaagagggaaaucucuucuuucucccuguguuuuugagccauuacuggaucuaguuuuuguuuuguuuuguuuuuuggccccccuuacuccaggccuccuggagauaagcagggcuggugucaagacaguauuuaguugaggaguuagugacagacagacucaaauucaaagccacacucugcugguggccuuguuuaaggcucccgugcuuagucuucuuucaggaaaaaaguguggugagcagggcugugcucaagaguucucacacaaaucuauguggaugugugcguggcacucggucuauaguagaugcuuaauaaacggggacguugagcucugcucugggcacaaugcuacccagaucggaacucccucuaaaagcaaacugaauagguccuguuagugucaaacagaauucacaaugaggaaaugggauuugcauagguaagagacuaacuggaggucacacagcauggguguuugagccagaugauuuaaauuuucuuuuccggauuguuauacguguguaugaaguaugaaaguacauucauaggcaggggacaguguggcgucuguuuccuccuccugccgugacaugggcucaggagguugacaauuuacccucaaaaacuuuaaccucugagccaucuugccaggcagcccccagagucaagaguuuucaucuaaauuuucucuagcuuggagcaguucuuacagacaaggacugugcaguaguuauaaaugaaaggcugaaaaaaagaaaagaaaagaaaggagaagcagcagccaguuuccauagccuuuaucuacuuccauaaggaguguuuacagaaaacucacccuugcagaggggcaugcuuucaggguuaaucugauuuaucgguuauugauuuaacaaguacuuuccuggaccgugccaaauuccaggccguguucuaaauacuuacaacuaguaacucauaguccccugucacgucuguguaucuuuuaagucagccaagcaggguuuguaugaaguuuccaagagauccagugcugaugcuccugagaugguugguuuaguuagauggagggagaggagggagggagggaggaggggggagaggaagagggaguggguggauaguguauguguguggaauuacguuuugggguuugggguaucaccccccccuuuuaacaugauuuucugaucauacauauggcuuccuuucacucgcuguaaaauucagaagggagcuggagacauaacucaggagauagcuugcuuggugcgccuggagccuugaguucauuccccagcaacgcguaaaccagguaugugguaguacagacacuuagacucccauaacucaggagcuggaggcaggaaguucaggguaaucuucagcuacuuugagaccuugagccaagccuuggccuugggcggccauaugcaagagaaaacaaaggaaggaaggaagaaaagauaaaauguaaaagauauuuaaaaaaaaaaaaaaaaaguaaaguacuaaaaaaaaaaaaaccuuuuuuuagggcgguagcucagcugggaaagcccgcuugcaagcuugcaagcucuugcucagaggcucagagcccuuguaaaaagccaggccaccguuguaccuuaucagaauuccugagcuccuauaggaagcuggagggaaaggcaggugaauccaggaagggccagguagccugaggacacgcagcgggaagggagcuggagaucguguugggaacaagggaaggcccuauacccagcuuguccccugaccccuguguacuguagcacacuuggauucacacucacacacuugggcccgcacucucgcacacugugcugguguauauacacgccaccacggcccuuucucaaagaacucaaaauccuaacacggggaccauucauccaucucaaaaggcugccagagagagagagagagagagagagagagagagaguaaagaaucugguuauaagaggauuuucuccacuucguuccauuuaaaguuuuacaacaacagggccacugaauauuagggaaagauggugguuugguuucaugaggccaguaucuuuuuuuuuuuuuaauguguacuaucuuauuccauaaagcuagcauagagccuaucuccaaguaggaauuccccugaauacugaggaggaaauuaagccaauaaaaauuuuaaaaauuagcaugccaccauaccuaaaagaagagcaucucagacccuugucugccccuauuaccaagcucacccucucccacucggaagcgugaaagacuguccacucugcucuugggcaugcacugugcccgugacccccugcugcagaaacccaauggcuuggcgugcagagcccucucugccgagggugggcuccgucgccggucgcugggaaggcacauuguucgacuccgagagcccacagucuaaaaucaucaucaugcauuuucaucaggaugaaauaucgggcgcucugcucagcgcaagguuuuauuaaugaugcgcugucagggcuggacguucugcauauuugcauauuaaacagcugagugaagaaacauuccuuuuauugcugcagggaauaaaucaguuuaaagcaagcucucaucauuuauacuccuuucggcuaagucuucuuuuauugaaauaaauuguugaagugcuuugcucauucuucgaauacugaugaaauuuaccuugauaggacccgaggagaaauaauauuuccuuaaaggugcaguauugucccacuuuuccgcauuacuuuaauucauuauugauaaguuaauuuagaaauaucaagcggaagggacagaaaaacagguccgaacaaagacuguuuccucugguugauguuugccaauugcaccuuuauuggcagagcgcaauaaaaagcagcaggggcuccagagaggggcucagggcugaacgccugcuguucacacagaagaucugaguuccgggcccaacauauacagccaccuguaacccucaacgcagggaacacaguaccguaaccacacauaugucacacacgugcagacaagcaggugcgcgugugugugugcgagcacacacacacacacacaaauaaaacgaaauaaaauuuugaaaaaagaaacaaaccuauuguuuuuaaugccucuguaugccuucucuaaggagcugugaguugcuuuuauauuaaaaucuuggucuaucucacccucaagcaaggaccagaaaguccaguuauuuucaauuacgcauuaugcccgccucggguaaagcucacgggcuccuggcaaaugcuuuugaguuccugucuauuccuuaccuagucuuuucuuuaaaaaaaaaaaaaaaaaaaaaaaaaaaaagauuuauuucuaauuaugugcuucuggaucuggguagggauuuguccccgugaaugcaaaagcccacagagaccagaggaggguaucagauagaucccccuggagcuggaguuagagguacuuguaaacugccagauguggauacaggggacugaaccuggauccccugcaagaacaacaaaugcuuuuaaccacugagccaucuccccagaccccaccccaccccaccccacccccacugccuauuuuuuaaugacuaaaaauucacuguucagaccguuugugauuugaaaacauuuuuuaaaaaaggauaucuauaucuagcagcuauggagauggcuugcaauggguaccaugcaaacgugggggccuaagcuggguccugacauccauguacacaguagccaggaguggcggugagcucuaggucuuguaguccuagagccgaggaacccugggguucauccccagcuuguggaaggugugagcugcagccuaggaagacuccugacauagaccucuggucuucacacguacacaaacacacaaacacacaugcacacggcaccugcacugcuaugacccacaugagggcuuuggaaacuauugguugcccaacgaacgguauuuccagacuagggacauuucugcugauacacggccaccuggcacacauuguucagagagcucaucuucagucagcuucucccggcuuucugcuuugcuuuuccccgcgcccugggggagaggcagcaaugcugacaugggccgaaccuguuuccagggucucagaaagcccauuugcugaagucccaggcuggcgcaaugacagugggacaccgcuguguucaguccagagauggagucagacaacacagcacuugguugguucacguuuguuuguuuguguuuuuguuuccaaucugcacaaagcagcgagcaagaaacccuauuuguaguucccugcuagaaaaagcaaggccugcaugggacucaugcguagcagaagcugcucacaucuaaguggauguacacguuuaaucggaggaggauaagagccuuaauaacauuuucccugcggaaagaggcguccccacucacuucuguugaguuugggacacugaaucagugucugggauauaccucagaucccaggcuuccucgucccaagcaaugaaguggaccagggucccggggaugaggaugcaaauagaggcaguuuauuuuaaaaggggaaagguaccccugaugguggccucgggcuggugagcuagggaacagacaagcagcaaagagcccagcuccauagcuccugccugccuuugcucucuccuguguuuguauauggcgggcguuucgcaccugcuguuuguuacaaguagcagacuagagagaauuuccacaccuugccugacgauuggcuucuuuccuguuacucucucucucucuuuuuuuaagugauuauuuuauaugauguguaggaguguuuugcagcaugcgugaauguucugcauguaugccugguucccauggacgccaagaguguguguugcauccccuggaccuggaguuaguuauagguugaugugggugcugggaacugagccagaguccugugcaagaggggcaccugcucuuaacuacugagcgaucucugcagccccucucuccccacucuuucccuccucccucccucuuccccaccccccccccauuuugccucauuaagaaggucacuguccuucacuuugcuuaggcagaguucugagcuguggcuucccuaggacgaccuaccugcccaauagccacaaagccuguuagcuuugugaacccuggaaucagaggagaccuggugccuggugaacuggcugcgugauagugaacucaagaacuccgcuccaguuucaucugacuccaagguguaaacaaccuugcauuacuuuccugggcugaugggaaaguuggacuaagagaaggcgguggaccuggucugucuaauagauaagguagccaauggcccggggccacuauuuacauuuaaauuaagauuuaaaucaggcuuggucuacuguaacuagugacuacuaguacacuaaccuaguguacuaguacaguacacuaaccuaguacacuagguaguacuugggggcuguuggauuucuguggaacucccuaccaggcagaggaggaacugucucagcuuagguacacuaguucuuaauuacaucacuucuguguaaggaaacaacaaggggcacccaggcacucaaaccagaaccuuuuaaccaggaccccccacccccaccccagccaaacucugguuggugccaccagaguguuccuuuguuuacaguaaaggaaggaaacuggaucaggcugagaaagguucucugcccgguggagucucuauggacaggcgggaucucgggggugggagggggugcagaaagcccaaucucagaggaguccaugucgcagguguuaaaccugauuagccaagccgacuccccguuaauucccugaaguggacaggacaguucccucugcucagcacaaaccuuagcguccguccugagucagccaguuccacccugguggccucagcaggcugcccuuuaagauggagccuguucucugccuagaacagagagagagagagagagagaauccauuggucaacugguccaaaccaaaugcccccagaccccagccugccugccgcuuugcauucuccugcucugaguccaggguuggagguauucguaccuagcugguucccaaauauugccgaagcucucugaguucuugggucucuucuuggaguguucauucauucauucauucgggcugcuccaguuucugcccugacagagaggcccgucgugcccacaguuacgugacaguggagucggggucugugaugucacugucggugucacuguauuagcaaguauuagcugcuauugucacugcacccuaacugacuaugguguuuacccuugaaaacgggacccaucaggauauagguuggaccgagcucacgccgccgccacaaaaugaauaucauagcuuuuuaacaaccugagaaccuuucaaccugaagucacccauucaaagcagagagagauuuucaccaugagauuccuguaagcagaugugucucuucccuucuaggcagcaauuuuaaaaguguauuucuauguauauauguaugcacguggaggggacaugccacuguacaugugaaaaucagagggcuacccccucucuccuucucccaagugacaggaaugaaugaauccuaaagagacauucgugcucacgucuggcuauugaaugagcccccaagaaauuagaauauuccuaggaaucuccuguuuggagaagaaaagucugaaggccuggggucagccagaggagggacuuaccaccgggagaaaagcuuaccauuugucagaugaccuugcuggagagacuuggagcugagaccguggcugacucuuauauagcucuugcuuucuguuuaauccucccugugccccuccucuaacuccccaugucaggaccccggagaggaacuugagaguucugggcacaggaaggacuccuagcuuuccaacagggcacuuggauggcagcugguuacucacuccucuagaggugaggaaagccaaagcacagcaugucuucuacccuccccaugccuguagauauucauaaaugaccuuauuuggaagcauuuugauuuugauucuggugacaaggggaaggguuuuuuuauuguuguuguuuguuuuuguuuuuguguugucuccucgcucucugaugaucacuguaacaugguccaccaccugaaguauugcuuagauagacugaagacucuuagcaucucuucucuucacagguucuggucagaguuuccauucugacuuuaugacccaggagggauauaaaagaugucugaggucaucuuguccagucacagccaggcuaggauuguucccuuaagguguagucgaguuacgugguccgugcucauuucggaugacgcacugcuaagaucagaggacucuggccguguggauucuugucuugugugaaucagaguccagcaggaaaagacuagaggagccaagucugcccccaaaagauuccuccccucgugauguucuuccaguggucauuuuugcuauaaaucuccacacagugugggaguugagugcacacuguaacuagaccuagagacuauuuauccuaaaauguaagaaaaaaaucccccaaaugaaaaugaacuccgagaacccgcucaggcuacaguagcaugcacacccagugguggcaguguguauaaaaaucacacccacaggacauggauuugcuuacaggaugcugaauguaaccgcauuuugcucccgccugccaggaacacaauccauacccugccugcucugcucugacccauugccuucauuuuugcucgcuggggaaagagacccuguuuuucaggaucugcuucuuuucugaugguaucggucacugugaagagcccagcacaaggcuacuuaugacuaacguagggauuucagggcaagcuugagaguugggggaaaaaaaagaucaaaagaaaggauaggaaaggacagggggauacagaauaugagagacuuggaaacggggaauuggaauagacaucuaaaauaaaacaaaauggaagauggaagacggggaagagaucagauggugcaaaaugaggaaaaagaaaggauaacaggcuugggacaagaauuuacauuuaaccagggauucauccccaaagugucaccuucuagauccuuccuuugcuaucggauuucgguuccccaaguaugccucaugggucaacuguaucagcagcauccccuggacauuuguuagaaaugucacaucccuggccaaguugcagaugucuugagucagagagucacgugguaacagaagcaugcucuguuaacuggcaagugguaacugcuccuguuuaagaaccaucgcuguuugguuuuugaaugacucucuccaguugcuuucaggauggguccagcaguucugagcuauuucuaucuguagaggaugcuaccccuacuuccuguuuuucuucccccccccccccccaccucacccccaaccaucuuucuaacaaugacaaaaccauucucuucugccagaagacaagugucaccuggauggcagagcccuuuucuccugaggucgugcucuggaagacauacaaugcugugggcuaaucuacagagcccuucuccgaacaagugccugagucuacaguacagacacagacaagcaugcgugugcaugcgcacacgugcgcgugugcacucacucacacacacacacacacacacacacacacacacacacaucugcauagcuauauaucccacuuuucuuccugcauccccaguuagcacaucaugacugacaagagacuaaggaccaaggaccauuaaggacacguuuuuuguuuuuuuguuuuuguuuuuguuuuuuuuuuuccuagauggugguggugcaggccuuuaaucacagcacucagaaggcaaagacagguggaucucuaugcauuugaggcccaccuggucuacggagugaguuccagggcagcuagggauacaacagagaaaccccaucucaaaaaaccaauaaacauacaaacaaacaaauaaacaaaugcaugcaugcauacauacauucauagaaaaagaauaacaguaaugacaguuuucccaaggaguuccacagacauaaaagguuaugaucuguacaaccauacaaaugaacagcuacauuuucguccacuuuuguccacucuguggcuuucacuugcagcgcucaggaaacccaaguggcuuuaagcagaaccuggccauaugcacccaccacauucugguugguuccuacaacgugauaaucacuuaaagucaaaagcacggcaguucaucaggucacauuuugagcuaaaggcgucucgcuuauccaaauggaaaaaaucaaaagucuaaaugucucccuucguuuuuagcaugggccacaguuguuccaggguuaguugucuugcacacugauaaauauuuaucacgguuaagugaacaauuauugggagacagauacugguuuacgaugcggcuucuugggguguccuaauugugccuccgccuugccguuuuauguuuuaucggaauaugcagacauauacuuuaugagguuggguaaugaagagcgagaggccccaguaaacauauuugcuaagagucaugguuaucuacaacucagcaacccuggguuagcaucacccauauuacacaguaccaggcaagcaguucauagcucaauuagaccuuacucgcuucauuuuuaggcauuauguuauucuaaauuaacacuauauuucauauucuccaggucuaacgauuaaccagauuuuggaaccuucaggguuuauuauuuaguaauccccgaagcucucaagcaggcguuuuuuguuuuuuuuuuaaauuccugcauuaaaagagauuaaaaauuagccgagauagccuguuaaauagccgucucucuguccuuugcuaauugugcccaggaaugagaaaagaaaacgcaggcgaggucagauggggaugugccagcaaacuugccaccugcucauugucugcugaaauugggguuauuuaaauuaguaaauaauugugaaaucuccauagagugucacagagcaaacaaaucagaaugggagcuguucucuuuccccuuuauacucaaguuuucagcaauagcaaugcauuuuugaauguaaauauaaagguaagccauaauggaaaccaucaaauggaaaauaaaauuauaaaauuaaaaguggccagacgugcaaauguuuuucaagauaguggcuaaauuagcccuugaaagcauuaaacauuaaaaaaaaaaaggcgguguaucauuaaugugugugcaggcacucacacgugugcaugcagaguucuaaggaucaaacucagaacauuaggcucacauacccaguauuuuuacccaacgaaccauccugcugguccuaggaauuacuuuuauaucuugugucgucuacauccuugccuguuaaucagauagaggaauaguuuucuuuccaaauaucucaauacauaaagaucacuuccgaugguuugucguaucgcuugcuauuuuucuuauauggggguucuaacaaacccgguuuuauucugcucuccguguauaaacucacuucuguauuuugcuguugcauagaaaacagucauucucagagacgggcagaaucugccuuuguuacauagaccacaaccccgucaugugugcugcuuugugcucuaugagcuagccauucacacgcugguccuuuaaguacucucuacacauuguccuuucuccuucuguuccagggacauucuuccuuggacaaauaccuagagacaguucguuggucagaaugucgagaagcggcagccuaagccacuucuacuagcauccagcguggggagguugccuuauauccuguaaugcacaggacagacacucauucagauccccacuggucuaauugucuauagugaccccauugaaaagcucuguugccacacagaaacauggggcauuuaccaaacucugcucugccgccuguuggcugugcauuucauuucugcugccugcccauaacauccaggcagccucaaccucccaucucucuaagaaaccuuugccggcaggcugggaauguggcucaguugaucaaggucaaccauuugcccggcauggaaaggaaaaagcacuggguuuaauggcagugcccaccuguaaucccaacccuccggggucaaaggcuggagaggaucagaaguucaaggucauucuuggcuauuuagccaguuugaagcucaucugugcuacaugagacccuguggaagacagacagacagagagacagagacaaagaacucucccuuugccaaguccuaacauggccuguuguacuucucgcagacagacagaccauccuugacugaauuuagucaagcuaauauaugaucuucgucccuuugacuuguggaaucuucauaggccagucuuuuuguuuuuuuuuuuuuuguagagagucucuuccuauauagccuuugcuagucuggaauucagagagacccauggccucuaucuggaauuaaaggugugggccaccacaucuggcuucacagucuagucuuaaggagucucccuaaauuggagaccuaaacaaaaacccuucuugacucacccgggcauaccuguagcaagaaucuugugaaguuuauuaugaugaauuccaucccccuugauaguaccacuuagugaccuugaacucacugccuguggcauccccaccuuggcuuuuuuguuuuuuguuuuuuuauuuuuuuguuuuuuugguuuuucgagacaggguuucucuguauagcccuggcuguccuggaacucacuuuguagaccaggcuggccucgaacucagaaauccgccugccucugccuccagagugcugggauuaaaggcgugcgccaccacacccggcuuaccuuggcuuuuuguugccugaugccuuuauccuguucagaacuguaccccgccucucuuuccaucugagguagucccuucccaguagguaacaacucuguuagucugaggucagauggaccaugccauggcauugacauacacauaaaauaaccuuguuugauaaaaauguagacgcauuugguagaaacaggauacagacaucaggguacucgacuccaaacccaaaaggacucuacuagccuggucucuugccucucguccaccucagcauuuuccuggccgagucuggcugcauauaugaauaaacuucuacccuuaaguuccugaauuauuuaggcacugcuagugagucugaauaugccuuacaguaggauguaucggguaugcggacgccuccagagcacccgucagcuuacccaggaugcuuugacguuaucucucagcuguacaucaauacccagggauuuuucaaaugucgaagaugcccugagccuuuguguucagguucccauagaugacauccaauugugaagcccagucuagucuuuauauccagcaucguuccuugaccaccuuugaugguccccgcugagcugacauaugugauauaucgucacuaauggguucugaugucauaaacaaguauuaaugacuuuuuuuuggaaagugaaagugcuuugaauacaagucuuuauugccuuggaaguucauaaaagcaagagagacauguuuccccugauguuuggacauugagggaauagcugugugucaggggcagauagauccuaguguguuucaguggucugugaugccaaacuucuggugggcagaggccaugcauagcucucucucucugccucucucucucucucucucucucucucucugugugugugugugugugugugugugugugugugugugugugucuuucucucagucucuguuuuucugacucucugucuuucucucucucugggccugucucugucucucucuuauuucuggaacaguuucccuggaagagucuuacagagguuuguuuuauuuuuuuuucuagcuaguuuuaucccaugacaagaugaaagaggaaauccuucuggugggccuggagaugcuuggcagagucucacuugaucuuuguuucaauccucugggaaagagccgugguggguucucaguuaggaaagaagaagacccaugugccaggaugaaagugcgcuugaacuugacuuuugcagucgucugaaggucccugcauagauccuucucuuuugauugucacaaugaauggaagagaaaugggugucugucgucugagggguucuuaauccuucagguucugauuaagaacucucuaugguggcgauggcuaauucugugagucugacgggaccuagagucagggaauagacaagucucuggguaugacuuccagggauuuucuagauuaaguuaauuugaagugggaagaucgaaacagggguagugccaaccgaugggauggguccuggacugaauacaaaaggaaaauauuaccuaaacaccaacauuaaucucucucugcuuccugacugguugcccuguaucuggucucuucuucaagcuccugccucaacugcccacucauucugggcuuuguuuuccaacugugagucaaauuguaccucccuuccuucaguugauucuguuaaaugauuuaucacaacaauaaguaauuaacauagaguggaagaaaccuaggugcucuuggaaguuuccaaagccaggauagccugcuuaaggguuauuuaacauugucuuugugauaugaggagaacacuugaaucucauguuccuuaaacuaugguuuuaaucuucccagggaacuggugguacacaccuuuaaucccaaccuucagcagagaggcagagaggcagagaggcagagaggcagagaggcagagaggcagagagaggcaaagaggcagagaggcagagaggcaaagaggcagagaggcagagaggcagagaggcagagaggcagaggcagagaggcagagaggcagagaggcagaggcagagaggcagaggcagagaggcagagaggcagagaggcagagaggcagagagagaggcagagaggcagaggcagagaggcagagaggcagaggcagaggcagaggcagagaggcagagaggcagagaggcagagaggcagaggcagaggcagagaggcagagaggcagagaggcagagaggcagagaggcagagaggcagagaggcagaggcagagaggcagagaggcagagaggcagagaggcagaggcagagaggcagaggcagagaggcagagaggcagagaggcagagaggcagagaggcagaggcagagaggcagagaggcagaggcagagaggcagaggcagagaggcagagagagagagaggcagagaggcagagaggcagagagagaggcagagaggcagagaggcagagaggcagagaggcagaggcagagggugguucucagugagcuggaggccugaucugaucuacucaaucaguucccggacagucagagcaacauagugagauucagccuucaaagcaaaacaaaacagaacaaaaucuucuggauucccucugguugaggacugguagaggaguuauauuaaaggccacaggaaauccaaccguguuggauuaaagagacaacuccuucucuaaugaauagacuaugcaagagcaaauguuauguaacaggaaggcauccuuugucugacuuguucaagagaaaacaccuuucaacacuccauuucccccgggggaugugauuccagacucaucccuugggauucaccaugugggagaguuugaaagcacagccauauggacauccuggucuucguuuccauuugcuaccuagagcuugccagcaaccucccaucagcucuccuccagagcuucagccagcaccagcacggcgcuuaugaaaauuguugauagacagccacagcugcuacgacaagcucaagacugcuacggcuguguaugccucagaggcaacauuucacagucuuucucccaaucuuccggcucuuaccuucuuuccagcuccucuuccucuauguucucuaagccuuagaggggugguauaggcguccuauugagggcuaaacacucaaccaccgcuucuccuuaaugccuuggguagcuagcucagcgucugucuucagcacaguucauugcaaugccaagcaucuccugacugaggcuagguauaguauuugccuacaaaggcaagcacauagaagcaguuuggugccauuucguucuagcugaacaaugguaauuaagucucccucuggagccuaagaccuucuuggacacaggguuuuaauugugugcucagucuuaggcaugaauuccuaccugugcaguggggccucaaccccacgaagaacacgcuuccucacguccugccugucuuugcaguaggucugagggcacaccucugucuuccuguucuuuguccuguuugucccuuuaucucuucucaacuccauuguguguguucaaccugccaacugcacuagauucgagacuuccagcuucuauuuaaguccuaaauaaucuccagccauggugacgcuucccuacuacuauaggaguauuuacuugucuuuguuuaaaauguacacaagaacacaguagggauucaaacgguggguacuaggguaacagaaacugggcuucccgggugguaucuggcaggguguggaggugguuuugguaguaaaagaaaugacaggccguuacuauuaaauguugucugacauuguugggcuauuuacuauguguucugucaugaacaaggcaguccacaaccauauagacuuaucugagcccccaaaguuaagugcauacuacgguugcuagaugcuucugcaagacacaugauuccaaccuucuucucacuccugaagcuccucucuguacugcuugguuuuaacugccaacugggccugugagcauguuugaggggagcauuccuauugucaguugaugaugcaggaggacccagccuauuguggacagugccaucucauggggugucccuaaacuguguaaaacggaaggcagcccgagugccuuugguccucuagucuccugacuguggaugucacuguggccagcugcugauguuccugccuugcuguccacucagugguggucugggaccuagaacuguaaggcagauaaacucauuccucccccaaguagcuuuugagccugauguuuuaucacagcuacagaaaggaaaggagaugccagggggugguggugcaggcuuuaaucccagcacucgggagccagaggcugguggauuucuguggguucgaggccagccugcucuauagaguuccaggacagccaaggcuauacacacugaaacccuggcuugauaaauaaauaaauaaauaaauaaauaaauaggaagccagaacacucuccauggucucagacaccagguauugcuggucauguaauacuaaaacaaauccauuagaguuugcagacuugagaagcaagagcaugacuuaggacuggagugaaaccuaugcccuagaagacaugggugauucuggguccaaacucugaauaucacuuugucuucuuugcuucugcauuuauaccaaaaaaaaaaaaaaaaaaaaaaaaagccauaugccuaacaaaguggcacccuccgaaagaaaagcaaagcccuucacuuaguccaggaaaaagcaagucuuugcaaagaaacgccagucucguucucagaugcucugccguuaauuggggauuguggggauucugggcaugcccauacauugcacuucaucaugguauauacauagaacacuaaaacuuaaggaaauccagcccauuuauucccacuaaccaacaaaagccuccugcguggccaggaguuacugacauggccccuucuagacuguggcaagacagaagcauagggcagaauccacacgagaacagacugcuuuuucuccuaagagugccuuguuagacuguggacccugcuagcacaugggagacacuuuugcagucccagcuugagcccagugucgcacagcacgcuuucaaccuguguuccucacaccgcugacuccucacgguuucagaaugacccacuuaagccucucgagguggguccuucacuuucccauaaauuaauaaaacaucuaugacugcuucccagcccgucucggcggcuucagucuguuucaauaugaggaccauuaagacagggaauagauaaagcaagucucgucuuucaaaugcucuuccgauguaagacagaauauuauuaaucucgacugccugcugcuuucauuuacuguguugccgcucgugggauuacaggcaaaagguuucacaaguuucagaugaaauaugaauauuuguugucaaaacuacuguuaggcuuugaaagcccugcuaguauccauuccauuuuauuauucucacaguauuagcauuaugauauuuauauucacagacaucccuguguucuaggaccuaggacacaaagccucccuccugcucccacaccuuuacauuuuuccuuuucuuucucuuccuuccuuccuuccuuccuuccuuccuuccuuccuuccuuccuuccuuccuuccuuccuuccuugguuugcuuuaaauacuuuauuaacucuuugggaacuucacacaauguguuuuuuuuuuuaucauauuaacuccucccacuaauuccucgaagguccaccccuaccuccccacccgugucaacuuugcaucaucuuaauuuauuugauaacccaccaacuccagauuguaucacccauauguuuccggguacagaaccauucaccggacuguccuugacccaccgagagccucaugcuuaaagaaaacugacucuaccuucccuggaagccuuccguuguuggcuucuagguuacgguucuaggucacgaaccccguccuacuccaugacaaaauguugcaaagccugaucuuugaagacuccauucauuauggcccucccugacugcuuccugacucugcccccucuuccuccguggcccccaccuugggaagaacccauaggggugccucaguuuuggcuuaucccccccaaaucuguacacugaccgauugugauuuugguuuuguuuuuuguuuuguuuuguuugcuuuuacugucggcuaagaaaauuuccugauuuggucugagaccugcccaaaccuaagguuagagaaacagagauuuaaauggcaguuugaugcucugucuacuuaccgaauaauaguaggacauucauuccuggggccugggaacuuaaauucacccuuguuccucccucauucuacaaguaggagacaggaaaucggagagccagugacugagcgucugcccaucuugucauguccgaggcgucucugugacaugagugcaggcacaccgaugcccuuguuuagggagcaagaguugccugucuuucagagcagagguaggucauggggaguuuagcugacuucaucagauaguuucacacacaucccaccugggaggcuguugccugccaaggaagguucagggggcuagaucagagagggcagagcaggcugggaaggggaagccuuccuggaaggcagccaaggucacaucagaaaagaaaacacuuucuaagccggaggugcaaaguucagacggaucaaaggaaugggggaucugguugugaacugagagaguccagcaucaggugaauuagggcuucggugccuguagcagcacaacagagcuucacgaaaggcuccauccguggagcccugaccaagaaagaauccaacauccgaacgcccacgagcauacaucaaauacacuguggauguggggagcagcggcucuuccaggggcuacauugaauuagcccagguguucucaaggugagcccuccaauaggaggagcagcuccacgaccuggagaguucuuagagaagagcauucuaggacccaccuauaccacauguuaagaagccccuucagggauucugaagcggggguggggaugggggguugagacacagcaggcaagaaaucagagcagagaucccaguguucuuuuacugagaaaccccgucuugucucggucugugguaaccucugauuacuuccucauaccucuucucaugggcccuagauaagaguucccacaggacuguguucaugcucacagauggucacaucucuguugcgcucuuucuggaugaauagagagacagaagccaucuucuuuuaccuuuucccaugagugaggaacccuaccuucaaguucuagguacuucuaguguagacuuuagcacauacauuugugcauuuguguguguguguguguguguguguguguguguguguguguguguguguggacacaguuaagaugcacaguagccaaggucacuccaguuuacaguguggacuauaugggcgagaaacucauuagcacugcacccagggauuggauagagugagccacauccccaugcaaggcccacccucuguucuguuauaguaccucacuaugucagcauagaugccacuacauccugccgccacaaugguuuucuugugauauuucugagcuuccaguggccuggccucagcccucccauggucacaacuagccauaguugaaagaacuagaagcugaaagaggaucaucuauaauaaagauuccaggagauggugucuuugugaggguuccguccagugaacagaccaugaccaaggcaacuccuuuaaaggcaaacaucucauugggacuggcuuucagguuccgaggagguucaauacauuauaaccaaggugggaaguaccacagcauccaggaaggcacugagcugagagaguggagagaucugaaggcagccaggaugagugucuuccacacugagcugagccugagcauaggauuacaaagccuacccccagggugacacaauuccuccaacaaggccacaccuccuaacucuguuacucucugggccaagcauauuuaagccaccacagaugucacuacagggugguugcuuuuuguugcaguuuuuuggcuuugcuuguuuuuguuugguugguugguuugguuuuguguguguguguguguguguguguguugucauuuguuugggggugguaggugguggugcuguuuugagacaagacuuuuuguuuuucaauguaaccagcccuggcugucuuggacuugauuuguagaccaggcuacucuugaacucacagaaauccaccugucucucccucccaaacgcugguauuaaaggcgugcaccaccacacccagcuuuuguuuuguuuucccagacaggguuucucuauguagcccuggcuguccuggaacucacucuguagaccaggcuggccuggaacccagagcuccacauguaucugccuccagagugcugggauuaaaagggugcccaccuccccacagaguggaugcuuaaugaguaucaagugggugguuugaguuuaauggaagaaaagaaacagcuuagcaugcagagaauugaagguuugcuauaaucaaccccagucaacucagaaaaaguaucgcccagggcagaggucagggcacaggcgcguucucaggagcuucaguggauggcacaggauuguucuaaaaggauagggcuuggagcccaggccgccuugguucaaauccaggguuugcuagguauagcugugugaccuugggcaagcgguucagccuugcuguucugugcauaaucuccuuaucucaaauggagcaguaaagauaagguaggauguuuccugugggcugcaggaggcgccugagcagaaaacacucuguguggagccagggacaggcagauauuuagucaucuucuugcagaugggaggagccagggagaggcggugagauuugaacccuuucucacccuugcaccuuacccucaacucuccccuccauuccacauuauuuccuucucuauacuacccacaacccucucuccacccauucccucccaccucuccuucuucccuccaucuuuccccuccgcuuggggacccugguuccugaaccaguaguaggucaaccuggucccuaggugugaggcugacuucccuccacagaggcucugccccacgucucuccugcaggaugaaaugagacuauaaaccuuuccuggcagacacguucuucuacuggccgcccccaggccuucaggcuugucuuuucccuaauggggagaacuggggaaagucuaauguggacgaggggguguccaaagaauauagucauuccugccagacaggaguccuacgagaggcccaggcagaauugggguugaggguacagagcaugucagagaagagcuguauacugcugcacuggggacacugaugggacacugacacacagagguaguccucuccucccucucccuccucccucccucuccuuccuuucuuucccuccccucucucacucccucucugucucccuccuccuucucucuccucuuccccucccucucucccucccccucccucccccccaccucucccucccucccucucucucccccucugccucccccucccuccuccuuuccuccuaggauucacccuagcccagccucccaagcccuuacacuugggucugucuuuaaagacaaccucaggcccuccagcagcccuguccugccaacaacuacucuguaucucuucugaaagaaacuuccuaaagaguaagaccuccagccuggcggugugcugcacacccuuugucucaguccucacagaggcaggcagauguccgagucugaggccagacagccaggguuacucagagaaacccugucucaacaccccuugcccccuccagaaaaacaaaaccaagaguaagaccucgagauagcacuguaucgcugguguccgggagagcucucugggggacagcaugauagacugagagaaggaaccuugaccuuagccaagccaggaaccaaaaccaaaaacccgugaagaagugagguggaaggcacuaacuuggaguuuagucuucucuucucuucccucucccccuguauucuaacugcuccaagugacucaagccaucuguuuacuacauuguugccuccagaacuucugcuucaccccagccccuucugcaaugaucacuaacaaaaugggagcugagagucugucacaaaagagagcuacaaaauaggccgggcagugguggauuucugaguucgaggccagccugguguacagagucaguuccaggacagucagggcuacacagagaaacccugucucaaaaaaccaaaagagagagagagagagagaggcgaggaggguuuuguuuucuuuuuucuuuuuuucuuuucuuuuuuuucuuaacuuaaaaaaaaaugugguacagucauuuaccauuugagccacuuacugguggaugcuuugguggcaaaggggacagccagugcuguaguaugaacaucacgugacacagggcauccaauggugaacuugguccugaaguuaccagccaccggucucaacucgcaagaugccuuucagccuaugguaggaaggagcagucugaggcuuguguauuuauguugaagcacaggcagcuguuucuuugggggcaauuagcugaccucuuugagccucuaugucugucuaucuuggacccaucauuucccuccuuugcaucggaugaucugaaccuggagucaguggguaccacacagggcaacucgucacagccccaucucucucuguuguaacccucugugaugguuaaaugcuagcugaccacccaucucucucucucucucucucucucucucucucucgugagucugcacuuuccuauccuugauuuuacguguaugugccccugagugcaguaccugaagagaccagaagagaucucuuggaaaugacguacaggcaguugugagcuacuucacugggugucgggagccaaccaugaguuuucucaaagagcaguacagugcucuuaacugccgggccguugcucccgucccggcuugaccuucuguaaccaugacucaggauguaugcagcaccugcaaaggcugacagguucuggggggucccucagcaacucauuggagacccaugggccgaugcgagaggagcagcccaacuccuuaguaucugucgccacucucagaacuucuaauccauagaagccaugugagguuuccauccauugggagaugcgcacaagugguuaaaauuagucaugcauucuugguccgcugcugcaggaagggugucuucgcccgugagagcgauuaugacauguuaaaacgggguaaugguaagcagacaguccgaggggcugcagggcaagcucugcaaacgcucuguuuauuuucuccccauugacuuuucucuuucaggcucaaccacgagugcauuaacucggaaaauaaaccaagccugagcgaguucagagcguugacauugugugccuucuuuugcagccugcacccgcuucuuuuauuuggcuuuuaaauggccucuucuuccucuaaaacucaaccugccccgccguuuuguuuuguuuuugucuuuuucuucuucuucuucuuuuuaaguggaaaguccuccccucccccagacuggccgguauucuuccaguucauucuccugugacuuagaaacacagcguggauucugaggucacuuuugcaagcuggcgagucagcugauggagucccuuauucccuucaacacagcagugguucuccguguuagagaaaagccugugauuucucuuggacauucaaacucugggugcuuggauuuugcaaagagguauucacauucaguuggccggccucuaaaacuguaugugggguuucaucucugugugcuucucaaugcguauuuacauuuauuagacaugguccugcccauuacuuuauaaccaccauugcuucuggcccuagcugacaaacgugcucuauauggacaaaaacacaaacaaacaaacaaacaaacaaacaaaacaaacaaaaacucccaaagcuuagaagagucaacuggauuucuuuugagaggguuugggaaaaugguggguguggcuaugcagaugagcugcaucccaagcucugucuguugcuguuccuccguaguuuaucaucaucugucaaucagacgacuccacuccauaugaauuuguaaccugagaggcacugguacuguguagcuuaccacuucuugggagaguuucaaacacuuaaaauaagagaaaagggagugauauugucugggaucauccaugcaaaacacaugaauauuuauuuguguaauuuacuccagcuccuuccuuguaagaauuuugcauaaugccacaaacacuggccccgguguguuacuguuaggugcaucaaguuugagaacaaggcccuauucuugcaauucugguaugucaccaccagguggcaauagugcauccugaugaaggaacacugccccucaaacugugguauuuauuuacuuugaccauaaaccuaaucaauguuuauauauaggaauacauuuuuuuuuuaaaguaagcuugcuugucuuguuagcacaguuaguucuucuauaaaauacacuguggugugugugugugugugugugugugugugugggguguuguaugagggagguguuugaaccagcaugaaucuagcagaagauaucucucuaccuuguucccugugaugggcugucuucagcagcaugugacagugggccacagggauucuccugucuccguccccuacaguguuaggauuacugacucagacgcuuggguuuaaguagcuucggggaguuggaacgcaggucuucaugcuuggcagaaaucacuguuacugcugagccauuuugcagacccccaaauacagaguuuuuuuguuuguuugcuugcauuuuguuuuguuuuuguugguugcuugguugguugguuucagcuuguuguuguuuuugagacagguucucacuauguaauucuggugcuguccuggaacuuccucuauagaccaggcuggucuagaacccacagagacccaccuccuaagggcugggacuaaaggcaugcaccaccauaccacaccugguacuaaaauacauuuguguguguguguggggggggggguacucacacauacauaccaugugugugcccaaaauacauguuagaguuuccuuggguucuaauucucccguuugaagcuuuuuuuacuucucucccuuaacauuucauuugccuacuuggaagaagccuaaaguaggaaccauggcacuuguguaaaucccuaggaauaccgguggaaacaaacaacccaccaccaccaccaccaccauuaccacccuccucacccuguccagggaacagacauccucaagggcucuuugagcaacuccugaguguuugcuguuucggcaaaagucuuggguuuuuuuuuuuuuuuuuuuuuuuuuucgagacaguguuucucuguauugcccuggcuguccuggaacucacuuuguagaccaggcuggccucgaacucggaacucaagagauccaccugccucugccucccgagugcugggauuaaaggugugcgccaccacgcccggcuuguuucggcaaagucuaugccucagcucucccaucuggcccaucacggagccacucaacaguaagggccuggauacucaggaccaccugcagcuggucuucuccagccucucccccuccaucccccccuccauccccccccuccaucccccccuccaucccccccccccccagagcccgccauccgccuuuuauaacuacugaggaagaaagaaguucaggcaggcacagagucgggccagggucaccuggagucgucuaggaccuuauuagagcucugacuuacauuaagaaaaggucagcauccuccucuugguguccguaagcugauggagggagaggcuaaggagguauagcuuccauaaucuugcugagauacccgguugcucuuguaaacuaggguucagggagauuagacagguaguccagguaaggcuaggccaggauucacaagcugauauuucuuggggcauugcucugaccacauaaaaaucuuggaauuggaaguaccuggaaccuccagauaaaaacccaccuuagauaauaaucuccacuucugagaacaugcaagaauaagaacgcaggcaagcuugcucuucucaagcggugacugacagcugggagguuugccuuuugaguaccauccaccgcagagucccuuggugucauacccagggguguccuuccccagagucaugguugaaaggaacugagguucugucagguucggggcugugcuggguaccagugauacuuguuggacuggagagaugggcccuguccuccuaggaagaaggcauccacuucugauacugugauaaaauagccccaugaaagcaacuuaagagagaaaagcauuugucuuauaauuucagguucauuauuacagggaagucuaaaagucaaggcagcuaguuacauacauccacagucaaaaccaaagagaguaagcacacaucacuuaagcucaacuaauuuuucuuccuuccuuccuuccuuccuuccuuccuuccuuccuuccuuccuuccuuccuuccucccucccucccucccucccucccucccucccucccuuccucccucccuuucuuccuuccuuccucuuccucuucuuucuccuccuccuccuccucuuccuccuucucuuccuuccccccccuuuuuuuugagacuguuucucuguguagcccuggguauccucagacucacucugugaccaugcuggccuugaacucugagacuugccugccucugccuccugagugcuaggacuaaagaaaggugugugcuaccacccagagcaacucaccuucuauaucucuauacaauuuagaacccaaacccaggacauggugcagaucccuuccuucucuuccuccucccuccuucuccucuucccucucccccucccucucccuccuccucccucucccucuuccuuucccuccuccuccucccucuucuuccucccuccuucuccuccucccuccuccuuguccccuuuucuccucucccuccuccucucucuuccuucucccuccuccuccuccucccucuucuuccuucuuccuccucccuccuucucuucuucccuccuccaucucuccuccucccucuuccuccucuccccccugcucccuccuccuccuccucccuucuccucaucuuccuccuucuccucuuccaccccuucucccauuuucuuuccagguuccuuggaacaggacuuuaucccauuacuuagaacuagcaauccucucacuucaaagccucuugugugcuggcauuacauacagguguacaauaccaugucgugcacaaugguuuuucuuuuaggauuuauuuuuauuccuguguguucgacugucagugcacuugcuacauguguguggauaccuguggaaggcaggaaaagacaagagccggagcuggugguuguacgaagccugcggcagggugcugggaaccaaacacggauucucuaggaagagcagcagcaaaauuauucuuccccacugagccuaaaacauguuguugcuuuguuugucuuagugaaauacaaugcuaacagccacccaaggaggcacaaagcauuggucuuauucaaacaaauaaaaccacccuagcaucuuggcccagcaccuagcaaaugcuaugcaggaacccuguggaauguaacuguuucuugacugauguguuuuaagagcaaaggcaaacaaacagaaacaguugcaaguaguuguuuccauccauuuaagcaguguuuccagaccugaaagugagcgagcucucaugaagugacaucaucuccguugagaaggcccauuguugcucauuucggucggaaggcccccacucucuccucagucuucuaacuccaucucacacuggcaaucgggaggaggauggagaaucuggcugggcguguaugugugaagugggacugggaaaagcucccagcccuccuguccacacaaagcguucauucuguaaucgcagccugcaggagacauggugccagcucaucuggaaaacaagauuaacucauuucaguuaaguggugaucacagaugucagccucagggaguucggcagccucgggggccugcagagcuggggccuuuggggcuggggcuuaagagcagaaauaacagugggaaguccuugagccuacagguagccacagcuuggggacaaggacagcacuagagaugcaguucaacuuugacauggcucucuggguguggacuuuauaaauguccuggcuuguuugcuuucuucucagaguccuggggauggaacacagugacuaugacuacaugcuagacuccaugucugaguuacaucuucaguuccuuugcaguuuuguuuugagacaguguuucaccuaguagcccaggcuagccuggauuuggugagccccugccucauccuucuaaggaacuggacaggccuguuucaucaggccuggcuauaacuccuaccucaucagacuggcaccugagcaccucccuuccacacaagcacugcugggagucccuggagagugcgcuccaggcacuuugucuuccgugccacucaaugaauccuaaggacuaacccuggacuccaugcuuguggcuucacugggcauuuguuuuaaauggacacauuucuuguuuuccuugcagcccagccaaacacucuuauuuacuuucuuccauuucagggcuuuccucucucugaaagugauaagcucuaccaugaaggcauucuacaccgucauccgucugucucccacccugagcccagcgaucaggcuuuucacgaagcuagcuguccucuaucucaacugaugcauuugggaugguuaggaacagcuuuaaugaccagcacagagaauccugugcaggcagcaagcuggugcacauaagagagcuguucagacggaugucagggagagcagcauguccaagagagggguggcuucugcugcuucuuucugguauucuagcauugacagcacgcaggggaagcaagaaugaacaccuucugucuuugcauauacagugugguguguguaugcaucugccuaugcagguggacaugcaugcauuguguaaaugcaucaguggaggccagaaguugguacuaggcauuguccucaguugcucccugccucauuguuuccagauaggauuucucagugauccugaagcucaccaguuggccacacuaguuggccacugagcuccagggcuaucucggcacacagcagugcuagaauuacagaugcccguuaccacgcccaccuuugcgcccucgucuuauacacggaaggcugggagacauuauacagcacuucuguccccaaaggcccuuagacuugcucauugacaacauuucuuguuuuaugugaugggggcgugggugucaugcgugcaauugugcaaggauggaagacaggggccaguuuuguggagccagcuccauacagguggguccuaaggauuaaccucucauugccaggcuugccaaauaagugccuuuauccacucagccaucucccuagccccacuugcucuuuuauugacgaguagacuauaaacaauccaguugcucauuugaggucaaauuucaggacugaaagacaguuccagaggacuuugggaaauuggaggguaagugucacagugagagaaaagcccacacagauucucuaaauccaccuagguagaggaagcaagauuuucucaagaguguccucucccugucuccuguauggccuuugagugauaugaaaaagcaggcaugccuaggcuucauguaaguugcuagcgaugcuagagcauuaugaaugugaggacagcacuuuccuucuuguagaaacccagcauuuccauuguucaguaagacucgcuggaaaugucgucacucagucggugcaagaugucccagucuugccaugaugcaugcuucagagagauuuuguuuuguuugguuugguuuuuuuuuguguguguguguguguguguguuuguuuguuugagacaggguuucucuguguagcccuggcuauccuggaaauuugcuuugucgaccaggcuggccuugaacuuagagaucugccuaccucuaccuccugagugcugagauuaaagguguagcucuucagugggauuuuauuuuuauuuuuauuauuuauuuauuuauuuuggauaggguuucucuauauagcucucgcuguccuggaacucacuuuguagaccaggcuggccucgaacucagaaauccaccugccucugccucccuagugcugagauuaaaggcgugcgccaacaugcccggcuuuccagugggaauuuuaaaacuugaccaguuggagcuugagagaugacucagcgguuaagagcauuuacugcucuacccgaggacccacauugcuuuccuggaaugcuaaguggcuugccacugccugugacuccagugacuccaguuccaggggauugaaugccuuuuuuucuggccuccagggcauugcacacagauucccagacuuucucaugggcacacacaacauuugcacauuuuuuuaaaauaauauuuuuuuuaaagacucgguaggugaagccauucauaguuuucguugaaucucacacucguuucuaauucaucaacugggaagacuaucaacuuuagaguauguagcgguuugugaaucgucgucuaaaaggcuagccccaaagauccuggugauuaaagugugaccagauggcagaaugauaaagccuaacacuuacagauguguuuguccggugacaccucugggcaacaccaucugauggguggauuugagacaagagauugaauggaggaaccucccauaaggggacacagcacaguuuuaauauaaacgcucccucggauucccacauuaguguuggagccagaguauugaucaguguuugcaggugagugcagggcagccucuucguagccuguuuuauaugcacucccagagagaccugcggguacggaccccgacgauguuguaaacaggccuugcgaauuccuccugugugugcacccugaaguuaguccaaauucagaacaaagcuuguaggauauggaggagaucucucaggauauggaggugaucuuuuaugugaagaaggaugggauggaccccaggcaaaggaaugugauuucauaugauauaugauuucuaugguaugcuaugauugaugugguaauaugugauggcuaggguuugguuuuuuuuuuaagguuuauuuauuuauuaaauguaaguagcugucuucagacacuccagaagugagcauuagaucuuguuaaggaugguugugagccaccauguggcugcugggauuugaacucagaaccuucggaagagcagucagugcucuuaaccacugagccaucuugucagcccugugauggcuaguuuuaauugucaacuugacauaaccuagaaucacaugggaagagagucucagcgaggaacuggguuggccugugauaugucuguaggagauugucuuaauuacguuaauuguuauaggaagacacuggcuccuugugucauggugguuugaacaggaauugaccccauagacucagguguuugaaugcuuaucccacagggaguggcacuaggaagagguauagccucauuagaauaaguguggccuuguuggaggaaguaugucaccguaggggugggcuuuggggucucauaugcucaagcucugcccaguguggcuccuagucacuucuuccugcugaucaagguguagaacucucagcuccucuccaucaccaugucugccugcacgcugugauguuuccuaucaugaugcuaaaucucugagcuguaagccagccccaguuaaaugguuuccuuuguaagaguugcaaugaucauggugucuccuccuagcaacagaaacccuaaguaagaaagacauaagggcagugccauucucuagguaagggguccugaacugugcaaaaggggagagauggaauagaacacaaacaggcaagcaugucuucauuucugccugcucuuagcugaggaaaggauaugcccgggcugcuugccauucccaccuugccuucccaccaugacagauuuucacuuggcacuguaaguugaaauaagccucuuucuccccuaagugguuuuuuuuuuuuggggggggggguuggauauuuuaucacaauaacagaaaugaagcuaaggcagccuguuaaaugauaaauauaucuuaccauggcguauggcaccuuaugcguuuuggugugacucgugccaaagucauggcuacuggcugagagcuggaugccaaagauuaaaaccgggaacacaaacugaugagaagauucaucugugaaaauggcauucuacugcuacuuaaaacacaagugagcuugguuccagcacccgggauuugccuuucuugcuccuucagaaccucuucaggaagcaguuuccgucugucacgaguucugcuggcucugcagcccgacacuugucagguuccgggucaucaacccugcgaugcucuagaucauuccucugauaauguagaggccccgcggcacugaauaucccacuuggauucaaagugagagggaggaagagaaaccgccaccagcagccauucaggcuaggucucaguuuccaacauccucuucauauugacuuuguggcacuagauuguaucugcaugguguugcuuccuggauacgucccuucucuugaaggcucugucgccucucaauagcaccacagaccagcugucaagcuuuaacauauaagccuuuuggggacacuuauccaagacauagaaggccacucacagagauuuauuuacauggugcaaaaggaagcuuuuccgacuacagggucuucauuuaucuaaugggugcauguguccuaaaaaucuuuguagccucagauuggaacuaucuuuuuguuugcuugaaacagucucagguagcccaggcuggccucaauuucucuauguaagcgaagguugaccgugaaauccugaauuuccugccucugccucccgaauguuggaauuacagaugugugccaccacacaugacuccucugucuccucggccagcuuuuauuuauguguucuuacuuacuagcuuguucuuuuuaaucagucauuaaauuuuacaauagaaaaggaaauauccuacuaagcucaccaaacucagggagcagggaugcccugacguucucuucuguaaaauggggcuaauaacaacuuggcacagacaguuguuugggugggggcgugucaggaagucacauuuucuaugaaaagugucaaaagggagaugcucuugucaccgaucauaugauucagcaugggcugucagcccucucccaccacaccuaggggccucugucaaaugugaacauguguguguguuuuaaaaacuaaacuuaagucaaagcagugaaccuugauaaauugaaaggucaugugaauaucggaccucgugaguacuuuggaaaguaguaggauaauaauugcaguaaguguagaucccggcacaacacauuaacauaacauaauuccacccgaugggagacuacacacuguauaaaacuguaaaaccccagcauguuuugacccauguuuggucugcagcugaccaacgugucugaaguguuugaguucaggguccagggcauauaagugcugcugagacagguaugauccagugucucugaugauagcaccauuguccuggaugaggugauaacugauuuggguuuugaugauggaaagucuuuccagacaaauaaaggaaguagaauggaaacaaaaaaggggguuucaaaggaagaaucgccaaaggacaggaccguucccucuuuggauagaugcuccgcuguagaaucccuucagguuggucuugcauggaucccgggggagccggagggggggggaguaagcugcacaguaaguuggcacuauuaugaaggcucucuccagccuguguucauuuccauucccuccucuugguagccacuguguuucccaaccuucccuaagucuuuggugauaggaagccauuugcugcuuugacacuuuguuagaacaggcugacaugaaucucaugauaaacaagucuaacucuucugagguccccuuaaugacaccugccuuaguuaagguuucuguugccgcaguaaaacaccaugaccaagaaguuagcuggggagaaaagggcuuauucaauagcuugcacuuucacauugcuguucaugauugaaggaagucaagacaagaacucaaaacacuacaggauccuggaggcagaaccugauaaagcagaggccagggaggggcgcugcuuacugacuugcuuccauggcuugcucagccugcuuucucacagaacccaggaucaccagccuauggguggcaccacccacagugggcugagcccuccccccuggucucuaauugagaaaacuccuuacagcuggaucucauggaucucuuugacugucaugacucuagcuugugucagguugacagaggaaaccagccagcacaauaccuaaguuguaacuguugcuaaugaucaagaaggcguuugcuacauauggcacgggcaucagcuggcuagauuaccaacaaugucaucggccuuauggaaggagauuucaaaauaagggggcuuggguggcuuucuguuuucccuccacaguguuuauaaaguaugggccauuguguguuuauaguauuucuguuuauggaugcccaaguuauuauuuuuuauugguuuggguaguuauuuugcacauuuguaaacaauuacguagcuccacagcugucuugccacugaggccauaugugaugccaagucaggagaaaauuccacaagggacucucacugcgcauccucaugaaggaaccaaugccaaaauaauaauaauaauaauaaaaauaaccagcacaggaggucuguuccccccauuacuagaagcuaaaugaauuuagugcucuuuucuuuucuuuucuuuccuuuuucuuuugaaacuuuagaaucagagucaaacuuuguaacuaagucuggagggugucccauguucuacacaugaagagaagauaugauacucccccacaagggauuaacuagcuagaaaaucaugccuuuuauuuuuuuuaauuuauuuauuuuguugcugugggaagauucugccuuuuaaaaaauuaaugacauugaucuauuguguguccaucuccgcugcuguuauuguuauuguuacucuuuuccgaggcaugcacacacgcaugcaucugcugaggcgggggugugggaguuagaguaugaccucaggaacuugguucuccccugccauguauuagucuggauacuggcugaacucagcucucaggcuaagcagagaucuccuuugccugcugagcuaucuugcugguccucucuucuucauaggaaauauauguaugauuuauuuaauaguugauacucuaaaauauaugccuguuuauaugaucuauaugcauauauuuuauagagugugugugugugugugugugugugugugcccuucauuuuuguucuuugaagacacaguuuuucuauguagcccuggcuggccuagaacuugguauauagagcagguuggccuuaaacucacagagaucuuccuacuucugccucuccaagugcugggauaaaaggcaggugccaucgugccuacuccuucuuucaucucucucuaaaugauuguauuuuaaauauguaaacauaugccuuauauaauguguacaaauauauauauguauauguguguauauaugaauauauauauauauacuuaugcuuauauguauguauauauuguuuaagagguucaguuccucccccccccaaggaauuuuuuagagcuaaaaaauauuuauugaguguucaaugcauacaauucuaccuuaugugcagaagugggaaauagagaagucauuggaaucaagaggguagcagugaagaauggacauagaucauguaggagcaagccaugagcuggaaaaguggcucccguggcccuguuaacacaaccuucauuccuucugcacaacuguuaaccugugagguagcagacacuguaggaagcaguaguauugaguggguaaauggagcagcugaauuccuuucuagcagagcuaauggucauugguugagguuaugaccccagugauggaugcacaccuggcuggagagcuaaaccuauccuauagugucccugggcaucagggaagccauuuccucucacagucucauuuucuugucuguaauauucuugaaguagcauuaacuguguauagcucagauccuaggcaccaugagaaagauggcggccaagaaguaaagucccuccaggauucucacagggcauugcuaugcauugcuucugugagaccaccuucgccacaucuauucaggugacaucaaauuuuauuucaggauaggagggagauuuuaaguauaauuguuuccaaagaaaagagauuuccccagacaugcugaaagaacauuuggaaauaggcaucuuuauucaaauaaguacguuuucccugucuucucggguugauaauauuuccguguagccucuccucugaggugguuuggguaacaguuauaauuuaccaaauggaaacaucgcuuagcuuuaagcagaaaguuaagaguggagcuguagccagcgguauuaucuuuuccucgguauagcauggagcaaucaaaaagaaaacaaacaaacaagggggguaaacccacagccuuuauuugcauuuucucccugcaaaauaugauuccuuuuacuuauaguguuuuauuuucauuuuaagcacguccucaccaaaccguuuuuacucuaagugagucgccauucaauuuaaagugaaagguuuuuuuguuuccgaguuuuaauaauuuacauauaaaagcgucaccauaugaaaugacuauguucagauaacaacguuuuggguuuaauuguuccgcucuccgucaagccgcaaugcuaucccgucccuuccagccauccuagcgacaucccuucucaucucaauuuugaaccuuuaguguuuggaaauggaugugagucuuccagaccccaucgguaaggucucauagacuugaagaugaugugcagggugugugugugugugagggggcaacccuagagcaucuucgagacaaucugagcaugacagugauacagcucuuucucaauuguuuccucguguuuuuccccaagaaauuauguuuggcagcgacagucucaguuaugagaagcccacacuaaaacccuuacaccucauuuugucucaaauuauacauguucuuucuucuuucccccuuaucuagauagauagauagauggauagauagauagauagauagauagauggauagguagaaagauagauagauagauagauagauagauagauagauagauagauagauagaugaguguaguucuagaauaguccuuaggaaccccuaauucuugcucgcucagggacucaucucagugcaucuuugagaaaugcagccauauguuuaggaucugggcugccauauucguucccagggagucugccagcauuucaauuucuugacccuuaaauugaguugaggcucuggcaauauaagaggaagaaaaaaccuugaauuuacaguucugcaagcgugaacaugcauuagcuuccauggucgcuguugcuugucuccucugaagcuuagggcucuucuucaacagcuccauuaucagagcagugggcagagcaucuuccucccaaagcacacuggaucauuuucuccgggaccugaauuugauggccugagcucaucggguggaaaggaaggucuagcucccacagauuguccuuagugcacacuuaugcguacacauuuaugcacugugcaucaacaacacacacacacacacacacacacacacacacguuuaguuuuguuuuaaccaaaagauaaguucauuucccuuucccuauugucaaacccagagcucaugucccuugguggcacgcugcauagccagugccuagagccuggccaugcaguaucugguuugccaccgcuggcuccuguaccuucuuagcuuauguguucagggucauugagcguugacuacauauauaacucucagcccauaauucucagaaaccaucgcuaaugauuuaggcaccacuuuguguucugcaauagauaagugacauagacacauuauagcccacuguugauuuacauauucauugucugucuacaacaaaagcauuuuugccggauauaguggaccauaucuguaaucccagccuucugguauauaaggcagacugagaucuugcuauauagcaagaguuccuggguaggaagggagagaggaaagaagagaaggaaaggaagagaguaaagaaggaaacauggaaagggaaaggaaaaaaggagggagaugagggaagcuggcugugcaaucuccugcuugcuccagacuauaacaacaaauggguauuugauauuauauauuguagcuauauauuaacuacaggcauagcauauauuuguugccucauuuuuccuguguguuucugucuucccugcuuucuugucuuuucuugcuucuugcccaucacugagguguuccauucucucccagagcaucugaggaguaucuucucugcugcucuggccaccagagcucucuuuguggucaaccuggacaacugcacauugcguucccaauauaucaaagccaaaagcaagcaugcugugugcccuguguucuugucccagacagagccaguugauguaacagccuccaaauugcagugauuuaacauucagcccucaguauaacacggauuugcuuguagcuguagacacaguguaauguggcuuauugcuggaugucgauguuaucuguccuggaacuuagcccaaccugucugcgcuaggcuugaagaagaggaaaaggauaaacagacugugugagcucaucucugggccacaccugagacguaagaucauccuauuucaaccucauucucuuuugcaagaauccaggccauccagcaggaagagggagguggcucuggugacacgguagccacagcugccuguuccgcccccccccucucuuucauucauaaucuguaauuagaucuguggcaagugcucgucacuaggugagcaacucuuuuacagcccuggauuccagcaaagaacgaagcccaaggugaucgaguacgauccucagacccguuaucucuucuauuaacuagcagcguggcuucucugcugccuucaagggaaagcagagaguccucacuuguguaacuuuucccaacuaucccucugaacacucucucguuuccuccucuaaucuugccccuuucugugcuauagaucuaaaugcagaucaucuuuguuuuaauucauuuguaugcaggugcacucacaccuguguguaugauugaguguguacacacacacacacacacacuaaacacacacacucacgcauaugauguguacaagcauagauauaugugccagugugugcauggauagaagccagaagucaauaucaaguauguuccuugguuguucgcuacuuuauugguuuauuaacuaaaauuguccuuugauaguuucacacguguggugugcauaaugcauacugacugcucucacacacaaccauccuaucuccccucaagccugccccuacuccugccacccgcuuucccuagagaucucguucucacauuccuaucuauuagguuuuuuguuuuuauuuuauuuuuuuuacuuuaugacccauugcaauuaaccauggguuugaaguuaucucuugaagcuuuauagccucaguuguauagguggacagcuaaagacaaugacucccucuuucccagaauguuauccauagcagaauggggaaggaccccaugaacgcucccugccuacccaaaacugauuguucacagggccagucuuguauagguguagugucguuuuggagacagggucaauggaccuggaguucccugauuggauagacuggaugaccugcaagccccaggaguccuugucugucugucccauccagcacuaaaaucagagacccacacacugcucagcauuucuggagguacgagggguccagguucaggcccucauguuuguacgcuaugcacuuuaccaucugagccaccugcccagcucccuggcagaucgguuuuuagcacuuugguuuugagcuguauuguuauaaugcaccauacaugcauaaugcaccauacauacauacauacauacauacauacauacauacauacauauauauugcuucuauuugcuaguacagggauaagcaccauggccugggaaguuuagggaagccaauaccacucacacaaaauccucugacaggaagacaaaacccuuggagaaaacgccauccagucccuucucaguuuacaucaaaaccguuucaccgcccuugggauugaaaaucacacccugugagcccugcgucaacacugcgugugugucuguucucugcacccugaagcaggcuuuuuuuuuuuuuuuucuuucuggaaagcaguugcgaaugacuugaugacauuuucugugugcagagauuucuagaugugucuuauuccuggcacauucuccuaagugucuccacaggcagagggguaguaaagaggccuuagcacauaguaggugccuuagacugcaggucauuugaauagcuagagccagagcccaguguucucugugcuggaugguacuugcacaugauguggucugccguguuuuguggaaauagaaguugcugaguuuccuuauuggcaaaaugaugggagggggcuuggggguguucuggcaugggcuaucauuuccacaggugaccugauccacuggguagacuuaucuugcucugguggugggcacugugguugacaucauccuaacgaggucccguucucucuucugucuuuagagcugagggucagauucagguucucccucauaugggacaaauuccccgccacucaaccguaucccaggcagauagcccuucucuuaaggacaccugucugccuuugggaauuugccccucccugauacacaaggcauggucaccucagaaccauaagaaaccccugagaagacauccacaccacuuauaaacaagacucaucagaugugucuucuuggcgcugguccucaauauacacacgcaucacuucuaggcagcuccagcucacggugagcacagagaccagacagacgaaaggauggaaggaggcaaggaucagcaggcucaaucuccaagaugaacugaugccucuguucugguuuggagacaggaaagauacaacccauuucucagaguguaguuuauaguccaugaacuaaguaaggcaguagagucagaaaccccagggccuaaacccagggcucagggccuguuugcuucuucuuuuuucuuucuuucuuucuuuuuuuuuuuuuuuucaauacaaggcuaucagucaauuacaauucucugggggagaccauaaaaauuaggaaaagaucugauggccaagaaaaaggaguccgauggggggcacaaguggauuccauuucuguggccccauguagucacuagggacacacacacacacacacacacacacacacacacacacacgugcacgcgccuucucucauucccauauugggcacccauucacaucccauacagacaaccauaauguacuuaguuauaagcccccacaacacaaaauggcuuccugguauuuacuguacaaucccauccuugccuugaccacagaagcccagaaacugauuccagagcagagaauaucuuuacaaagcaaaaaguuggggaggggugacaccaagcaucuauagucacugggauagauaggacgaagguuugaaagccaugugccacagaggacauucugccugacccuguucuucaggugacucccauugcucuccugcccugagcugaccuaacagaaagucauguguacaaggucacauuuguggaagugguguccagaaugcacccuguggcugaguccuuacuuaacuauucccucaccugcccuuuacccaggcgacacaaucccguuucccguuauccauauauuuuuuucucucaauccauuucccccaucccaaaagaacggcguuagcaugcuucagugagcccagaucaacagggaggggcucugcugucacagucaaggcugcccuucuucaggccucaagcaacacgagguagccuucuaaguggcggcugccaccugccuccaaguuggagguucugauccugucucucaaagaaagagcucuguuaggcaaaagugacauucugcaaggcccugugcgugucucauaaaaguuccuaaggcugucauuggaggggaagcagcagucauuucuggauuugggaagcugccagaguuggggagaucauguucccccauccuaauauuaaauaugagguaugcgugugcuggggccaucauccugacugcgauuucauuaccauuguaauuagacaucacaucgguauuuauacauaacuuguaauucgaagauucucucuguguaugacucugggcuuuacaaaugagaaaucuggguucuagcuggccagggggauggcaugagagaauuuugaaauaaugagauuuguacugcaccaaagccacuggcaucuuacaauacuauguguauucucucaccucucuaagaugguggaguguguguguguguguguguguguguguguguguguguguguaaagagacuucuuauucuggcucauccauaaacagucauucacacuuuuuuuuuuuuauuauugugguugguuuuaauuuagcauauguugguuuuaacauagcauguugcuaugucugcaccugaucccuaggcagccagcauggcaaagcuagaaaacagccuuauuaucuucugagacuucccauucguuuuguuuugcuuuguuuuguuuuguuuuguuuuauuuuguuuugaggcacaguuccucuuuguagcccuggcugaccuggaacuugcucuguagaccaggauagccucgaacucagagauccaccugccucugccucccaagugcugggaucaaaggugugugccaucacuuguaggcuugaccucccauucuuaggaagccagcccaggugcccccagccagagguggcaggaagggcuggaucuggcgucucccaugacacccgugugacuucagcagcggguugguucaguguccaggugaauguauucaucaccuggacuugugacagcaagacuuugguuuuaucucaagcaaaaccaacagggcugugagguuugugaggccugcgcuguggauagugguuggcagcauccacugccuugggccuuuguacccagcugguuguaggauacgggaaacgacucaaggcaggcuccuggcauucugcuaaggagaaggacccuggucaggaacugugcuaagaguuccaggugaggacgggaagcuagaauaggcagugcagacagugugccccuccucacaggcauaggggugccauuuaauuucucugagugcuggaaggggacuuggugaaauugauuuggcagaaagguuaauguguuauggcugccaauuggccgauugaauugcuaguaauugaggaaggggaagcuuuuaauuugacacaauaaaggcuacuccaccagagcacauaguuuagauguguauguguguauuugugugugugguauguguacaccuguguggggcuacguguguaugugugugcuuaugugugcaagugugugauauguaugcacacguguauacauauguguuuguguauaugugcacauguauaugcguguaugcaugaagugugugugcaugaaugcauguguaugcauauguacauguauaugugaggcuagauagccucguuucccaucucaaccuccccaguuuuaaaugaaguuauuaucauucucugucuauuuacaggcccugacuugaaacccuacagaaagcacaaaauauccaucaaccccccaccuuuuuuuuuuucaguguaaggccauauuacuguagacauguaaguacaggcgcugugucuuacagaccaggagucgucuuucacaugggcuguaccuuuguuaucccuagggcaggggcgccacagcugcaggcugugcuuaguauccacauguucuugguucuguaaauaaaguuuuauugaaacagagauagcuuacuuauguagggacugccuagugcuccuucacaugacgaugaauuaguucaguggguggcaaagauaggccagcaaaagccuggaauauuuacugcggccuuuucuguauuaacgagagcauuuacugaccccugagcuuugccagauuuagcaaauaaaaagaugcccacgugcaucugaaucacccacaaacaauaauuucuagcgaggaagcauucugagugugacuggguagcuuauccaucucuguuuuccauagggaagcccugugacccugaacaaggguauuggaaggaaccagaaucuccuacuuguauaugccuuuucuuacagccuguuuuaguucauauuuauuuuacugcuuuguaauguuauguguaguagugaauacauuauguguagauaaauauauagguuguguguguguguuuguguauacauguguguaccugugugggcauaugugugcaugugugugcauauguauacauguguaugcacauguguguguauauguguuuguguaugugugcaaauguauauguaggugugcaugagguauguacgagugaguguguaugcauggaucuauguaugcaugaguaaauauguuuguacucaugguuuguauaagccgcuguucugcagcagccuagccggcccacaguguguccugaauuuaacuguuuaugucugcgcagucucugaugugacccuuaggccucaguucucaaggguuucagcaaccuuguuuucuuuucccuuugguugacaacaugaguuuuguccaccauaucucuggaucuggugugcuugugaaacuucuuggagugccaagcaacuagucagcuugucacagcgaccauccuacuauaguagauacuaaggacuucuagauauggugaccuaucaaggaaagggccacauacuuccuggaaccccccagagagagggaaaaaauggaguuagcauguggagcuuccucagagucucucaugaacaucguuucccugcccccgauuguucccagcccagccaggagccaggcacaugcagguucauaagcaggaagugcacugcaucaggggaaggagacagccuccucucuccccccggaagccacauuuauacugucacugaacgguggugacagucucuaaggcuucaucucugaacaggucauucacaguugguacaguucucaagcaagaagguuggcaggaugucuuaguuuacuuuucuaucgcugugauaagauaccacggucaaaacaguuuagaaaguauuucauuuaagcugaugguuucagaggcauggcggcaggaacagcugagagcguccaucuuucacugcaaguuagagacagagacaccacacugggaauggacaggguuuuggaaccuccaagccugcccucagugacauaucucccuguacaaggccauagauccuauaaggccauagauccuauaaggccauagauccugauccuuccguaacaguuccaccaacuggggaucagauaugcaaaccuaugagucuguaaggcucccucuccuacaagccaccacacaggccacagccauucugcacuagagacuaaaugcugucauguaccuuauauaaguggggagcuccauuagccucugaggccaggggucuguccucugucaccauggaaaugacguuuuuugccuucccucauuccuaaagaacuuccuugcacugugcucuguacccaaaacaaggcuugucaagaugguaacacucagcacacgcucagaagaaacacuguucauugcagauuuuaaauaccuaaaauauuccuaggaggugugaugaguagagagaacagcaguggauaggugcuaguagugcccauaagugcuaguagugcccauugcucuucugugugccuuugguugaugaagacacuggauccuaagugacugaagaacucacuaaaauaugggcaugguagugcccaucugccaucccaucagagacuaaggcaggaugaucaugaguucaaggacaaccugggcugccuacugagaccucguuucaaaacaaacaaacaaacaaacaauaagcugccgggugugguggcacacgccuuuaaucccagcacucgggaggcagaggcagguggauuucugaguucgaggccaaccuggucuacagagugaguuccaggacagccaggauugcacagagaaacccugucucgggguggggguggggguggggaaccaacaacaaacaaaaacacuggaacuguagcucagcgguagagcacuucgcugguguucucaaaguuccagguucaaugcccagcauaaccagcaaaaaaaaacacacuaagaguccaacccaguuuagaguagagauuuguuagauuuuagugcugaagggcauguguuuguggguugcuggaagggggacaacuucuaaaaaaaaguccccuccuuucacuuuguguaucccaaggauugaauuuaggccguuagauuuagcggcaagggccuuuacccacggagccacagugauaacccuuagaauggauuuuugaauuugaaucugagucucgcugucaaaaccagccuacuacacacagucagucucacuguuagugaacugacucacuggucaggucugaacgagcauccggcuacaccaagugucuugaucuguuccuucuaccccuccuuccagagccuggauugccaaggccuucagaaggaacaaguaaaauuuccacucuuguuggucaucuccccuggggcuaugacugguuuucccugucucccucaccauugagcugggugcuaaauccaucaugugaagggagauccuuuuauuauucaaugguguguguguguguguguguguguguguguguguguguguguguguguugcgguggggguugucaaucccuggggaaggcuuuguggaaucuguuccccuugccuuuuuuccuuuggcacugucuagaauuauaacuuuuaaagcccuucuuggcuggaggauuuuuuauuguaaacauaaaacguucauugaaacauuaaacauuuuacagcuguuuuucagcacauaaauuuucauagacacccaccccucucacagccacacccccaucauauauuucucuucuucuucuuuuucaugucccuucuccccaaaugguuccaaaagaccaauguucaggguaggcagggggcuagaugacagaugaaauacggcgguugaaguagaucaugccauuuggaaaaaaaaaaaaaaaccacacuguauuuuaauaggaggaauguauauugugacagaaccaagccaaggaaaggaaauucuccugcuguuccuuccagcccuggcuuaagccucugugagcagaguccugccccagccccugcuuagaaaggacacagggaaaacccaggacgugucuccacuuacaucugugcuuggagaagagcugacuccaaggaagucgugacucaggagagccagucugggauugguccaagagcaccuuuuggcuuaguuaaugcauggauguugggccacuuaucaaagcaguguccaccagaaagcugacuuagacuuaggcccgaaaucggcaggaugaucuuaggagcugaggugcauucguuaccuuucuaaucccugugauguaauaccugaccgacgccaggaagggagguuucuuuuaguccaaagggaugccauccaucauggggaggaagacuugucagaagugggagaauacugaucgagguucaucuguagucaggaaacaaaguggauaggaagugguaaaaccccaaggcccaucccauugaccuaccuccccccagaaugccucuucuuuuucuccuagaaccuuccaaagcagcacugacagcuggggaccaaguguucaaagacaggauuuuguacgugugcacaugugcacaugaguucaguguuaugguagggugucacacccacuuggagcuugaguuauaggcaugugagccauuagauguggguguugggaaccaaacuaggguccucuggaggaguaggaaguacucuuagccucugagccaucucuccagcccuccagguacaauuguaagauguggcuugcuucuguugcaggcagugaugcugcucaggcuccagaaugggauguguguaauuugugacauuguacaacccugagcagcacgguguacucucaggccaucaugcucugucuaacucagaacuguguuaucccgcugugcagugugucccugcugcauacgcuaccguccaguaagucacuugcuaaucagaccgugugcuguggcgggguagcaccuguguuccagccaucuuuaguuuacuuacuaacacaaaaguaaugguggcagcgcccaagaacguaaaggaaaacauuggggaacuucgguaggugaaacuggggucccaggggggcacugagugcauuauauaaccccccccucuuauuuucugcuuuugcugaccuagaauaugaguucaugaccuuauauggcaguccugugaugggaauaaccugauggagauuaaaguauacuacaugccagagucauguccuaguucugucuccaguuuauuaaaaaagacaaaucaguauacauccaaugacugaaugaaacuugucuacgcccuuaugagcagcucaucaccagcaucuauaaagcagcccaaagguuauaaguggauaugacuauugcccguuaguaggggugaugagccuuugcuggccagucauuugcuugucuccaccuucucuuugcuggacauucuccucgauaccuccccuccccgggauucggugauaaauagaacacaaguaaccuggccccuacuggccgugauguucacucuucucucgggcuugugccccacccuagcaacaaguuaauuuucuaugggaaagacccgagaucuuauuacaguguggacaagaacaucagcaugcccuaacugguuagcagcuggcagcugagugaagucacugaacccugauaggaaucagcggggagauuagguaaaugcuuauuugaggugcugucagggccacugugaaggguucccccucggaggcuguuuucucaugugcacucggauuacaucgcucagugauauuccaucugcauguaccuugcccucugacaugacaaacacagaugccgccagaauccguacaaagccguauaucucaagcaggaaggagcaucuuugggaggagaauugauuugcaaagcagcccaacacacgaucucuuauaucuccucacaaucaaauaauucaucuuuauacuccuugggggccacagugaaacccaaaccugaaugaaacggaggaccgcagggcuuauccguagcagccagagcagagcaguuagccaagugcagucuaaaauuaucagucgcugaacauagcccagccgugugggaguucucauuggccagguugggcacuuuuaugggaaucuccccucccauucgucagggcugguccaugaguggcuguggucccacugcacagaugaggaaagugaguccuggaggacuuauauucccugccaugcagagaggaaaggggggagggggcuuuuuaagaguucaaauuaaaaacauuaaaaccuuuaaaaaucccauagcuuuuuacauugaguuacccauguuaacaacaguguggggauggggaccgagauauucaacauuuagguuuggaguugauagcccguuagaucagcguggagcguuugguguuuauuuauugcuucccccacccuuacuguuagggauauauaaacuagguaaauauuuauuuuaguagagaaaaauaaaagugaagaaugugcauguggaaaauagcggagcaugaaucaggcgagaggaaauguuuucgggucucguugagaaauagcuaaggagggaaaauuacagaucuuaaaauagacgcaauauauuauacagcugugaaaacgggccaacuagauugccugcauuaaagccguauuggauguucaaaucucgaguuaccuggaaugcgacuguacuuccuauauuuaacuaggcuuuuuauaaacucuuccuuuaacaccucaagcucacaaacauaucccacgugguuauuugguaucaaauuugacuuucuccacucugagaguccucaguaggaaaucuagaagucagucuuccagaaggguucuacuguuguccucuccuuacaucuccgcaucaguaguaaauagucugcgaugaaccaaaagcuggagaaaaauaggccggcauacagaaagaacuucuaaguccuuuucgcucuaaccugacguucgagcaaauguaacagaaaacauuggcgaacuuggccccuggaguaucuuuacaucggaagucccaccuccaccuggaagucccaccuccauccagaagucccaccuccauccggaagucccaugucuuguucuguuaucuccauugcugccuugccuuccccugucugcagucaguggauagguacuuagugaauuuucagauaguaggcauccagugugacugcagacagccugagaucaaugugucuguuagguuagcaagcauacaugucauagcuauugaauacguggaacauuacacauuccuagauuagugcuucuaaaaggacaggcacagaauaaaaagagccaaacuguucuucauaugugcugucuccuuuugccuuucuucuugaaugcuguacccuugggacauuuuuuuucuuuuauccagacaauuaguguuuauuaaggaagacgcucauguucugacccaccgaccagagaugaacaaagccuucagaaguucuaguuguaucccucagcaccggugacugcacugguauaguuagcuauggguuuccuucuguuuaccugugcacaguuuuucuuucuuuguuuuacguaugugugggugugugugcaugggaaggucuguugcuguacacgguugaugcuguuaaucauccuugaucaucuuucgaccuuauuaauugagacaaggucuuucuagcaaaccuagaauucauauaugggcuggucuuuuuacugcggccauuggcauacagauucagauuuguguuugcgugucugcuuuaaccgcugagcaguacagccaaugguucuuugucgugguugguuaggaaaacaagaggagguguucucaugaucaacugggcuucuggcccuggcgagcugcuugggagggucuacaggccuucaguuaaagagucgaggagucaaggucaggagcucuauuuacucagcagagggcugauaacucgcuuacaguacuugccccauggguguuccucaucugcuggagagguggugucaugccuagguacagggcuugcucuuaccacaugaugaugaagacuacauugggcgacauagucuagauucuaggucuggguaaagcaggcuuaguugcucucccuugggucauguccuauuuugggaccauaggggcuuucaaugcuaauuaucuuaagucugugugaugauacagaauggguagaaauauucauuagguaauaccuaccaggacagccauagugcucguacacuguucaacauccccacauuaguuggucagucaucuugcucugagaugcccaggugucucucucucucuaccuuccacgggaauucccagucaacucaccaccugaaaaguuaauacuuuuuuuuaccggggaagggaacuuuccaaagacaugaccagagcuccuucagauugggcuacaacauaccuuguaaauguguccaugccauucuuguaaaaggacacucuuaagagcaguuuucaagacaucucagaucgcauuugaccauggaagaguccugcuccuccaggucccgcccauaugguguuucauuuuccuaguacuguaauccuguuacucaguacuacaaccucacaagacugcucucaggauggagugagaagaacucaugcugagguuccauuguucacauacuguggguccuuaaaaagugacauagcaugguuugaaaucuuuguuuggacacuuaaguauugcagguaucuuuggaaguacacuguggucauuagauucauaaauucauggauucacugaguaaugucccagucauuguaauuagcuuuucucucuccucaggaguuuaccgcuucuuuggguuggggaaccuucaagcucuccucuccuugguuuuguuugugauguauaaaugacuugcgucaagggcaucucccuacucucuuguggaagacuggaacaaaucaacugucuuuugguacccaaucauucaaccaucuggcccuguuccucuccaaguuccagccacuggugacccucaugcucauagcagcuuuccaacugugaagaccucccucaggagcuuuaguugagaggucucagccucacagccaugggugguggaaagggggaagggagcgaucaugaaugaauaacacacacuaggggaacuugaacauggaucacucuugacagcugcagauuguauuccuccuucacccucaguuacccgguagaagcaacucaagaaaagaagggguuaguuuaacuccauccagacugagacagcauggcaggguucauggcgguaagaccacgugacugagaaccaggaagcagagaaagaaagccagagacuggacuguaacucuuaagucccagccugccuuggcccacucccuccaaguaggucccaccuucaccaacucacagaacagcauccccagcugggccaagggggaaccuggaugcauuucagucaaacccuagcagggaccuugaccucaugcacuuuguccuucucagcuggaccugucaugugcacgguguuuuaugaaugcuuugguuucuuuucaaaacugugcuuacuuaauguguauuuggaccucccuccauccuaccccaccccaccccaccccacccccacccccacccccacccccaaaucaacaaaaugggcagcucuggaugccagagugaaggcuguugagacaggacagaacuccagaagacccuuaggcauaauucaggaugcucugaaguuuacggaguccaggauucuauaaaaagauuaguuaggcaauaguuuacuuugggccauuagaagauggaguagagccaaauauccugccaaacacagagaaagcuggggaaagaaauuauuuuuaguguacugagguauuaauaauauuccuguaggaggcucauuaguuauuggugcuuuguacugauuggguaaauuucagcuguguguguguguguguguguguguguguacacaugcauucaugaguguguuguuguaauguaacguguuuucuguauacucauguuuuuccuccugcccccaagcucccagaauaaugacccugagacucaaauauauuuacaaacacccaggccauauaacuaggcaucuuccccaacuagcucauaaugcaaauggauggcucaugagcacagccauacagacuucuuuuaaaacacagucgagcaccuauuccagcuagcuuugggauggugaacaaggaacccagaauccaugaugguuucgugauccuccauuccaggucuugcugucuuugcacagucuucuguucacugacugcacagccagcaggaucugcagagaugacuagaugcaacuucugagucuuguccaucacucauggggaucacucacugugcgggagagaaagcugccguguugugaggacacucagucaccuguguggagaggaauccagccacuuccacuuccuacgugagggagccaucuuggaaguugauuccagagcucuaacugaacccuugauggcuacaacuggcucuaguucugauggaagcuaccaacauggccccaagccagaauccccaagcuaagcagcucauacuuuucuuagucaugacacccugcacgaaauauucaugucuauuauuggugcagucuguacaucuuuggaaugauuuguuacacaacaacagauaccuauaacaacuagaaaaaaaacugauucuggcugccaaauuagacuccaaacuguccuauuuggaacuaccaacugaaaaugagguacggcugggcagugguggcccaugccuuuaaucccagcacuugggaggcagagucaggcagagcucuauagauucgaggccagccuggucuacagagugaguuccaggacagccagggcuacacagagaagcccuguuuuaaaaaaccaggagaggagaggagaggagaggagaggagaggagaggagaggagaggagaggagaggagaggagaggagaggagaggagagaacaaagccaggcaugcuuuaguaaguguggucuuaccagacacuguccacugcagaccucuuucccccagaguuuaucuaauuggcccaacaggauccaggcuacgugaguuuguuaaaaccacuacuuuucauggguagcggcuuuaccuacuuaacaaauagauggguuaauccugcaaguguuaucuuauaaauauugaaguucguuuugguuuaagccuucucaaggaauuaccaccggcgccuucccuccccaugcagacugaguuuaucacauagucucugggauuugggauuguuguuauguaaagucugaagaguggccgggaagacagaaggugucagcugugugggacauaggacacccuguuauuaugguuugaguauuuagugucccacaaagguucagguuuaaguguucagucccaagaugguguuccuauuuugggaggucagggaaacuuuaggagacggagcccucucggaggaaguaggucauuuggggcacgugauugaggcucuuguaucuugcccucagccauuccuguuucuugcucagcuuccagucagaaaugagggaaagaggcuucucuaccacguguucccaccaccaugaugcuuugcccaaauguuugggucuacauaacgccugacuggacugagcucucugagacuguaagcagaaauaaaugcugcccccccucccauuuuaauguuguucuuucaggcaucuugcccuauucaugagaacaccgucugacccaccucacugguaagcaacauggauaacuguuggagccuucccugugauagcuaugauacuagccugguccaugaaggaaauuaaucucacagccagagugcugagucacagacucauuuucuacagcucuggaagccagaagcucacaugcacuguagccacugcaccaaguucuucuagagggcacucugccuaguuucagagguugcuucuuagugugucuuuagaaggcaaagaacaagagacaaucucucauuccgugcuccuccuaagggcaauacugccagccauggggcagggggaaggugcuccaccuucaugcuugagucaccucccagaggcuguagcucccaacgccaucaucugguggcucagagauccacagaauuacagcucgcagcacugaccuugugcugagccaugcagggcauuccuuuccaaggccugucacucuucaccugcucuucccuccguguccuucuuauuuaauuuuuaaagccuuuaagauuucauuaauauugaaauuuuuuucucuaaaucaauucauagauuuauuaacuuuguuuuaaaaggaaucuuucuaucuccauuaccaagcaaagaucaauaugguuugccaaaaauagauaaggauaaaacuaaaugauguagagaaaauaacuauagacagauauuguucaucccagcaaacugugggagccagaaaagagcugaagaccaaggcuuguucuccuuucauguaagcaggaggugggcaagaugcugaugcuagagaugaacugaaccuaaagcaagauucugucccaucagaagaacugaacaagguuacuaaacgugaacccuaacccuggggagacuguauaagcaccccugcauugccucacauguguucuccaaguauguuacccuucuguauccucugacuggucaacaccauuccaagcaagaaucuacucagcuguauaucugagugugugacacgagcccucagaccccagacuccuaccauacucuuuguuguucuggaccauggagguugagaacggcagcuuugguacauacucuguccgcucuugcugcgugauucugaguguggcaauggaccucucugagcccauggguaaaugauaagaaacacucauuggacuguugagauggccaaggcugaugcuguguguguguguguguguguguguguguaugugugugacauuucccuucauuccaaagaaguuacaucuuaggcgcuguauuuguauugugcauuugaagaguuugugguugaauucccgaaagcgucuucuuccucugccuacauugucugccugaccgccccucccucccucccucccucccucccucccucccucccucccucccucccuccguccauuccauuguuuagaagaaaaauguccauuucugucacuccccagggcuauaguucagguggcaucucuccuugcugagcuggaggcugagccaugaucaagccaucugcaugcuugguuuucgauagucagguugcaccuagccacagacaagagauucccacugacuuagcuuuugaccagcuaggugagagggauggugcaugagagaagcaaaagaggaaggacuucaugaaagagcaucauguucauccacugauacccacaccccgugccuggcaggaugccgucagggugggaauaacagaacaucaaccuggagccaagcauacaagaaauaaauuccuaaaugcguugauuaugaagagaauggucuccucuaccccaacaggacugguuauucuguaugccccucuuauuuugucuggagccccauguuuaaugaagaccaguccagggcuuguuuguuggcacaguggagcuguugcccccuuuccucacuguccuguaguuugggggcaaagcugaaugggauugugcggacccuagcaccuugaaccagagaggucuacucuccccggccuccccuccaucaagugcugggcugugcccuggaccccaggaggcugagcuugcaaugcaccagcuguacaggaugcaggcaggaucuggucugaggcguccagaaguggcgaccuaagugggaucagcuggugcuucagcagaagugucauuucaucaucuucacagaagaggcaccguguucucucacagccagcaguuuguggggcgccauauugucuuugcucucccagccccccccccuugccugucuccaaauaugucugcauauuauuaaacaucucaguguuccugucaggaagaguuguuucauggagagagaggucccuccaguccagcaagaggcaccuuuuggucaucuuagcuaagaagagcucauggcuaaggggagaugccucucuauucaauaaauuuaaaccucccaggacugaaagaaagugcuguccuucaucccuccggguauuugccaaccuuagaaaacguucauuggccacgugagcgagcuauaaagugaagaauucaguuuaucaaguuuguuacagucuuuuuuuuuuuuuuuuuuuuuuguaacauaagaggaaauagucucuuagcaauggccuguuaguuuguccuguggauuuaauacucagguugcaugguggcucgcucuuccuuccuuccuuccuuccuuccuuccuuucuuucuuucuuucuuucuuucuuucuuucuuucuuucuuucuuucuuucuuucuuucucucuuucuuucucucucucucucuuucuuuccuuucuuucuuccuuccuuucuuucuuucuuucuuucuuucuuucuuucuuucuuucuuuccuuccuuccuuccuuccuuccuuccuuccuuucuuucuuucuuuccuuucuuuccuuucuuuccuuccuuucuuucuuucuuucuuucuuucuuucuuucuuucuuucuuucuuuccuuucgcucucucucuccuucuuuguguuaugucaaaacauacuauuucucaacuguauguucuauuuauuaacuauaugugaaggugcucauucagugcugucacguuuacuugcaaccccaugguccuuaggaaccuguccucauccucaucucauccccaugguccuuaggaacccguccucauuuucgucugcuuucuauguuuucagguacuuaacaguauaccaugcccugaaacuacuauguagaaaauucuggaacuaagcaguuuauaaguucugaaagcacacuuccuucuguaaaaugauaaaaaucucacgcuguccugcuuagacaccuugaaugaccauggugugauggugauuacacagggccgugcucucugcaguuccgggcacccauugcguuucuuggaauguuccucuguagaugagggagggugucuauugcauagcuaguauccuuccauuuucuccagcacaaacuguguauguauuaaauaugaguaacauccuucuugguccccaugauaacccaugcuccacuuuguucuucagugaagcuuccccuucuaggacucucauacaauuggagucugacaguacgcucuaggcuggcuugcuucacucagcacaugccuuccagaucugucccuguuguaacacauggcaagauucccuuucuaacauugcuuugucuuuugguaguuucauacaugaguacaguauguuuagaucauaucucccuucuaccccccacuugugagucucuucccucccccuguuagaauguuggcuagcuugauccugugcaagucuuauguuggcagccauagcugcugagaguuuguggaugcgacgacccugucauuucuaggagacaguauuuagcagcaguccuccaugacuucugauuguuacagucuuuccuccccauuaucccugauauacccauagccuugugggagacaggcucaaguuccuucauauuuuuuuaacgguaauauuccauuauacaaaagccaguuuaguuuauugaagaugcuuggacacuuugggcuagggugggcagagcucuuaggaacuccuuuauacaacuaucuguuuaaauaucgcccucagucccuuugaaaauuuaucuaggagcgaaauggcugggccuuagaauggcuccacauucaaccuuuuaacacuugucaagacugugcucuuacauucacgcuggcagccugugagagucaacuuuaucguaaccauuagccaauagcaguugucuucccuuuuccuuucuuucuuucuuucuuucuuuuuuuauuugcccuuagguuuuaguuuuauuuaaaaagauuuguucuuaauuauggguaugugucugugugugugguuaugugcacauaugagugcaggugcugucagaauccaguagagggcgccagagggcgccggacucccccuaaagcaaguagcagcuaugagugcugggaaccaaauuugggucuucuguaggagcagucugaacucuucacugcugagccaucucuccagccccugccuucuuaguuuaaaacagugacaucuuacugugacuuuguuuucuauuucccuaaccauuaauggugucaagcaucuuuucaugugauuuuuguuguuguucccucaugucuucaucuucuuugaagaaagcaccauccaggucuaacacuccgaugccuugucucuuccccacuuucccuuggcuuguggcuacguuccagcaacucgaguuucaagggcacuaauuuccuccgcugcucuuuagaauuugagguaaaaagaaaacaguaauugaaacagacagucguuauuuacaucugggaggcugguauuacacacccugaugcucuuucauuagcuguauuauauucuuauuauguguuuuacuagguaauuguaaucuguggcuuugggauuuucuagcuuucuuuuugguuuauuuuuauaaacagacaacagcaugagucuaaaagaacagggccucaguaggaaaaaaaaaaaaaaaaaaaaaaaaaggaaggcgaaggagaaugaaaccccaagccagccaaaggagaucugagggccaaaaauaacuaaauaagcccuucagagcuuacuaaucuccacacagguuuucccuauaguuuccagaggugacaaaaugggcucagucgcuuagaauguaguuuguugcucuaauugugaagaauuuuaauuagccaguauguuuuauggugcaaugaaacgcucaguucggagccuacgaguccaucucucuguggagcgagaaaaugaauauucucaccagagauuagguggcaacauagacaggacugucuagucaaagagagaggaggccaggacucacuaccccugcaugcuaacaaaagauggcugcuauaccaaagagcaggcagggcagguuuccacucacucauguugaccaucagaauugaaacaagccccgcaaaggucuggcguuggcaugacgaugcucuccucuuccagccucugcucgauucggcuugauuaugcuccucuaagagggucacaagacuaggcgugguccucgggcucuggcauuugauggcgagguguuuugauauucuaaucaguugguaguaggauggaaaguuuaaauggaaaucaucugaaccauaccagguguucuuucagaccaucuacugacaacugagaguuuaggggaaggccacccauccauccauccauccauccauccauccauccaucuaccuacccauacccaccuacccauccacccauccauccacccaacuacccauccacccguccaucuacccaccuacccauccauccauccauccauccauccauucauccauccagaaagccagcaacucauccauugguucaccuguccaucuauccauccaucuacccagucauccauccuacagucugcccaccaaucuauccaucaauuccuucaguugcucauucaucuguucauucacccaaaugcucuguccuuccauccauccauccauccauccauccuuucauccauccauccauccauccauccauccauccacccauccauccaucuauccauccauccauccauccauccauccauccauccuuccauccaucuauccauccaucuauccauccauccauccauccauccauccauccauccuuccauccaucuauccauccaucuauccauccauccauccaugcucugcucuuuuucuguuucccuuccccuaccccugcuucucuuucuuacuuugcuacuuccuuccaaccuccaaacaacuguucagugcucauaacagugagugugcauccuagccuuugguggcauaguaaguaaacgaaacaagguuuugcauucugugagacuguuauaugaaauggguaauuaacagauacaauccuccucaacugaaguccucuucuauguuuauguauucguucccaauagaucauuuaccaugucagccaggaaccagaugggggccuggaacgucacacuucuuuugacagaaaaaaaguuccaaguuaaacauuacuaccuacaguagggugugaauuaucaaggggcagagaacucuuuccaaguccaggagucugccacugggagugcugagacagugugcccaagcuagaaggacauccugcaagggucucuagggguaaggcuggagaaaagccacuggguggcuggugacuccaugaaggucagacucucugggaagccgcucucuagucccaggucaggauaacacuggagaugcccauccaugaaagucacuuggagucucccaggaggaggaguacgcuaggacguuuccuguuuaggggacaggauugaguugcccacagggagaugccuccagagaaccucacaccagagccugaggccuccagugucccucuagugcccucuacuggcuaaguuugucguggugccagccggcacaggggaaccaguucuugguccuaagcagggccaaggcagcuggguacgacaaagacaggucaucuguugacagcugggacagauguucaauaaauaccgugggggaaauaagcugagugaagaaaaugagaaggcucaggugugucauuuuugaccgggaguauucaagacagggcucucaggaaaggcagcauuugaaugcaggccugaagggaguaaugucacuggcagagcauucacccagaagaagcagccaucgagugcaaaggcccuccggccagagccuacacggcacgcuugaagaggaggcagccgcaaccuaguggaugugagugggggcuuagaggacgccugagaguuagcaugcugaugugggaagccuuccuucuagagaagcuucuaaaauuugcuccuuuucccccaaagaaugggucccccaaagaguggauuggcgagaggggcaguaacacggacagaaacagagacaccacacuagaaagcuaggcagcgauccaacuuaauaaaagaccucagagccagcaaggccaaagcgguuccuguucugcuccgggugacaaaccgucuuagaaauaacgaugguaggcacgcauguaaagacacucagaaggacccuucuaaugaugccaacggcaaaugauuuguugaauguauguucccaccccgcaaggcccucaagaaacagcgaaacagagacaggacucaauuucccccaugagacuaacagugugcauguguguucucccuagaucugcucuccucuccaucaccuggccagugugguccucaucucuaggcucccgccuuguggauaacaucucuguaaaaaccuaguaacuauaacuguggccauagcuagcaucucucacaguauccaugcagucgggcuaaaucacuguggccauagcuagcaucucucacaguauccaugcagacaggcugaacagcagcauacccucccuguccccugacccuccauucucugccucugccaugcuggaaucacaggagcaugcugcugcacccaggucuuuuuguggguucugcaaguccaccuugagguucccauacuugcaaagcagacacuggagauguauugaccaagacaucuccccacugccccacuuuaauacauauuucuuacacuaagacaaaccuaaauuuguguuuucugacaccacagccuaugguuuuguuuguuuguuuguuuaucuuuuucucuaccauugcucugacucucccccgucugacauuaucuaggacuugccacaauuucaggaaugcucggcuguuuuguuguuguuguuguuguuguuuguuuuguuuuguagcauggaauggggacuguccucagucacuggcugggucauggacagcaaacauuuggcccucagagugacauuccuaccaaguuuccaacaauggugucggccugguacgccuguccuuccuuggugugagcagaaguuuuaugacuguguguuuaugggaaagugcuguuacuauucuuagacuggcugcucucacuuauucauagccccacucugcuggugggcgggaacgagaaguuauaauagcagcgcaggugccucucauugucuuccguuccucacuggaucguguuuauuaagaaggaaaucacaguggugugucuggaacugcgucugaacaaauaacccacagggaggaguccccggaaggugggcaggaggcagcacaccaagagaggcaaaaacaagcccgugcuaauugggaucaggcagugcuuugcaugagaaucaagaacaagagcucggcugccacguaauuacuggccucaaccuuuguuggcauacuucuucacauaauucuacaggagagcggcaauuugaauuuaacacacuuuuuuuuuuccuucuggguuuuuaaaggaauuugaaaacagaauugcacgaguacagggaugaagagaggucuuugcuaaauguucagguugcuuauaaauauaucgcuacacacacacacacacacacacacacauacaccgagagagaggggacgagggagagggagagagaaagagugcacacacuaccaccaccacucuuuggacaacuaucucacuuggugauguuugguuccuuggacaaagcucuucugacucauucagaugaaaggcaggagacuuaauucaguagagauugggaacugccagcucuuggaguccacaucaucauaaucuuguggcaguuuucuagccagauccuugagagacuuauggaugugugucucuacaugugggugugguguuuacacaaaaggcaacccuuggcccaugucaucgcuuuggucaugaggcacccugaagggauaucgcaaaucccuuuacagaaccaugcagcaaguguaccucuucauucaucagucacugccauaucaaagauaaaccagacgucacccauggcucugauacucauggucccgcaccacagacagagccauguacagaggacuggaacaccagggucacuugcuaugguuucccagggcaauagagaggaagaaaacaguccauucaaauaggggagggggcacaagguagugcccaaguaggcaccaccucagaggacgcugaggggguaaauaaauuaaucuuccaacaauagaaggauuggaaagaccacagacaaacuugggacacaucaggacagaaacacauuugggggggagcuuaaggccagccauggcuaacauguugaguugguccaggggcuacugagaagacaggcaagcuagacagaaaggaguagacaucaaagcccacaucacggguacaggaggagaaggggagacaugcucagagcucccaccaucaaacguggcccuauuuuuagaagggucugacuccugaaauaccuuaguuccuccuaccucccuggcuccucgucucucuguucacugaacugaaaaauuaucagggcuauauucagcccucgccaauaauaacauguaacaaaaauaucucauagauugcaacuuaggaguguuuugacugcucccagccaagucuuugagagucacaguguguaccccacccccacccugucugccuuuuugaugaguaaaauugagccuuuuuuuuuuuuuuuuuuuuuuuuuccccaaaaugauguucuuuuguggcuugucugcuucuucaagaacaacuauacucacagcauucuuccucucuuauugaaaccgagaagccaccauggcacccuucugggguggggugaguaucaaaaguuuggagacuacuaccuaccuuucugcaaaccugguggggaaagaggcaggccugaaacuccacugccaccuugcucccaugagaauaacaaugucuuccuuacagacaagacgugaaccuuagcaacuagguacccagcaguuauucacacaggaagugggaugagaaguauuaugguaaucucuaccauuauuuucccugcgaugcuggcuacuguuuccuuuagccaaaggagcuuugaccuucagcucacugcuuccuccugaaucaagagcagacugcccaccaucagccuggucucguuggcauugcucaauuaguauauauugagauucuguaggagucccuguccugagucaaacucaguaggagccaccagaauccuuacuuccuuacaugaccaugucauguuaugauaauuaauuauuaauuauucuucccuguagagaucagauguuuacccccaucaagauccuauucaaagacaucauggcuucuucaguaggccccaguucagcuuccaaacccagaagacacuuggaaagugaauugagaaggaagaaaacgcccuguauguuucaaggaucuggggugguacuuucaggaugauuccuagacuugacuggacuauaagcacagagauugccacucuggcauccagaagcagaccugcuugccucggacacucccuuuacuccaacuuagccuccuguuccuugguuuccucaucugucaaauggggauguguccuaacuugcuuucagauacuaugauaaacaccacagccaaaagcgauucgggaaaggguucguauauugaaguucaucacggagggaagacaagguaggcagucaaggcaagaacauggagguaggaagugaaguagagacaaugaagaaacucugcauacugcuugcuccucuugguuugccuggggguggcaccacccacagugaacuggguggucaagucacauaugccuacuggcuagucuaauggagaaaaucccucagcugaggcuccuucuuccugggugacucuagucugugucaaguugacaaaagcuaaccagcacaggauccugaggacccacagugauggucugugggucgugcacaggaacugugaacauggcugccuguucaguagcaguaugugagaccugcugagagguguaaguucuucucuguuaggaguguugggcuugagcacagggccuugugaaugcugggcaaauucucuaagucugagcuaccgccccagccccaguccuguaaccuucuaguucauuuggaguccuuaugggcaucuaguccaccaaauccuguguauacacaacaugcgugucuucacaucucugugagacucuaaaacaucucugaggaaagagaggauaggcaagcaugagagcagcgcagggaggcuucagggauuagguuuuuaggaauuacugucccuugguuucucucuuccaucaugcucuuggcuguccucccugucucuccuaccuaacagacacccacauggagucucugccacccauguguccacguugcccagcaggacauugcauacuaaauuggaggugauuugugucuguaugguccagcucaguguucacucaaagcuaaggagcacuugaaacauggcugguaugacugagggucuagaagcuugacuugauugaauugaaucuaaauaacuuaagaagucugaugucccugguggcuguugucuucuacaauaucaugaaggcaacagagacucagacaaaaggcaacacugugccuugcuccugagggucucugguccacaggggucagacacccugagugacagucaacaagccugaacguggagauugguaacuaguaaggagaaaacugguguugccauagcauccaagaagaugcuagcacaagagugcacaccuguaaguuucuaucuuguuuucuucuaagauuuuauuuuguguguguguaugaaugagugccugagugaguauaugcauacuguguguguauggguaccuguaagggccaaaagagggcauccaaucuccuggaacuguaguuacaggcaguugugagccacuccaugagggugcugggaacugaacuccgguccccagagagaguuaucacugcucuuaacuacagagucaucuucuccauccccuguuugcuuguuuuuaacuuguguaugugugaguguggacaggggugggugggggcagugacuauaagcaaaugugcacugugguguguaccuccuaugaaacaggaucuuucuaaacacucacuacggcauaggcuaugcuacccagccugugagcuucucauggacugccucugccucccgacuccugguagaagcuccuacucugugaaugugugcacuaccucacccgcuuugguguagcuucuggggaucuggagucagggccucauuccugcacagaaagagugucacccacugagccaucuccccagccugaaaaauucaaacaaacaacccuacuuauauugugugcaugugugugggggacagaggacaauuucugcgagucucuuuucuccuuccaccauguggauccccagggauggaacucaaguugcauggcacauggcaaaucccaggacagcuacuuucuguacacgcuaacacacugcagcuuauuggggcuguuaccaccagcuacagagacggcacuucugagauucaugucuaugauggucucuucucccaucuuuagcuuccucuugaggugagccugaaccccaugcaaccugcuuccugauuuacucuuugaccuccccagcuuggcugguggauucuuucgcacgccaguucuggguaaccagugaucagucaucccccccccccugcccccccguuaguccccaccccugcugaaggcagguuucauauaacuggcuuagcacuugguaaggaacgaggugacagcaaggccacaagcugauaaauagacugguauuuacccagugccggaccuccgcacgacugaugucuguguuguugagcagugugucacaugucccugcugucauccuggucucaagaugacugugaggacggggccaagucauuuugcaaucugggugagcgguccaagcuucucagaagaccgacgcaauagaaauucaagguacgaaauuaaaggugcgaucucccagucauuuuauuuagcaccuucuccauugugucuucucagcacaucaggugagagccuccuccccuacugcucucccauaugaacacgcaaaaaaaaaaaaaaaaaaaaaaagaaacuuccucuuaaggaagauuucucuugaaaaaccauauaacccauugcguuuguguccccagccaugcccgcgccaccucugucuucuuugaaaggcacuggucggggccuccagcaccagcuccaggcuaguucuuuuaaagaacgcccguguauacccagcagugugcacuuuccacaagguggcucuugacaggaauaugauaucuccccccaccuccccgguggcaaucaccugcuugguucauuccaagcccuaguuuagauucccagcuauuuuugggggggaguugacaggucugaauuaaagcaaugaacuuagucuucucuuggaauguuauagcuggaaggggugugugggggaaucucuguagcaccuaaaauuaucugccccgcauaccccaccacugggaaacagauacgcuuccaacaaguccuucugauucuuuaaaaauaaaauguuaaaguccagcaaaggcagcucccaccaaggcuagcuaacgccgcucacuugcucugugggaggggcuugugcaacgcuguauacuuguuuuaucccugacuugccuauggagagauugcacuacuccacuuucacccagcgcucagagaauagcaacuggccccacccagcgcacagagcuagucaaugucguagucauccugauuugggagcuuauacuccaaauuaggauagacagagcccugucugucuguuugucugucuguuuguuuuaauucucaggcagcagguugguggccaaggggagaaucagacuucuggcuccacaggacaggaaaaggagaacggagggagaaaggcuugggaacugggcgggcauaaaggucugguuuuucccuugcuuugccuccugcauuagcuuaaaaccuaaggcuccacccagaucaagaagcccaggcagggagccuuuucuagccgaacuucaguacagaaggccagcaucucuagggagaacacaguugagaacugcagcaaaggcaagcuugguuuuccucauagccagggccaagugcuuggaggugguuucaggggaaugggcuuuguucuggcucauaguucagggcuuaaaguccgucuuggagggaaaagcauggccacgggggcuuggucaccuacagauacaccagcaaacugagggaggggaaugcugacacuucaggccaagagguugugucaucuaugucaagggaggucuuuucuuugucaggugucucccuauaaacaaaauacaccaaaggugugugccucagaaaugccucagggaagcuuuccugguggagcuauaaaaaaacaaaaccaaggugguuuuguuguugguuggauguuuuguggguuuuguuguuuguuuuucguuagaccauguuggccucaaacucagagagccaccuauuucugucucccaaaugcugaucuucaagcuguacaucacccccacccccagcagaaacaagcuauuuugaauaaauaaaugguguugacaggguucuuucuagguacuucaaauuuuugucagaccccuagagaccacaaagguugaguccaaaguuucacccccagccuuagaagcuugggcuuauguccagucagucaccauuuggagagcauucuuucaaucaugggcuaaaugauugacucauugagauggcucuuaaccuuuggacauuggacagagcuaagggcuguaauaaaauacuaaauucacccaaaaccaaaagaucccuugcucuaacauggcuuccaugguauugaggagagaaugguaaacaagcagacaagccaauaucacaggggccaugaggagugcuggacagauggcucagugauggacagacagcucagugguuaagaacacccacugcuugcccagaggacccaagcaaguuugguucccagcauccacaucagacacucacagugucugugacuccagccccaggagcugaugucucuuucuggcacacacaugcaugugcacauagcaccccccccacacacacauacauguaauuaaaaauagaauaaaaaucuuuuuaaaaagaagaaagucaaccagagaagaccuguguguguguauguguguguguguguguguauguugaggaauaugcuaaggagaugauaccugaacagaggcaacagagcccaucuacaaugggaaggaauguaagggagagaauguuccuggcccgacugcuccagguguagacagguagaccuucuagaaaauggcgucuuucucauuuaacacucuuaccuucccacugucuacaaaugcuauuauguagucucuuaccuggacauagauuuuaucuuuuaaaugauaacaaugaaagugauuauggugaugacaguguggcuguuggcagugggaucuguaggugacagguacugagcacauaccuugccccaugacauguucuugugaaaauguuugagaccucacagugacaccauuacuuuuuuccuaaagcuacacguacacagauuacagugcaaaccauauggucaaaacuacucuuggggcuagggagaugggucaguggguagauagcuuacuggacaaguguggggagcugaguuuggauccucaaugcccacguuaaaaaauccagcauggccucucacgucuguaaaccuagcucuagagagguggguuaacaguggauccuaggagcuucauagccugacagccgagcuaaacuuaaggcuaauuccaacuucagugagagacucugccucaaagaauaugcuagacaacaauagagaagauacuugguuggccucuguccgucacacaugcacacauaggcgagcacacccgcacccuugcaugccacacacaugcaaacacuccccaccccaacaugaacacacaauggguuuccaaaagaucuaauuuuaauguauauguaucccuggauauguauggcguguguguagauaccuacuggagccggaaaaagggaucagauucccuguagcuggggucccagauagcugugagcuaccccaacaugggugcugggagucaaauuccuagaacccugcaggaacagccaagcacuccuaaccacugagccaucucgccagcgcacauuccuuuucaaaugcucuuaaccacuccaaggcuucaagaaggagaaagaagccagugaggcugaggagcugucuuaggggcugaaucauuggucaguaacucucucuucuuuucagucuccugcccuccagcugugucuucuuuuuccccuucucccagccccucucuuccccuauccuccugccaccugcccugucuccgcucgcuccacuuuuuccugcuucuucagugguggguaucacaucgaauucuucagcaguuaacaacccccgccccgcccacucagccccgcccacucaaggcuuucccuuucccugucugggaggcuugggaggguaucucuucuccccacuucaggcuaugcccccaaaguguucugggagugcacuagcacacccaccaugaggaagaaaucacuaaaacuugcucgaucgucucagcccauucaaguugguuccgucagugcgaugcuugcccugcaagccugggaaaccugaguucauccccuagaaaacacauguuaaaacccaggcacagugauacaagccugcaauuucaguguuagggaggaggagacaaguguuucccagcccguuuacccuagucagugagcgucaggccaaggagacacccugccucaaacgaucuauggaugguacuugaggaacaaccguugaaauugaacucugccuucuacaugcacacauacgagugaacacauguauauauaaauacaguuacauagacacacauacacagagggcaugcauacacacacaaugaaugccuucucuucucuccaccagccugggaggcuccacccucacccugcccuucauauccagccuccauuggccacuccccccacccccaccccugcccccgguuucuuuccaguccuccaucucuguauccuacucugucaacuguaauuugaggcauucugacgauguuauuucggaacugccgaggccugacaugccaugauuugacaugccaugcuuaugaacauguaaugcagccaguuguaagaugcuuuauaauuuugugucccacuaagagagggaauaaaugucgucaguuaagcaauggcccaaagcguuccaaucuuguaggauccacucuguauauauuaagaaggcuuugccucuuucgaauguagcuuuauuacacagcagggccauuuucauacuuuucugcaagucuaguguuuagauuguaacaauaaucauacugugugcgaucuuuccaaagacacuuccaacgucaagcucauuuguggguaacaccaacagucuacuuaauugacaccaaaaggggagacugugacuaggacguugaaaauaaaaccaaaaccuguaccuucacaugggugagaaaugacuuauaauggcugugugguagccagguugugcgcaccagacuuaauuuaacauucacacacauagaugucgcugggcuucuccugagcucugucacaggacgugggguccugucugugacaggacauggggcccucugcacuuuagcacagcaugcugaggcaagcaaagguagggguggccugauggggacacgccuggccuugaggagcaggcggauugugaggugccacugccaagagagaaaguuggcaggaggacuuugcacgcacuccgagccacacgcgaggcgagcacuucugccaagcagaucauucuguaccaaaacaagggacaggagcgggauaggcuggaauggguuuguacgagguggaaggggcucagggaagcagaggagagagcuggcauuuauuaggcaccaagggugugccugccauaccccuuggggcuguuuguuuguuuguuugcuuucgugcuugcuugcuuacuuugguuggugcgguguugguguccaugaugcaggugacagcaaugccaguucugugauguugauggugacaaugauggcaucaggagugacauggacuuacuuuguucuuaggacucacuuugucccacguaguguccccgauucucgguguucaguggcauucggaaucucuccaguccucggucuacaaagagggaauaaauaacaguaacuucuccaagcaguguuuguggggacugaauggguaaaggcugagcaccgugaugaaacccugacacuugccagacccucaguaaaugucaguggucaccacugccauugauaugagagagaggaggugggaaagaaagagagagacuggacauccccaucaaaccccuauuaccccaaugugugagugugcuaguguuuguguauacgcacaugcgcauauaggagcaugcacacauuugugcacauggacacagaccagaaauuggcaucagagguuguucucucuuuugcauuuuacuuuauuuuuuggagacagggucucccacggaaccuggcacucaccucuuggcuaggcuagcugcuagugagcucuggggaacugcucauccucaccagccucggcucugcaaugcugagacuguagacguguaucccucccugccugccuggccuuuaaaugccgcugagugcuaaggauuuaacucagcuccucaugcuugaucaugggcguuuuaccuaccaggccaucucccuagcccuacugucacuguuuccagacaaggggcauaugagaaaaagcauggugaacagucuagacaugaaauguuugauaucuccaucaaacccccugugacuccaaggucggccucucuccuuagccuaaagcacccacugucaguccugagccuucccagggacacucuuggcuggcaguuccuaaagguucucuggaagauacaggcgaugacugacaagccuaauucaaagcccauggcuccaugggcaaaagccagguaggcagcuggauagagaccaggcuugguaaguacaguuaaaggagccuaaaccaguucccaggugguccaaguagccagggugauuaaagccagagagaaacuaaauuccggaggcuuguaccgucuccagggaguucacuaauugagaaauagcauccauaaaaauaauucaauaguagucuguacagcuaaaaacaauaaccaagugugacuggcuguuuaagaauuaagcaaagugagacagagugucguuacugucaggcacugccagcgaagggggcccuggcacuucuaggccuucccagcacugagggagggaggggcaagcaccucugguggcuguagaaagucucacuucuuagcagcagcucucagggaccuuaacucugaaaggcuccuuugaguggcagguacuacugucagggcuguuucucagcgugcaaagcugaaagcucacccagggccagggguagugagcagucaauguguaaccgcugccucucuagagaagagcccugugccuauuacaucauaggcacaccagcacaagguucuuagagaguacaggcaugacguaggcccagcccgcagcucacaaguaauaaaucguaggagaguggugacagucagggcucacuugguguuuucucugagugucgccguacggugaugcccagccacaguggagacugugauugggagguaugucuccaaaaugaauauugguuaguauuugcacuugcccuagcacggaaaaguaacaacgaaaugcuugaggcaggaacgggaacuucgguugcagaugccacuggcuguaagacaaucagauguguguaggaaucuguaauuccggggcugugagacaauaagaugggugguagguagcacgcaucuguaauucuggggcuucaagagacaaggguauuaaaagguauccacacccacaaggccacaccuacuccaacaaggccacaccucucaacaguagcacucccugggccaagcauaugcagaccaucauagcacagaugaacgagcacaugugcacguacauacauucaaacacauaaacacaaucauacacagacauagacaagcacucauagccaccaaucucuuccauuacuuuauugcuguguucuuuauagaguugcuggcagguauacugcauucccuucaggccaagaacuuuucuaauauaccuuguugugauagaauugacgcaauaaucacccuuucacacaauaaaggauaaaaauucagugguuuaucuuacauuuugcaguacugagcuccagucagcauuaaauuccuaaacauuucaucccccaaagacguccuguauccaugaggcugccauuucucauugcccuaccccaagccccaguaccauuaauuuaauauuuguguucuugcacaugauucuucuggguauugcguuuacguggaagcaugaggcauaaggccuuuucuucccuuggcaggauguucuuguugguucacccauguugggcaauguaucuguguuccauucuccccacuacgcaugacuaauguucacugagccugcacuuuauuuauccggucaccacgugcugggcauuggguggucucugcuuuggggcuaaggugaguuaugcugcuguaaguauuuauguucuggucuuuuguagguagcuauuuucuagucacuugggcaguggaaugaaagagcuaggucauaugguaauucuauagaaggcauuuaaaagagauauaaaauggcuuuccacauuggccauaccaucuauauucccaccagcgaauguaugaggguuauaaccucaccuuacccuuggcaauacuuguauuuuaaaaaauuauuaucgucucuggggguuauuuugcuuuuacaaauaaccuaggaucguacaaggcagcucuugugaggcggcaugggccggcuucugcucaccaggaagcaccuuggcgggggcguuuccuguuucucacuuggagcccguacugagcauucguuugugaauucuccucuuacacaucuguucuaccaaagguacugcagcagcguaugacagccgugcucucgggacuccaugucagaaggaccgacacucaaacucugccucugccacauagcugggugucuuagggcaagaugcuuuagccccucaaccccccacuuucuuucucugacuauaaaaugguaacaguuguuccccauucauugugcucuucgguggauuagagauaaucuauagcaucgggcacauaggagaaauucuguaaauaaaacaaaugauaucuuuugauuauuugcauugcucuaugaacauacaaccucgggaauucuucccagggaaaaaccaucuguuggcauggauggccaucuuaggcacuaagaaaaugaggcagaaguuauauauaugguccuuuucuuuucccuucaugcacuuggccaugaacuauaaucgcaaaugcucuagaaagccagaguggcuuugcaaguuacaaaugaguaauauuagaaaacaccagcuccaguccucaggauagggauggaggagucccuguucccuuagauagaggaacagagaugguagaggaccggagugucauuagugguauccuuggcuugcuuuacacucauugugcauuuguggacaguaucaggaggagacacuuuugugaggucacauuauacauauagacuacuuucucuucccucuaccaggaauugaaugaacacacacacacacacacacacacacacacacuacuccaugacugaucuaugguuuaagcgaguucgggccuuagucauuuggaaggguucaguagccagggacagacucucuggggccagugugaaugauggaggcaacaugcacauuuuuaaacgugcaauuuagaggagccaguuuucagagcucacuuaacagccucagugacgcgaagguuggcccucugccacuuccgcgucucuucucuccucuuuaccaaauggacuccaugguggcaaggggagggaaggacuuccucaaagaagccagcagcagguuuuaucuuauuucgugcuguccagagaugcccuauacagucacuacuagacccugaguugaccagcagcaggucucacaggcguccgacucacugcucacacugaagccuucgaugcacgcagcaucccugugucuggguuuucauaagccugguccaccucaccugggaugcuugcuaauccugcucaugaagcugggaauuggcugauggguggcugaucucggcuauguuagggugagccuuuucacaaccgguagaaacacagcaggcaggcagaaaccuacaaaucucagaacugucuccccaucgcauuggguuccuuccaggcuagaggaaaucacacccacugacugaggguacuacagguuguguggcagaggguauggauauggggccgugaguucaaacucacugcagaauugaucgagauuuaucaugauccaucccucagagaggaagacagaguuuacuacguauaucuguggagaaugucauaucuaaaaugaggucugagcagauguggaauagcuaaggguggcuuguuauccaucucugaaaagaaaucgcaggaggaugcaggucacuuaccggcaggauaccaugacuauacauaacaguguucuccguucucucagaaaccugaaguuuaacagugacagaacugaagcaauguggguagagggcugugcagacagcaggagagacacagaucaacccugccuaagaucccagaaguacaagcaauacugccaaacccugcaggucgcagaauccuuuccugcuucuuauccaaguacacagacaguuccuucugucuccaguuugauggggcccaauauagacucuugcugcucuccacucaagaguacacauugaacacccacuucucucauuuuuuuuuuuuuuauccaauguugccuucccaaggcccagauaugacuucauuuguaaagugaaauuuuucaggucauuagcccauaaugauuaaaugauucugguuauuagcauaaaacacagcuguaguacaagagagguuaucuucguuguuuaaauauuacgcaguguggucacauagcacacagaaaaauuaauauuuuuuagauuauuuagcuauuauggaaaugaauuagaauccuacauucuauugagaaauaaaaacaaaugagcuuuauucccucagaaggguaaagauuguuuaggagagucucuaaggggaauccaugucagacgcaaugccauuucugacaggaaaaaaagaccuaguuuggguagacguccccaaagagucccaggacauaugguaaacugcucuaugacuuggguucaggucuugcgauggcgugaauaugugggucuucucccaaguugcguuuaucaugaggugaguucuuugcgggggacaugguuagauccugagagcaaacccuucaugaauaccaguguccccaugaaagaagcuacagggaacugcauugccucacccagccccugagggugggucaggaagcccaugugugagucugugcucaucagcuucccagagcccugacaaaauaaccaaggaaucaacuuaaagagaagaaagcgucggcuuagcucaugguuuccaaguucucaguauggcauugguggagcuuguugcuuuagccugcgauaaggucauauauaucacgcugggaacauuugucccccuggugguucagaagcaggcagaggaggaaccagugucaccccucugcucagugacccagguuccucccagugaguuccacccccuaaaggucccacugucucucagucguggcuggcaaccauaccuuggagcaacguuucauauccgaaacaugacaagaaguaagccaucuccagacauggaauuugcuugugcauuggucucgagcucacacacacacacacacacacacacacacacacacacacaucuggcaaauagugucuaauaucucaggguuacagaaaccauucguagauggccaguccagugccuggcucauugugagucucaguaaacuauaacugcuauugucaccgcuccagugacugucgucagcucuaucaucucaguuuugcuggagcccuagauaaacaaccagguuacauggaagugagugcaggaugacccuaagaaugcaggagguucaagcauguuggggaauggugaacagugaaauuaccuuccccugugcaccuauucugugcaucuccuuuugcacguauccacggcuugauacauuaaucuuaacaucgccauaaaaacauuugcucauuacaaggacuggagucuucaggauguucuucgccccagcuucuucuuuagacagcccacucugccugcucacagugaagaauguccugucuggaaggaggugcuaaugcugggggagaugcuggugauaaugcugaugguggcugcaauccuuaagcuuacugaugcucaaaaggcaccaggagguguccugagggaucuacaggcauuguguccuuuauacuucaugggcauugucucucuagaggugagaaaaccgaggugcggcacucugccuauccuaaccugagcucuucaggaaaaauguugucugcaggcaaccugagcccagaaagcuggcucuuuagcugugugugugccucugucugucugucuguucucugaauugauagaguagaaaggagaccugugaggucugagugucaccuauaaguugaagcaaggauuccucuuugauuucugacuugauagaguaccccaaaaggccucuguguugaggccacugauggaucuuaaagauucuaaagaagaauccaggguauugcccuggacacaagucucugggagaaugcuacccaggaguauaccugggaguacaccccagucaccaaaugcaaugaucacuuuccauccuuguucuuggauuguuauugcuucauucaucauauacacgaugcaccuagaguguaucucuguguaccgguuaugucucuugugguuuguaaccuugguuuucacaucuguaaaaugggagcaacaauaacaccuaccuuugagaaugaaacaagacauugugucaaguagaaugacugacccgugacuagaaugccauugaugcugauuauuauugucacuauucucaucaaauggaggcaaaaacacaaggcucaaaccagugaaccaaaugggagacgguugaugaagaagaaaaucaggugaugucuaggaaaaggcauagaaucuucugugaaugucuguccggaaagaucccaggaacagcagggcaguuagucccgugccaugugugcuccaagaaggacuauaucguaaauacuauauggagggguaaguaugacacuugagucagguaugguggugcgugcuuuugauccaagcacaaggaggaagauguaggcuaauccaugugaguucuaggccagccaggcuacauagugaacuccugucucaaagaagaagaaagagggguagggggaggaggaggaagaagaggaggaggaagacuagaaagauagauggcucaguggucacuguucuuccauaggacuuaaggaaaaguauaaaaaucuuggcuuccucugacuagaggugagacaucaaaaaaaguuaauaaucggagguacccaaggauguaauagacaaaugaaaaaaaugaagaaggaaaaucuggggaaacuagugaacaaaagauauauuauuaaugugaaguguauuguuauauauuccagaauuauuguacagccuguacuggguccuuagacagaaaccucuugucauucacagucuuagcuagacaauagaucacucccugccccccacgggaguuugugugcauguguguuuuuaaagagauuuacaaugauucuuuuccuauaggguuuucuugaaacauauauauuuuuaauuucuccccgucucagggguaaauaaauauauuacaguaagcuaugggauguauagccgaguauaacaaugauaaaugauguuguguguaauuuuucuacuauuaacauaaaguaauauaaacugaaggacacuggucuauugagagacuuagaagcuaauguuccguaucagaugcagccaaugucaggacugaauacagauuaggcaguguccuuuucuccccaagggaaugaaaguuggagacaccacucgcugcccgugguuuuacggcauuuuguuggggccgguggugccuuucuuggucuauuaauucaggagccguuaaaugacagugugagcaagaggcuuuuccggugggaugcauuucauuuaugugugcuuguacggccucuaccucgccaauccuuucugucacaauaaguguuuuuaaauuguguagauuaccuucacuucauuaugguccccggcauggguuucucaugcaaagcuauuauguaaaguuaggaaauacuucaaacuguguggucaaagaaaagaggggaggggcauugagaaaaguuuauccggaguuagucuccacucuccggcguugaguuaguucauggucaggguaugcucugcaaaaugcaaagaaaagccucagaauagaugauguguguguguguguguguguguguguguguguguguguguguguguguguguauuuuuuccccagggguccaucugaguucauaaacacauguuuaaauagaugugauggucagaagucuaagaacuaauccaugauggagauauucuaagggaagaugaugaugucuuaccagugagacagccugaaagcuggaaguuuugugguuuauuuuuaagaucauuguuauauaucaucugagcgaucagaaaucugcuggaaauccuagaugcaaagaagaagcaccccagaaggccagagacuccucccuggucccgcaguucucugcuuccucccacccucccaccccccuccccccaccccugccuuaaccuugagucuugcuuucuugggcaacccccacccucccugcuccuucaugcucucuuuucacuugaugccaucccaaaacacacucccuaaggaaaagaggaggcaaguggcccagucaucggcagaaagagucuaacuggaugucuuuguguuggcuggagccgucccaguagcacccaguauaacaagacugcauagcaguugauguuccuaauggauacaaggaaagcauccugaaucucuugggucaguuaaguacaacacacacacacacacacacacacacacacagacagaauuugagaauggggcuccugucaguauuuuuugucccgucacuccacuaaaauggccaagaaggaacaagcauuuggguuucgccacaaaccauuguuauccuucgggaaggcucugagaggauacguuugucacggucgguaaauuuuaucuuugcacuaaaaacagggguugaauaucuucaaugcaauuauaaaaauguauuaaaacugggaaggagagaaaauccagugguagaugcgauuuuaaugauugugugacuguucaguguuccauggccaaaaauaaaaaaaauaaaaagauaaaaaauuaaaaaauaaaaguugagguuuuucacccucaguguuucagagggaugccggggaauggacagcuuuuuccaugcaugcacauugugcguuuuuuucaacacaaagcugaacauaucaguuucaagaucugcuuggauccuacgaaugacaagcuaucagagaaugguucauuccaugcaaaauggguaucauggccuaaaagugaaaugucccucauaguguguuugaacauuccguccccaguuucuggaguuguuugggauggccagggaacauuuaggagguagagccuuguuggaggaauuauguugcagggagcccggcuuggaaacuguagagucuggcccagcguccuguugaugcucuacuuccugcuuagcugauacguugugacaggacagccucuugcuucuguugccauauccucucugccgggauauagagucgagcccucccaggagcuguaagccauaaugaauccuuuaucccuugaaugauugguuauuauauuaucacagacgccagagaaaaugccaaaaaaacgugagcugcuuuauaucauuuccuuguaugaauuuggaaaguuagagagcaaggaucuccaugggagcucagaaugagcuugugguagucuguccucauuuguagacucuugcauuggcucucuucacucagugguucccauuggcuacugacaagacgaggaggagccaggaaaagugaagacucagccgcagccacccgaggggcuuucuagaggagcaccaguuuucaaacgagaaguguucucggagaaagucugaguguccagccaaugucaaauacaugauccucgugaucaacaucuccggggacagcagccucugccaccugccuucacccuguccauugcugcuguccacagaugggcugaugguggagagagucauggcaagacauuuccuagauuaaaccauuaaguaccaggcucucuaauggaaauucuguaaaauaaaauguaggaaaaaggucaggccugguagugcucagcuauaaccucaacacuugggaggaggcagaggcaagaggaauauuuuauauguuuugggcgagucuguuugaccuagugagguccaggccaaccaggccuacaucauaagacccuuuuaagccccacuccacccuuccuccuuuuugaagcaaaacacaaauuagaaaacuguuaagucuggaucuggcuggaugcaggaacugacuucuuuccugcuguggguuucucuguucugcccgugaucccuucucguccucggguggcagaauacucgcccauuuccuuccaguuggugcgcugcuuugauucucuuggcauuugggcacaguuaaagucagcaaggcaucuuguccuuacauggaggcguuugaauuuuuaccgcucaccaugaagaccuugcuuuuucuuuauguauaaagucacccacagaauuagaaaguuggugguagagguuuuuuagguacagaauuagccagucagucauuaaguuagacagucugagacacagccuuacuauguagcucuggcuggcccguaauucauuauguagaccaggcugaccgccaucucacagaggucuaccugccuuugccuacuucacgcagagaguaaaggcgcucaccauguuagacagauccaggcuucuuaggaccccacccacucacacacugucccuugaauuucugcuuuaaaaaaaauacaaaaacuaaagcuguauugacuuuauaggucgagucuuaacacgugcucuaaugcagguguuuaggucagacucuucuaaucuaagauacaguguuuucugugacuuggggcaaaugccuucacuuguggucuaccucuaagcagcaaaccagguagagaagcugccuggcacaggauuagauguuauuauaauguagacgacaggucugucggggagucugguacauaaauuacuuggugccagauaccagcugcuuuccccacaguucaguccauaccucuguucaccuauuaagagaucuguacuaagggacaucaucaaauuguccugaaagaguguuuaguucugcacccgcugcuugucucugucuaccucugcugccccugccccacccuguguguauguguguaugggauauauguaccucccugugaggguauucacaugugugcccacuggugcacauguaugugcauggacacgugugguggcauugguuguuauaacaucuuucacugaacccagagcucaucaggggagcucugccggcugaccagugaccuccggggaucugucugucuccacucucccaaugcuggggauacaggacaagugucaucauccugacuuuucagauagcuguuaaguguccagaugcuggucaccggucaccgugcuggagucucgagcacaucacuaacuaagcauugucuccggccuccgucugaugucagcaucggcagugugguuguuguacaaacagugaagaauguguauaggauugaauuucacucuuacacggggcaugccauucagguauacagacagcuuaaacacagaacaauucgagugugugugugugugugugugugugugugugugugcgcguguguguuugaaguauauuuugcacugucagguguucuuccacagguucugugugagauacuuaacacguguuucacuuucucugcaaugcacuacgaugugagaagagccgggaagagcagggauaggcgugugaggcuaagugaagucccucagcugaaugcagggaagcacauaguuaaauaaacuggaagccggggguuuguggaagacuuuggaaguguacccuucuucucugaaaccuuguguccugugugugugaggcuaaaugaggugacauggaggucagccauuucccccccagaauugcauucauauuuuuguuccuaauacacauuaagaaaucuguaggagggucuggggagccgucucaacauagaagagcacuugcugcucuugcagaggacccagguuugguucccagcaccuacauggcaauucacaaccaucuguuacucuaguccugagagaucugaugucuuuuucuggguuccuggaaugugagccauguuacucauacauauaaaauagaaagagaugaauuuuuuaaaggacauuucaaaagagcucuguagagaaacaaguuggugguauggucacacggucuuagaaaucuauagugaguggcugagugaaggacugaguuauugaagagcagagaagggagagaggagaggggagaggggaguggacucucaccaucaggucuggcgcagcauugccgguacccaucuuuaagccuagcacuugcuagguucuugauacauuuuuuuuuuuuuuuuuuuuuuuuugguuuuucgagacaggguuucucuguauagcucuggcuguccuggaacucacucuguagaccaggcuggccucgaacucagaacuccgccugccucugccucccaagugcugggauuaaaggcgugcaacaccacgccuggcucuugauacauuuuaaaacaugcauuagagucagggauaauuuaauauccaugauauacacaguugguauaaggccccaaccuccauucacagagcaaguuauuuccauaaaacccaugguuucuauuuaaaaagaacuuuuaaagccauuuaaucccagcacucaggagucagaggcaggugauuucagggccagccuggucuacauauagugaguuuuagaauagccagagcuacacagcaagaucaucucaaaaauaaaauaaaaauuuaaaaguagcaucuagagagaagcaagucauugguccucccuagccucugcuuagucguauguauuauuguauuugcuuugugaacaucuuuggccaaagaacguauuguuaaauuauucuccauuuucaaggauuggauuuauuugucaagcucagaaagaauuuuguguuauauggaaaucaugcaccuguguagaaaggcauuguguaaguuaaaggguauuuuuuuuuuuuugaagcauagucacagagaugcuauuggcacuauuccaguagggaaacucaccagaaaugcaacagcuaagcauuagaauucaggcuagagagaugcugcccagguaaaacccauccgugaaagcgugaggaguggaauucuaggcuccggcacucaggcaaagagaugagaaaggcagggauccccaagagcauaauacagugcgcucuggauucagugagacacugugucuuguauaagguggagaucaauaaaggaagacacccgacauuaaccuugggcugacaagugcauguauacucauguggguauaugaacacacacacacacgcacacacacacacacacauacacacacacacaugugcacacucacacacacaccuaaacgaagauuagcaaugaaaaaggaaauaauacuccccgugguuccuaucacuaucagcaggcugagaugugugcaugucuagaggagaugcagguauuggugaucuuggauuaaccaaagagcaaaucaucuucccugauuggugguggaaccacaaugagugucccaucacuaagauugaaagcucuuucucuucuggguggcaccucucuaaucccaagcaugcaugggcggcagcaaugagagagacaaggucuggcgcucaucuauuuacuuuuaacuuccucuugcccagauuucaaugugagugguagggauugaacccacguccccauaauugugcggcaaucacuuuacugaccgagccaucuucccagccccucccacugacacaccacuucuuaauaaggucuugggcuccccuugaaaggcccaggaacuucagucccucugcuacaccugccccugaacacaaugugcccuugcuaauaaauucugagggcugacacugccugagccugcuggucuuugcccucaauuucauugagaugggccauugaaaacucauuacaagcuguuuagacugugacuuugacuuuugcucggcagugaauggaauuaacagcucuuggagguaggggaaaaaaaaaaaaaagaggcacucagccaaauuaaaaaaaaaauuuuaaugaaaaaaauugaaaugaugagagaacacuuuuaauauuaucucuauuagacaugcaaacaagcgcucaucugcagcacggguguucugugugcagcucucguuuagagcuuguuguggaucgaaguuucccuacugaaagggaaauucuuacccaggucuugcaggcagcucaaaaauuuuuuacaugccaagcaaugagccuuugaguguagcagaauugcuucauaaauuucacuaucacuuucggauuucuguuuuuuuucuaauuuagugcuugauaguuuuuuaugugauaauuuuaaaaugcuguuuauagcaaaaguuaccuugauaguacaggugugcagagaaaauucacagccaucaauaaagggaugggaagaaagagagagagagagagagagagagagagagagagagagagagagauuuuccuguuuauacucuaggcauuuugugauucuaagaaugccacccugauggccuuguagguguaaaaugcacccugauuaauccaaauuuugggaaaaguaacagcacaagauuuaaauauugcugcugauaccuauaguuugcugucugucuauguuugggaagcucguacaaaauggcucugucuccugauauuuguaauacaucuuaaaaauagggauauuuacagaguguauauaguccuguaaaugaaaugaggacuaacacuacuaaauugcaaauuuuauuaaugagaugauuuaaugcuuaauauguaaaguagacaaaaggacuuuauccaguaaaggaaaaauacauauuugagauuggccugauaacauuuuccaguguccugagauccuuaagcacaaacagacacagauauggaucauguugaagguggacagaaugggguauuucacacuggggcuuuagguuauccagacauagcaaaugggguuggagagauggcucugcaguuaagagaucagacuacucuaucuagcaaagaaccugagcuugauucccagcacccaagucauacagcuuauaaccaucuguaacuuuagcucaaggggaaauccaaugcccccugcuggcccccauaagcacagcacccaugugcacauacacacccuguagguccuacacauacauguaauuaaaccaaauuaaucauaaaaucauaaaaggagcaaggguuccuuuuauguggcacggaggugugaagcagaagccacaucaccccugccgaccuguggcagcgucacgcuacaauuauccaguugcuuuauuuuauuuugucuuauuuuuccagcucuuuccccaaguugccaaggacguggcugagagcugugcaugcaguaagaauaagaugcucugccuuguaggguccccuuccuagcaugccaagaacguuugcucagccuccgaacacuggaauagcacccaacgccaacuuaagccaccaaaaaaaaaaaaaaaaaaaaaaaaaaucuuucagauccaaauuuaaugacuuaauacagugcccauguauagauuuauagauuuuaacagucaguuuaguaaauguacagccacauaaaucuaaccuguggguuauuuacuagacacucuguuuucuucaccuucaaauaucucauuuaacucccuauuauaauaagcuuuucaaaucucaguguuuuccccagagccaagacaauaucuuuuuuuucccucccaauguaucuuuugugagaagccauaguugaugguggaauggaagcaauugccucuucuagaguuucaaugaaauucgacuauguucuagucacuacuaccguaucuaccgcagagcaccccaggccguacugcucugugaugacauguuucagcaggcuucaguggggacaguguauccaucuccacaagcaucaacagaaggagcuugaagacaaaaacaaaggcacagcccaaggcagaggucaucuagaggcuguccacucaccauaguagaaguugaagcuggcuauuggcuguggcgcgucacagugcuuuugggcagccagggcuuccuccaaauacggcaaauaugggcuuccaggguaugugucccaagaaagagccaagucgauuuuacauugccuuucaugauucagcuguggaagucaugcaugccuuugcuccuucucugagcagucuguccgggcagacccgaaagccuacugagguagaggaaggaugcuccaccuucucacagggcaacgggaugguucuuggaaagaauguggcauuggcaaaucaccguggccacuuuugaaaaauaugguguauauaggggauggagagauggcuuagugguuaugagcauguccugcccuugcaaaggaccuggguucagccccuucuaugacagcucacaaccaucuguaauaccagguguuuuugauuuuuuuuuuggggggggggcgucuauugucccuuucuagccucugugacacuacaggcauaugcuauacguauauacauucaggcuaaacacuuaggugcauaaaauuuuuuuucagaaaagaaaagaaaaauaaagugugucuuuaaccaucugcaaacugacguagcuaguuuguaguaguugcacacgaggggaaaaaaaagugcuguuugagagggaaugagagggccuggauuugaauucugucccugccccuuauuaaccacacguccaggacucagugugcucaucugugaaaugggggcggggguggguggguucucacauugacccccuauaguuguucuaaaguuugugcaaauaaaacacaauguaucugcugcugaggucucgguacagcccaguugcuugaugacucuuccccgagucaguucauugagucagacucugcacaggguagacauuauuuagguuuauugugcccuagucuaugucgcggagugcauccuugauguuuucaugaauuuuccacgcaguugcgccaugccaccagccaaugaaggucagggagggaacagauuaacaguaucucauaccacaaugucagaauccuuaaaaguguuuacagagccccgugacacacaaugaauuucaaacaagaagaccggagccgagguaaaacuacccccguuuuaagcuugagcagaggccuugauguuuuaugauuguuuuaagguccauuaaucguugaaucauggggccauguaaaaagaugacagcuuuaacauccagggcccgcguucauuugaaauguuuuuguuucuacccuguccuuaauuaauggcaggggcuaaaaccugcuucaaauguggcaaaaaaaaaaaaaaaaaaaagugaggugccacgaaauaaagcaacucauucucuccugaagacauucuauggcuggugccaaggagugugccuuagacugaaggguggcaaucucuaauaggcaucugcugagucucagaaagaggccuccugcuaccuagccaggagcugcucucuaauagaguagccacaggccacaugucaauguuuaaauuuagaugagugaaaacauaaaaucugguuaggguuuuacugcugugaacagacaccaugaccaaggcagcccuuauaaggacaacauugaauuggggccggcuuacagguucagagguucaggccaugaucaccaaggcaggagcauggcagcauccaggcaggcacgguacaagagaagcagaggguucaacuucuuucuccgaaggcaaauggaagacuggcuuccucgggcagcuaggaggaagcucucaaagcccacccccacagugauacacuuccuccaagaaggccacacccacuccagugagaguacaccuuguuguccuucccugggccaagcauauucaaaccaccacaguuggugcgccaaagacugugaguguauagcugacaguggguaaagugcuugccuugcaaacacaagaacccaugcuccauccccagcaccacauacauuuaaaaaauaaacaaaauagaaagccgggugugguggcgcacauuugucauccccauguuggguggggacagaauggcuccuacucaucaggacacccagcauaaaguuggcaccagugcauacuguauacagagagccagugguguccaaccugggaacuauugauguucaaaggaggcaagaugauaucagaagaaugaagaaugugaggugaaaacccgggacaugcuccuuucucuaccucuuuggccguaggcuuauagccaugcaucgccaggcuuagcguuuucugcagauacuggcguccaggcucagguccccauaucuguguaucaggcacuucaccaaucaagcuaucuccccagccccuaagcagauguaguuucaaaaaaagauuucugacucacuuuuagauuggucugaaaaguagagaaauggaaauaaaauauaaaaauauugugaaucuuggugguaaacauaauuauggaacccacccuaggauaacuccaugcuaaaucccgauuuucagcuagcuaugggcaaaauaccuacuucauugugaguuguuauuuucaauuugcaugcagauuuuuuuuucauaauuacuugauagcuuuuaagggggaaaaaacaacuuggcagcuuuaaguauaccuugcuuuuguuuauguuuuuguucugauaggcucugguuaaaacccacaggcuggccuugaacucuguguagccuagcuggucuuggacccagcagccccagacucuguacaucucuuaaacacugaggaagcaagcagauuucccuuuaacacugccucuaaauuccacaauuucccugccauagagucagcccuccacgccacagaauucagagccuaaauucuuucucauguaguuuccuuucuuuaaauuuucugugccuccacaccccuccucccaaccuccucuaagccagagguauacagcccuuugaagaacaucgagacuuuuaaacuggagugccaaccaacugccacucuguccuuaauaccuuucaaguguuagauuaauaacguuuugauaagguggcuaccaaaaccgugugcagugcuucagccgagucucacugacaucugggauaaugcgcucuaauuucuggagacacgcacgguuuugucgugagcagaaagagauguaauuaugccaguagaauuuugcuaugcuaugacuuugaaauauauauguguguaaguagcaaaguguauacuguguguguguguguguguguguguguggugugauggaguacuuuccauugucaauucuauacaacuacaaucaccugggaaggaagucucaaggagcgauuauguacguuggguaggcuuaugggcaugucuguggggcguggucuugauuguuuuaacugauacgggaagacccagucggaaaaugaguaacaccacugcauagauuggacucucagacagucuaagaguggacagagcuagaugaccacuaagcacacaugcauucaggucuauauccucuugaccguggaugggauuggguaagcuguucuaacucacuuuaaccuuggccuuccugacuacaaccuagaacugugaacugagacaaacucuaucuuccuuaagucgcuuuuuaaaaguuguuuugauauuccaccuuuuuauuaauuaauuauuuacuuuacauccugacugcaguuucuccucccuccucuuuucccauuccuuccuccucccuccccucccccucuuuaauuugguuucugucagguuauuuuuacaguagcaacagaaaugauauuaggacaguaguguguaagugugucugucuguaugcauauguguguguuuguguguguauauguuuguuuguguuuauauauauguuuguguauguguguguauauguuuguuuguguguauauauauauauauauauauauauauauauauauauauauauguuuguguauguguguauguauguguauauguuuguguguauauguauauguauguauguguauauguuuguguguguauguguauauguguauauaugugugugugcauguauguguauguguguauguguguguguaugugugugcauguauauguauguguauauauguguguguacauguauguguauguguguauguguauauauguguguguauauguguguguauguguguguguauguguguguguauguuuguguguguguaccaucaugcaaaugcaggggccaagggaagguguccuagaugcuccuccuccacucucaguuuuauucccuugagacaggaucucucaguuaaucuggcuagugaccucuccccagccauccuccugccucugcccaguacccccagcauuaggguuugcagacacaugacugcuuuuuauguguguucugggaauaaaaacucagcuccuuacaccuucacagcaagcauacuuagccauaagccauccaucgccccaugacauaaaucaugaucauugcaaccucaagucaacggcuguuggucuggcuuguuuuggcauuccuggugacugaaccuagggcacgggcaucgugguuacaagccaugagguucuaccaccgagcuccagagccaaccccaagcucuugcccacagcaucaaaggcuaccauggagaucagucagucauaggcaugagacauucguuccccaccaccuaggacuuguugcuuuuucuuugucacaacaaauuuuguuugucauaugucagggcuaggaugagggagccacauucagauucagcucauuuucuuuuuuucuuuuucuuuucucuuuccuccuuucuuucuuucuuucuuucuuucuuucuuucuuucuuucuuucuuucuuucuuccuuccuuccuuccuuccuuccuuccuuccuuucuuucuuucuuucuuuuuucuuuuuuucuuucugucuuuuuuuuuuuaagcaggcaccuuugcuaauuuccaguggucagcacauuuagcaagucaccagccgcucgcccaagcaagccauuaaucuauauuagaaauugaggaggauucgaacauucgugacgcuggcagccccuccccaugucugcagaugauucugcgucucccuugguugaaagagccugccauuucuauugcaaauuugccuuuuccuuugguguuugaauaucugcaucuaauaacaaggccauggcugcacaggagacugugacuguccuuggugccugacagugucaucacuggcugccacagagcuuggcuggacccucgcuuugcuggccccuggguucggggccaagaacccuuucuaguucuuucuccuagagaauuuuggcaaaaugugcuucuacuggaaugcuuccagugugugucugucuggaauauuauuuucuuucaucuuuccuccuccuccuuauuugcaacaggaacuguuuuuuucuuuuccuaaaaaguuuggaaaaaaaaaaaaaaagcauguccaugcuaauucaaaugaacucucugucucugucucuuugucucugucucgcugucuuuaucugucugcgugugcacauuuaaucuuuaaauccccuauguccuacuuucaaaacuaccaaaauagucucuccguuaaaaaaaaaaagaccaaaaccaaaaaaauugaaaguguugaguuucuacacaucugcauuagaaaaggggucacauugucagcuugguguuccagaaaugguucguugaguuaaaaacaaugccuguugcacaagcuuaugggccugaguucaaauccccggaaccuauaugaaagccagaugcauaggcggaacauucaaucccagcuccuguaggggcuugggaggcagagagaagaguccuuggaaagucacaggacagcgagccugaagcauacagcaaaagucaacggagaggugggcuuuaccaagguagaagaugaggacaaaaaccagaggaccuacacacacacacacacacacacacacacacacacacaccagcaccagugcucuuugcuaacagguaccaacaagauaaauaugcuccacuuuauucuggcaaagcccccaguucucacuggugugcagucuacacaguagcugccucucuccccagguccuccugguugcccugccuggaagacugacugcucacgcucuuucuggaaagcgagaggagcuaaccaccagggcuucagagcaaagcagagucagcuuccccagucuccaagcucauucccuccagguggcauugacugccucccuuucuagaaacuucucaccccucagccauaccugcucuuugaagccugggauacccgcuggaaaccacccacaguccuaaaacccuacaaucaagcucugcaaggaguguccuuaccuaguaccccccagauccuaaugugccccacugcuuccuuccuggacccuugacugacagcuacaguucgaaaucucagauguugaacuacauccuccuuaacccaggacacgcacuuucauccaagacacacacguguguaggaacagggggcguuucuggaagaagcuuucagcagacugauagcccuuucuucuucccccgaguuuccagccucccuucccucccugcccuucuaaaggcauuuggaaagaggugaaagagcuuuagaugcuccgcgucugugucugagccaaagggcagcugccggcagccccuccaccaggcucccagugacccuugucuggcucccugcaaguccaugcucacacaucuggcugccugcccaaaugugaccuugaaaauggcuuguaagaucucuucagggccuagaggcccucucuugaacccccucacuggccuugcccucucccagauguucccgagucccccgugugaccuuaggcauccucccugggauaccagucaaucaucaaagggucaugaagcaaaggaauccuagaaaacaagcagaauagaaauauccuugcaucugcucugcuucgucuuuguggcucggcauaaagacucccccggaugaaggccuaguccaguguuaguuaguugucaucaaauccugaauugaccucuucuguugacccccuccgauacagaguuaguucaugggaaaauuuggaacaggggucagagggaagaaggaagggguccaccccuuucuuuuguagcauugacacccacccccucacugcaccuccccuccccccaccacauacccagacauaaaacuacacaagagcgaucccucuauucuuccugucuuaaccgagccuccagauguagccucauugguagucuugguguguuccucaguguuugugcuuuuaauagauauugcaaguguguuuaaugugaaaauagaaacggagggcuuuuaaaagagcuuacucaaaauccugccaauuacugaaguagaccagacaagaaggagccucuuuuuuuuuuuuuuuuuaauacaaggaggacgggggcguuuccaccgaaagccuggcccuuugucuuuaaaaauauccaugucuuaggcacugaguuauaauaacgaacgcagauguagcugagucacauuaagaaagcaugaccgaaugccagugugucaggcuccaaugugucacaugucauaugcagcuuuccuacagaggagccaggauagcucuuacuugguggcucagagucuuuggauuggaggagaagauaaccuuucuuucuuucuuucuuucuuucuuucuuucuuucuuucuuucuuucuuucuuucuuucuuucuuucuuucuuucuuucuuucuuugcauguguuugugcgucuccuacgagcgugugcaugcucagauaugaaugggcacacuucaugcccaggaacaaaugugugcacuuguguguggaggcccgaagagcugaccucgcuaucucuccacuuucuuuugaggcagggugucuugcuggcaguggagcgagcguuagagagcuugcuuguccuggaaaucccaacugucucugaaacacugggauuacaggcagccacggccaccuuaccuacccagcuggcaccaagguuguugaguucugagccccagcccucucacuucccugccucaacugccuuaugcauuuggccaucccccaagccccaucuuuaacccccugugccaguugcuaaacugugccauccucuugccuuuaaaaugcuuucagucaccugcugaccuguauucaauggugagaaaucaccaagaugagccugcacgagcgggaguaaauuaucacuagacagaaacaaacaagucacuacccgaggccuaagacauuguacaaagcagccccaagaugucuuggggggcaggggguaaguggucuguccagcugccucugcaguagauccuaccauuugaaguagguugaugccaaugcggaggucaaaucuuccauaacauucggcagccucuggugaaugguggagcugaggaauuaauguugcuuaaaccuucuuccucuuucugcuucuuaaauuugagcucuguucuauuuuuuuuuccccacuuccaaacccugacuccuauucuccaagaauaaggaagcuuuagccaacugcaauuucaaaguauugccucuuaagcccgggccaaguguguagacuugauagaauucugauuaaugcagcauauuauauuaauuuucagaggaaccugcaggcauuucucccguuccuagugcaggcuggccugccagaagcauuugucuacguaaagagcuaaugucuucagcuaccaacaaccagaaagcuggaaaucuaucggaaggguuggcgucucuugaugugcauaaggcacacuacaaaauagauauagaacuuggcugaacuuugcuucaaauuugccaaucaaaacucagaagucucugccaaguuggcuucagaaucucuucguuggagccagcacuaauuaugucaacaaguagcucaggguuggccccuguuaaguucuucacuccuggggcuuaggacuaugccuuugguguguaggcaaacuggcccugugcagaugagcugcuccuggcuucuaccuaaaucucccauuucuuucuauuccccuggagcauucuacucccaucuuuaucauagauagcaaggguuuuggaaaggcagacagauggccugggccccaguccgagguuuucugaugaggccaagucuucuuagaaucacagccaugccugcaauugagaaaccucacugggcaguuggggaagucuagacuucuccauguacagcaucacucaggacaagucaguaccuggggaaagggaaggaggugacuauggaguagaugugggcaaguugagcugagguaacaggccugggagucucagcucacccucaugggaagcucuagagcuccaagggcccaucagagcugauccccauuugaucaguacagccagacauuuggaccucugccuugacaguuggguagacuggcccuggaaggacaugaccuugagaaugacagcccgaugaauucagagacucccuagaagagcagcaacugaaacagcaaggccuuccuggaaaggaaggcuaagcuacauuaucagucuggcaugaacacaccccuacccuuacuucagcucgggcccugccccagccguuccacaccaucauccucuaggauauagaccucucuucuauggauuaagguugcuaggaccuagcugcaucuguuguugaccuaacaccugaagcccaugucugaggguguuugguauguggacacauaugugugcaggugcaugcauguagaggccaggugagcaugccagguguccugccuuaucucaguucaccccguucuccuggaacaggagcucagccagacccugaagccagauucagcagaaagacccagugccucuccugugcugagguuacagguccgugcuuacuuuucaaguggguaacggguuuugaacuuggcuucccaugcuuggccuucccugcugaacaacccugcucauccuucaagccucugauuccaaagcugggcugacuccuugagacacugcaaaaaaaaaaaaaaaaaaaaaaaaaaaaagcccagcccagccuugugccagaugcagcagcauccuagauuuugacucuucagccugaaacaaaccaucccccacucuagcuagagguuuccauauuagagccaacugccaagcauggaaaauucugaugaaaccaagucaaauccccgucuccggccagaaaucuuaaauauguuagggcuaaaaucuucagaauuuagacauucaccagaaccaagaggcaccaaauggccagcacgaggcuuggaauccccacacacccuuuuuuuuuuuuuuuuuuuuuaaauuuccgagagcuacauagcaggcagcuuucaagaaacacugucucagcugaacccagacacuuccuccuguuuagauuggacucugagggaagguugggggcaagauuccuugggaagccugcuuucucuucaggaauguaauggaauucaaggguaauccuuaaaggcaagggcagccauuuguaaaggagaaaggagaaaaggaaaggaugcuaaggggaccuccuccgaggcugccauuaaaacaacagccacagcacaaagaacccaggaaaagaggaagaagccccuucugagcccccuuuguuuguaaauguguaaacagacccgcuaaagcaaaucccggauucauauucaacuugaaaaaaacagggagagacuguccacgacaugcuuagaaguuugaauacacuuucaguagcucuucguuaucucaaauuaaaucuuaaauugagcuugugguuccgugaauuaauacucgggcgggccuuucagcccggcugcugaggucauucaaaucuaaugguggaaauggucacaaggucagggcuuggcuggaaguguauagagugucuuuaugaugcccagcagauguuugcaucccacagcuggaacugccaggcacugggauggggaugggguggggggcgcucaucagggcguagaggaggaacuuauugcgugaauacagaauccugccauaucccaccguccugaaacaaggcaagccguuccuuaagcagaaaaaaaaaaaaaaccaaaccaaaccaaaacaaagcaaaacaaaacaaaacaaaaaaauguaacugcagucaugucugcaaacucaccauccccagacucugcggacagggaagggucucucucauccgucuacggaaugacacaaaacaacuugaacgugguccacuccaacaacauuuuaacggcagccucagcggaggugugguagcucauguuugagaacacagcuauggcccacgaauuugaggaacuuagauaaauguacacacacccgugcaaaugcacacaguucaaguuagcugagcccaggcugauaugaauccccuaggagaaagaagcguugucucacaguuuaagauagcugcaguguggcugugugugcgugcguguguguguguguguguguguguguguguguguguguguguguguaagcaagagaucaacaucauuauugagugucucccucugucauuuugaccuugguuuuugagauagaaucucucacuaacccuggaucccaugccuucagcuagacuggcuaccaagugagccccugggauccaccugucugccccacuggcacuggagggauccuggggugcaccgccacgcccagcuguuauguagaugcugagguuccaaacucacacccucacaauuccucaacacaugcuuuccaggagaacccaugcccccagcccuucagucuagauuuccugcuucugaacugggcauuuuuauuucauuuucuaguuccuuuugggauucugagaccacgucucguaguauccagccuagucucuaaaugucuggauccaacggcgaccuuaauuccaguccuuucuuucccggcuuuccaucacuggccucuggcuucagagcucuuuagaaauggcaucagaggaggcuuuggaggcaagauaugauggcgguaaggagaggaaggguccccgaaacucaccgaggaagcccuaggcagggucagcacggcuucagcacagguauguaaucucuaggucucuaggucccaccucugaucuucacuaucccucuaccacaccucugucuaauuuaaggacagggagaccccaggacuggaagcaccuccuguugugggaugagagagaaacacagaggaaccguauccagguagaggcaagggugcuucugcaggucaggggcaggcccaccccugccuccuugucaggagucggcuuugggguuguaucugugagacugaggucguggacugcugacaacgggggacagagccacagugaaggugucaggucaugaaggggaauuagcugccagguaucaauaggugcagauugcugcaggcacuggugacugagaacccugagugucucuauuaacuccucaggccaugaggccuuaaugacaccccugccaacaacagaagaggcagcaagugacagacgcaaagaaggaugccagcuaauccaaucugaacaccccauggggccugggaacucccaaggcccggcuccugucgccugucacauggugcaaagaggaugacacuaaagaucauccuccaagacaagggccuuagauggacaugagggucggggaggggugaggggacugaaaauaugggaugcaaaacuggaagugacucugcauguggaggaagcugagcugggggacgaggaagaccugugcagaaagaucugacaucucugucaguauuacugcuucuugcaaucuagggaaccuccaauauuugucuagcacugcuccgggcacucucaacugcuacuggaauaugaguucauacugauaaaauuuauuauaguaaauccuauucacagagguccuacugugugccacagauuagcacaugacuacuacuaagaaacauauuccagcaugucauuaugcucuagaccccuuucuguaccccccccccauuaaauauggcccacacuaugugccaacaacguuuggagaacuucccccccucccccgucauccucaagagugggcgguauuauuucaauuugcgauuaagauuaagcaggccaggacuccgcuagacucaaagccccgcgauucacucuagccacugaccuucaaacugcguuucccacacugugcaaguaucccuguguuaagcuuaaaguguugccguaacccuucccauugcacaaauggagacccuagagaugaaggggguuggagaaacggagcuauggcuccggacccuucccaugccauucugccccauugccggaaguugggaagcauggcuccuccuucuugguaagauucccaaggucaaaccaagcaauaggcuagccagauuuacccuaggaagcccuuaugcuuauugggcuuacuuaaagagugaaagugauuuacaagcagaaaugcaggugacccuaaagcaaucacucuagaaagucuccauccagcguggacgguggcuuuuuguucuguuugagccuuccacaagacacucucaccuggggaucuggucugucaaaugugaggcuccucucuagauagccucacuguugacacccagaaauaugagaucaagcaacugaacaaccagggauuuagccaacuggacacagacauuuaagcuccacccccguauuccagguuucugggcggggucuagaaucaguccucauuccacccccagcaggucuguguguuaugaucccacccagcugagggagaaggagggugccagcagcaccucaggauccuguagacagugaggacuggaaacucccaauccgaaagcuuccccuucccaaugagccccuuccugcuggcggucaugccaauggacaaaacuguccauagcacagcagugcagccuccugcaacaccuccagcacacgcagucggcagggaugacagagucauagaauuaggcucgacaagaaaggcaccagcaacagcaacagugauaaaaggaaggaagagggcacaguggagggagggaggaaaccgccagcaucccaggaacuuuuguaugcagcucucagauugacaggguugguacagucugcuucucuuuugcauguauacuuauauuguacacguguucucuuaaaguccuuggccuuggcuuggggaggugacucagugguuaagagugcuugccgcuguuguuucagaggacccagcuucaggacuuacuuagcauccauguugggcagcucacaacugccuaucacuccagcuccaggagaugcaguauccuucucuggcccccacagacgcuugcacacauacacaugugcucccacacacaccaauaaaacuaaaauaaaaaguauuuucaaaaaaaaaucacuuugcucuuagcuggguaguagaguaugguugguuaucuaucuaucuaucuaucuaucuaccauguaucauauguauguaucaucuauccaucuauauaugcauguaucuaucuauccaucugucugucuaucuaucuaucuaucuaucuaucuaucuaucuaucuaucuaucauguauccaucucucuuuaucuuucuccaucuaccucuagucccucccaucuccucucucucucacucuauuccuuuuucucucuauaucccccuuucucuucucucucuuucucauauagcuccccauucugcuuuugaaaggaagauaguagcuauaugacuauuuucauggcuucccccagaggccugaaaauuaaguguaaauaaauuauccauuaccagggaagcccuguccuucccacacgcccuccccaguacucucucagcuccuuccuucaccuccaagagacauuuuccaaggucacuaaauuaagccuucagacaaucgaaaaauugaaucuugguacaucuauuuuccuaacaaaauuucuguagcgcggauuggggcugacaggugcggccgcagagccuucugggcuguucaggucgauuuggccaagcaagagagcaucagcugggauuggagggaacaucugagccacucaggcccccugggagucacagagucccuuaccuccuugccacuguaaaugacugccccugucgcucucgaagcaucccuuuuuccuccucagccggcugccuccucacccccugcagccaacaguucaaaaaucuauucaauuauuuaucaaacagccccccccagcccccuccccccccccccgcaaucauugcaaauauguuuaaaucaaucuggaaacuguucuuugcaaggacucuaaugaugcuguugaaaccaccccauccugguaggaggagaagaacaggaaggauaggggucaugaguuugugagagaaaggagagcuucacccaggcucugcaguuaccacaggcuaucucgcuauccagagggcaugagucacccaggacccagaagcuggggauccuggcucacugagugccagccccuugucucuggaagucacuuccucucgcugggccuguuugccucauauacaagcuacauguuccuugagacucucuguaccccuucacuugggcuuccucagccuccaagauucauauuuaaaguuucugguggugaaaauuguauucuauacaggugcguacgugaauguaaaugccacagcaagacuuuaauuugcuauacagucuuaaggcuguggcauucuuggaagacaaucugaguuuuauucuucguuuugaguagcccccacgguccacagggguacccgggugcccguggccaccggcacaguaccaacgaccucugcaaaugagugcaggcaagcccaaaguguaccacaguauuucagucaagagaaugacugaagcuaucaguugauucaaaacugcucacacaggcaccccaaaugcggcuuccggaggcuugggacccagcagugcgaagcccacucaguuggcucuugcuguggccugcauaacaacagcgugugggccuucccagcuugucauaaaucuugcgcaucugcauuguuugugcugaaggguccgugcacuccuguaacaaaugccaggaggccagccagcaaagcugaugagggacggaguccccguccagcacuggccccgugcuaagucggcagaauauuuaaauaagggguuaauuuauaaagugaagcccgggaaacuuuccacgaucguugugcccgugucucauaaaucggcacaaauugaaucuagguuucugugcccgucagcuccuggguaaaccaaaauuuauugagagguacauagguugcuguccaaggaaacauaguaaaugagagaaauguauacucgggaggucgguaaacaagaugaggaggcagcuagcaggacgagauggcagagucaaaaugggagacccucuuugucccggguucagaagcacagcccugauggaggcuggcuuccagaaauccuuccuuuuuuuuuucacuuucuuuuucuuuuuucuuucuuucuguuacgaacauuuccacuggcuucuuagucuguuugucuuuuccagaaggaauuuauagaugcagauauuagggugugaggaucaagaggaguaugaagccgaggguuugcauacgucagauuaucaggcuugcuugaccagggccgcaguucuuacuggaaauaugugucugaggugaucacagcucuacucuaacaacaguggcuguuuaucauaaccaggcaugugucucucaucaguggagacaauuauaacagcaccucacguguuuugaggaccaacagugaaccagacacgagguuaaauguggugcaaacuuuauuuccagccaauuaaaggaugguuucuccaggguagguugaagguuuuuuauuguacacugggccacugguuuuuguuguuguuguuuguuuguuuuguuuuguuuuuuaaaucauacuccugucucccugccuagaaagcaaaggccagcauaccaguuaaguuucguugcuaacauuuuuauucugcaacuuuaauucauuugcuuggcacucuaacucacaggcaaaaucaccuggucaugaauagacccuuuuaaagccuacacacgguuuacagccacaucaucuuagggugguaagcagcacggcuaauuguaagcacagucgguagaauacuugccuaacauguguggaggccugaguucaggcugaucucagcacugcccaaacuuagggcccgguggcacacaccuguaaugcuagaacugggaaaguagagucaagaagaucagagguucgaaguuaaccucagcuguguagggaguuugaggcuggccugcucuguaugacaucuugccuuacaauggauuaaaacaaacaaacaaacaaacaaacaacacuaaagauaaauauccauacacagugccuugagcauauuuauaggucaguuguguguuaaagagaaagcagaauuaugcuaagcucugugaaaccuuacaauguaaugcuaacccaagaccugaaaucaguacuauugacuggacucgucgucgcggcagcucugccuggagggaacagagaugcagagucacuugcgugagagcacagagcagcugcagaacucugccuucuccagucugcucauacuguaaacucggcuagugggcugaagagggcuuaaaaaggaacacuuggcuaaaaugcauuuagcaaacaugaucguaaaaacuucccagacuucauuugauaagaaaaggggccagaccgaaacuguaaugcaaugucuacguuguucauuucugacacuuuacauaaauagguuccucaccuguguguccucaguugagaccaguaagaaaauagaaaguucuucucccgucugagcugacacuucuucaaagccuuguuauucuuguucucuucgauguauaucaacuccaaaauacacagugacacgaaaauuguguauucagauugcgcuauugauucauggagaaagugaccuuguguguacacacgaaagggaagaaaucuauauaugcugccuagccucuucucuguggcaguggguugcacgggagcagauauaguauauauauauauauauauauauauauauauauauauauauauauauauguguguguguguguguauauacauauauauauauauauauaucagauauaguauauauauauagccuguuuuaacaccuacauuacuuuaccuuugcaaagacuuauagcauaaggguguggaucgcagggaaggcccccuguaaagugcacagguguggcuuugggggaccuaugucagguuaaaauccuguguuccauuugcaagagccagaggugggagggucucccuaggaucuggacuaugguuuuucccagggauaagguuuucuuuuuaagcuuaugcacccauagaccuggcacuagggacccaggggagugacauuacccaccgucuuaaugagauggcaauacccccacaccucagccugcugucacguuucaucagucacguuauguuguuugcaucuguauuaguugcaucucugguugccgugaccaacucucugauagaaauaagaaguggaagguguauuuuuggcuuccuguuucaggagacuucaguccaucauggugggggaggcaugguggugggaaccuccccuguggaagggacuuguagcagagucucagcuacaagucuaccaccacgaagcagccagcauagaccuguggguugucccuucaaaggcuuaguuacucaggcuccaccuacuaaacuguccacaacuuccugaagccaugcccccaucuaggaaauaaggguuugaacccaggagccuguuuguuaaauggauguuucccauuuaaacauaauagcuucuaagcccaaccgauaggaagccuguuuuccagacaaggacucaugagcauauucuauuaagauaaacuuacagcuguugcccugucaaagcaagaaaaaaagaaaagguuuugucuuuguauuaagaaaggagguuagucauggagugaaauagaugauuagguagaaguguuucugcgucucuauuugcaauacuauguaauguacuuuuauaaagaaauuagaucacaaauaaaguuuuuguaaaaaguuuccaaaaaagaaaaaaagucauaaacauaacagcaagcugacgacgcccugggauugguaacuguaguccuucguuucuccucacagcugccuucaaguugagguucucucagcaucuggagguggacaaagcaacucacauagaccccaguacagccugccagaggucaggaggcucaagacagagaugggggucaguacuucagcucucugaccucaaaucagaucagcuuuguuauucuacacaucuuuggaugugugucucgaaccccucaccagagaacuuggccaagaacugucgacuugcucuccccaagcaagauaggggucugggcaaagagaugugagaaagaaaguggagggaaagacagugggagagaugaggcgagcggaggcuggaugugggcacagagaggccacuucugcguuuuguucccuagaaaucagagcccagguucuauuagcaggacauucuaggaguucacguugcacuuggcugccuaggaaggaagcaggcagaagaaugagggggggggggaaauagcaacguaggaagcuuaaaaaguggucggcuguauguaaauggcuuuuuauuauaaccucgaggcugaagcggcaggcuucagcuguguaaaaugcugcucgcucgcucgcuugcucuuaucacgguucauagagauuaccuuucaccgugaacuucauguucauuucuucccacacuuagggaggagagcgaggcugugaccccuccauuucccaguccuugccagccgccggcuccuuccuccggguuuugugucacccuguaugauauugcgucaagucaauucacugcagcaguugaaccaaaagcaauuuaagucaaaauaaaaaaaaaauggacaaauacggaugucauuucuaaagcuuguucaaaggccuuugacaucacucaaagccugaaugcuucucagagccaaggcauucucuuucuuucuuuuucucucccccccccccagcaaugcaggauuggagaucgaacacagacaagcuaaccagaaagcauugccagacucuguaucauguauugagaaugauugauuccuaaccaaaguaaacucccgaaaggucaauuaauauuuauuauuucaacaugguuuaucuguagcaauaauagguaccaccuaucaauauuuauuauagaugaguaugcuguuagaagacuuuaucuaacuuaauuuucguaaucaccuugcauaggauaucuauaaaaauuaggcuaugaaagcugauguuacugaugaagacaccaugucuuugaccagcucugagcacagacaaaauauuucuuuuacuuuguaauauguaaggguauaugagugcaggugugugugucuguuucucugucucugucucuguguguguguguguguguguguguauguguauguauguguguguaugucugaguguguauguguguguaugucugugugucuacguguguguauguauguguauaugucuguguguguauguauauauguaugucuguguguguauguguguguauauauauauguguauguguguguaugucuguauguguauguguguguguguguguguguguguguguguguguauguguguauguguauaugcauguguauaugucuaggccagaggucagucucagcuaucauuccucacauaccauucaccucgcuuuucgagacaggucuuuggccacauuggugcucaccaagcaggcuaggcuagcugaucagugaauccuggauaucuguccaucucugcuuccccagcucugggauggcaagcguaagccaccaugccucgggccuuuacauagguucuauggggcucaagcucagguguuugugguugcaaggcagguacauacugacuuaucaagcuaucauggcaaccccugaguacagaacucacgagagugaaggucauucugugugaguccagaagucucucuucauggugccgacuugucauuuggaggaagacuggcaaaguggaacacagagcucugcacaggccgucugccuucuucuguguguauuugagucuuagaauggugaagcuugcacacacacagacacacacacacacacacacacacacacacacuuggcaggggaggaaaauugacuuuugaaggaaaaaaaacuggaaaagcuagugggaaaagccaauccccaugggugauacacuguaggauucauuuacauaacauucuggaaaugucaaaauuauacaaauggacacuagaucagcaguggccaguagcugggaggaggguggugucaggggggcaagguggcuacagagggcaacugaggaguccuggggccuccagaaaugcucugcaucuugacagccacugccagugucccuacugugacauguccuuaccauuagggcacaugggucaaguguaugugggaucacggcauuauuucuuacaacugcccaugaaucugugcguguagguacuucuacaccaagagcauaauuaaaacacaaacaauuguuggacauuuggagaagcaaagcaaaacaaaacaaaacaaaaugccaagaacauuucaaugguguacagcauauaucuucucucuugccaccucuaccucauuugcagauuacaaaaugcaaaggcuuuaaaguguaguuauaccuacaugcugggcaguagccaaccucugaccguucuuagaauggucagaaggccacgcggaagcccguuguuaccuuggccuugauucagauggaaagagaacaacgaggcccccuggccaggagcccuugugaucacuguggaccaagaauggauguguuuuaugugcaaagccgugaccuuauuuuccccuccucgugcuaauaggugugaagauucugcaauaaauauugcuuaugguuguuaauggaacggcagcccagauagucagggcauguugauuuucuuauuuuuaauuucuccuaguucuugcacuugugagaagugggggagggguggaguaguuuacccuggagacaggccugagccagagucugugccccagugauauauucauaccaaggaaaacacuguaucugcauugcagauacagaagaaugagcuaggagauacauuggaaucccugaugccagcaccucucaccaugcuguggagauccuuucuccaaguguccuaggagcugcggaaggaccucugagguccaagcacuaaucaacgcagacaaaaccagaagccccuucauuccccuuuuguuauuaccaaugugaaaaaucaccacugucaacuugacagaaccuggaaccagcugccagaugguucucaggacaugccuacagagaacugccuugauuacaaugauuacagugggaagaccacccacuguggguggcaccauucccuggcuggccuccuggucuguauauguggagagagggagccacgcagaagcuugcauucauucaucacucugucccuaacuguggaugccaugugaccagcugcuucauguuccugccccaucgaccucccugccaugacaggcuguaccuccugagccagaauaaacccugcccccuuaaguugccuuuguuacguuauuuugaugacagcaacaguaaaagaaacugagauaaccacuuuguaauggggccucucuucuauucccugugugguccucacuccccuuucagaagggcacguacgugaagggucagaugaguugcugcaugugaauaggguucacgcacacaaggcuguguguaagucugaguagucaucaguguaaggugaaaagaaccccgugccuuucaguuucgccuucacuggguucucauagaagaauauuugugaugcaagaucuuguguagcucaggcuggccucaaauuucuuaaguggcugaggcuggccuagaauuucuaaucuucuaguaucccaucucuuaagcauuaagauuacagguaugcacugcugugcauagcucuuuuauaaacuuuuuuuaaaagugugugugugugugugugugugugugugugugugugugugucuaucugucugucuguucaucugucuacaggacaagugccauucaugcauguggaacuuagaggacauauuggauugggugucaggccucaccuucuaccuguuugacauacgauguuuguuuuguuuuguuuuguuuuguuucccacaaucacauaugucagauuagcugauucauaagcuaccagguauucugucucugccucccaucucaucauaauagugucaaaucacugacacaacugaacuggcuugguguagauucugggggaccugaacucggaucgucaugcuuguccaacaagugcuuuacccacuuagccaucucuuuagucucuugcuucaguuauuuuuaaucaaaacagguaugaucaugaaccccgacagugcacacuccuaacucugaggcacugagcgaaagccuggcacucuuccuguguuguuugucucauggucgguccaauucugaagggcaauugugcccugauuuggggaaagcugguacaaaguauagcauagaguaaggauucacuagaacugugguggaagauucaauaacuguguaagugguggucauggaaguccuucuauaaggaaggaugagggcaggguccuuccagcaugccaucacuguuaccagaagucuauuaaagucucaguggagcccaugguuucuccuacaucauucguacagacacuagggaagauuccugcuggucauuauugauguucaccaucuuaucugggguuugcucaucuaugauggaccuucaauucaccuagcccaugauaucuugcuaagugcaaauucugguucaaguguuucaggauucugugucucauacacagagccccaaagcgacaccagagucaugggacugagaacucacucuuaagucaaaaccuuuacaguccucaacagagucacuauugcugucuagaggcauuuuggaacgguguagaugcaugcuggagccucuggacauuuaguagaugaugucuacagcucuguccagugucucaauacaacacagcugcccggaaacugagaacacaccccugggccacggggcauguaugccagcugguaaggcuuuaacucugaauucacuauucuucacacagaaacacaaugugucucaagucucccagaaaugcaaacacuuucuaaacaaggggaagauuguacuguguauguccaaaaugccaacacuuaggaggcaucuugggagguucacaacaauuugagccuugaugacgugugacuuguauguuucaagacuuacuguauucaccauuggugagcacuugcacccucuagcugcccucaacacccaggagaacagguucuuccuaugcuccucaaaucugcguccagagaugcauugauaacaccauggaaaguggcaaauauuaccccuaaggauggcucugucuauucuugaucuccaaauaguggcuucacuaugauguuccgguuccuuuuuuuuuuuuuuuuuuuuucuguuuauuuuauacuucagacuuuuuuuuuuaaucaauuuuugguuaguuauaugcauaguggauuauguuauucacuaauuucacuccaaaaccccaauaaaaacaacuagacauucuuuuucaaauaguuauuuuaucaauaacucuccauuccccauacucaugcuaucuauuaacccucgauaaauuccuuggaucacacacacacacacaaaaaaaaaagaaugaaaagaaaacagaaaaacaggugugcagcaggagaagagcuugaggaucagaggacggaggaaggacacauaagaggauacuaggggugaucagaguacauuguacacccacaaaacugugaaagaaauaaguagauucaaaaagcauuuuaaagugaguguuuuaaagauuucuuucuggagcuaaaguguguguuugugugaguguaucucacaugugugugaaugcacacagaaaccagaagggaaugccagauccccuggagcugugagcugcccaacaugggugcuaugauuugaacucaguuccucggggagacugggaaauacucucaauggcugauucucucuccaggcccaugggaggaaaaaaaaacuauuaaaagacauaugggaaagaaaaccuuauguacagacaugcauguguacacacaugugcacacacaaauguaaacacauacacacccacgcucacacaugucaggacuggcgagaccaagaagcgguguguuaccaagcuggauguaucgugagcgcugcuaacauugcacuuauuuuugagaccuugcuuuuggcaaucauuucuccucuuauuauuuuuuuuuuccuuuuuggcaccaaagcacuguuuccacaaauagcacaucuaauggagugugcgacuuuauugcugucagcugcuauaacagcagaggaaaauucaauaaacacagaagcuaagacgagaacauagaaggacuucccacuccagaaguuauguauaauaaccuuucuagaagauucucuagucacccaggaaauucuaacuuuuuguacuaagaagccacccuauucagagccuggugacaguagguauucagccaggucuuggggcacauucaggaugauugugaccacugugcugaccugaagaaccaccggucuuccccacagggcugaggcucuccagcuggaggagaugacauaacuguucaaugugccuaagcuucaggcacuaacugucuauggaugcagcaagcucacgacugaaaugauauaauucuuugccaggauaacugggacucucuuucuucagcagaucaggguuccaaaguaaaggaugaggcauuuaaaaaaaaaaaaaagagcauaaauaugugaggacguuagcaaaucaaaguaauugaggaguaaaauaauucauuccaugccccugccucagcauggcugaaacagcacaccaugaaguggcuuaaccauaccaccaaauauuuagccagagccaagagcaauuuuuuauuauuauuauuuuuauaucuagguuugauuuacuaaccuucagugcauucccuauuuuuagagguuggcucauaguuuucguuuguuuucuuggaagcacugacuccuccccaggguuucagcuguccacucgguucuuaauggcagagcaacacugagaagcauaauuacauuuccuaauuauguguaauuaggcaaaacccagaugauguauccaaugugcucccggaauagccaggggucaaggagcgccggaauucaguaacauuuuuauaaauaagugcguuaguuaacucugagguccaaggugguacuggaugccuuguagaccaauauaaugguugaaauauauagcguucauuuauuuagccaaguaaagcuauaauugauucccugccuccuuacucuccucuuucauauauauauauauauauauauauauauauauauauauauauacauacagagagagagagagagaguuagauuugcuauucuuagucuaagaggggcccucuaaacucugaaccacaguucugcuuacugacagcguaagugauauuuauuuuuucaaagccuaauccuuuugaaacauggagaaauaaauacauccuuuuaucuaccauaugccugggaugggaaauaaauucuuauuuuccuacggugcaguaccagugggcuacaaugaauaauuugggcagguucccugaagauaauagggaagccuucucuauuaccagggauaauuaugaaucucauaauagaaaacaucccgagcccgaacaucaaucagggaagauaaacaauggggaaugauagguauacaaaagggaaaauggcgucagcacacauggagggggaagaccgugggauuccagcugggcuauaaaucauagagucaaauaauuccuacgcaauuaauaucuucaaauuaaaacauacauuuuauuaaaaaaagaaaaaaaugguggacuuuuugagccagacaacuggcuacuuuacaagauuaacccaagaaccucagagcuagucuuguguggaucucuccaaucucuccugcccccaaguugguugggacauuguuaacagcccaaccauguguacucaugggaugacugaccucaagccgguucccagggacagaccaugggcugccaaggccagagcuaauggugggugacccuugggaucucuagaaacacugguuuauggagcuggaacacugacugccucggucaguccagagcuugucuacaggcaagcacaugcagcuuucgagcuauagaaaaauaggaaagcuuucauuccuguuccuaaaggagcauugucaccuucuagugaagugcccuuuguuccugggcuaucaggggcuagagagauaguucagcaguuaagugcacugacugcucuuccgagguccugaguucaaaucccagcaaccacauaguggcucaaaaccaucuguaaugagaucugaugcccucuucuggugcaucugaagacagcuacaguguacuuacauguaauaaauaaauaaaucuuuaaaaaaaaaaucaauacuuaagguauuucuauguacuucucuuucuaaccacaguaggauucuucccuaacuaugagaaaauugugccuugcuauccuguuagucuccagugaguuuccagaaucagauauaaggcaguaugacuaauuuaucuccuaagucauaggcaugaaccaacaaggugucccguuuuccucauaucuuccacguguggaaccucaaagagugacaggaauuccaacaggaucuuucuuucccucuccccguuacaaacagggacuccaucugagucaguugucaaauaugccuggaaggccgcaaaaauaugcuccuggauuuuguuuuauuggcccucaucuaauauuuuaccaaacauauuuuuaaagaaauauauaauuugucccccaaagcaaggguuuucccccaugccauauaauuugcuaaguguggcuuuacugcacuguagccuauaauuuauagucagccuccacaaggcaaaaaauaacucccagcuaugauuaaguaaguaauggacaagguaacuaauauucccggaaggaagcccuuccagacacucauuuuuaaugacaaaacaggggagguugagaugugugguccugcacaaauuuaacugggccgugugaaauggagaggcagcaugauaaacuggccuaucugggcagugaagacaugagccgagccagauuuuacacuugcauuuuaaugagccugugccacgucuucccccgugccaggcaaaugggucugugcaaccaguuuuccccgcuaaaauaauucuuggggaaugaggauucuagucaaguacaaaugaguucugagguagcggucuacauuguguagauggggaagcaugacaguguggagaagacucagacuugauaggcaauacuaagcuggggagaugccucagucagugcuugcccugcuagcaugagguccugaguuccauccccagagacacaucgaauaugugugugugguagugaacacuuauaagcccagugcuggagugguagagacaggcagaucucuggggcucacuggccucgugggcugaccucaccggauggaugagcucuagugagaagcgcucucucucucucucucucucucucucucucucucucuugguuuuuugagacaggguuucucucuguagcccuggcuguccuggaacucacucuguagaccaggcuggccuugaacucagaaauccacccaccucuuccucccaagugcugggguuaaaggcauagaagcucugucucaaaaaaacaaaacaaaacaaaacaaaaacaacaacaacaacaacaaaaaaaacccucagaggacaguaccucaggcaugacucucuaccuccacgugugaccacagagauagaugcaucaacacacacacacacacacacacacacacacacacacacacacacacagagugggggggggagggagagacagacagaaagacagagagagauacagagagagagauacacagagagagagaguacauauacccacacagauagaugcaucaaaacaaacacacacacacacacacacacacaugggguggggagggggcggagaaagaaagagggagggagagagaaagagaggugggguagagaggggaauaugauuaucagacuugggagauauuugacaaacuguaaaaaugacaguauguuacaaaccaggaaagaagcaacacaggucugcccacugcuucgcacccugccuacaauaagaggagaagcccauuuccucaccagguaaaguaggcucaccuuguggaucgcacuggccaauggaaucuuaauaaaaucuguguucccagaaaauggcuagaaccuggaccucucucuuguagccuaccauccugaggccacucuaagaucaugucuggauaaaggaugacaggccacauuaaggaggccuuguugucugaacugggagcuugcugacccccuauauaugagaagaucauucuagaaucauugagcagccaaucauuacuaagcuaacagcagagaccaaccaagacugccugcgcucaagaaggagucccugcucuuuguauagucauaaauaaacaaacuggggucaggagaggggggaagguugcuguucuuacccacugaauucuguagagcuuucgugcauagcaaacgcuaacaaauacagaaucaacaaccgggaaauaaugaacucccuaacucuacaaaaugaacucucaaugauuuagcuuuuagucauugacaugauuucugagaaaaccaccaagggcugcgagccuccuccuaccaucccuuguccaucuaaccagaugaagugugguuccugaguguugaagugggucauuugacuggaccagugccuucaggaagagcccaugucaggaugaggcugccugucuucaucagcccuugccaaggcagaaacggaguucuguagauguggagcacauaaacacuggggauuggagagaccuuuaucugguguugccuaaggguguagggagccuggccugguguaaggagggaggagggugcccugcagaagagggaagcaggagagaaucugagcaggccaaauuuagccuaauuaacagauuugccuaaggcugaccccgaagcagaaagugaagccuagaucagccugcucaacuccuaccaauacgguaaugaugagguugaaccacccguucuuaaucccauagaagaguuucccaaaauagacaggaguuagacaaagaacaccccuacgcuuccuaucuccuccgagucccuguuuccuuaaugacccaacgcauuuguucagcgcagucuuuguccucgaagagagguuucugcagcucguggucagcuguccaugauuuuguuucuacuuaguagcaaaggggccgagagggcuuugcucauaaaaccaguauccuccuguuggagauggguguguggcuacugacugcacuguaauaagcuuggcuacaggaggaaggacagcauaguugaaucuguuuuaggauuugcuccauggcccuugaagggcacuucuguaugcucacucaucaacagccauucagcuccccaguuuggccacccuucugccuauauaccuaaggaaggguaugggcaagacaugagucuccucaagaugacucuucauucucccauguuaccagauuugacuacguuucacuauugaaauguugggguauaccucuaaauacuuaagagccuaggguugucuagacaagggggggauguggcacagucaccaacugcugacugagguggacucuguaacccuuaccuacuggguuucaugcaguagaguggucuccguguacucugaacagacaagaccuugguaacugacacuggagugacagaauguggcaucugagauugauugacaagagcuugagauguuugccuuuucucucagcuuucuuguuuuuaggaagacuauauaccacacugugaggagcuucaagcaguaccaaauggaaguccaugugucaaggacacagaccucuagccaacaacugaagcuuguccacugauaaggacgauugacaauuugauaugaucuagagucacaagagaugcagaccucugggcuugggagggaguuccuagauuagguugacugagguuggaggaucuaccuaaggcgggggggggggggggggcaucauucuaugcaguggaggucccagacuaaagacaaagcagagagagcugagugcagcauucagcccucuccaccuccugacugcaaccaugaugugaugaucggcugccugcacuccugccaccacgaccuuccucaucacgacgagcugugcucuugaccaguagggcaaagcaaacccuuccuuuccuaaguugcuucugucagauauuuuuucucgcaauaaccagaaaaguaacugagacagucccuguguuagugugccaucuuggaagucugucuuccagccuuaguuaguuaggcucgugcguggcuacagaugaaaccucuugacuuaaagggagucccaagccaaauugucauuuaagcugccccucaguuccuaacccacccaaauuguguaaacucuggucacccuuuugaagggcuaaguuuugguguaguauguuaccaacacuaaagugggcuaucuagacugcccacagugcaagacauuuacaauuaaaaugagccagggguggcagcucacaccuuugauucaaggucugaggcaaaggccugcagaccucugugaaguugggaccagccuggugaugcuggguaugguauugcacaccuuuaaucccagcacuggcgagacagaggcagguggaucgcugugaguucaaggccagccuagucuacaaagugaguuccaggacagcuaggguucuauuauacagugaaacccugucccagaaaacccaaagcaaaaaggaggaggaaggggagacaagaagaagaggaagaagaggaagaagagggagaaggagaagcagcagcagcagcagccaccacugccgcugccaccuaguguaguguacugaguuccaggacagagacucuaucucaaaacaacaacaaaaccuuaccuaucaacaacaaaacaaaucuugcuuagaaugagggugcauguaggacccccauaauacuuucaucuaacacuugacuuuaauauuuauacauuuguggaugagacuuuuacaaaucauuaaguccucuuaccacuuucacuuuuuaaaaaaagguguuuagugguggcaauauuuuuaauuuuauguuuauguuugccuguauguauguauguauguauguauguauguauguaugcauguaugugcuccaugugcauaccuggugcuuucaaaggccagaagagggugucagaucuccugaaccuggaguuacagacgcaaguccccauguaggugcugugacuagaaacccugguccucugcaagaucagcuggugcucuuaagcacugagccacugaguaucucuccaggccagauuauuuguuuuauggagaaaggacacuagaaaucuaacgaacugauauucguauccuggcucugugaggaaucaacuagcugaacauaacagguaauuaacgauguugugccuuggcuuucuccucugugaaaugagauuaaccaauccauuaguauucaaagcacccccccacacacacacaguuacaaauacauggucaaugguaucugaagauuucauugugauucagcauuuauuuuaguuauaagcauuuaaaauccagaauucgaguuugaacggauguucuauaacuugauugguuaugugccuccugccuggugucguacuuacuuuucccguugcugggauaaaaugucaggcaaagcaauuuagguuagagaagauuuauuuuugcuuacauucagaggaauacagucuguaugaauguggaaaacauguaggcagguaggggaggcacagcagcaagagcaggaggcuggcugacugugcugaaucuguaagcaggaagcagggcagggaaggccaccuccugcuuagcucccuuccuccauuguccccacacaguccuuaugcaguccuggaucccagccagagaaugacagcacacaaggugggugggucuucccaccucaauaacauacuccagacagcgcccaacaguaaagcccagaggcccaucuaccuugugauucuagguguuguccaguuaaaacaaaacaaaaaacaaaacaaaacaaaacaaccacucaacaauacaguuagucuccauuuuucauggauucccuugaccacgaggcagaaucuuuguauauuuuucucaucagagauucuuaucugagauccuuggaaauucuaccuuuccuuugauagguacagaggaagaaaaaccuaauuuaauaggugccccauagcaugguagugauguaguuggcucccuguuaggaagcuaagcuuuuaaggauguaccucugguccagggagguuuucagugagccaagagauaccacaagcuguccuugguaucauaauugaauagagaauccaucagcaauaaaucuucagguacgauggagacuaucauauagaagucagaaacuaacauaacuuaaaaauuucgauauuauggacacacacacacauucuuuuuuauuucugaaagaauuuccaaaaugcuguguuaaaaagaaaaagacgccuggcauugguggcgcacuaauccuaguacuugggaggcagaggaagaugaauuucugaguucgaggccauccuggucuacagaaugaguuccaggacagccaaggcuauacagagaaacccugucuagaaaaaaaaaagaaagaaagaaagaaagagagagugagagagagggagggagggagggagggagggagggagagagagagagagagagagagagagagagagagagagagagagagagagaaagaaagaaagaaagaaagaaagaaagaaagaaagaaagaaagaaagaaagaaagaaagaaaagacagggcaggugcagugguccagacuuguaacccagucaccugagagcugaggcaggagagcugccaugaguucaaggucaaccuggacuacauagcauuccucugucucaaaaaugggacuggggacauaguucaguagguaaaauaucugccuagcauucguaaagcccuggcuucacccccuauccagcaugacauaaaccagguaugguguugggagccuguaaacucaggacuggguaauaggagauucacaaguucaaggucacccucagcugcaaaggagggcagcuugagcuauaugagagcugggggggggggcggugaggaagaagggagggaggggagagagagagagagagagagagagagagagagagagagagagagaaaaugaauaaucuuuauuuuuauuucacuagauuucaguccagauuuuucucagcagucuaugacuuugauacuuaauuuguugauuuuuuuucuaaauaaaaccaucacagugaacauuauucuccuuacucuuucaaauugcucacgaggaacuuagaguacaucauaaggaaaauuggcuuauuuuagagaaaaugaggagacguugcugcucaggaaacaguauuuauuaucugugcagucaaucaacuagcaucccuuuguucuacaaaauaaauccugugugucuuuuaacaccaaauauuuaaaaugaucaugaaauggauacuaaugaauuugggagaccaagaaggcugucauuuagaugguauuaauagcuuguaaggcauuuauuuaguuaauauuuuacuucugguauguggaucucucaaauuauaaaacaguguuggcuguguuaagacacucacuguagcggcagcuaauuuuugagccacuuuuguuaaaauuaagccuuaaaugugcguuauggguuuuauuuccucacugaacuaacagcgucucaaauucauacuccauuauuucauuuagaaaggaaugagacacgcgguaaauaaaucagggccaugauugacagccuaccuagaaagauuagacaauugggggugaugggccccuacucccccaauuauugccuuuguucuuacaaguguguuuaaaucuauuucuguuaauuuacaauuugaaagguggaugagaagcagaguuugaaaaauagauuacugucuucauuaauacagguuugaccuacaaagucuucacguacuuaaugauuaaaaaccaaaguacuaaauaauaaauuauaagaauuuauaggagucaucaucuugaaauuagcuuacugaauguucuuaucauaauaaaucugagugggugucuaauuuaguguuagcugacuaaaauuauauguuacgggcaggggaaaaaaaacacuuuuguuugaagacaaaugcggcaaguuuaaucacaggugauaugaaaggcacccaucucuugcugguucccuucauagaaacuuuggcaaaacagguugaaggaagaucaauuccaauuuguaaaucugccgagcaagaaaauuccccccaggcacuaggagugauguuuacguuaccuuccuaugugaagcuacaccugucagagucucaguauagacuaaguuaaccauggggaauauaugcaguccuccccauguggaguguacagagauccucucagggucauugccaagguuaaaugaacucuugugugucgguggauagaugggaggaaacuauugcuucccucuucugccucaguuucccucuuccuguguagaggaauuuuaauccagcaaagugacugcucuggcaaggguaggucugugugguccugcuggaaugcagacacgcccucagcacgcaucuuuaagguaaaauuagccauguuugaaacguuggacacgcccaacucucaggggaacagagagaaagggggaagcaacuuaagagccaggcagagcgagucagugcagugagugcgguggagcugaguccauucaugagcucaggcaguccagugcgggucagcagaggccguuguagucagagaguaaggagcuagaagguuagaauaaauugccagaguuaguaugaggccaagcagagcaauucagcgagaaagccuagagaagucagguugaaucagucagcuuagaggggaguuugagccagaacagcggaguugaaccagccaucuaggguucaggaagaacuagaaagggugagcuuguucagcagugagccuccuagaggacacuugcauccuguggguaagcuuuuacaccaugugugucucaagcaugacuguuccuucaacacuguuccuccaggucuuugcccuggucagucugugcuaaggcagaggucccaacaccaaggcuuacagccgcccugguucaguuaaugggagaggggcuaaaagagguuuccagggcagaugacacuguauccucaaguugaugagaccuagagucaccuuggauacaaaucucacccugagguuauuucuagguuggaucaaucaaggggaaaagacccgcccuaaaugugcguagcagcauccuauaggcuggggucuagagugaauacaaacaguguagcaugagagcugccuucucauacuucugccauagccugccuuuuccaccaagaugggcugcacccucacacggugggcuagaguagcccucccucccuuaaauugcuuaucgucaguuauucagucacagugaugagaaaaguagcagccaauauaagaaguuacagugauuuuauaguaaaauagaaauaaggucaaucucuuucggauaacugugguaaaccaguguauaauuuaaucuuguuuucaaguuuaguauguuaugaaauugaauaggaugugugugugugugucuguguauguguguguguguguguguguacaugcucaaguacauacacagcacacauuaaauaauuugcuccaaaauauacagaauuuguacaaauuaaagggagaaguaggauuccucccacagaaacacaguggccaaagaaaacgacaaagaaauuaagggaaaaaaaauagauacacauuugaaaaauucuugauuguuaaaaaaacauaacuauggaaauugagaacugagaugacaguuugcaccaagaccccagcaaagguuaugcacuggcgagcauucaugcuauaaaaagguaagaagugcucgcuccaaucuagccuaaaguccaucucuuccuccaugguuugauuggcagccucauuccugauacauuucuuaagcaacuuucugauaagucuucaugggguuaagacuuguucuggaagguucuucacuuucacugccuuaccugcugacucucagagggcuggcgccucucagucagaguucuuagccuaaccuugaccauccagucauuccacucccuacaaagugccugagcagagagaaucucuaguucauaccaccacaggcuucugcccugaacguugugaaauuuuacuaaaacucugacuccuugcuaaucacccaguuagaagagucuguguuuguuuagcacuuuauuuguguguuuuugguuucugggauugaacccagggcagcacuaggcaagugcucugccacugagcgaagccccugggcccagaauuaauuuaaauucacacguccaaucaccuacccauuugaaaaguauggaaucuuaagguccugacaacaggauauuuuucaccuaagcuuuucaaauguauuaaauacagcauagagagagacagaaaagaggaggaaggggaaagaaaggaaaaaggagagagagagaggggggggacaagaacuguguguccaccuuauagaacacaugcaaaacagaauaaguuguagacaugaauccauuauuauggccuuucuugcuuuuuuuuuuuuuaacucuggagaaaaauaccuauucuguaauuuccucauuugcgugaacgcauauggugcuggggagcaccuguuaacugcaaacuguaaggaccugugagccagaagccugacgagaggcagcaauggacggaguggguguuauucuagguaugcuccugcuguucugacuuucuuuccauccacauauaauauuuuauacauacguauaugcauguauaugucccuggcagaagagucccauucucuuccugugugucaccaaguucaggccugguggccaggccugcuuugcaggguagcacuuuucucucuguuuuccaaaucuaaaccuccugcuuggcugagcugcgagggagcugccagggaggggaaguagaggaggcaggagugaauuccauucuucacccccugcugauccccccaacugcaauuucuaauuaauuaguagagucgugccuuccagaaaagagcaggcauaccuuugggaaccucaccaggaagaagugggucuuguggugcaaaaagaaaagcuucucucucucuuuuuuuaauauuaaaaauuaauuaaaaacggaaugugugaaagccggggauuuuaucauuaguacccauuccagagggccaauuccuguuggugaaacuuuagucauugucacaauacauuggauuuuaggagggugaccuuaguaagucuagcucaucaauggguauggggguuccugaaacuuagggccuucugugcuugaguuggcuuuuaaaaguauuaaacucaaaaaggcauuauucauggucugcuguguucugaggaugugacggggcagacggaguaucaauagucaucuugaauugguuucaaagaaaagacacggaguguguguguguguguguucuguauagguaaauguaagccugugcauguaugugcaggcgcaccugugcacaugugggccauugcaucccauguuuuacacagguccugcaucugaacucugguccuuaggguauugcaacagguacuuucccagccucugacaauuauuuucaauggaagaaaguccaaaaagccauuucaugugagagaacacagggcguuuccucuuugcuuugcaaagacgguauuucucuaacacaaaacaggucucugacaaaucauacuuuccccuggcuuaaaugagaaauuauaauaaacuucaggguuucauaacauacccugacagugguggccuaucgcucccguugcucacauaucucucaauuuuaagagaagguuuuacauucuauuuuuauaaguauaugaauuauauaaaguuacagguuguaucauagcacuucaugcauguguguguaauauacuuuggucuugucaccucccguccaagagcaaaaauuuagggugacuccaaaagaaaauauauugaguuuuaggccuuuuaucgguaauucuuaacaagugcauaaacucugcuucaagugugagaacugaaguggcuucuaacaucacuuuacuauccucaaguguagacuuuguuagaggagagauuuugaucaauacucuugaaaaauagguuauuguuucuaugagaguauaugcuaugugucaguuccaccauaauaaauguuuaauaaauauuugugaaucaaugaaugggugaaagaauaaaugaaggugugugugugugugugugugugugugcgugcaugaaggugugugugugugccuuuguguguguaauuucuauauuuuguucuuuagaugguaacuccagguucugagcgcuuccugaaugcuauuuuaaugccuucugaaagacuuaauauguaguaagcaguuaaggaaaguaacaaugaauuggguagauuuugacuuuuuuuuccauucauuaaaaaaaaaaugagcauccugguauaggagauaagggugggaagacuagagaagauagcaagaaggagaggaugcauauuauuuuguguaauuuuagguaugacagugggauccacagaaacguucuucuguggguaccacacauucuuuccuucucaggaaucucuaagccgugaguucucaacucugaaccuuagacauugacuaagggcuccggagaccuccuaguaucaucugagguaauauagagcaucaugacccauguguauuuugugggcagaggguccuucuuucgccccagcugaucucaaagagcucaucugcuccuguugauguagaaugguaccuugagacuaccgcugcuucuccugaccuuucaccuucgugaggagaacccaagagucacucugucaguuaugaucuccauugagucaggagccaggauggucccauuuauucaugucccgggagugcagcuuuguguccuccacacagcaaauacucaccagacaugucgaaccaauaaauaaguuaaugaugguuguaucgguucuuuguugcaccgagagcaauucuuguagacuuggugagggcgagcuguugcuucagugcuguccagguugugggaccaucugggggaagaagugugcgggcccagcugaagcagucugugagacugggcuagagcaccuguggguggggcuuuccuggauuucuaggaaaggacugagggaugcugggagaaccaggaggccaggucugcuuugguauaucaaauaugcaccucagccccuugccccagggucuaaaaccaaacaccaugucccaccaggagauccccagucuuggauggacaaaacaaagccuugcggauggaugacuguuccaaacuccauuugguaaaacugaguuaggauaaacauucuagugugcuuaugagugugugugugugugugugugugugugugugugugugugugugugucaacaauucccaagcuccuccuacuucugccuucccuguagugggcuuguaaguguguacucccaugguagauuucuuuucuuuuuuuuuuuuuuuuuuaacuuaggugcuggggaucaaauucaggucaucagcaauucaggucuuagcaagaacuuucccuacugagcuguaugcccagcuccuagcacccuaaauuuuucuaaguaugacuuggguuuugguuauugauguuauuugguguuugugagccgguaggcaggugggcgcacuccuaagcaugaccuggaagucagaggauagcuuuuugggacuagauucuccacuuucaccauuugguuuguaaggaucaaacgcaacccauuagguucagugucaggcagcguuaccugcagagccaucuugcuggcacgagcaccuuaaaccuuaauacuguguacguugauggugagccgauguuuuggaauggaauuugggagacagucuguguucuccuggccuuuuucuacuuuuguuuuuccuuuucuaauuuuuaucccuuugccauccccccaaaccaauguaaaguagcccacaguacccuuaccaaaugacuggguuuuguuguuauuguuuuuuuuuucuuuuuuguuuuguuuuguuuguuuguuuuuuaacagagcuuggaauaaagggaaaauaggaaccaacaccacggcuagggcuuuguacucucuaagccaaggugacucugauggacauccuggguguccccgacgaccccuauaacagugaagcucaggcaauuuacaaagggcuccuauuccucccccucucaccucucacccccaacccccgccauacaauggcaagacaaaucucuauuucccaagggacuugugcacauaaauggagggaggauggauuaagcuuggugaugauugcuacuuccaaguuucagccugagacaaccuagacucaccuucccagaaagucucaaugggggauucucuaccuuggguuggugcacgagcacacugguggaagguugucuuaauuaaguuaacugaugugggaugagccagccuacugugggaaacaccauucccuaggcagaggguccuaaacgauaugaguggagcaaucgagcugagcagaagcaagcaaucaugccuucucucucuguucucaacugugcaugugaccaacugcuccaagcuccuuccuaggacuucccagauaggauggacuguaacccaaggguggaagcgaagaacugaacuguggccuguuaaacaugcucagcaagccacacuauguuuguuuucccccuuuaaaauaaugauuuguuaaaaauaacgaacaugagacuauuccacaaacaacaauucccagcaucaaugaauggaaaaacauaccgggcaguuccaaaaugcaaauucuagaaccaggggaggggcuaggcacuuggaagcacaaggccccgaguucaguccucagaaaacauguggaaaaagccaggucucccuguguagucacugcauggcaaaggggaagaucggcaacucccugaggucacuggccagcggguuugcacugcuguguaagugccaggcaaugagacauccgaucacagagguaaaaagaagguagagagagugugggaauaacacucaaggcucuccucuggugucuacaugcuuacacacacacacacacacacacacacacacaugcacgaacauguacacacgcaugugacaugcgcacauaucuaugcacaggccccuccuagcuggaaguauuaaguucuucacagccaagcaaaaauugaucuuacuggcuuccauugcaucgcuuucucauuuaucucccgacuuaauauuuguuuaauaugaguguuaggaaaauacccacaaucccgcugccacucuccccagccgggacauaaaucagagcuugcaauuccaccaaugccucgcugcucuucuccgggccucccgcaggcaacugcagucagacuuccaaaaggccguuucucccuuccucccuuugggggccagagacaugauuaacuugcaauuauggugccuuccucauuaaagacaaguuguagcaagagaggaaaaauaaaaacccagggacugacaggacaagcuauguuucccuagcaccuuggcugugugggcgccucucaucccucugcccuucagguuaguaaaaucacgaccaguuguugaagcuaugagcuaucaauaaaaguuaauguaccacaggaaaugggaagagggaacaaaaucacuuaaguguucagggccaccaggccacccucgcgcgugcgucccuuugugaacugaucugcacuuggaggugucuccggugcccuggcuuuccgugugcccgugauuuucccaagugaacggcggcuugugaagaucaagggcacugguggguagucccagcgcuucagggaagcaggaguggucugucacaugucuugggauaagagcggauucaccucacuggucugugacuucaacuacucaggucaguuaaguacacccgcucaaagacccauccagguuagggaguaaagucuuucccuggacuagggguucaagucugucucccuagccauggucugaaguguuacggcuaaaaaaaggcuccauguuggugccuuaccaggaagcacuagcuguaggaagugcccacugugagcccagaugggccuacugugcacaucugaaguucaugcaucgcaccuucaaacagcagggagcaggggucugcugugugguuggaguggaaagcuauggccucuggaggccaguucucucguggcucccucgcaugcucagauuuugaugugucuaggugaguaggaaaaggugagccacagccugcauauggaggucagagaugguugggucucuccuuccgccauauggguugggaucaaacucaagcugucaggccagacagcaagcaacuuuaccuacuguagcauuuagggcaggcccagguuauguuuacuuguuuguuuguuuguuucuucauauuaacaguauauacgguacuuauaguauauauggcauggcacacacacacaccauggcacuaguguagaggucagagagcaacuugcaagacuugguuuccucuuuccaucauauaaauccuggggacugagcucagccaguccagauugccuguacuugccuguaccagcugagccaucuugcugacccuaaagccaaguuaucuaaaggaagaaaauaaaauguaacccacaaaaacucucacucggagguaaccccugugaacaaguuuauauauuugcaucgguauagauuacauuaguccaggacauaauuauccauguaccaauauguaauuauauacaaauuuauccuuguacuaguguagauaauuaaagcuuuauauaugcguuuuaccuaaccauuaacugucuuacuggagccucacaaaugcucuagauagaugggacccaagcuccugcagucuccugagagaaagcugauuucucucagguaccugcugggaaugaagaguuagaagggccaccaguuugugcccacuuacccaaauauccaggccaccggucaucucggcucacaguauuuuuccacaggcuaaugaacguuuaaaccugguacauacacucuccacccuucuggcucacccaggaucaguuuagauuuaacagggcaguguugguuuugugcuucagaucgggccaauaggugccuaauuggaguggugggaugggaaggagccacggcuaaccaugcuccgaggaaaggguaaaggaugugugugcaugugugugugugugugugugugugugugucugugugucugugugugccucuguguguguaugugugugugugucugugugugccucuguguguguaugugugugugugugugugugugugugugugugugugugcaggugcauauggaggccagaggacaaccucagcauucauuccucaggcgcuaugaccuaaguuuugagaauggcucucgcuaaccaccaagccacagacauccccaucuucaucuccccagccgagagaugacaagcuaguaccaucaugcucagcuuuuuaauguuuuuguuuuguuuuguuuugaaaccaugaguuucacggaaguugaacacaaguccucgugcuuguguauugagcauuuucccaaccaaccccccacggcaccccaucuccuauccugauuuuuuagucuguggagugauggucuacuuagagugccuccccaacucugaaugggugagcgaguguuccugguguguacacuccugacuuuucaacaguaggaaucaccucuagaugucuucauaguagagcuugcagagguaagaccggagcugccugcugggggugggcucauuuccaccugacucccagcucucucccagccucaggagugaggggcuggcagcaauggagagcacgcugcuucucucugacuucacuggcccaccccucauguggauguauuggguuugaaagcuaaguugcauguguuuguuuccucacgggcuggucucuccaguccugggcugggggaagcucuuacuucagcucuaacccaagugucugucugucaccuguccagaugugaugcuuugacaagacauggcuucagaacccaacuggagggagagucucuccacuucucaaccacaaggcaggugggaagguccugaagagccuuucccuuuccaucccggggucugcuuucaauucgguuuguugccagugaccuaguuucuuuucgacuaaaugcagagacauacacuaugacugucaguucaaagcgucguguuucaaauguuuaaaggcccagaggcccaggaagggaaauccccuuuaaccuuccacuuaacacaugggcagacagaggccugaacugcuugagucaccagcucucgcaaugauggucagagcugccacagcagcccccaauucaugguccuguccuuguuuuuuguguacgucaucucuguauauauuacacgaaccuggucuguguaacaugacauguuuucuuccucuucucucucccuccucacccuccucagcuacucaagagucuuucaauaggaaacuaacucucugcccauucaaguugaaccuugcaugucuccacccaaaucccagagacucacgguuaggauagauucuuuuguuuuguuuuguuuuguuuguuuguuuguuuugagacaggguuucucuguguagcccuaggauagauucuuuuagagaaauuuauuucaagguaauacuauuaaaaaaaaaaaaaaagaagcacgacuugugguuacacauagaagaaauucagucaacauucguggaauaucagauaaaugaacaacagcauccagcaccgguuguaaccacugcaacauucccaaggcuguuucgguuucuuuuaaccagacagucagaaauaaugaucucagcuacugucacaaaacaggaagagacagaauaaccccuccccuccauggcuuuguccuugucccugugaccuggauacacugcugaacuuccugaauaacugugucaugguggcaggaagugggagaggggugaacuggagcccgaugcauggauuaaaggauuguugucuuuaugaagguccagggugcaugccggaggggccacauggcaggcacagucuuugauguucacugggccucaguaccauggcuccugugaccucugccucuggaccaaagccagucugcaucacuggcucagcccuaaauugagacugaccauggacaaguuguagggaaacagcucugagcagguuacacagugcaaugguucugcccuuauuucagguugccuuccucaauuaacauaacacaagccucugauauuaauaaguugguuauuaauuucaccaagaggaaaauaaccaacagccuuuuaaaggaggggauaucaaagagaugccagguugagagacaguguagugaauuagcauggugggugaaugcagaaguacgguacagcacggaccuggcagccauggccucgaccucuugaccucucuuugccuccauuuccuggcuauaaaugaaagugagaggcagcaggauggcucaguggguagugaugcuuguggccaaagcugaugaucugaauuugauggccggaacccacauguuaaaaggaaagcacugacuauggaaaguuauccucugaccacacacacacacccaacaaacacacacacacacacccaacacucacacacacccaacacacacacacccaacacucacacacacccaacacacacacacccaacacucacacacacccaacacacacacacacacacugauuaaguaaauaaauguuaaaaaaaaagcaacuuuggauaacccaagugguaaguaaaaagcaaaacaaacaaacaacaacaaaacaaaaaccacaacaaaaagaaaaagaaaggaaaggaaaacaugugugcaaacgagcacaugaugucuggcaaaguauccaguaaaugcucauuuucuguacuuuguccuuuuccauacugcacauuugcucggacccguuacuggaggcuguguacacaccguccccaguugaugucuagucugcccucccauugguggucaccccaucgucucuacuuacuguagacacaggggcccuucaaaggacagccgucuucuguucauauagcugugaacauacagcuugugaaacuguucgacaggcgugcuucuuguguauguauuguaccugucugcuauguuguacacucccauggaaaggcuuaaaaucuguuuuccauaaagaggaaacguucacuagcuguuuccuccacccagacucugaaucagaacagaggaguccuccugcuccucagagcugcagccuucagguucacggccuccugacgcugacuucacgaaugccucuacccaguagaagucuuaagaacacacacauuuccacccuuuagagcacagucugcguaagggcaauagaggaggugauaauccaagccaccugggaggcugaggcaagagaaucacacuaggaagcuguaaguagcaugagcaacgugccaggaccucaucucaaacgugagaauacccgaggcuggugauggaccucagcuggaagaguguucgcuaagucugcccacagcccugguucagucccugguacagcauacuugagugcaauggcacaugucuggaaucucagugucugagaggugaaggcagaggauuagaaguugucccaggagagcuugagcuacguauguauaguccugccucaaaacagauagauugauccacagaugauaauucuauagaugacagaaugauagaugcuagauaggugauugagagaugauagauugauagauaguguuggaauugagaccccggacaaacagcuguggugcauauuuaauguaccaaaguggacccuccagguucucccagaaucccucaguccuuaccuggcauaccccacccccuacccugaacauuccagccuaggggcugggcuuuccuccccagaggcucuuuccuauaugaucuggacauucuggccucuccccacuucucucucucuuucucugacucucugucucugucucucugugugcuugcacucuccucuccucuccucuccucuccucuccucuccucuccucuccucuccucuccucuccucuccucuccccuccccuccccuccucuccucuccccuccccuccccuccccuccccuccccuccccuccccuccccuccccuccccuccccuucuuuucucuuccccuucuccucugucucccuccccauggugacuucccuggccuaaucccuugagacgagugaauuugccuauacaccccaaaaaucugccuuuauacauacucuaauuugucuugaaucagcucauuucaccaguggagaaauaaaaauaacuuauuagauagauagauagauagauagauagauagauagauagauaccagcaccaugcuaucugcacuugccagccuccagagucaggagccgaguuaaacucuuuacacguaaccuagcaguucacagugucauaguaaugacaaaugaacuaaaauaggcaucaucucagaugagguccuggucccuauggagacugcacucuacugcagcaaaugugugacuccccaccacagugaaggaacaccauggagaagggcacaccagggugggcaugcacacaguggggagcuggaaccugaggagccaccacccucgugaugaugggagcugacccagagaaggacugagcacugcccuuccugaacugguucucuacuuacugaucccaccugggucacuuagaacuucucugugcauaagccauagcuugcuuuuuuguacccagcuguaguaccuagcuaggagguaggagacgcuugauguuauuaaugguaaaagauuucugggcauucuuuucagcuccuguacucacuuaaaauuugguuuugcuuuauuuuauuacauggauaugugugugugugugugugugugugugugugugugugugucuauauggcggugugugcaugcauauacaggugccuguggagaccagaagagagcugaaucuccuggaauuggaguuacaggcaguugggagcuaccugacaugggugcugaggccugaacucagauccuacagaagggcagggagugcucuuagccaccuagccaacucucuagccccacgucuugcuuuuaaaaauaggaauucccugaguuugggaaaugaauccgagacuacagagcuugcaagcuuaaggaccuugguuaugacucucaggaugcacccaguuguaaucucagcuagagugaguaggaagcagagacaggccaaucccucgagcucacaggccggcuaguccacgguaacguuccaagcuaaugaaugagaaaccguguacucaagagaagguaggugccugagagacaacaacugaaguugucuuuugauuuccauaugcauauauacaaaacacacaccacaaauaagaagguaauuuuccuaccucugacaacuuuauagaacuaacuuggagcuacccaccccucucucuugcucuuuaaccugagggcacuuaggaagagcgaguuuuauccugcagggugguauuguuguuguggcucagaggaauacccucucuaggucuccggccuucuuuuauucuuaugaacaggcuguguggaaauugcagguugaccucagccccacugucuaucuuggcgcugaggaaauauucauauuucagcuagucacacgccugccuuacacagucuccuucccgcacuuuugugaauguuaguuuacauuguacacagguuuccuuccauggguugccuuuaaaggcagugccaaaacugccgauuuucagcuuaguaccacaauuccuccccgggggggggggugguggugguaauggcucuuugaagcagugccugcucuugcucucccacucuggcucaggucugcuucucuuuuguaagaaggacgcguuuccccuguauucucccaugacagaaacccaccaauucucuauuuuaaucaacaaauagauuuugaaaguuugacuuuuuuuuuuuuuuuguccuaaaggaguuucaaggguaagaucugcugccucgugaaugucaaaggaucuuucucauuggcucuuucuucucccccucucccccuugcucuuuaauuuauccguguucucuacuuacucagccuuagauaauuuucaaaguaccgcuuccuccagagaucucuaaacagcagaaacccuggcuguuaaagaugugccauucucagagaaccccagucaagguaccccccggguuauuuauaacuggauuuuaucucugaaaauuaacuaaaaagaagauuaaccaaaaagucuaaaggaaaaaaaaaugccuuaaacaccucaucuacuacgcugugcucaagcagauauuuucaucuuaaggguuuugcaaacccaguggaauguacuuucuaguuuggggcaugaaauaagauaacauuuugcauuccuccuggaguuacagcaucccuccuuacaaugaagaugcgaggaaagaaacugugaacuuccucaggauggucuuauugcugugccuguuacauuaagugguucccagcucugcagcuccagagagcccccaggacauucagauaccucuucuggaaacagaugcuuucccuggaaggcccucccagaaccacgucacccaauggaggaaaccugccuuacuuucagacacuccuucaucuacauuauccagcugagcugggaagcuggaauguuugccguccuuuauccauccaggggcuuuguccauuguaugcaauuucagcuggaguaaaggucaggucuacaccuaggcucagagagcuucucugucugaccagcucacguccuccuacugacuaacugcuucaacccuuuggccugugugccuccucccucugaccugucuguuuguuccccuggccugucugccuccuccuucuggucuaccugcuucauuucuuugaucuguguacuuccucucucugaccuuccugcuuuauccuuuuguccuguguaucuacucuuucugaccugcucucacccugaagaauaaaaaaaaucccaaguauccagcuuuuuaaauaguuuugcaauuguugucuuuaccagcacauggagacaauaaacauacacuuacuaaaugacuccagagggacccauggguauauccuauccccccaacucuaccaaguagccacacaguucuuaguauaucucauacuuuagcagaauuaguuucuccaaauggucugacuuacucauuuaaguaacugggugaggggauuugaaaccagcucucuaugacucucgguauuggcuggcaacaggacaggaucuagaucacauggcagacaaagcucuggaugugucugugaggaagagucuagauuggauuaacugaagugggaagaccacccuagccauggauggcacuguuccuuggccuggccuccuggacugaaaggagaaacugagcugagcaccagaaucuguuucuaccaucugaccaaagauauagugugaccagcugcugcccugauuuccucaacacaacagacagaaucaucagaccaugagaccaaaccaaacccuucuuucuucccuugcuuucaucagguauuaagacaaauaagcaauuuacaguauuaguuacucuucuauugcugugacaaaacaccuugaacaguguaaguuauagaauaaaaagguuugcuuggacuuauggcuucagaagguuagaguccaugauggacaggaaaaagcaggaagcagaacacauacagggaguggcuugagucuucugaaaucucaaaucucacacccaucgacacaccuccuccagcaaggccacaccuccuaauccuucccaaacaguucuaccagcugugcagauauauuagccuauaggaaccauucucaucaaaaccaucuguaucauagauagugaaugaauucagagcugauuggauggucucuuaaaguauuguucucccuuguaccugucaucagagaugaaagucccauagacaaggcgugucugcaccuuagccuucuauguauuaaccagccccaaccaugcugagcuucugagauuaggugagacugggugcauccauguuaguauggccaaagaccccuccugcuucuugcaucucuuagcauacaugauuccggcacaaaacacaaaccuuggagauuugacugucaccgauugaucucagguagcuggcccugcuuagaguaguggugucacagugguguuggagggucagacuguguggaugggacccagagcaacaacucuuuagcuucaagucccaagguagacagugaucuggguagacagcagauaaaaguggcauaugggacgauagucucacaggucucacuaacaugagcucuuaggcuuauuccugacucucuagggacauaugacugcccuccccucaguuuacucuucagcuaaaugggaugauaaacagcauucacaacuacuucacaugguucugggggaggagaaaaaaugaaguaauauuuacaaaaccccugguuuguucccugaggaacaccaggcaucagcagaugucagccacuauuuaugauuuugugaacagcuagcccaugcauuugauaugacauaacauaagauaaugaguguaaagaauguagcuuggcacacaucagaguuccauaaauguugucaauucuuuucuuaaucuccucuauguucugcuugcuuccgaggcucagcaggcuggcuucaacuccaaccauguuauagaugcaacacauaacuucuguggcccucaguaucauggauggggugggggaaagaauucaaggaggaaaaugagagauugaguauaaagacuaugggcuucggggucagacuagaguuucaauacuuggaaagggcugguuugcucauugggcaggucuucgugagcauacggaguguguuaauuagucuucucauagcucccacagaauguucaacaggaacacauuaagggaaaaugccuuuauccuuggcucacaguuuccaacagaauuuuuaaaucauggucaggauggcauaacuucaucugugguaguguguggugguuugaauaugcuugguccauagagaucagcacuguuagggggcaugaccuuguuggaggaagugugucacuguguggguaggcuuuggaggucuccuccuaguugccugcagaaaacagucuguccugguugccuuugaaucaagaugcagaacucucagcuccuucuccagcaccaugucugccugcaugcugccaugauacuugcuaugaugauaguggacugaaccccugaaacuguaagccagcuccaauugcccccauaucaauucacuuuugucagccagaccccaugucuccauuucaccucagguauacguuucagacaagggcaaaaagcagcuucacucuucaccaaaccaucacaagaacugugccuaggccacauucuucucugaaucgucuuaagccagggccccacaguucaaaccacccucagcaccagugucuuccaugcuccaccuaguuauggcccauuaagcccugcuuaaagcaucccacugcuuucccaacccaaagucucacaguccacauuucuccaaacaaaaguagggucaggccugucacagcaagacccgagucccuagcacucacuucugucuuagaagagacaccaugacuacagcaacucuuauaaaggcaagcguuuaauaggagcuugcuuacauuucagagcuuuaguccauugucguggcaggaagcgugaccgcacacagacagauauacuggguacagcaggaagagaaguacugauccuggccugagccuuggaaaccugaaaguccacacucagaaacacccuuucucagaaaagcccacaccuauuacaauaaggccacacuuaauagcgccacuccccaugagcccgugggggccauuuucauugaaaucaccacgcuuaucaaacaccuugucagcugugaaugagaggcucaaauacaugaaccuguguggaacauuuccuggucaagugcaucucugauagauagcggcuccuuccacaauggcaacauaauauggaguuggugcuugcugucauugcaaagauuucacaaucucuaugcauuuauuugggauuuaaaggcgaaugaagucuaggcuccugcuuuauggagauuuccucccaucuccaaacaucucuauccuccaugacuguuggaggggaugggggaggcagggucuuacuguaucuccuuggaacucacugcguaguuggucuuaaacuuauguugacacccuguccuccacuugaguacugagauacucaaucucgauuguguggauacuggaucuaaugucccugcaagauuagaaaauaagccacaagauaaacgccaauuuucuuccucacacauauaaugcacacaacacguacagccaggcuuggcugcuaacuuucaucaaagaggugucaucauugugccuaagagcaagucuccaacaucuccuccgacucaggcucuuguaugcuuuuggaauuuaagucuuagauuuuucaaagcaucagggaguuuuggagucggggcagugauuguagcugaccaagagauuauacuaaaagguaguuguggggggcugcagagauggcucagucacuaaaaugcuuguuacuggguaagcaagacagguccagguuucaucccuggaacccacuuuaaaaagcuaggugugauaggcauguuuggaaaucuccgcagcuggagaaguauaaacagacagacuucugggcuucacaggccagguaggcuccccucacaugccagcccuagacuaaucagaaauccugucucaaaaugaaggugggagcucccgaggaacgaaguccaaggcugaccucugcuauucacaugcacguauacacacaugcacgugcacccguucacacgugccagaugaauauacucgcauacacauacaugcucucacaaaauaaaaaauaaauaaauaaauagaaguuaaguacaguuaaaggauaauacagaaauggccccgguggugcgauccacaauucacccagaauuauaugcgugaggaugaauacugggcucuguccuguggcuuauuuuccaaucuugcagggacauuagcuccaguccagcaucagaagaaauaccaguuccgagugccggggacucugcugccuucgcacuuucucuccuauuaacaugaaaacaccugacacggucgaaaacaucuaaaggcuacuuccuacuuuauuuaccaucacuucagucuaaugcuugugugugucacccccccuaauucccccccgccauccccauaccuguggaaaugagacugucaccugcuuugugcauccuguuuccuuucgaguuuguaaugaagccccccgggaauuacgcgauuacaaaaaugaguuacaaauccucaccugcgcuagcuaccaaaguguggagccgcuuccccggcucuguuuaaauugucuacaaaacaagaaauaauuagucaagcgcuauugguaauuaagcacauaagacgaacauuaaacaaacugcaaucuugcacgauuuugaagguggacaggcagguuuccacacuuggaacccagccagcaugcccuuccacaguccccauguuuauuuauuacaggcaagggaauucgcuugucugacuugcugauguuccccuggacagcgugcgguccauccgagaguucacagaagugugagcaguuuuucuucuucuucuucuucuucuucuucuucuucuucuucuucuucuucuucuucuucuucuucuuccucuuccucuuaaucuuccuuuuccucugccucugccucuuccucuuccucuuccucuuccucuuccucuuccucuuccucuucuucuucuucuucuucuucuucuucuucuucuucuucuucuucuucuucuucuucuuuaacaguaucaccaucuggacaggaugagcucaaagaaguuguugguggguugaguggaaagacacuuuugcucucucauuuuaucuuaugugcugagcugggguaauuucaugauucagaacacagugugugugugacauuuggcgcgacaggaugcuggcuguuugagaacccaggcccuucagcuaaccagacccuaugcagucaggacugcaagaauccacccagccugacccacaccccuaccugaaaaagacagcccugucauguagccuaaaucaugugugcccugcuccaucacauggcacaagugucauauuaacugaggcugcguccucuagcacaagggcugaaacuccuucauacugucuauuggaggccaugauaaauaucucgucugaaggaugguuccacuggcuggccuucugacccacuccuugcccuuucucccucucccccucucccuuucucuucccucucuaccucccuaaaaccuaacaggccgcuuuuccaaagcaaauucucuuugagagucuccucuucaaaucaccagaguuucuuuucacugauuuuauuuuacuuuauuuuauuuuauuauuuuuugagagaagagucucacauuguagcccaggcuguccuggaacucacuauauaaccaggcuggucucaaacugacagugauccuucugccucagccuucccaugugcugggauuaccggucugagccaccacgcccaacuuccuuggaguuucuuagaaaaguucaccuauagagucauugcuguacuagaaaaaucuaaaaaccuuuaccgucuaauuuggucagguuucuauuggaggucagaaccuucagaaaaccgacccacaggguuggauuaagauagauauuuuuagagaaacuuggaaaaaucaacauuuccaaaccacucagauuagaaaguuaaauugggcuugcuaauaaaaugaaaaguguccugcauuagaugacuuaaaggaaugcugucaccuggacaacuuuccaaugcuauguaacacucguugucacacagcccuguucaccuagagagaccacuuccaaaucucuaugucgucagagaacaugcaugaaaagaaaaggaaauccaacauccaagccagcucuccccaccgcgguaugggaaggacaaggaugcuucucacaucucauuagcuaugaggaguuuaauggcgauccuuccgucagguugagacuggacugagcaggaagucaccgucuuaugcuucuaugcuauuuccuuucucacgcuugugcacguucccgggugcguaaguucaccuguaugcucacauauguucgagacacaagugaaccucacuccucaggaaugaacgcugucugcccuguuuuacgaggcagggucucucaccagucuggaguuugccacguacacuaggcuggguggccaguaaguccuaagaauggugccgucuccaccuccucaucuuugggguuauaagugcaagccaccacaccuagcuuucuccggucugugugcuaaggagcaagcccagcucucccuguuugugcagccugcacuuuacugauaauacuaucucacuggccuugcuaucugggucuuacuguauagcucaggcuggcccaaaacucaugccucucugccugggccccgcuaggacugggauucuaggugugcguuaccacccguggcccuugcaggaugcaucuggugacaggcacaugcccugugcucuuggcucuguucguguaacacaaacuaacaaggacucacaaaguucaagguaccuuagacuagaguucaagauaagaagugagcucaacugcacgccuuucgcuuauuucucugcucuccuuacccugaguggcgcagucuuccguucauagcuacugaccccuccaacccgcccaccucccaccccagcucuuggcugugcuccugagauccugccucuuccaguguaagaugugugugguguucuugacugaaacagcaccccaauucaucagcacacuagcagagaagugccuggagaucucuguggguguaagucuucagcugucaggcacucacuccuguggcaggggauaccaaucgcucucuauacuuuuucuauaguuuuuccauuuguaaaugggaaaggagcauggaaaaaaauccucuugccucucuccaucuguauuuucuuuacuaaauuauccagucuuauaaauauuugaauaacauuuggucgggauaaaaaucuuuccugucagcucaguacaagagcauuucuggcuccugagaccguagcagucagagaaauuaauauugauuuguuagaaaauaguuuucacucugucuaaacaucuuauucuggggcucuugaaccaaaauuaugaauuuaaaagcagcaaaauacuucuucgcaguugucccagugaaacuaauuaugggcagauugugaaaaaaacguauuggauacgauuuccagcaaagaguuccacuaaccaaaauucgagagggccagagcuggaugccugauuuauuugagcaaguugaaaucugguagcagggaagacuuauguaaauagucuccaccguuucuguguggguaacacaauacauuaacaucucauaaauggaagaagaugaaggggggcuuuuuaaaagcaacuaauuuaauuuacuuuguagaaaggucagagaguuuuucccuucuuucuuaggacuauaaguuguuguuuuguuuuguuuuguuuuguuuuuuuuguuuuguuuuuuuaaaaauaagauaguucuuuccucugcuacauaaauguacaaaauuugggaauuugucuuggauuuuaauuacaugccuguuuaaggcuuuggguagaaaaauguuuuuuuaaaggaaaaaaaaaacaacaaaauaaauuauugcccauaugccuacacccauuuaaaaaucuauaauauauuuuucucuaaaagaagcuauugguuuuugucucaugaaacucccagcacgucugucccagcacggcuaacaaaggaaugucuccucuucuuuuggacauauaaauuguucucucucucucucucucucgugugugugugugugugugugugugugugugugugugugugugugcauguguuggugcacacacccaugugcaugacugcagguaagagcacauauggguucagcuacccccccccccccccacacacacacacacacucccaucaaacaggcuuuucucacuggcccuggagcugagcugacagccaacauaccccguguuugcccugucaccaccuccucacagugcugggcuuauaggcgcaggcacaggaggcuauacacaacucuuugggguuuguuguauuguuuccuuuugguuuguuuuuuccauggugccggagauucaaacucggguccucauaacucaagcuuauguaacaacuguucuuacccaccgagccaucuccccggcccuguucccauuuuaaguggcacaucgacgaacaucucugggcagaacuccuuaucugaauuggagagacuuucuuagaagccaugaauuucaucuuuccaucuguucuaagauccugacucauacauauuacccuauguauuucauaaauaugagauuauaaacaaagcacaugaacggagaaauguauaugcagauagacugauaaauaaaaagagagacaaauguauagaauacgaaggcaaagaaaccuggcuuggguggcacaugccagucauccauuucagcacucaggagguagaggcaggaggaucaggaauucaaaaccguccuagcuuaccuaguaaguuucaggccagccugggcuaugcaagacaaucucaaaagagauaaaaauaaaaauaaaaccaauuaaaucaaggaaaugcaaaggaaacugcagagacaauauaauuaaacccaaagaggcgaaacuggggucccacccacaagagcaguggggauacaggguguguccguaguugucuccuuuuggagagcaccguuagagccucaaaggauggaaacacagcuacagagucaaagcaacuuuuuccuugaaauaguuuauugaagcaucgcgaauauggaguccuuauuauaguucauaggcucugguggguugaggaggaccaauuccagucuucauauuaccaguuucaaauuuucagaaaauugaaauauauguauauauuuauaaauauaugauauauauuuauaauaaauauaauauauaaauauauguauaaauauaugaaauauauacagagagagagagagagagagagagagagagagagagagagagaaagagacuagugcugaguuugaagaagaacuauuuuccuaccguggaguaagcugaaccaggcugugugucagaagagaguuuuguugucaaccuaauccacugucaccuuguaaacugccauuuuauuuuguaagccauuccccuaugucuccucauauuucugagaugcuugacuuuauuaucaacuguuauggcuuucuuucccuuucucccaacuccccuaccguucuggagucguuaagucauuugcuuggcauggaccuguuugauauuuacccucguuucaaagugacacaaggagcgcaaagcacauaaagacaacagaguaauuuagaaagaagaaaccaaaaaaaaaaaaaaaaaaaaaaaaaggaagguuaagaaguuacuaagaacaacuacugaagagauucccagagcauuucagucacuuugucugggaagcagaaguucgugggcgugucagaauacugucucaugaugugcgcauaagcacuggggacagacaugguaacaccuggcccuaucccauagaagagcugagucgaaauccccccaagucuuuuuaaagaugggggucuuccggacaugacaaaggagaagacauuaccaaaucacaauucccauuugcccuucgagguguuggauuuuucucucccuccgcacuggugcaauuaaggguuuugcugagugagcucgggacucugucucuuuaaguguuuaacaguaauugguucauguccuugcguucauugaaaauccuagacauuucauguagaaucuucuuaaugaggggaugaauuuuucauucacauuagaaagcucacucugacaaacaauuucuaaauaaaacuuuggcgacaugacaucccacauuggacuugacacggaggacaggugcauuagaauauaacuccauggcgauccuucaagcugucagccaugaauauuuuauuucuuaaugaaucaucuucaugaaaugaacuuucuuguuguagugucagugccauuuacaacaaaaagccggcucccuuuucaaaaggugagcuuggggaagaugcugacgugagcacaagcuacuucgccccacccgaguggcuggggacccagcugcacacuccccaccccucugcugaaaucagggaucccgggagaaacuggcccaggaccacugcuucuuuuagcagaacugacuucuggggaacccaacuagaggccccuggguaccugaagucagguaccacuggccaucugucugcgugccacagaugcuaaggcucccagcaucugucuuguuagaaaacuguuauuaagccaggcagugguggugcaugccuuuaaucccagcacuugggaggcagaggcaggcggauuucugaguuugaggccagccuggucuacagagugaguuccaggacagccagggcuacacagagaaacccugucuugaaaaacaaaacaaaacaaaacaaaacaaaacaaaacaaaacacaacuguuauuaaaugaagaguguuaucagucugaccauacacuuaaggcccccccccccacauagaauguuccagaaccugggucagagacaaugaccccaguagguaaauccagggacccagauggcagcuggagagaaccagcccccucaaguuguccucugaccucuaacaugugcagggguacaugguacaugcacagaucacacaaacacagacaccacacagacucacacacacacacacacacacacacacacacacacacacacacacacgugcagggguacaugcacaagaucacacaaacacagacacccacacagacucacagacacagacacccauacagacucacacacagacacagacacccacauagacucacacacacagacacagacacacacacacgcgcaugcacgcacacacgcauacucguuaggugucuauggcgcuagauguagucucuggucuuuagacaaagacaauaaaagugcuuccucuaaguagccugggguuaguuuugaggcauugccauuggaaugugauucaaggauaaagauacuccugccucccccgccuccaacacauauacuucuuucuccuauuuuuuuuaaagauauauuuauuuauuuuaugcauaugaguacacugaagcugucuucagacacaccagaagagggcaucagaucccauuacagaugguugugagccaccaugugguuggugggaauugaacucaggaccucuggaagagcagucaguauucuuaaccacugagccaucucuccagcccuucuuucuccuuuugaagucauguuuucaaccauauucuccagacugcccuguaguccuuuccugucuccuggaucucgcuccuuuucucuuccuucuaguaacuaucagucucuuuccccaaggcuggccacuuggcacugcacuugauucacugagaugcuuucccgaacucaguccccagcacucuguacuagcacuuaguauuagcacucaguccccagcagucagucccagcaagcacucaguccccagcacucaguccccagaacuuucccuaucuuuccuccgaacaggaucacuaucccaguauccuuccuuccacacuggccccggcccucuuugaauuugacucucagguugaugacgccugccucugacacugaugacacccgugcugugccucuugcuuuuuauuucucacuucggaaacugcuaaacuacacaucaauguugauugaaaccuagauuggcagacuacaauuguugucuguuuuagacaggaaaaaaaaaacccuuuauucuuuuauugcuacaaugucagaauugaguauuugucacagacacuggcucacaaucacagaaaucauuugcaaagagcuccuuauagaugacacuugccagguaugguggugcacauuuauaaucccucagagaggcugaggcaggaggauuaugaguuucagacccgucucgguuaccuagaaagauguugucaaggagaaaugauagggagaaggggacagagaggaagacaaggggggaggggagggggagggaggaagggagggaaagaaagaaggggaaguaagaagggaaaggaaaggcaugggagggagaagagaacagaggagaagggggaaaagaaaaggagggagagaaggagggaggaagaagaggaggagagggaggagggaaggagaggggaggggagggguaggaagaggaggggaggagaggagaaagaaggacaagagaggaaaggaaggauagaaaggucauggaaggaagggaaggagagauacuucggggaagggaggcaggaaggugaggagaggaacagaagagagggaaagggaagagaauugccagccccuggcgucuacccuggaucccgagccugaauccauccuucuagaccccaaggcucugcagugaaacugacaggguaugcgggcaaugcacccgccauacucucucagcuccaaauauauucugguggauaaaauagccaggagaaccgccucucaggagaagacauggcugagugucaagguguuacuugggcugggaggaaaaggaagaaacuguuguucuuuggucguuuaggcuucagcgagaacgcagucguugaacgagcacucagugugggcaggugacaauuuucccccuuaucuuuugacuuucaagaucuuagcucugcguuuuuuuguuuuuuuguuuuuuucugucccacagccauagcaacagcggucacacaagguuuccaggcccauccgcaccuucagagcgaguuuccugugcggucuccgagaacuucuguaggccccuguuaguuuccagguccccccaccccccggauuauuuggauuacaaucuaugcugugcgguucuauccccccccccccuucauuaucucuuucacauuaggugcuuucuauuacccgagagcaugcgucaucacuacagugugaacacaauacagugugcucauucucuaauucccacugcagggauacagggauacggggacaugggggucacuuuuauuuuuuuaauaaaugaggucagcaguuuuguagcaaauguacacugacacacguuugguuaaaggggcauauuugccauugaaguaugguuauuuaaaauuaucacagagagagagagagagagagagagagagagagagagagagagagacagacagacagacagacagagagagacagagacagagacagagagagagagggggggacagaaccucucacauaacucaagcuagcuuccaucuuacgcuauagcuaaccaugaccuugaacuuuugccuccacuucccgaguguuagaauuauacagcccugcgccuccagccgggauacauacaguccuggggguugagcacagggcuuuaugcuggacaagcacucuagccaccgagccacgugcccagcccaagcugugaaaguaaguuuuaaacaaaacccuaugaccaaagaucccucauuguucucuucgggaauggcccucugcucugaucucccaggcucccaccagacacucaucccacccuuagucccugagucuugggcaguuguccccaggacacaggucacagucaugguggcucauccacauucacuugcuaaacuggccucccagcaguggggccgauucaaucccuucccgcccucuuugcggcccugacaacccugucuuaacucgaagggcaaagccagaccaggaggugcggugagggggaugguaggauccagacucugucugcuuacuuaacuguggguuccaacuuaagauuacuccuuaccugugacguuagugaaaagcuaccuucccguucacuuucuguuuguggaaacaccagccucagccucauuucagguauugcuucacagagaaccggguuucagauccuuuuaucacuucucaauaaacaccuguagcuaucagcugcccaguucugcccucacacugccuggcucacagaauccagccaugagcacucuuuaugguccuugguccucaaggccuaagggaagagcaaaccucaucugucuacauuuuuauuauaucaccaacugucuuccccaaaucccucaaaaugacucuuaguuuaugucauagaaaaauugaagaaaaaguccaucaaaccaggauuggacaaauaacguaguaaaguacaagaggaccaauguuuggucccagaaaccauguuaaaaaaaucagauguggugaugguguguguauuagcucagugcugggaaguagagagcaagaucagaagaagauggaucucugagacuugacagccagcuggccuggcugaaucagcaagucccaggucccaguaaggaacccugucucacaaauauggcgcacaauaccugaagccccugaaguuguugccaggcuuccacauacaugcauaugcauacgaacacucgaaugcccauauaucacaugcacacagacacagacacgucuacagucaaacauacacagacauuccuacaaucgugugcacgcacacacacccacauacagagacaugucuacacccaugcaaacacacagguauaguuaaccaacaucuuccaguaucuuuuuuuucugucauccccugcucccuaagucccacuuuucaccuccacugucccaucugcuagcugauaacaauaugcaagcucccauuuaagacccguuaucuaccaaucagagcacaagucuuggcuaucuuagaaguucaggucuccaucccccucugccuucaucucugcacagaccuuagaagacugcacuucauuaaauuauucuuguaaugagucccuguuaccagggaauauggaguuaaaaaggugaucgcacuaaaauuaauuagcauaagaccugcuggacccucggaagugacuggauccuaaucaauagcaauaugauuacaucugugccacaauuauaaauuauuuaaaacacuaccccuagguuacugacuaguugccuuuaaauuaaauucucugucaauaauugaugcaaagaauuaaugcgagaacaccuucaguuacugaaacuuuuuuuuuuaaagguggcauaaaauauugaagugugaggcccgucauuagcagcuaggcugucuguuugccacagcauugcucuguuacaaauuggucaagaaagacucucggaucuugaaagaugacaaggacuccgaguccacugcugggcaguuuucuaaggacacugaggagccccacuagagguucaguagacaaaggcaaggggcugggggaacccacuagcugaggaucuauuuuauugcuucaagucuaauaaauaaggaacucuuuuuguuuugguuaauucuuagacaccgccacucuuggugaggggaggucuuacaugacuugaggaauccuaaccugacauagauaagcagugagcguuucagaaagaauaaaaaggaagggagagagggagggggaaaagagggagggaagggaggaggaaaugaggaaaggggggauagggagggagggagaaagaggagaaagaaaaucaagucaaaggccugaaaucaagucaacccuuuugugaucacugccccucgcuccaucugugucguuccgcuucuguguaaaacaacgucaccugcacaguugcccucucuucuguggcaauucuuuguauguucaauaagcacuggaagaugcaggacauggaguaggggguucagggacaagggggaaugguuaagucaucuauugccagcccagagcuuuugugugaucucagagauagaggccacucagguggccaaggaacgacaagacugaaucaggagauagaacagaagcccuccccugagcaugcacgcacagcggcgugcagagaagagcagcagggaugcauggagccugagaugaugcuucugcuaagcucaucaucuaauaaucuaaucuccuuauuugugauaacagauguuccaggagugccccagcuuuuuuuuuuuuuuuuuaauugggaauggugaauuugaacuggucaccugagcagcagaagccugaggagccaagcaauggugccuucugccaaaacaucuuuccccgaauuuacuucaggguuuguuuuuguguuacucaccggaaagguuaccugcaucuacccaaggacgccguguuucugcagaggucagagggcaugcuggaucucuagcacuagauuuacccaacauuugugagccaccaucuaggugcuggaaucugaucccagcuccucuggcagagcaaauagcgcuccuaacuacugacccaucggguggcucugccucuccccguuuggugcucugggaugcugacucaaaaagaacaacgaugaaaauaauaaccaaccaaccaaacaaaaccccauagucuccucugcucccaaccgaacagccuggccaaggagaccagagugucuucagagcaagggacaccccaugcaugcuguguccucuguuugaaucuuuugucacacauggccuggaucauuuaagcaugcuggcuucacacaugacugaauguucaguccugugacugaguacaaacuguggcaaguugucaugucugucuuccaguacccaucaugcuccauugcuguagagcucagccuguagaaaucucgccuggaauacaaagcccuagcuucuuuaucuagcaccaccuacacggacugagugugaugguguagucagaagguagaggcaggaagaucagaaguucaagcccauucucagcuacacagggaguucaaggccggucuggaacagauaagacccagccucaaaaacaaaaaccagaaacaggaacaagcccaggauuaucuggcagccggagccagggcccacaaaacagcccucaaggucaaagacguuucuggaaucuugguucccuguccauuucauggaugaacaacaguuacccagacagauucagaaggcuggcuuccaugacaggacaccccacaccucagcugugucccaccugagaccugaaccagcagaacuggaguccccaccagcuuaggcugucccguggccaguuccugaggaggacaagccucaaucuuuucugucacucuugucugagucuggguuugugaaacucccacaugagguucucauaaacagcacauaccguuuauuuuuagcuagucuagaucagcuucuuccaauugucuuucuuuuuuucuuuuaauuuucuguuguuucuuagaaaacuaucgccaggcaaacagccacggcagaaacagagagaacuccccuuccccaaccccacccacacccacuccucucucagacucugcucccucugucugguucccacaugagugucauuuucuuacauauuuuugccuucacuucauauucuauaucuuguccugucuuauuugcucgcccuuccuuccuccucccacccucucuccuuuccuuccuucuuuucuuccuuucuuucuuucuuucuuucuuucuuucuuucuuuuucuuuuguucuuucuuuuucuuucucccucuuuauuucucuuucccucucuuucuucuuucacuuucuuccuuccuuucuuucuuuuuccuuuguucuuucuuuuucuuucucccucuuuauuucucuuucccucucuuucuucuuucucuuccuuccuuccuuccuuucuuucuucuuucuuucuuuuuccuuuguucuuucauuuucuuucucccucuuuauuucucuuucccucuuuucucucucucucucucuuucuuucuuucuuucuucccuuucuuccucccuuccuucuuuucuuucuuucuuuuuuuuuuuuguuuuguuuuuguuuuguuuuguuuuguuuuucgagacaggguuucucuguauagcccuggcuguccucuuucuuucuuucuuucuuucuuucuuucuuucuuucuuucuuucuuccuuccuuccuuccuuccuuccuuccuuccuuccuuccuuccuuucuuucuccccuuccuuccuccuuccuuucuuucugauucuuuucuccuugcuauacaccaagagaggcugucuagcccugagaauagcuuuccauuucuuguucuagaaagugcccuuucuaaguugccugccucuuuccccuccuccuucacacuuuggccucacacggguaaggugaagcaggaacccaugccugcuauuuuacagcacagagcagcaggcuuuguuuacacgaguugaggaacaagaguuuccuugacauguuagucaccggaugggcagcuauuuguaaccugucuugagucccuuccccugucaggugccacagaguaaugucccccagugaggcaauuauuaauguuuacuuucacuuccacaauuagccuuuauugguauuucuucuaaauuuuaaaauuucacagaagccugacuagggcuucccaguagccccagcuacucuggaggcugaguuagggaucuuuugaguuuaauaguccuaggucagucugggcagcauaaugaaacugucucagaauaacaaaaagguuacaccagucuggugugguguugagucuugggacuauuuggggcucagucugcuuucuuuccuuuacugcaauaggaaacuggauagcuggauaggauucccuaagucuacuuuggaugucaaaauuacagauuuucaguggugccugguguguaugucauaaaucucggagcaacuguuuguuuaaaucaucaucaucaucauuuuggaagagggucucuuguacccacccauacgugccuugaacgugaucgcuguguaagagcaaugaccuugaacucccgauccuucugcuucuacuucccaagugcaggccucaccaccgugccugguuuaugcaguccugggaucaauaaccagagaacacugccugucagacaaccucacuaccagcuaaccgggcuauauccccagcuucuuguucuaguuagcauuugucaucaguuucugcucuuaggacuaggugcucuuaagaucugcucucugcucuccccaauuccuuguggcccguuccauccagccugcuuuacgcccccgccccgcagccuuuucauuuuacaguaauuuuaauguguccaggaaccgaccugauaauauuccuuugugccuagccugcuuaguguaucuugggcuggcgugaaacugugaaaacccuccugagccuggaggguuguaacuccaugacacuaaccccagugaccccaaaaaugggcuuugcaucuucgcaguguggcucuuuugaacaacucccccaccccgugacuaacugaaccuggcaugccccuugcuucucagaauuuucaagcagaaauuaucugaugacuggacugcggcugcacacacagguuccagcagauccacccagggacugccacgaaggugugcggaagucagagugaggucccacgcgcauccgcauccccgcuuguggccuguggagccccaacuucucaucacucuggggcgccaguuuacgagaacccuguguauaucuuaccucgguugcacgguuaggaaaguaagcccaaugguuucugucaagguuuccauagaugugcuaaugugugauaucugcuuuugcaaaccucacuucaaaguccguagccucgucgccuugggaacccucacaaaaacucaggcucacccuguuaagauaaauaaaaccugcccggucaccaguggguuuccuuuaacuuucuguggguuucuuuccuuuucucaauggaauaaagggcucaaguuucuaaaucagguagcaucuuucucgcugauuccugguaaccccaaaaugcaguggcucauuugaaaggaucgcugugucaacuucuccacagagcuuaaacuguguugucugcuguaccucacggugugaugggaaccuagcuucuaaccaguacuuauugccuaauuuguacaaaguacaagccaaggucuguuugccuuuaagacugaauaguguuccauugaaacccuggcaaguuugauagugcaaaacccacacaagaauuuacuguuguuauggaucugauuucugcugcugcuagaccacccacugaucuuuaaaauauacacugguuagaucaauggagaaauacaauuuuauguggaguacaggacuggugaauuuugagugucuaacaaaaguaaguuuuuuuuuuuuuguuuuuuuguuuuuuuuuuuuuuuuaaagaacaggcuauauagccuggccgugguggcgcacaccuuuaaucccagcaagcacuugggaggcagaggcagaggcagguggauuucugaguuagaggccagccuggucuacagagugaguuccaggacagccagagcuacacagagaaacccugucuccaaaaacaaacagacaaacaaaaaacaaacaaacaaaagaaagaaagaaaaacaaaacaaaacaaaaacccggacagguuggcucauagaaucuaauuauauaugauccacacacacacucaacuguagaugcagcuuagaagaauggcaguauuucuuagcauucucagaaaagaacaaucucauggauucggucccagcuauaacuuuagcauuccaggucaaagacugcuggcaaaagaauguguucuaaauuaggucuucaaaauaauuaaguauuuccagaauauacuuauacucauuaagaaggaaagucaccggggaugguuucagauguuuucacacagccacuuaguaauuuucagaaacaggaguuuggauaaaaguuugaaaguuuaagugacauuuauccuaaagccacuugguguuuacaagguuguaaaaaaugggcccagaacacccucaccccacaaaaccaggagcuuccugaugguuaacuugcccaaggucacaccucuaaugagaagagaaaccaaaauagugaccuuggccuccuaagcccuaucucuuccuccaaagccugaggcacucaggacagaaucaaucggugggcaauugcaggggccggagagaccgcuaggcaguucagagcacuggcugcucuuguagaggacccggguucuggguuccguuuccagagcccacauggaggcucguggccaucuguaacuccaguucuaguggaucucacacccucuucugguucccucaagcacuuagacugccgugguguacaaaagcucucucucaccacacguacacauaacaaucaauauuuuguacacauuauuuuaaaauaagccauuuccuuuccugccuuccuuucugucuuuuuuuucuucuucuucuucuuuauauauauuuuacccuuuucaagacagggcuucucucuguaacagccuuggcuguucugaaacucucuuuuuagaccagucugguugcaaacucacaaagaucuaccugccuuucccucugccucccuagugcugggauuaaaggugugccucacuaacuccagcauuaaacacaacuucuuaaaaucaccuuaacuugaaacuucaaggaccuguguggguugcguuuuacccuuaacaugaaaggugucucucggggacuucaauuuugucuccuuuuguaagggugugaucccagcaaggcaaaaaguaagaaaguuaguuaguaaaugaguaaauaaauaaauagcagacaauagacuaaaacucaucagugaaauaaacucucuuacaagcguuuuuaauuguguauugagugagagaauauuuacauguguacacagauaauacucuauuaaaucaucuaaguggcugacaugccauagaauuaacauguugaaaaguauaguuuucuauuuuuggauaaucauguccauacacuugugaggugguuaccagcuuuccugggauauacaguguucuguguauacagagcauuuacaaagugacugaguuuaucuuccagcauauccuaaugcucucagaaccagcacugacugcucuuguguggccuuaccuguucuggaaccucauuuaaugaaaauuguaucuacccuuucaagucuagaacuuuugucuuuauugguuuguuucacagcuagcauguuucugagacucaugcacgcugcuguacacgugaagaccucucuuucagcucacgauauucuuccaguagaaaauugcgccacuguuuagccacuugucuauuaguaaaaaauugguuauuucugcuucuguaaacagccuugcaaaaacugguggcauuuuuauuuucauuuuauugauugauugauugauugauugacuuuguugaugauugguuuuccaagaugggcguucucuguguagcacugcccugguuguccuggauucacuuuguagaccaggaugaucucgaacucacaaagaucugccugccucuuccucccaagugcugggauuaaaggcauacaaccaccacuuugggcgauuggugaaaaauguucauugacacaugcuugcacauaugugugggaugaugugugauauacuuuaaaauauuuacuuuauuuauguguguuuguauguguucuggaugugaucccagcaagguuauacccagaacacacaggcucauaaccuucucugugcaucugcugggaaccagaguuagguccucggcaagagcaucaagugcucuuaaccaccaagcuuccucuucaugugaugauugaucuaugugauuaguguauagugaucagaucagaaccauuaacauucuugcucuuaaauacuuaucagucucgcucucucuuucuuuucuuuuauaaagauuuauuuauuauuaaacauaaguacacugcagcugucuucaaacacaccagaaaagggagucagaucucauuaugggugguugugagccaccauguaguugcugggauuugaacucaugaccuuuggaagagcagucagugcucuuacccgcugagccaucucaccaggccucuuucuuucuuucuuucuuucuuucuuucuuucuuucuuucuuucuuucuuucuuucuuucuuucuuucucucucucuuucuuccuuccuuccuuucuuccuuuuguccuuccuuuuucuucuuucuuucuuucuuucuuucuuucuuucuuucuuucuuucuuucuuucucucucucucucuuuccucuuccucuuuauuucuuucucucucucucuuuccucucacucuuuauuucuuucuauacccuccuuccucccucccucccuucuuuccuucuuuccuucuuuccuuccuuccuuccuuccuuccuuccuuccuuccuuccuuccuuccuuccuguuuuucuuucuuuucuuucucagaccuggucucacugugcaccccuaaccuagaauuaugaugcagaccaggcaagucucaaagucacagagauccaccugucuuugccuccugagugcugggauuaaagguguaagccaccauuccuggcucaauuauuaucucaaacuccugucaucuaguuucuccucaaauagaugauuaauugguguguacuacagccccccucucagcucucuauaugugucagagccuauuucucuaugaaauacuuuuauuucucuaugaaauacuuuuguauucauuaucuucuacuaaaaacaucccccauauaccuccuccuuguuggccuuccuacuuuccaccacuguuguacuguuuccaucuaucaacucugcuggguuugauuuccgcauauaaauacgaacacuugccuuucugugucugacuuauuucauuuagcgcaaugccccaccuccaucaugcccauuuugccagauugacagacuccauuauguuuuuagagacucugagccaucucucagccucugauaagcugcuguguguagguaccacauuuucuuuugcccaccauuuaacuguggauaccucuguuggauuccauacugaggugcagcagauggugcugcaguaaacaagggacaucaaugucucuuugguacaacacuucuuugggauuuauacuuaggcagaggauuguuggcucuugggguguccaguuaagaugccgccuaacaguaguguaacgugguugaaccguuuuuacaucuagaacugugugagaggucccauugcuucauauccucauugauacuugcaaauaucggucuuucaauuauaccuuuggcaguaggugugagaugcucucuuuugcuugcucgguuuugcauuuuccugaugacucaugcuuccccacaccuccccaaucuccuuggccauuccacucagauugugucgauguggaguacuuacucacacauuugaacaguuuuuuccaaguuggguuuucuuuuuuaacacugggcuguagagauucuacacaccagagauacaaggcucuugcgcauucugggaacuuucuccuuaccugccuuuuguagucucugacguagucuuuuaucuuaaaucuugauagcaccaaauuccucuucucuuucuauugucagggauuuuguuuaauuuugcuaugaacucuuugcuaaugccaagguaagaaagaugucuucucaguguccuuccaggaccuucaagacuuuagauucugcauuuguuccuguuuuucaccuuagcucgcucuuuggauguggugggggguaaggguggggguucauguuccuucccauguggaagcagugacaucuguucgaagucucauccucccuuuauugaguucccuuugcaccccugucaaacaucgauugacuauguaggcgugggccuauuucuagccucuccauuguacuccauugauccaauuguucucccuuuucucuuccaaugccugugacuaccgcaucaauuucuguggcuuucgagucacuuuugaagcuggccaaacauaaagacccuaaccauagcauacucuuccuuguaagacuguuggaacucuccuucauacuuuguuucucgacauaaauuuuaggaucaacuucuccauuuauauuaaaaaaauaucugcucagauuuuacuagguauagaauugaaucuauugaucaacuugaggauguugacaaccuaacaauauugagugucucagcccaucaugcacacacacacacacacacacacacacacccauuuccaagaacauauaucuuuucauacuuauaaauaccucaauaauguuuuauauacauuuuuugauuauaucuauugucaaauguuuauuuuuggccuuguuuuguuugguuugguuugguuuuuuguuuuuguuuguuuguuugagauaggguuucucuguguagcccugguuuuccuggaauucacucuguauguagaccaggcuagccucgaacucagaaauccaccuaccuccaccucccaagugcugggauuaaaggcgugagccaccacugcccagcacaaguauuuuuaauauuuuaucaguauuguguguauuugagggaguuggacgcauuggucauaaaguuugggauagugaugcucuuuagucugcguggaugccuggccuggggaacauccuucuguucucucccucuugguuucuugaucuguaaacuagaaggugucuacagagaccucagccuguugguggacaugugacaagcucucuguccaagcaagcuaucauuuuaauacucuaguguucauaggcacaauacuguuuaucuuggagacuucaugaacacacacacacacacacacacacacacacacacacacacaauccacccuuuggggcuggagagaugacuccucaguuaagagugugugcugcucuuguagaggcccugagcucaguucccagcacugauguuagguagcucagaacugcuugugauuccagccucacagacccugaggcccucuucuggccucugaggguaccugcacaugcauacacaagcacacaugcgugcacacacacacacacacacacacacacacacacacacaaacaacacacacacacauuauauauaaccgccagaaacacuaucaauauuagccuaauucuccacucuguguauuaaagacaagauguaacuucucaucuguggcuugaucucgugagacuuuaacaaagacccuuaacagcucuccuuuuuuuuuuuucuuuccgugugcuacuucuaaaaguuuaaguagauccgcgggauccccaaaagaauuacaugcagacuacauuaagaugaaaaucuuuucuauuuguucugaagcucggcaagcccagcacacggucuguuuuguuccacgggcuccuaagguucagguauuaacauaaauacagcccguuaacacuuguuccucucugucaggacauaaauuaagucugcagguguuccacagagcuggacccuugguacuaauuaagccuugauaauuagguuuguuaaauucaggacuuuaagcuuauauucccucuuuggguugccaaaauggagcugcgcaguuuucugccuccacccccugguuuauuuuuucuguccacucccgucucucccucccucccccucccuccaucauuuucuccagucuuucuucucuucuaacgaaggcauugcuguuuucucuccauuuuaguuuucuuucuuucuuucuuucuuucuuucuuucuuucuuucuuucucucucucucucucccuuucucucucucucucuuucucuuucucucucucuuuuacucucucuuucucucuuccuuccuuccuuccuuccuuccuuucuuccuuucuuucuuccuuucuuucuuucucucuuucuuucucucuuucuuucuuucuuucuuucuuucuuucuuucucucucucuuccuuucucuuucucucuuucuuccuuccuucauucuuuccuuuucuuucuuucuuucuuucuuucuuucuuucuuucuuucuuucuuucucucuuuuaauuaagaaagagucagugucaacccuuuaccauuuugccaguguaggacaugacucagaugcacacauccguuuauggcaagauuaaaagcuucaguuccauucugcaucagccgagacuugagaaugagaaguggcuggcuggcuuucucuggaugccaaacacaaucaagucuauguuguaaaccaaagaagcuauccuucaggagugagcucugagaugaucuaaauccaggcaggcaauaugcugggacucaagaaaauuuguguuuauguuuauuuuuccuuauagugaaaucaucuuggguagggagauggcucguggcuuacaagcaugagaaccugaguuugagcccuagaacucauguuaagaaaaaaaaauguugugucaauaugcauguuaucccaguacugacaagauggucaaucuuuggaccucacuggcuggcaagcuuggccuauauggagagauccagaacaauguggacucuguaucaaaggaagauggagagcugguguuugagagacaacaacuaguguuuuuuaugaccgccccuacauucauauacaccagaacacaugugaacaugacaugcaucuacacuggcacccaugugaauacacacaaacacacacacacacacacacacacacacacacacacgagagagagagagagagagagagaaauacauguaucuauauuugucucacacauaaacaugcacacacacauacaucuauacugacacauacaugaacaucacauauccacagaguagcacauauauacauuggcacaaaugugaacaugcacacgcacacagaucuacacuggcacacacaaggacauacauaugcacaaacacacauguuuuagcaaaacaauauucgaagaucaccccuagcucucaaaagaaaaaaaauaaauucucugcuucuuaugguauguucccaauagaauuuccuauccaagggauagagggggacaaccuguggccugcagguugguuaucugugacuagcugauccacagcaacacuauggaauccaacagaugguucucccaccugucucuucucuucaguggcuuuauggaugggcuccucuucaggugagaugguugaugagcgcuggucuuccuuuugugguaagggaaucuaugagcauuggauccccagauacuuccuuuccagcuucacucaucugugggacgcucaaaguuaggcuuuuaaccagaagcauuucuguuuguaaacaauggccuugccgggcggggguggcucaugccucuaaucccagcacucgggaggcagaggcaggcggauuucugaguucgaggccagccuggucuacagagugaguuccaggacagccagggcuacacagagaaacccugucucgaaaaagaauggccuguaccuggggcuugggggggagggggaugcgcaauugcaauggugcagcuccacucuguuccuuuagcaaggagcccagugcugcugaucuuucuagaaggguaccccgguuucagugagcaccagguucugaggaaugccuucugcagggugaccugcuccucuagguccugagacaucccuucucucuggagugugcucacaucccauagcuccugugcacggacaccuuuccccuucaggcuggcacucaggcuccaucuucaaaaucgccaugccccguuuccccagacaggacagaaagagccucaggaugugaggaaacagacuggaagaaacagcuuggcaagaaaacaaaaguuuguacagaggcagagggucagagaguuugaauaugcaagggcaaucguaagcaacuucauggagucaaacuggcugcagaauguguguucugcagaaagaguuuugaugugaauucuuucuuuuuccucucuuucccuuuccccauccuuuuauugguuucucucuuuucuccucucccuuccccucuuccuccuuuccuucuuccuuacccauuucuucuucccacucuucccuucuucucugucaccucccacuccuaucugucugauaguugguauucuuaacauccaggcacaugacaacuccguugaugucuggugcagagaaagaaagacgaauucucacuugugugacccacguaucugaggacacaccaagugaacuguggcuaaccugcuguggggguaacagaccccccccccaacccuuggccaagauucagggcuuucuguacugcagcauccguuuuagccaacgggaaggggagauguagcaggagccagugccagucacauggaguaugcucaggccaccuucugcuguagagcucacugcggcagacuuggagccaggagacggaucucagugaacuuggaaagcaccaaguucacuuucccagagaacugagcagcuuggcagcagaccaggugcuguuugcagccaucuugcaucuugcaugcaauggugucaccagccgagagcucucacucugucacaaagccccaacaccaccccauccaccaacccccuucgcaucuuuuucaaagcagccucucugcugcacaguugauguuacaggggcagaauguguucugagucauauuauucccccuggcaaagagucaccgcugauuaauuaccucaaggacagugccuggugacuuuuucucuccccacugaauuguuuuguaucccacagcuccacguggggcuggggagaucagcaaagcaugagagggcaauggggagccagggugagcauuucaaaauaccagacagcagugcucagaccuaugagucuugcagaggcccaugccagagcuucccugggaacagaaaaaucuaaaccagguugcaaauagucacuucugcucucucaagcuacagcccacagacugggacaaaaguaucacuguaagcucccuagcuccugccaagcaagaaaagacagcuccuuccuuaguggauguccaccauccucuaggaaggaaacccaucugaagugcccuccugcuuccuacaacagucucuccauuggugugauucucaccuaccacucccuucuaauuuuacuuucccuuccaaguuugagggaaaauccagaaaggacugaacuauuucugccugguuguagugcugagcaaagucacaagagagccuucccagagccaggaauucaguucuaaggucugugugcuaccacuugcuagugggcaugaggcuuuugaggcuguucaucuggauagaucauccauaaauuugugaaugguccaaucccagugagagagucuagaauuugacaaauauucauuguauggucauacauugagaaucuacuuugugcuugugcauguguguguguguguguguuuaaauaaggaacaaguacacaaacacauugucccugucaucaaagcauaucaggagggguguaacuucagcuagggcuuaagagcuuuccuaaauggauccuuaagcagaagaagauaaaauggaacccauuccgagggagacagaagaacccaaaagauguaccagagauaccaagcccuaggccggacuagaguugguacguucaccaacaaggcacugaagguccuggccacaguaaggagauagaaggcaaggggacugggagaugcuuacagcuuugaaaaccauaggaaggaauuuggggguuguugucagcuauucccaucaguaccugguauaucaaccuauggguauuuauggcacccaauuugcagggcagcuaagcuucauaacuuucucuucuucaaagcuuuaagccaagcuaaggcuaauuaugagcugauuccacucuuuaaagagccaguagaauauuuucuuaucccuucaugccauguagcuacuuuauaugguccacagugacagacaggcauuuguguuugaugaaaugucaagaggggagaaauaaaagaacccgauccucuuuguaaaaaagaguggccuucgggcauccugcauuaaccguucggcuguugagccuguuauuaaacuuuauggaccauaagccccacagacacaaggcgagggaacagccauguuauuacaugagugucccaaccaggccuguacugccugccuuagagcacucaucuagcuucuccguuggcccugggaagaacucaguggcacaugaaggcuuucagggaaagacauuccucuuaaaugcaagcucacuuucaggaaucuggacccaggaucaugugacaccuggcucugcugacuccacuagcaugccucuugccaggaucugauaggucaguuuucaaacacuugucucuuauuucgagugagaauaagguuauucuauggguccauuuacuccagauauagagucaggcaaauaggcaugccaugccacccauacccaagucaguggcuguugagaagaaauaccaacugcuauuuaccuugcauaggaagagccaagacauucacuuaauaaauaagauucugugcuuguugcaaugauauuucuaacuuucaucuucuuuauacauccagagauacagugucauuucaacuuuauaguaaugucaacauucucagauacagaugcauucgaucuaauaguccaagaaauccucauaucaagaauuuacgccauuuuauugcuguuguuuaucaaaguggucaccccugguguuucugcaaauauuucucccuucucugucuggggauaacaagucucuggcccuuuugaagucaagcacaggcgcaucuccuuguaucaaggugugaaugaaaguaucaccuuaaggaagauauuuaaaagacaaaguguggcgauucacucuugucuauaacaaagaaucacugauaucuguaauuguguggcugugagcucucccugcgagcuguuccuccaucaucuuggggggcccuaaugcccaccuguuuacagcuacaguguaaccgaccauuaagcuuuuacugugucaagucccugaaggagguguggugaucacauuggaugauccucccaccuccgcccucccaccgccuaccacccaccccguugacuaaagccaccaaagggagggaggauuugcuuugacucacaggucgagaugggaauguuaugguggcaggagcuugagccagccucucacgguccaccauaaucagagaacagagagugauggaugccaguccucaccucaucuuuuccuauuuagucaguaccaccgccuaagguacugccugaucagacauuauggcaggucuuccugccucagguauccuaaucuauaugacgagucacagguguguccagaaucuugcuacuuuggugauuccucuagauccugucaaguagauaaucaacauuaaccaccagagggacuauucuucucugcagcaaaauguugcccauccuuccagggauaagauauggcauucugugcugggacauacauaggccucuuaugucuagcccaacauaggcauucucaagauaaauagcaugggaacaugcucucauuccauucgccuuuauaacaaaucacagcauuuguaaaauauauccucauuuuuuuaaguaaaaaaaaaaaaaaguaaaauuugucuacacauauuugcaugcgaguguaagugcccuaggaggccagacgaaucagcugccccuggggcuggaguuacaggcaguugugagccaccugauguaggugcugggaacuggacucauaaaguacuauaccuuuaaucauugagcaaucuugccagcuccuguaucuucauguuuuacuaggaauggagaaauaaucuuuucuuucucuugcuggccagcauuagccaaccucugccuucuguagagacacaaaaggugccagaaaccacgguaguugaaagaccagagaaguuggaugagaaacgagagagggaagacggcaggcccacagaggcgauaagacucaggagugugcucugcacugugggguagaacaaacuccaacccuggucaucccuuggcucaguguuugagacucacagaugaugcuggucauccccaccucuggggaauucggaggcagucaacagaaccaggcacccagaugauggcaacuuauggcugacuggucaaugccccaaaugcugaaaagcccuggcaaugguggugaggcuugcuagccuucagagccuugacagccagauuccaaauccggugauggccgucaugcacuguguuacuucagaccaguuucccacugucuuugaacuucaguuuccucgucuaugaaaccgagaugguacuuuuuucccccugaagcuuuuaaaaagcgauuaacaugagccguaaugaucccaugaacugcaguucugcuguaagccaugcacugugcgagagagcacuuuuggugugugugugugucgggguucgauagcaggaaagaaggaaagaguuuauuauauuggcugacaucauacagucuaggugguccaaaaagagccgcucguccugaguugcucaaucuaugagcuggauaacccaucagucucaaucugauacucgaguccugaaguuuucccgaagagccgcuggucuuuaguuuaugcuggaaucuggaagaaguaggcucgaauaccggugaagggaugcagcaacaauagauagguggacuugccagccauaacgaaggcacacagacuaaaagcaaagauuccuuucucaccucccuuuuaucucgacuuccccuggaggucauugcccguuuaggugggucuuccccccccaaauaaucagaucaagggaaucccucacaggaaugcccaucuccuuuaguugacucuagaaccagucaaguggacaaccaagauucccccucacaguuuauuauuuuauuuucaccuauacaguggcucucagagaggucacugccgugaucuguagguuagugaaucugccuagggucacgugaccaggacgugacagaagacuuuucuucucuaucguaugcugagcuccauaugaggagucuguucacuguaucgugagagguugugugauacaguuggcugucuucucuccucuucuaugagugcccuuggaagauauaaccaguaagaucauaucucagcacuauaaucuagcauggcgguccaagggaaacaccuuguggaauuccauuucuuaccauuuuauguccccuuuaauaucauucaaguccuccucuguaaaaggcagucccuucagcucucauaaaacuuuacagucuuuccuuaugauuaggcaauagugaaauugguucucucaaaucaacuucuagucgaguuauguaauuggccaauaagagaggccaaagagaguaagacauacaaaguucucccucaagaggucagauguauuaucauuggucagauucuguaucuuuaaaacaccaucagcuuggaaaacacuauccauuaagaagagaucagagcagugagaaaccucagaaggucacgagguccauucugagggcucuucaaagaacucagcaucccagaaggacaauuagccuuccauccugggggcuaucugaaacugcaaugcauccgaggcuuaucccuuggugaauuaacccauugggcuucagcccuagcuuuugcaucccacauccaacauucugccucccacugagacaaauagauagauuagaugcccugguuucugcaacugacuccauguaaggacagaaacucugaacuugaagagagaacgcuucucaucgccuccgcucacaaguucacuugcugcuguucgcauggacagaccuggagacaucccaugcccauuccugccccuuccuguuuuaccuuucucgacuucuccccgggguaggcauuggcacaugaccauguucagguuaauggauuguugggugaaacugaguuaugaacaucagcccuguacagcucucccucuucuucuccugcaggccagaugcuaaugaauauagugacuuggaagccuaagguuaaagaccacagagcuccaagacaaaaugagacagccacagagccacuguggagcaaagccaacucacucaucagauguaccaguucugggccuggggacaugacucaguugguauauagaaugcuuacucuguaagcaugaagacccaagggucuuccugagaacuuagguuaaaaguaaagcuaguuaugauggaguacuuggugagcuucagauucagcaaaagacuccaaagcaagugggagccagugagaugggucaucagguaaaagcuauugcuauacaaguccacuaaccugaguucuaucuacaugaauguggagagagaaaauggaucccagaaagcucuuuccugacauuuauuuguauacauggcaagcacauacacacacacacacacacacacacacacacacacacacacacacacuaacagcaacaguaacaauaguaauaaacaaaaauuuaaaagcaggguggaaagcaauugaauaagacaccugaggcugaccucuggcuucuauaugcaugcacacauacacagauguaucuguguacacacagauguacuuguauacacacacacacacacacacacacacacugaagcaaaagaaagagaagaaauaaauauuaguuguagaguacauaaaggucuugaaccacaucucaguaacugcuaucaucguccuagcugaugccugugauaucccgcugauacuguuauuuugggcagauacuuauagcagugcauucaacuacauuacugaucagaaugaagauucaucccugcuaagagugaaugcagaaugaucccauuuuucuacugugugggucuuguccuuuugcuggcauuuacccuagcccuuuguccaaaguagcaacucauacuuucucaacccaauggcuguuuuacuccucugcccaacacuugucacugccugcucccauccauccauccauccauccauccauccauccauccacccauccauccggugguucguuuauugcuuacuuguuguuuuaguaauccaaugaccauaaucugcaggagagcaacaaccucaucugccccaucugucuacucuuuuagucuucaccaguuagaauggagcuuccuaaauuuauugguugaugagugauuaaauauaugaaugaauaaauggaugaaugaaugaaugaaugugugaaugaauuuaugaaugaggaguuugggcucauacauuuuacuuuuauuuuuuucccuaaagguuuguuuuuacuuuacauguaugaguauuuaaugugugaguuuaugcacaccaugugaguguagugcccacagaggccacaagagggcaucagacccuccugaaguuggaguuacagacaaucaugagcauccauguagaugcugggagcugaagcugggaccucuggaagaguaacaaauguucucaccugcugagccaucucugcagcccccacuuuacuuuuuccaauaguuacaguuuuguguaauuuugcuuccuuuucaguggaggagauuucugaagugaguaacugaauuagagucaucugugguuuaacugagauacacugaacacccaguguuccgggagcugugcuaggcaccuuguaugagagggaaaccaguagagucaagggaaggggucgggugagaggacugcggcccaaaccagacagacaaagauuaagcauccuaacccagucuccugugaaguuuagagaugggcucuggggaaaauggauggccacucaguugggucagcgagcuccaauaucaguucagacuuacauugcugaugaaauaguguguccugucucccuccaccuuuccuuccacugccauccacucauguggcuuggguuauacagauacagagauucccagcacacacgggaccucuguagucauucgcacagaacucagucacauggugacuaacuugcccacuugaaucccaugacagcgaagaguugugcacuaggugagguuccauagagaccauuccuccauccaaagaggguaauaggaaguggaaauugaaguucuguagguuguggcucauagcagcucucuuccucugagcaugcccaccaacgagccuacucugaacuuuacagaugcuccauccuguagaucaugacacccaguguucaaaugcuaccaaaguacugagcacuuuggauuuuuuaaguacuagaaaauuguacuugaugucgaugguuccuaggaaaaagaagacauccgaugguguuaguucaugggaucaagauaaguuauuucacuuaccuuuugggagaagggucuaugucucuuccuucugcaguauaauuauaguuguuuaugauauugggggugaaagcaggugucccauacaugcugugcaagagccccuccccugccacacccacagucccuuuuucucuuccugaccagccucacccuuuaacguuccuuugccaauucuccucuaacuaucuccccuguucgggccuuugccuauuaaguaauucugaaagcaaagcggcuccuguccacaacuguuuauaacucucccaaccucuacuuccugucuugaaucucugucaccagagcuuuauaacaagauuaacacucaaggaagaaaaauggaagaaggcugaauuuuaauuugcuguuucuucacacacacacacacacacacacacacacacacacacacacacacugcucagcucagucaaugcccagaaaugaaggccaauagauaaugauagcagggucuccuauuucccaccuauuguuuccaaucccaauuaggaaaggggggaugugggcccauugucuucugggagugugcagacacgauguuaucauuguguuuacagaggugguuggauuccccgugcucugcacaccccacaaagaugacugucccaucuugauaaaacaguacugucagcccaaucccaaacacgcugcacacugaacgcaucacggugacagcugagaggaaaccccguguuaacaaacaaguuuguaagccaggaaguguuaaucaguuccuucuacccagggagcuaugauggauggaggccccguuucauagggguuuccuucagauaaaacaauaauacccggcuuucgagaacccaguucaaccaaaagcaaugauuaaucccacaaaacgucaaacaugggaagacuggaaagaagauaucaugcaugggguauauaauuagccaugguuaucucugagaggaauucagaauguuuugcucucaaggagaguaacaaucuuuguaaagcggacagggcaggagagccucccuccguuuucuuauccuauuccacucuggguaaucuugagaguggaaagacaccaacgugugugcugggacaacagauaggaaccaacugucccagacuggcuggaaucaaggguuacucugcccguuagaaggaagacagggccagccaccaugcucuccuuagauaugaaaaugaaucaaagcagucaugguuguucuaggcucuaagcuaaaucucugagcaguccugggauguguuaccugaauuuaauagcccagggucgugaaacuuguuucccauuuuccaccauauacacacucgugagcuuugugagugcaaauggaagaaaagaucauccaaacaauuaacuggaacauaggaaaauguauaugauauaugacauaauauauuauauauguauauaugacuuuauauauggcuauauacauauauuaugcauauauuauauguauacacauacauauacauacauacacacacacacgugugugugugugugugugugugugcaugacaguuguaguaaggaccaguucgggggggggggugaaugaccagcacccagggugugcuuccucugcauugacauggaguuauagcagugaagucuauacuacauuuccaaguucaaguucaugaaagaagaccauugucuuuuccugggauucagugugacuuggcauguuugucagcuuucuguggcuaugauaaaauaccugagacaaacagcuuauaggaggaaggauuccuuuccuuuccuuuccuuuccuuuccuuuccuuuccuuuccuuuccuuuccuuuccuuuccuuuccucuccucuccucuccucuccucuccucuccucuccucuccucuccucuccucuccucuccuccccuccccuccccuccccuccccuccccuccccuccccuccccuccccuccccuccccuccccuccccucccuuucucucucucucucuuucuuucuuucuuucuuucuuucuuucuuucuuucuuucuuccuuccuuucuuucuuuguaauguuuugacacaugaucuuacuguguagcuguaguugaccuggaacucacuaugccaaccaggcugcccucaaacccauaaaggcucaccugcuucugccuccccagugccaagacuaaaggcaugcaccaccuuaaccagauuccuuuuggcucacaguuucuaagaccucauccuauaguucuuugagaugggauuguggggagguacagcagcaagugaugggacuggaaagcagaaggcaggaagaagaggggaggaugggagaacagagaaagagagaaggaggaauagagagagagaggaaaggagggagaacucacaaaacuaaguucuucaucuaucuuccuagaagugacccuugccauuucagcuuucuuuuauuggcccaaggaagugaauagguguuuugaucauuuuucuauugcugugacaaagccacaaccaaagcaacauaaagaaagaaggguuuauuuggguuuacagugccaaaggaauaggaguccaugauugugaaacagagaggcauggugguaggaauaggaaacaagucuuuaaacucucagaucccacuccuacccuuccuccaacaagaccacacucacugaaccuccccaaacagugcugccaacuggggacaaagcauucaaaaacuguagucuaugagggacacaugucauucaaaccaccacccuaagccaccuuuaaucagagguguagaguccuccauagaguaacaagguaagcagcaaugugccacaguguucccucccacauuaggcagccagcugccucuuucuggccuugcugucccagcuccuaaagguuauggcuucuaacugccuucgguugacuccagaugcuggaagcuguacugucuuucucagcccuccuuggcuuagagccucuuagacaacacucucuguuuccagguacuuccccuccacgaaaugucagcccugagugguguaaaugcuccuaguuuuaagagugcauggauuacccaguugggggccuggcccugcuugcuucaagucuuccaaagucucuuuugucuuuuagggaaaguuaaagagagauggagacagagagaaagcaugaccuacuuuucauuaucagccccauuucaucugcaaaacacgacuuuccucuucuuauuacgcugagcaugaaaaauaaaauguuuuccaaaagaccuggcuucggcugucgugaggacggccggggacuuguucagaacucccaugaacucugugaacaaaugacuccaauuuuuuuuuuucccuaaaccaccauaauugacuuucaggccguucucacuggccgugaauaauacgugaggguacauuccuccaaauaccagcauccaaggaggacaaaaaccaucuuuccacugagcugcucacaggaucugaagcuuuccccagucccaauauaggugacauuuccaaccagauuuugugcuuaucucuacauuacaccuuguagcagaggggagaaagagaacuccuugacaucuuuuugaagaauggcgcucuuuaaaaaaacauaagggaacuuuuucuuuuuuuuuuuuuucaaacacuguaaugaggguauucaagucugcaggcaaaaacagagcuguuugaaaagacauuagccuggaaauugcgcugugccagaacagcuccagccccgucaaaggccucggcuugccuuacaguuccuuuccccucacuaaaaucauccacuaaugaaaguucucacugccacaagcccagcaccugccgauggagucaagaucggguucccucagcccauggaaggaagggaaaacgaccaggacguguaagucugaaggcacuuaaagucugaaguaauaguaacaauagcuguaguaucuuacaauuggaacugaagugaccgguuccaaagaguuuucacggucauuaucuuaauugagucccauaauaacuuugucacguggacugaguggcucccauccuugcuugauuuuuuuuuuuuuuucugaugaggagaaggagugugggagggcguacagacuguggauguggggucagucaagggcaguuacaaggaggaagguauguugguuaccuuucuuguugcugggacccaauaccugacaagaagugacuucagggagaaagcuuuauuugggcccgcaguucaaagagcuaugagcuauagcuggguaagguagggugguucguucagcuugcucuauggaagugguucucaaccucccugaggcugcaucccuuuaauacaguuccucaugcuguagugacccgcccuccccccaaccauaauuuucauugcuauuucacaacuguaauuuugcuaccguuaugaauuauaauguaaguaucuguguuuaccgauggccuuaggugaccccugugaaagggugguucaaagggagagaagauccacgggcugagaaccacugggcuagggugguuuugaucaggaagcagagaaaggggaaugccacggcucagcugggaguuuuacuuuuucuauucaguccaggaccccagccuauggcgugaugccccucacauucguaguggguccuccuuccucauuagaccccuggaaaagccaaagaugugccucauuaacuccauggguaccucccuucuucuucuuccgcccuacccuucuccaucccuuucuuucucucuccuucccuuccauucccuucccuucccuucccuucccuucccuucccuucccuucccuucccuucccuucccuucccuucccuucccuucccuucccuucuauucucucucccucccucugucucauccuuccuuucccaggcuggccucaaacuccucauccuccuguuucuacuucccaagugcuuggaucacagguacaugccaccacagcuagcugaugucaccuugaggaucaaguccaggguccccugcaugcuagaugagcauucuacaaguccugggccacaucuccagguguuucuuaauccaucaaggcagauauuagaaaauaaccgccagacacggcuucccauugaauguguuuuaguuaguggaggaugggucucgacuugcgguaggauccuguuaggagugagggaccaaccucgugaguggaugcaagccugacaguguccucauuucugacaccaaaggcacauugggaggugacccuccaacuaaccucaugccuaauaauuugcuagaaagacuaauaagguuaacuggaaacugcaaaaugauugauccuaguuuacugcagggcaagaagggcacagaucacagugaccaagagaaagagacacggaaggcggaauccaagaguagcagauggucaguuuccaccaucccuuuccacgaagcguggacaaacugucuuccuuguauugguauguggcugcacucuggaguguggccacucgugaaaggucaccaaaacccaagguccagcguccucgucaccugaauccucaucacugaggcaugguugcuuggcugacgaaugauuggcuaguugauccaggguuaaccugagccuccaggacaggugauaccacaugauaaaacguucuuacccuaaaccuaauuuuuugguauuucugcaauggccugucucacccuaagaccuuagggaugaauugcuaccaccaccaccaccaccaccaccaccaccaucaccaagaaagcuuaaaaccaggucauuccuuaggguuuccuaaauguuaucaucaguuuaugugcaccuuuaauaggacauauauauuuaaauauauacauuuaaaucucugccucugucucuccuucucccauguguguguguuugugugugugugugugugugugugugugugugugugugugugucgggacagcacaugcaugccagagccugcacauagagaucagaugaccuuggguaucagucaucacucuuuacuuugggaaagaguggcuuguuuuucauggcauauugggauccucccagcucugucacccagcucacagcaacagagccaggauuagagacgcgccccaccgcauccagcuuucacccccaguuuaagauccaaccugagguccucacucuuaggcuucccacuggugcagcuugucaggucagagcaucucuuuuaagaccgcuguaucacaggauuuugcagcugucauguggacacaggucuuaauauauauacaaagcaucucugguggccaugacauccccugggcucucaguguucguuguauaaaaguaagaacagcguucaaccucuguaagaugugcccuguccaccaaggccauuuuaggccccaccaucaaggcuuaucccuguugccacuagguggcagcaaccaggauugggaaaacaaccccucaacuguucagaagguaaaaggggggccugaagggcagguaccuuuucuccacaggggcuaaggcuaagauacccagcacuaugugucugcauggcaggugccugucacagguuguugcgcaacuaguuuuggcuauugcaagacuugacagaggcagccccggguugcuggaaagagacaggcucuguccaccggagugccaauucuuacauugucuccagcuaguugagggagcaugaagaugucacauugauccacaccaaagcccgucuuucccuccuccaugaaaugagccuuguuucagcgaaggagucugguguuguuuaacuuugagcaggauuuucagugcucuagagauaguuaugaugauguagagaucaaugacuaggguuugagcucugacaccagccuccaggagagcagcucugggucccaugugucuguguggccuuggccaagucauuaauuuaccauaguauuuuucuucuauugcaugugaauaaggaguaauuaccccaaggacacacggguaacucccagcauuauccgugauagaacaugccagggcccagcaguuguauuggccacauaacagacugucaguaaauauuauucaguuguuacagcaugugucugucuccagggcucuuugucgauucucugggugagagauucagucuuaucuccacacugcccaagcacagagaggccucagccuggccuguagguguucaauaccuguguaucaaauagaaaaaguagauagauuuggaucccuggggucuaguaaaucccagcaccauggaccacauugguugaucuccuauucaccguguuuuccuuuaaauccaagucagagggaaggguggucauuaaagcacgcuuaucagacccaaaugagcacucuuugccacacuuccuuggugccaggcuuguaucuuuugucccugucuugucucacugccucuccugugguaccaggacggugucucuucgaauaggcaucuuucuuuaguaggcagauuaaguggggguuucucucacuacuuguuuuucuuucuugcucugauguuguaaugaauggaaucuucugcuccugucccucacacauccucagcugccccccagugcuaagauuaaguugcuaggaugugcguuucaaauuaaaccaaaggucuugugugcauuucgaucuugcuaaaauucauaaagaaaaacaaacagaagaaacugcagucccagaucuggauacuauguucucccggccuccaaaagcccuuucuuugucccuguguauuuaugcauuuuucauauuugaguuucauuaaccccucgaauguaaaagcaaaguguuuggggcuuugcucucccuauucuuuuucuugaccugaagacugaucuuuuuagauauuggaugcuuuagaaagaggacuguugcaacaguuauuaauacacuuccuagauggguggcuugaaagaaagccugagaggaagagguuuugacuuccugggagaaauaaaugacggaacaggcaaaauagaagcgcuugguaaacccggguccguuucaucgccaguuuuaugggcaacgcuucuguguugccauaaugucggggauaaaacacacuuuaagccaucaugcaaaacucagacuuagaaaaugaaaagauaugaauuugaacccgaguuuuccugucaagagaauuacgguguauuucagcccacugcuucgcuugaguuaaauuuacuauuauuuucccuaacaauaauaacaacagugcaaaguccuccuuuaagucaagaugcuuguuauaaaccccauaugcuuauaaaugcacgccugguuguauauaugaaccguacauucucauagagugacauuagauuuuuaaggaauuuccuuuuggcuuucaaaucauugcacagaauaucggaguaggcaccgugucaaaauaaucaaaacguauuuaacacucucucgaaaaauccauuuaaaaauaagaacaagguccaaggaugauuuucagaccauaaauugaaguguaaauauucaaauuauuuucauaaacuauucaguucuguugggcuuuuaugcuaucauacagugauuuuuuuguauuuaaguuuuccagcacuucucuuuuuuaagagccucaagugucccauaaaaagcaaacacuugaauuuucaguuucuagguacugcauauuuuuccuucugcuugccuuauuuuuauaacguugauuuauauggacauuacuaaagaaaaggaaaggaggauuucgaagaggaacugcuauauaacacugcuuaaaaaaaucuauuuccaaugcuaaggagccaucugggggugggguuugggggggaacucuggcaccauaucagagcacgauccaguuuccgaggccgccauuccugagucacuaucuuccaaaaauauuuauugagccuagcggaggagggcaggauaagggugccagaugccauuuccauuuccagggggugggaggagguuagagggugcggaaagggccagcacggacugcugguggggguuucuggaagagccaccccagaggaaagagaguucaaaagucaggccugguggugcaggccuauaauccccgaaggcugggaggugugaggaugcagagcccaagugcacaaguucaagggcagccuggccuuacugagugauuucaaggccagcucuggcugcugcccaagacccccaacuaaacauaaagaggaaaacaaaggcuaagacucaguaacuggcugcuugccuaugaugggagauccucggcucagaccccgcuacugcagaagggaaugaaaaccaaaauaaauacaugaaaaggaaaaaagaaagacagacagacagacagacagacaaaaauuucuaugggagaaaaauagcaggagacaaccaggggucuggcugaaguugauggaaccccaacuuuaaaugauaaaagccaagaaggacugucauuugggaagcauccuucccccugaccccccuaagucccaaagauaaaccagcuuucaccucgagggaaucaauagguuuagugggcuuguuuacaacagauccugggugagggccugccaccaggagugugggugaucccaagugaccaacacuggagauggagccucuucucccucaucuuccucugccugucuccucuacccugggaggugagauccaaagaggugagacuucuguguacaacucuagcagaaccguaagcaaacggccugaagagcaucugguugguaccaagaagcagccuuccuuuguggcuucugacucugcaccuccuugaauuccuacauugaguccccucaaugauaagcugugaucagggcauguagccaaauaaacucuuuccccauugcgaugguuugggucagaauuuuaucacacggcagaaaacaacuuaggauauuaaaccauugggacaaacaacaguauggggaaaacaaugagagagaagagugaaggagaaacacucaccgaggaacucuggaaaauucugugcuaccacugagguaaccacccuacacaucuuuauugaauacucucuguucauggaucagagaugaaaccguaccuagaacuuugagccagaaauagacacggagcuagacacagaaugcuaugcugaucugaaagccuccaguucaguagcugcgcaugauugacuggccuuguguuuuaagggcaaaagggagacgccaaaggccaucuucucaggaucuucaagcucgggagaccuacagucaugaagacagagguguugagguaacuagauagacccggauguagaaucugcagacguggccuuacugguggaucuuggcuggaauacagagagacagggguuuggguuuaaccaguuggacaacauacagaaaagaauuuauagaagagcaagcucugagaugaagguugaagguacuuccagcuggcauugcucguaggucuggaccacagccuuuuagacauucagggggucaggggagaccuuccucuaagcugcauagaaaguaacagcauggaaacuuguccgaaggugucuggguguacacacccagauguuucuuaacugaccacucgaugacccagcccaggugcccguguggguaauuuuuccagucugguauuuuuuuuuuuuuuucauauagacugggacuaugccuggguaagaucacgcuguguaagggaguucuucugcaccucacccuccaaaugugcaaaccaacaacaaccacagauagaucccagaugccguuucccugcucucgacauccuugaagugggccuugcuggcaggcacaccugccaaagaaaacgccgcccucaaaaugcuccuggugugguucucacuaggugccaaccauggaggcuggaaucgcugacuucccugaaaaagaagucggggcuguggucagcagggugaagucccuccgcaggaagacccagggcaauuaaacacacgcuguccacaucacagagagcccaccccaccugucauucacagcccaggaaguacugguuuccaagagggaccuucccagaaaggaagugacucaguuuggcccccaggccccucccagagcucaagcauacaaggugaggaugcaaagaggcauuuggaggucaccugguccuucccucuugucuggaggacagauguuagcuaccuaaaguccuccagcaagagaacauaaugggagcugaccccugcucauugucccucugcgugacagacucugcuaagaguuucuacaauauagaaaaugggguuggagaaucaaggcucaggagccaaagguaguucuuccaugggagcaguuacuuacauaggaagcagguuuagggaccgaggacacaguucaguugagagaguguuuuccuagcaugcaggaugcccuacugaccccaagcaucacaugaacagggcguggugguaaagaucuguauugucagggcucaagaaguagaggcaagaggaaguucaggucacugucugcuucauggcgaguuggaggcaagccugggauugauaucuuguuuuaaaacaagcacagaccuguacacacacacacacacacacacacacacacacacacacacacacacacgcgcgcgcacacacacacacacacacacacacacacacacaucagucuuaagaaauagcuuuuuaaaagauaacaugauggcaugauggcucaaaagaccaaagugacuggagaagggcagucaaggacaaguuagggaaggcaguccaaccugcacuuuggaaacuaacuggucagacuauucaagcccauggaagaugugaugggggaggagaggacccuguuucugugcauucucaccccacuagccaccacucagaccuuacaaauggaagcucuuccacggccacuugaaugucaucaccgagaguuccuacgcauucuuugguggugagacuacagcagauugaaugagacaguaacaagauuuaaugcagguguacucagggcauauuucaaggaauaagggaaagugguccagagacaaacuugaacucccuggugccauuucagugaagggauacuacaggucuaaauuuaguugaugcaguggguuuggagaggagagauggacaauuuagguuuaggugcugaugacagagaaguaggcugugaugauuuuuggucugggaaguagagaauuaauuagugguccauagaauugggaaagguaagauacaaaccacagcaggggaaggcagugagcuucacggaugauuucugaugcaugcaugcaucguucauaccuuuaaccuggguccuugcaugguccuccaaauaucuccauauggcgauccagcccaagugaguuuucucagucuccccugaaugaccacaaaccuuuuaagggcaucuccucaguacagauuagaguucuuaauauugagaaauacuauccuugggcuucaccacacaacacgccgagcgcucaucaacaggagcuagcagcagcagcagcagcagaagccuguaaaacgaccaggcuuggauguuagucugcuauucaguaggaccuugugauuuccuggcuggugugcucugggcgaaguccacagaccacaucaauuuuagguagagccuggguuguucuuuuuuuuccucccaguuuagaaguccacucacccuaggcagggagagaauucugacaacaguccagcgguuauuguuugcagcaaaugacugcagcagauuaaccacaaguuaagaacaagucagggcuacucuuugagucagguacggcuggggucugcuucccauccaucagugucaggaucacgugcaaucccagaucucuguaacucucaaaguauugcagggugccgcaugcuaaauggaggccgagaggaaaggcauucugcuugcagcucaaucuuguaaggauucuuucaaaagcauauuaauccauuaguaauccauuuugauuuaaaaauaauggucauauauauuugguacaauauguacucaacccgguccuggaaaaugauauggaaucacaaguuuaaacccuaggaacuccacagcaggcuuguugaaaucuccucuacuacuauuuuuguuaaaaaaauaguaauugcuauaucaaguaucuaucaagagggaaucugugagucagguauggcacacaccaguaaucccagcacucaggagguggaugcaggguaggcaugaguuucaggcuggucugggcuucuuugaagauccuguguuaacauggaaaauuaaagaaaagaucaguagagaagguccguggugucucugagggcagagagggaggcgcaggcaggagagagaacuuuucauuuaacaacauuucaaauuuaguacacaguuaccagaauaauacucugauuuacugaugugcccguguuuucaauuauacugauuugaugcacauaagaagacauauuaucaguaagauauuugaguguaugguuucugccauuaugcaaauuaaauggaagguucuaaacauacauuuuuauuuuaggcuuuauaauauaccccgcacucuguuaucuaugauuuaagucccagaggugucuucuggucuuugcgaugguucaguggguaaagugccuacacgcaugaggaccuggguucaaauccccagggauccacacaaaaucuggaaacagguggagugagauggcgcagaggguaaaagugcgugucugaaagccuaauaaauagccucacuuccaucuccagagcucccauuagagagagaagugauuccagaaaguucuaugaccuccacaagcacaguguagaacacacacacacaucuacaugcacgcacucgcacacacaucauacacacacacacacacacacacacacacacacacacacacacauuacauacacacauacacaauaauaauaucuaaaguuagacguuaaaaagcccagccacgggagugcaugacgauaauuccacuguuccuguggugagaugggaggcagagacaggagacugccuggaaguucaugggacagcugcucuggcauaugcaguagcagacaucaaguugagccugcuuccaacaagauagaaggggagggcagagauugucuuuauacauccuguggcacccaugcaccuuuagucacacaaauacacacacaggcacagauacacacauacacacacacacacagacacauagaugcacacacccaaagacacagucacacagacaugaagaaaugcauacuuucagcagacacacacacacacacacacacacacacacacacacacacacacuuuuaaaaaguucuuuccugagucccuaaggucucauggucgcuguggcagaagcaaguagccuuauuuaggcuggguagucagcgguggagcugggauucccacuucccauuuagacccugggacuucagauuuuggguccugcgaugucaucaucuuacauaguaugucagaagcguccuagauuauuaguaagaaugaggguggcugauuugagggggauugugaaaacaggaauaugagauguuucccguucccuggaguguucgugcaagacaggaagaagugaguccgcgcugaccgcacucugauuugccccauuaguguucgggaacuccuucugcaccugaccucaaaucagaucaacugguaccauuggcaggauucacugagcugcugagagcuuaaguaccagacacaggcacugugugaggaaguaaggacccucaaagucuucauccuguguccuguccuugacagcugucuggguggaccugaaccaccugauacuccaagucugaguguucagguuggccaauaccaggacucugaaauauugcaaauauugaaagucauuguugggccucaccuuccauucauucauagggagcacccacgacgacuggggaaaacaaaacaacaaccccucugauuucuucaugauacagccccuuugaggaugaccuuuaauucuccaaauuucauuccaucccaguucgaauuaauggcaaccugucuuacuuccuauuugccuauuaaggugaccuauuuaacacugagguguaguuauugauuuugagaucuguacacacuuuugcuuaaaguuccuugucuuuuuagaaagguccaaggccauccaauucaacucugugugugugugcguguaugugugugugugugugugcaugcguguguguauguauguauauauauacauauauauauauauauauauauguauauauauauauauauauauucccaguuaugaauaugaguguguaccacagcuugaagcuuuuaaaaauaacauuuuccaucccacuauacaaaaauauuuuugagguggucgucauuuuauuugggccauggucuuuggagacuugggacaauaauauacuccuuucuaucuuaugcaaauauaugcagaucuuaaagcauucaugcauguauuacacacuuuauaaauccgaguaauagaaaugguugugucuauaaauagguagaauaaggaguauacauucuguauaaaauaaccucugugguauuuguuuacccugauuuuuuuuuuuuuugauuuaugagucgucacugcucacuauagaagaaagaaaauaaauaugcaaaaacacugcuggacuuuuaauggggugccuuccugucuuagcucaguguuucucuacggaagcugaccuugaagcugcuuuucaaacacaagucaaaauaugcaaauuccagaauaucuggaugagaauccuguguugagaguuuuucaaauucacauuuuuuugcaucauuuuuaucucauaggcugucuuucaccugcucgaaauccaucuccaccugacugggaggaauguggggguucuuccagugugccaauccucucagugagauuuuuuuuccuuugcuaaauaacccacgacuucuagaaucaacaguauucccuagugcaggguacccccauucaaacucuuuuuucucaagucacgguuuucuaauuaguauguaaaaucauaggguucaauguggcuucuucauucauccuuaauuuuggaucacccccaccccaugcacucuccccccugccucaguucccacgcucauccccguucaugcccgcauauccccucccucccuguuuucagaucacagacguucuuccucugucuugcacucagagccucuucuccccacccuacguucccuuucuuucuucuaaguuuguacacacauuccaaguucaacagaggaagcuaaaaugauucggugggggcugggagaacaugguugcucaucauucuggcccuggaccaccucgcucaguauaauguacuccacuuccaucuguuuuccugcaaauccauaacuuuauuuuucuuugccucugaguaaaguucuguuguguuaaaguaucccauagccaguguccauccaucaggugacggcaucuagggugauucuuuaaaaaaaaaaaaguacuuuuuaaugaucauaaaauauuucuugcccgguggccuuaaguucuuuccuuuucacugugcacgccagcuagggucugugcgucauuguacucugccuuuugucucaucccucagagucuuuggugaggagcggcucuccucuaguaagucacaugguacaggcauuuguagucugucuucauguugguacuguccauuucacuggaucccagagaaaccacuuucuguccccugcucguauuucaucagagucucacggagucuccgugacaugggggcauauauaucaccgucgucuucuuaugaccaggaagacucacaaccaugaauuucacugaaguuuaugauuggucccugacugcuucugccaucacauuuggcagagaauccucuucuugcaguuacacgaacaaacagauauccugaaccguugcacgaaugaauaggaaauauaccgguucccaaggacaaaucucucaugugcuagagagcgacuccggggcaaaauguuuuguugugcuguugcuggaggauuggggccaugcuguaauuaaugcuaccuguagcaaaaggaccucaaagauguugggaguguugauuaugucuucauuuuguuuguucaaguuucccugcuuuggaaacucugugaccauugccacauaaagcucuggagauagagcauuaacggcuguuccauguaagggcauuguaacuucuccaaacacagucccuccuccuccuccuccuccuccuccuccuccuccucccucccucccucccucccucccucccucucucucucucucucucucucucucucucucucucucucucucugucacucucucaucaacaccagaugaaaacauuauuggauucaggaguucacaggaguccuggguguagcuggggacugguggaauagauuuaugaaauggaccauuucaaauggcauuaucuucccacagugagguacaccuuucauaaaucaugggcgagugcucagaaacccagcauuuguuauuccugcgguagcaugucuuugcaacuccccccucaccacccccacccccgggccuugcagaggaggagacuggcugggguuugccuucccuagguuugaaaaggcaauuaaucccguuacagugaaauugccgaagaaggaaaaaugauaaccaaacagaagaguacuccauagcagccaaggagaggguuuuuguuuuugcuucuugguuuucuuuuuguuuauuuaggccugaauuaauuauggcacgaacuuaauuacuuauuuuuuuuuuuggcgaguuuucaccauaaucuuuguguuguauuaggaugaaguggauaagcaaggaggggcugaaaaacgagcggccgggugcuggcugagcucgccuuuccucugucaccaaguggccccuggagaccuguccuggaauguacccgugguuggucacauugugcaugauugcaucuguaacaugggggccuccuuccuuuccaguagccagaucugacugacagggagaggcacauaggauucuuucucguguacccaggacgccauaaguguagccaaugguaguuggucuccauagagcacccaguuccucacaugcuaccccacuuguucccugcaccgccagcccaggaugaaaaacugcccuuugguagaaaugaaugaagggccucaauccugccugauuaagauaacguucccuucucugugcuccuuucauguucuggagagcagcuggaagccaauggucacuuuccccaagucacgacagcaauaaagaagaaaaauugguaucuuuucuccacccccuucucuuaccaaucugucuuugaauuaagaaugaauuaguaauccgcauaccaaaauauaucccauuagacacuugaggaaaaaaauguuacuauuuauuuauuuugagacagggacucacucuauacuccaauccagccacaaagagagcuaucccucugccuccgcuuuauagcucugggauugcaggcgugagcaccgugucaagcuaaaaaguuaaauuuuaaaagcaguuccaucucaggcaguuggaagcaucuuuuauuucuccccuugcauaaguaaccugagaaaauggcgaagagaaugcuuacucgaccucagauuccaugaccugaacucaguggucacuuuaaggguuuccauuuuaauggaaaacccccucauugagauuuguggaggugucccugugcaggcagagaagcucuagaaagugagaggucuauucacacacuucaguucucgccacuugccuggaagggaugaauuccaaagccuguggcugaggucccaggucaagaacagcccuuagaagauggucuuuguugucuuuuuuuccccccugccuaucuacccacuccucuuacccaggcauaggagauguccauuugcaagcauauauuagcauacucuuuuggguucacgucagagcagcuucaauguggagccugcccgucguucccuuaguccuuuuaauucugucuccaauuugguaagaugaagacagugagggcaacuccucaaaauugcuagggaaggucagccacuuguggccgggucggggggggggguucacauuaccguuugucucugauuaauuuuguugcagccaaagcaaguuugguaacuaccuauauaaccucgaagucgaugggcugaacuggaugguucucacccuaagacacagaggggggaacuuccuucuguugagauuuguugaagcgucucgguggaaguaaaccugagccagaacucaagagaucuauucgugcacuccuguccauuugcccagaagggauuaauuuuaaaucucgcgguugaggucccaggucaagaacagcucacagaagauguaaccugaauucagugacuuuuuuuuucuucccaauuuagaaauuauggcaggccccugauccaguggcccgauugagaaaguaugagaugaggguuuccaucucgccuuauucagggaaggucaucugaugacaucccagggaccccaggacgacucugaugcuuauaaaacaggcccuugacguaacccuuaucaauaaaugaccauggacaccccccccaaggauggaaggugcaaucuugaccccaaucauugaccuagauccacagcagagcgagggaauccugccuccuagguuacagucccugcagggccugaggguugauuuuguuuuuaaggauucuuuuaaaguuagaauuuuuuggcccuuccuguaggccuuucucuuucuccccucuauuuuccuaaaaccucucugauuuauuuuauuuauugcuuuuucaauaucuggaguguuacaguucuucagggcucgugcugaguguacguuagguuguccauguuguguuguccguuuucagaagcuggccuuggcagacgugggcuggacaaagacucaguuccaagcuacuggauccggagucaauccuggcuuuuaauuuaauaucucccaugaccuugaauguaucauuugguauuaauuuucucaucuguuccucugggcuacuuaauaucucucaccuuucucacaagcuucuugggcagcagaacuguauagugcucuagaugaaucugcacacuaggaaugcacagugagauaauugaguuauuuauguaagacaaugauucaagaaauucuucaaauagcugcacuuuucauuuccuccucuaagaacggagagacagcugaggccauuuucccuccugauuuuaaaucggaaacacauccuuccuuugagaucacauuuaccugugcaugugugugcacucaugugcacacauggaggucagggacaauuggaagucuguucucucaauccagcauguggcuccugggaaucaaacucaggcccucaggcuuaguggcaagugcccuuuaccacugagccaucuugccuguccccuagaaaauucuuaacacauauuuauuucaaaaggagaauggccuuccauacaaauguaggucucauguuccccugucucucuccuucccuccuuccuuuccucucccacccuacuuaucuccuucucccgacaugcaagagggcaggacaauaauuaguauaauacucuaugcauucaaucaggaggccaacagagaaagcuguuaggugcauuuaacagaggggccacauguguaaaagguuuaauagaccauguuaaugagaccuuaguaacgggauccaaagccagacuguggcccaaaagucacuguggcagggggaccucaggguaaaggguuuuuuuuuuuuuuuuuuuuuuuuuuuuuuuuuuuuuuuuugagacagucuuucuuuguagcucuggcuuccugaaacucacucuggagcccaggcuggccuugaaaucacagagaucugccugccucugccucugccuccugagugcugggauuaaaggcguuugccaccaccacccaguugaauauuauacuugcuuaagccacuuaguucuuuuauuuuguguuacugccugaagcagucaaggcagagacccuggcauuagcuucaaaaccuuauuuauuugccugucugucuaucuaucuuucuauuucuuuuuauuuaugccccuagcuacguguuauggaguagguaccucucucucccccucuggaaguuaaaggcgaugaagcggguggaggcgggguuuccucuuccuguuugcaugggcacggcaacaaaaccagggaacagagggugaauagcaugacuuggacuggccuuccccagaacugcaguugccuauggugguugcgguucagccccccccaguggcucccacucaccucacagagcacacaaucugacaaacccggccaaucauaaaccaaaggagagugcuugccuuguccaauguagugauugugcugcguccucuuaacucugagaagcaccccaaagacacugugccaccuccgugcuauuuauagccauuuguaccucuugccucugggaccuaaauuggaaaccuaauuuuagauccauaacagccaaaagcugauuuuuuuuuuuuuuuuuuuuuuuuuuuuugguuaagcuucugcaguagugcauaagcauccuaugagcaaguucagguuaauuuaccucacuguggauauuuaauuaugucauugagaaaacaccgauaauuaaaucauuauuucugagguuguugguccaaggacgcuuugugaagagucacaggcagaagcggggggugggggugggggggggggaagguggggggggguuggucuagugcagggcugggcuuugucuuuucaguagaggucggggccacucuggcagcccagucacccuacuuccucacucucucugggcuuugguucccaaaaauuucccagaacaaugucuguuugcccggccugcaguggaacggaggcaugaaggcuuguuccuacuucgcgugcgcguagcauucacaccucacgguucccaaggucuuugcuggguggauggccagacagaaaaagugaauucucuccugagugaagcacaauuaaaacucugacgacggcggcauuuggcuuuugaaauauguggguuccugaaaggcuccaguccacacugaaauuucuguaccugcuacauaaaugcccgggacagccuugcccaaaagguauucuuucuugacguuucucccaggaugcauuacagccuguaguagguuuucagagaaaaguccgaagaccuuaaaagccuaagacgaagugagcuccacaccagagcuggggcaaggggagagagggagagagagagagagagagagagagagagagagagagagagagagagagagagagagagagagagagagagaaauuccacguguggaucugucacacuggugaagguuuggaggggaacuugggccaagaaaugcaagcauggcuggaaacugaguccuagcucugguggacagccagagagagaagcaagcaccuucaucuuacagauguguagaagaucagaugugaagaaggucuugguacugcaaccacgaaggaaaaaaaaaaaagcuaucuugggcuuuucaagucccucaacagaaaacccaacugagagccaggcaugauagcacagccugucaucucagcuacccaagaggaugaggcaggaggauuucaaauucaagcccagccuuugaaacucagugagagaguaucucaaaagaaaaaguagaauuuuuuuuauuuuuaauuauuuauuuauuuauuuauugguaagugcugaggauguagcucagugguuggaucacuuggcuagcaugcagaaggccucgaguugggucuccaacaccacaauaaacaaagcaaaaaugaaagagaaccuuucccagccucaccauggugccuacacuucggccccacugugaguauacagucauaacaggauaguuguucuaaguggaaggcaagucugauaguaacaacuaagcauacugagacauaaacugaguuagcucucucuguggggugagcccagccagccuucagccucccuagccugucuccccauauaucauacccuugguuccccauucccccacuccuccccaaaaugaacagcccugcucacuugcugaaauugcuuauuugaucaugaccguguucccagcccgccucagccuaaucguugcuuuugacuaagcccagagccagcgcuacgcaucgugaagagccacguuuaauuucacagaugaacacauucuauucucugacugucccauuccaagccccacucugacucucucuguacagagcacugagguguaggugggggggucucucgcccauguaaugccaccccaccccaggucaccccaagcgucaagaaggcacguucgaagcucuccugcggggcagcgaaagcguggcgaguguuuuuguguugagcaugagaaaucucaaacgguccacugugacaugucccaucgucucuucaagucuacgcacauggcauggcucagugagccagcugccaucccauuuggaagcuguggccucggugcuuuuuuuuuuuuuuuuacacuaaucucaaguccccacccucaguugaaccauacugacgcuccucuacugcucuuaagaaaaucagacucaggagcguggccgaucaccucucuaccuagugagcuaccccaccugccuccucagucucauuuacaauggccucucacuuucgcuccccgccugcccccacacccacucgcuuucagcguuugcaccuuucuucucaccucuugccacagggacugugaccacgcagcacccccccccccuuggcucaccucucuucaagaagaaggaagagcaaaguguagacaauucaccccuucuuagaauugggaacaaaacaccuaugaaaggaguuacagagacaaaguuuggagcuuagaugaaaggauggaccauccagagacuccccacacagggguccaucccauaaucagccaucaaaugcagacuauugcauacgccagcaagauuuugcugaaaggacccugauauagcugucucuugugaggcuaugccagugccuggcaaauacagaaguggaugcucacagucaucuauuggauggaacacagggcccccaauggaggagcuagagaaaguacccaaggagcuaaagagaucugcaacccuauagguggaacaauaugaacuaaccaguacccccagagcucaugucucuagcugcauauguagcagaagauggccuaguuggccaucauugggaagagaggccccuuggucuugcaaacuuuauaugccccaguacaggagaaacaccagggccaagaagugggagugaguggguagaggagcacggggaggggggaggguauaggggacuuucaggauagcauuugaaauggaaaugaagucaauaccuaauaaaaauuggagaaaaaaaauaaauaaaagaagaagaaaaaaaagacuaguaaaugagagaucaaggccaggcuuccaaggcucuggcuugggcuccugaaaucuacagagagaagcaggaagcaaggugaccgggaucaugggacuucccuagauuacccagcacaucacaaaaucaaagugacgcugguagacaucaucucuuccccugaaauugcuuugugucauuggauuuacccuaccccacaacaaggguugccaguaguaguugugaaucuggccuauaugcagugagcugaugcuagacuccccuaucucuagagccucuggaaaguucggccuugguucugccuaugcagggcaaaagccagauaagugucauucugcccuccgucugccugaagacuaucuugggcccacaucacaggagauggaugaaccaaaugaauaauacagauccaauggcaguggaggagguggggguacccuuaaccuacuuuagagaacaaacucuuuuuaagggcucugcacacuaauuguaugcaaaugggugcugcuaauugcaaacacacauucaaaccuagucaaauuagaaagcuauucaucaauggucccuuuaggaccucugcuucuuucucugcaguguaaauugcuguuuuauggcaacucgcaggaacacaucaucuuucucaccccucacuuugccaucagcuuccuccagagaaguugccccgggagacucaaugaagccagagacucuguuccauucucuguugccauaaugccuagcucagcccagcggguaccacacuucaaaacaaacacuuagagagggccucccugcucuguggcuagcaucuccauaagcagggacugcaugcauggaugcaugcaugcuuucugggggagccugcuaucaucuuguuucuccacgugagccagcuagcuccuuccgucucagcucggauuucaccugcccuguccuauccagcugggcgugaucaauccaaccuccacucuucuguaaccuucuaucuguuguacuuauuugacacucuccucuuacugccuuguauaauauuuguucuuaggcauuaauucagcagucauuuuacugacuacuucugaaugugaaucccuguguaagaugcugcaggggacaaaaagauggacaacauaugguccuugcuuucauacauuauuuauccuauuaagcagcaacauaaggcaagaccaugucuuacucauuuucuagucuucuauuccuuccuuucccuacccuucuuuucccucccccuucccuucccuucccuuuccuucccuucccuucccuucccuucccuucccuucccuucccuccccuccccuccccuccccuccccuccccuccccuccccuccccuccccuccccuccccuccccuucccuucccuucccuucccuucccuuuucuuuuccuuugaaaaucccauaaaaggccugccagaguagaugggauugcucaauuuuugaaugucugcauggauggagggaugguuagaugauugaauacauggauggauaaauuggugaauggguggauaaauuguugaauggaugacugcccagaugaauugauacguggauggauagguggguaaguagaugauuaggugagugaauaugugaaaugacggauagcauaacagauggguaauuguauaguuaaauggauaguuggucagacgaguggauauauguguggauggauggaugcauggauggauggguguguggauggaugauggauggguagguggaugggugguugguggauggauggauggauggauggauggauggauaggugaauggauagguggauggauggguggauagaugguuagguggaugauggguggguggguggauggauagaugaauggauggguagguggaugaauggaugaauaguuggagauuuuaauggauggaugaucagaugaagaaauacauagauagaugaauagauuagauugauggauagugggcuaguugaauggauggguggccagauggguucaagguuugaugaguggcugccugccuggauaaaugaugcauaggaaagauaaauguugaaauuuuauauuugacuuucuacagucauauucuaacagcuugccaaaaaaugacauagucgcccaaauguccacagucccauauguccuuaggaggcaccagucaacuaccaaaccccagcaguuggaaauaggggcagacaacauacagaccugagcucacuaaauuccguuucuaaaagcaaagguacacaaugcaccgagagaaggguugugguggugccaggacacaaugcacacagagcugcauaacgucccaauaaucauuguguuuccacagucgaaaaacaacugagaauugagaggcaaagguuguauuggguuuucccgaauauaaagggagacguuacaguugugaucaaccggaggaguuugggugguucaaacugcuuguaacucuagcuccgugggaucagacauucuccuugggcuucugaagucaccugcacacaccuggcaugcacauauauuuauuuaaaaaaauuaaaucagagcaagguuauuuucuauuuuuuuuaagaguaguuguuaaguucagcguacccaaauauaacuggcuugccuucccaucuucugcucuuugaucuccugauucagaguggagccuuuguggccaccuaggccccuguaccaaugcauccugaccauccaaaaagccugcuguuuacaucuaggugauccugagugcuauguacccuaugggcaugacacacaugcaaccacaagucucuuccguguuguaugaugucaccaaucacauccuauaucgucagauaaaauaacuauucuaaaaaaaccugguucucaggcugcagacacagcuaaacaauagaacauuuaccuaguauaaacgaggcuucauuuuguuguguuuuccuaugagaaggaguuaaaucccucauguagcugaggaugauuucgaguuuccgaucuuccugccuccaccuuccaaugccuggugcauguccugcaggaguugaacucaguguucccugcuugcuaggcaagcacgcuaccagaagggccuacacccccagcucacagcuguucauuucucagcauaggcacccaaaguuccucucaaguuuuugcauuuccaaaguguuaccaccauaagaaaucgggugucugucaauuacugccucugccuuguaaggagaaaaaggugaagcagagagcgcgaaguugcucacugaguugugaugguuuagggagcuagaagaagaguccaagucuauagguucaagccacucaaaauucugggaaccgaggcaucuccuguaaacacuucgccguucuagcugacuagccuugagcuucaagccccugcacauuuggagccacagugacuuuccuuguggcuggaagggucugcgcaggcuugaggaucccagggccacaaaucuauccuccacacgauucuuuaauagacuuaccugcugguggccuuuuaugucacauguugucucuaugugguucacugugccagaagguaauaaguaccgugugcgcaugcucagagucaaacauaccccgaugguggacugugaaggaugcacgcuccaagaugcgcuauuuacgugugugugugugugugugugugugugugugugugugugugugugugugugcgugagagagagagagagagagagagagagagagagagagagagagagagaauauggagaaugggacuucccuccaagccacauaccacugucccuucggugaggaaauaguuacguggggcucauaauccgcacaacagccaggugagcugucugaggcaacuagcgccggccgggcagugucccuuugagaucacaggaugacuucauugucaugggccgcucccucgcucucuuacucucucuuuccuucucucuacuuccuuuccccaaguaugagugcaugggguucaaccaggucaacagccgguggccuugccacagcaguagagaugucaccugugugggggcagagacaccagagcaaguguuuccgugggaaccaaggucuccuuguaccccacaccucucaucuugaauucucucguggcuaaaaugcccaugauucauaacucagucacaucgcccccagcacagcccuucagauagaucccaucucuaagagcuuaagucaaggggauuuucaaaccgccacucgauuuauuuggcugaucuccucucucagaaaaagcauuuuauuuauuuuuauuuuuauuuuuaauuuuuuaaauuuggcaagugcccaugaacaaaggcacugggaggacaaccauuagaacuuguaucucggaacuucacauaaaaccagagacacugaaacuuauagaggagaaaguggggaaaagccuugaagauaugggcacaggggaaaaauuccugaacagaacagcaauggcuugugcuguaagaucgagaaucgacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagacggaguuuggagcugagaugaaaggauggaccauguagagacugccauagccagggauccaccccauaaucagcauccaaacgcugacaccauugcauacacuagcaagauuuuauugaaaggacgcagauguaccugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaaaaaaagaaaagcuuugucucaaaaaaaaaaaaaugaaaaaaaaaaaaaaaaaaaagaacuuguaucucaaaaacuucucccuacacggggcuggcaguguguuccauugcuugagaaucugcaggaaaggugguggccuuggcauggcugcuggcagugggugggugggugggcugcgggggacgugacuaauccucucucuuuuuuugguuggugcuucugcuuugcuuacugucaccucaucagcacauuccacugccagucucgguacccucuccucucgcuuucggucccccugaugccucucuacauuuuucccaggccacagaagcuauuugcaccccaagcaacacaccucgcucagcuaaccgagguugccuggcucuuagcccuccaucuucuaccauggauuauuuagcuccauuguuccuuagcuuaccucaucccucacaaggugaaagaaauuccauuuggucccuuuucagacugccggacuggcugacagaaaacacucagucccagucacuucuagagaaucugcuuccuuauugaaaugguccuuuuaaugucaucuuuaauuuaaucagauagugucaucaaaauaacauuuacuccauuacugcaaauucccugcguuauuaacuaguauaacuagaccaaaaaaaaaaaaaaaaaaaaaaaaaaagggaaaaaaaaagaugguacaaacccccauggaaauauagacuaacuguaaaaauggcuacagcucauagacauucuauauuuaauuugcagucucaaagcacucucuauggagagguuuuaugguucugaaauaauuuuaaaacacacuuuacuacaauucauagcagguaggguuccccccccccccccacucuggaagucauggcaucuuguaguucccugaguaacuggaacaguggccuguguuaaccuaguaaugcucuugucuuucauuaagcguggugguggcgguccauucccacaccaaggauuucucaguuuuccuuuggcaccuccccccaaacccaaauauaaagcucgcgaugucagcuggugucaucaggauccaguuauuuagauaaaaaauaccaacucaucaauggcccuugggaaagcuugauuagaccauuguggucaugguuaggguaggguuuacaagcuagaaagggcuauguaauuacgaagaucuccuucuggucugggguggugguggugaugguagugguaguugugguguguguuuguguguguguguuagagauaaguggguagcugggguuugcuggucacuagccuaguucuagauucagugaguccccgaugaaugaauaaggcugaaggugacagagcaggacacccaagaugacuucuacaugugcuugugagcauguacgcaggcucacaugcccguguucagucacaugcacauauaccacacccacaucacacaugugaacacacaaaaaaaucauuuuuaaaaaaaugucuugauucaaaaggaaagagugucuccaggugguggcacaagccuuuauuuccagcacuugggagggaagcagagauaggccaucucugaguucaagaacagccugcucuacagaguaaguuccaguauagccagggccacaaagagaaaccuugucucaaaaagcaaaaaacaaaacaaaaacaaacaaacaaacaaacaaaaaaccaaccaagcaaacaaaacccagcaacagcaacaacaagagaagaauguauuuguuguauucuguuuuccggguuccacgcaccacaguggaaagaacuccaaucugaguaguaggaaugguggguuuagaaccuuauggugucuauuacuucuugauuuucucaucuguggaaagagagaguuccaagauaaucaagccauuaaaaauacccaucugcccacuuuuccuugccaucaggaaagacaucuuccaaucagaaguuuuaucagaacuuggcacugacuacuucuuuguacaggaggaagguaacauagcaacagagcaucucuacugcaaggcucccaguguccucguuacugggaaaucccuguuccuguaaugauguugggcagacuuacaaaagcgaauaucgaaauaaauucauuuguuuucgcaaagcauguuuuuuagccuguugcuguacuuacgaucugguucugccaacugcuggguaaggcccuaagaagccaagguagacaagggaaggaucucggucagauggaacguagagucuacuaagguucacaaccauuugacaagaugugaauauugaagcacuucagguguuaugauagaaauugugaaagagugagccaugugugcauacacucauacauguauguauacaugcauacauacauacauauauacuuuucauccacgcacuaucuauucaucuauccaucuauuuaucuacucaucuauccauugauccaucuauucaucugucuuucaacuauccauccauccauccauccauccauccauccauccauccauccaacuguccauuuacccuuccauccaucuaucuauccaucuauccacauauccaucuaucuacuuccagcaugacagaacuaguguugauaauucucuaagugauauagaggcauauuucugggaugaagaucaaaaugcugauuaauauuugcagaguaauaccauagaugucaugaaacuaaugagacccuauaaagcaacauauaaaaaggucagauaacauggaauaaugaguccaaguggaaaaguguaagagcuaucaguaugugggugugugcugcgugguuggucagacauuauauauuuggggggguguaugugugcagguacacaugugugcacaugcaaugaaagccagaggaugaccacaggugucagucagugcaccuuauucuugaaggcagagucucuuguugaacugaaacuuacccaguuaggcuaggcuggcugcacucaaacuccagggauccucuugucucuacauccccagugcuaggauuacaagaauugaucauuaugcccagucuuuuaagaauuaauuuuugacaauaacauacaugaauauaauacauucuggucguccucguucucccaccaucucuuaugccccucccauucucaccaacccuucccaccaaguccccaaccccuuuuaugugucuuuuuguuuguugucuuuguggucugcuuguuuuaaccaguggcuccccagugggcaucgguguagagcuacucaacuuugguggcucaccaggguguugauuuuuaauguaggucacgggaauugaacuuaggagcucaagcuugcagcaugaacuugaucagcugagcuacuucccuagcccuagacugccuuaaaggcuaacaaguuaggauagagguuacaggaugagugguaagguaugaaguuugggauuauggagcaaggccucaauugacgcagugaacuucaugacacccaugucccaauguagaaaaaucucuugggcuugaguugugauaugggaccccaaacuggcuaucuuuugggucauagaucagaguuuccuuugacuucagcuaggacaaacagaaggacagggacuaucucucacaagcauuuggccuacaauuuguaugaaacuaauuucaagcuuguuguugcugaaugacuggccaucuugcccauucuuucgcuagaauagcguuguucuuaaacagcuguaauauagaaaugaaaagaggccgucacuagcuuuagguuaaggccacuggugagugcaacaacucuccaguucuuugcguuuaucaccacggaagaaauaaagccauggguuuggcagauuuggcucgauugccaucuggaucacauccagauguaccgaagaaagagaugacaguuuugcuccagagucuauggucuggaaagacagagaaugaaacagggaaguucuacaggacacaauaacuacaaaaauucccugggucaccagcuccuggguuaagugagucugagaagaaugcauuuagucuuggguccucuucuaucaggcugccucaugucuuuuauuucuucuuguuaauccaccacugucguuuauugaaccuuugccucugugguuauuguuguucuauacaagcagagcucccccgaaagcuuuauguucaaagaacuucacaaugaaugggguuugcuuugguacccaaauccucuuagcuuccuggaaacagaagaaucuauaguguauucuccggagaguaccuugggggggaagaaauuacucacuuguaauuggccgucucagaagguaaucagcuccauagaucugugcugacugaccugcagacucccgggacucagguguucccuguuaaagguacacggucccuggaaagagucucaagucacacacacuguaguaucauggagucaugcucuccuaaagcccaugugauccuucauggagggguacugaucacaggcaguagaaggcuugcauaaguuacugagaccaauggaggaaaugaccauuauaaguguucugaguuuuuaugauaguaaaauaacugaauugacaauuacauaggugaauugcugaaaagcuacucaauauagaggaaucuaucuaucuaucuauguaucuaucuauuuuaagcagcaaagaaaauccaaucacugguguugcauaaugauaauauuaaguaacuaugugauugauggaugcacagauggguggauagguugauggauauauggauagauggaaagauaugugggcagauauauguuuguacagguguauggagggauagcugugcagaugggcagauagaugauguaucgaugaacaaauggauggauggauggauggauggauggauggauauggguaugcaggugaauggauauacagauaguuguauauauuuacagccagacagaugaaugccugcuaggugcguagaugagugcauggguagguguauugaugugcagaaugaugcauggaugaguaagucaugacuggauguaugggaggugggaacauggcuacauaauuagauaaguggaugaaugaagcaguagauugacagaaaggauggauaaagaaauaaauguaugauguauuuucuuaaacgaacucuuccccaaagguccucgauccugaaacaaacaagcaacaucuuagcuuuauuagugugaauguguauacgugucauguacauguguauguaggugucugcagaagguguuggguccccuggugcuagaguugcagguaguggugagccaccugucauaggugcugggaaccaaguucuggcccuguaaagagcaccaguucucuuaacuguugugucacuccuauagcucugaucuugcagcuuuugucauacaagacauugcccaaaacauuguucuuaaaguaggcauguucuggagcgugccccgagauccguggauucagugaguauggagagaaacgaggagggguugcgguuugagcaagucccccaaguccuccuagugcaggcaaaccacagccugucaucucuacucugaccuuguggcuacagcuccuuccccugauaauguagcggaugccaucuuugaauuaccccgacuuuagguuauuuucaaacauguaccaaagcaagccagcagggauuaggacuagacccagcagcgaggucuuugucgccagaaacaauuguuacaucuaccaauaggacuuccuuccagcauguuccucauauguuuuuuuuaaucugugaaccauugauccggccaaggaugaacuuuggaaaggggaagaagaaagauuugcccucuccucugagcuaucuccuggaacagggagagagagcgccaaaccuuugauaaggauaucugucccacaggugauucucuggguggggugugcuagaguuggccucucucuacauccuuacaacgucucacgccagaggguggagauuugggaucagagagagauuuuuauucauugguuaaggaagcaaccuguuuguaaggaaaggaugagaaaacucggagaccaacaagggacaaggccaggaggcugagccaccggugucacacacucaugauuuccuuccaggccaagcuuacucucaaaagaugacagccauuucccaagaauaagauaguucgcugcucauugcauuuaaaggcuuaaauaauguauucugccagacaauucucugaaaugauuuuccaaaugaaugcaucagaaagugccuagaaagaaugccuggugcagaaagaaaaggacauucaggaacggugugaccguuggagucagaaucugcacugagaugaguuuuacccacugugagcuacucacgcgcuagaagcacagcucagcgagguguugacuugcuaauguacccauguaaauacaccccuaguucaaggccuggagcacugccagcuccccagaaagcccccucaaaucccuuucucaguggcaaugccugucaccaugaccaacuagagacuguucugacuuccaggccaucuuuuuauacucuuauucuaaagauuaggguuuuuguuuguuuguucguuugucugucugugugcaugcagugugagugcggguaccuacagaguccagaagagagugucagauccgccacaguaaccuagaguuacgguuugugguuugugucgaguugcccagcaugagugcuggaaacaaaccuuugguccuccccaagaauggcaagagcucuuaaucacugaacuccuccccagcuccuccccagcuccuccccagcuccuccccagcuccuccccagcuccuccccagcuccauagauggucaaaugcgcaccuugagugucagauaaaugggguccucuggagcaacuuauuuagucacuuacugcuuuuuuucuuuucuuuuuauugccacucuguugugggacugucccacgguauuucauccuuuauugccacauaguaugccagucucccagcagucugcuauggcgaaauaucucacuccuacacacaacuugaaagcacuaucuauuacucaugcacgcaccaccuaccaccuguaaauaaccuugcucucuaccugcaucccugcgcacucaucccuccauccacccaucaauccaccuuccuuucaaaguccauugcagagagcagucacuucacuucuaaacacucaagagggcagaucaugauugcacuauugacccagagucagauauuugcuuauggcuguuguguugggaugcgcucuuucccugaguagucgcagugauguaauguuaaaucuauuaagagccaacguuuuauugagucuggauguuguaucaaauauugcacuaaguaccaaacacaugagcaugucuugucaccguguuuuaugaugcggaagcuuaguucauaggggacuugcaucagcccugggugagggauuuuuuccaaagccagccacccucacgggauuugcccaaacuggguuucaugugaauccugcuuuccaguuucaucuuugccucuuccucauuggagccuuuagggaccucaaaauuauccaccaguaacacagagacaaccauagcaaugucuuacaaaaacaaaacaaaacaaaacaaaacaaaacaaaaccaacaacaaaaaugggcccucaagaugguucauuggcuaagauaguuugcugagcaaaccagagaacacaaguuugauuccuagguuccaagauguaaggagaaaacagacuacugaaaguuguuguuugaacacacacacacacacacacacacacacacacacacacacacacacacacacacacagaguaauaauaauuaaauaacauuuaaaucacucuugaccacugaguguauuuuaagaugccuuauaaaauaccugccuauucagauuuacagucccuugcuugccagugagagacgcucacucuguugaugucuacagaacaagccacaccgcucacuccacugcuguugaauuucuguguucucuguugaggccucaucccggucacuuugugauaugaucccagcuaaucagcucacucugaaaacagggacccuguuccucucugucuccuuggucaccgacguuauaucuggaagcuuaugggucauuuguuugauccuauuguggguacaggagcagucccuagauuuaacaguauuagauuuucccaagcagaguugucaugguucagacaaccagacgaagcaggugaugggauuuggacucagacugcuauaaaguagagcuggaggagggaggagcugugaggacagguacagaccgguuaucugcagggggaucugccugcuucaucaacucuggacggacacacugugcgauuaggcuggagaacagaacgccuuuccacuugcaaucucuuccuuuccacgagccaaaauacccagcauugucugcucaucugacauauuaaaaacccacaaagagaacauauuuuuccacguguaauaucucagaagaaucagaagaaaaaaaaaaaaaaacagaaccaguugaguuuucucaaggcacugcauuaagagacugcgggcuaagaaaagauuacagcuauacccuaaaguaaaucacucaacugaaucgaaaaaaaauuuuuuucuuaaugcacccuggaaauggcaucuaaacauacuaaauuuuacucuguagaaauuucuauuuuguuucucaccuuuacacaauuauauaguugcauuauauuauuaacaccuuaugcuuuguuuuguuuuucuuguuuauuuauuuauuuauuguguguguggggggggcauggcauguguuuuuuuuuuuuuuuuuucuugugaugucagucugaggcccuccagcuuggaagcaagucuuaucuugcuaacccuugcuuguuuuuaaggcagaguccuacucagcaauuuaaacugggcugaaacuccccauauagcccaggcuguccuccagcuaacaccagucuuccugccucagucuuccugugggcugggauugcagguaugugcuaccacaccuggcacgagguucuuuccuuucuuucucucuuucuuucuuucuuucuuucuuucuuucuuucuuucuuucuuucuuucucucucucucucucucucucucucucucucucucucucucucucucucucucucccucccuuccuuccuuccuuccuuccuuucguccuuucguccuuucguccuuucguccuuucuuucuuucuuuugugugaaggcuauucuuuauucuuuucuuuuaguuguauuacugcuauuguuuaugucuugcaguacuggauagagccggggacauuacauauuauccacgagagcucuaccacugagcuacgucucugacccauuucucuuuauucagagucuaaguauggagaucagguuggccuggaaccuugaaucauucugccucagacucugaaauagcugaggcuacggguuauaacuucaauaaccuguacuacgccuagguuuuuguuguuuguuuguuuguuuguuuuuuugggggugguggugguguugguuuguuuguuugucuuuuuuuuuuuguuuuaguuugauugauuuuuacucuguauguguaugcagcacaugcaugccugcaguucccaaagaagccagaagagggagucauauucuuuggaacuagaguuacagaugguugugagcugccguguauaugcugggaauugaaccugggcccucggaaacagcagccagugcucuuaccuccugaaccaucucuacagccuccucuaugucuagggugguuuuauuuuucucucuuaacuacuccauuuuuauugaaaauuuaacaugcuucuauuucuuuuacuaaaacaaggcuaaaaugaccaugacaaucacagacggauacauauauacuuuaauuauuuccuaagucaugucuuccaaaaaguaggaacaccagguaaaagaggauggacuuuguaaagggccuuaacuguguugcaaguuugcuuuugugaaaaaugguggucuggggccugagucggugaacugcuuacuggacuuugugaacauugaccacucugugccucgacaacuuccaagccuguuaaguagaagaaaaugaggguucccucugcuuccuggagcuguugcaaggacuggaugaauccucaggugucagaucaacacaggggccuggugugauggaggacuccauaauuagaauauuagaauguguguguguguguguguguguauguguguguguguguguguaauuaacugucauuaguaucuucaucagaagguguuugcaaugcaccagacaucccaaacaaauccaccauuacccucuuuccuuucuagaauguuccccauagugauccaccagcccucauguucaccugcaucuuccaagaggcccacuaacaccuagagguauuugguaggcaggcauuaaauccuuguccccacuucugcuccaaaugaacacauuugcagcucugagcagguaauguccauccucucccaucccccaaacccuccacccuccacaccccucccccacccccuccccaccccaccggacagacauccauccaggcuuucaaaggaagaacaaaaagccagggcuguagucacacugaaguucagacucugaggaucagguagggucagguuuccaccuaaggaagggucagucaggagcugguuuaggagaccccaaucugugagguuuguaaaagagggcaggcaggggcaggguggcaggcaugaagcugugcuguagugcccugggacauaaagcuggcuugagagaaggaaggagcuucuagaaccuucuagaaccuucucccccuagcuggcuucgauucuccgacuucauccuuuacuuagcaagcagccuaagacaugaaagacaugugugcgacuguagacccuucugcucuucugagaucucugagagcacagggugggacuuacucgucucuuuaacucuuagcccaagugcaugcauuacaggauuaauguacaggaaugaaugagugaaugaaugaaugaaugaacaaaugaauguacaucuaagugaguucuagacuagcccaacaccagaugaugcacaaaccccagacagaacccacaugcucugaguucaguccacaaagagcagauggaccuaguccuuguagcuaauacucagggagaccagguccuagaagugaccauacaacuccccagcgauugacccuagacaaguuucagucugucauaguuaacaugcauaugggcaccuucaaacugucuuaauucccuauguaaagucuaguccugaagccaagggagucuccuuuucauuaagccccguggagauucagggcaccgacagcaggcaccaccccagcugcggaugccgagggccggccgggcagagcccgccaugcuguccuuccuuucaucugcccuuuccugcucugcucauugguuuugaaaucauuaguauggugaagacgaaagccauuggagcuagcucccagauuguuucauuuuauuauguucgauuggaucagggccgagccauuugcagagugcaguauuauugccauaagaagggacuccaaauguuugucacauaaccaaucccucugugggugaaggcaguuccuuaaaauucaaaggaaagaagggaagaaaggaaugaagaccaaaagaaagaaauugagcuacuuaguccucuccccuguuuuaaguuuuuaguuaaauuuauuuauggugugugugugugugugcgugcugugugccacagcaacuauguagaaaggugagaagauaccuaagggggguugguccucuccuuccaccauggggacuccuaagaccaaggcaggcccucaggcuuggcagcaagcaucacagagccaucuuuccaacucggucuucuguacucuuagguguguagcaagaaagaacauucucagaucagauggaguccugggagcccagugaggggcucaacugugggauccaccugucuuuccucccugacguggagccuuuguuuaacaguguugcugagaaaccugguuuaucaccauuggaggggagccgggggaggcagaaauuccacagccacccugcagcauggguccuaguaguuuggguauuaguucaaacagcgaguucuagaauguuccuuagauacaucaugggccaaagucaagguuggcgccuagcucugaaggagucccauacuuuauccagaagccaaacggaugcagccacgaggaaggcugcuuagagaugaggucaggugcugugccugugagugugagcagggaagaccauccagacccgugugagcuacuuuaugaguugcuaucgucauggcaaacuaauuaacugaaaacgcuuaauagaagaaggguuucccggggucucacaguucggcugggaugcuguccuucacugcagugaaaaccggggaugagagaagcaugaggccuagggugacuuugugucacaugucccaguaagggaaggaugaaugcuggacagaagaugcugacauggguacugagugagccaagccucacccuagaguguuucugccccaguguauuagccuucccuugugaguuuggauugaaaagcugaccaagggauuuuacaggcauaucugcccaaucgcauuaaacugaacgcuaacaagacacagccagcccauuuccuccucucagaaccucgguuuuucccaucaguacaauggggacaagagcacaggaacuggggaugcuuccaaaagcugcaccauggcccugccugcuguugccagggaaccuucuccagccaccuguaagcuuaacucagaagauaacagucucuccuucccccccagccccccaccccuacccccagcagccucagagcccucuguggagaacagguugauguucuccaugucccagugagaggaagccuugggcagguggcaaagccgugucauuuccagaugaaccgcagcucuccagaggccaucagccgcugcacuagggagaggggcauccagacaaagagccaaauuuaaaugcacguaauguugccauuuguaccuuuggaugcuuaagacauccgcugcgagucucacguuauaaaugaacggagaggagagggggugcuuuuuuauuauccaggagcugcaaagugagcgccacauauuucaaggcuggaucuuaaucaggcauauuuauaucuauaauauuuuacaaauuaaaagcaacagagauaguaacaggaaggguauuaauuagcaaacugggggcggaggcaggggcggggcggggcaggcaagagaacuuggaucucaaugagagccagucugcucaacagccaaguaaaaugcuuacugcagucgccggguguccacgugguucgucuaaauuaaacagcacgcguccuaaagcgcaagcgcgcugccucgagucccaccaccacgugcuuccguuuuuagcgacagaaucugauauguucuuucccuagcagcucagcucuccucccugccagcaggucaccaguaucucucacuucuucauuuccuauuuccuuccaguucauuaugcccugcgauucuggggaaacauggagggaaaaauaaaugguucuuuaguuuaauuaauggugaacaucucaaacaggcccauuuaauaaaucuguucucuggacuuaacaagucucuuugccuucaagggccucgugucauuuuauucgccaaggagagcccuccaccccauccugcccugccccugccgcaauggcugaauaauugacaaaaaccgcagguaaggauagagccccauaauugauucguaagaucccuuccucuaaacccacugaagaguuaauuauuauuuuuuuccugcaguugggacucagcuguuauuucuacugggauuaaacagcugccagcauuguuaauggcaugggauucacgcauuaaaaucauucugcucccuucccuggaaagugggguggcagacaucuccgccacagccuucucccccccaacccccaaugaaggaguugaaagucuuaggaaagauaacagcccuuauuauaaaaccacagaccagagcuccuguugaugggaucccauaaugaguaauuaagcugccgugcaaaaagucugacugucacgguggcauuuggugccggcuuucccugggggaagcagcuggguagaccaggaagucgauaaaaggaaggggggauaaaagaagcaacaacagaauuccuuuagaaguagccugacuuuugaaggaaaacaaaaacaaacaaacaaacaaacagagccaggaaauaauaaacacagucaaaggaacucuaaaaugucuuugcaguggcugccauuuucuucaaacaacggcaacaguauauugauggaugggaaacuaagaagcauuuucucgcucuuccacucucccccucgcuuuucucaccuccagucuucccaucaccugucuucccaucuccccucucaucuucacuauuuuuuuuuuuuuuuuuuuuuuuuuuuugguuuuucgagacaggauagcccuggcuguucuggaauucacucuguagaccaggcuggucucgaacucagaaaucugccugccucugccucccaagugcuggaauuaaaggcguacaccaccacggcauuugucuucauucuuucucagucucucuccccuuucugugacagaauccauccucuaggcuguccuugaacucccaauguaucuaucuccaccucaugaaggcugggcuuacaggaaugagcaacgucaggacuuuguacuauacacaguggucacucugccaacugagcgaagucucugguccuuugugucccuucccuuccccuccuauuccuccucauccucgccucucuuucucuucccucuuccucuuccuaacccucuacucucacacccucuuucuucccccucccuucaucccucuccucuuuuuuucccucugagcuuucuuucuuuuccccuggucuaagccuccugaguuauaugcuggccugcuuagauuucuuguucuuuuccuugccugccuugugucuaucuguuugcucuccagaguccucucuuggcaaccgaaguuucaagaugaaagggcaaagggggagcauuucugggugucuugaaggacacaaguuccuguacagauacggggucagaggguugggcuucugagcugagaguccccccuucccucaucaacagaacuggaacaauuucuaucuccagccgggaaaaauugcauguagcuuugucuuuauuuccuccgacuucuuuaucucaguccgcacgaccaauccugggacuauuucaagggacauugccaggcuuucuuuccuuuggcaagacagagccugugucaccuuuaggucggauucuaagccuuuuacauucugucccucgcugagaaaauauaaaguuaccuccucauccauugucuggauaaacacaguaaauaacguacacggugccacacaucuccagugccacuaaagaugaggcagagacaggagaaaugcuguggguucgaggucugucugagcuaccuaguaaaugccagaccaacuagggcuauaaagcaggacuuugacucaaacaaaacaaaacaaaacaaaacccaaaagcaaccaaaaaaaaaaccccaaaaccccagaaaacaaagacaaaaagcaagggagagaugcacuauguucucacaaagcaacugaguccagggaagcccaaucucguuaauacuuuauaaaggaaaggaaggaaaaggcaguucuuugggguuuauguugaagaagcaguguuuuagaugauguuguagcagggcacacugcagauaaaugaaccaucuuccagauaauaaccuaggagggcuccgcgugucacacaucacaccaauaaacaucuuacuuaauugaacagcaagcguuugucucucuuccauuucucacagacacuggcuucugcagagucuuaggagaggccaggguuccucggaagcuggcuccacuaggagguguagccuccuuuuccaaagcuagauugagguugauguagggaccccauaguggguauaaaaucaucagccgagauaaccagcccuucucuaugcguguauaaauaaaggugugauuuguuaacaggagauuguuaacagcguuuccuuugguuuuuauuuagagcaaacuugaaauauugccggggcuuagggucucugguaagacgacagugguccaggccaaggagaagggcacaguguucuguggguccauaauacauugugcagcuagcacacggucagaccccaaagaauagagucauuuguucacacuucucgaagcccaguguugguaguucuacauguggauggccuagcccagacaagggcauugucagcaggcagcauggagccaacugagcuuguaagcaagagugccaggcuucuaccauagagcuaucuggcagucagggguuggggggagaauagccaagacucaugguccuucaagcccagaaggacccuuagucuaagggcauaaucuucccuucuaucuuugccagcugccauaugucuccccgugcucugacccucugcccgaguaccccaaccccauccccaaugacugguacccuccugcccauuaucccacagugcuugaaaauuuugugaagccucuuugugaagaugccccaacaucccccuggugcauuuggcuagugccccuccucugguccuggaacacugaaaacucuuuaugcuucuaccuguguggacuucaacauucucuucauuauucacccuugcaagccccacagaauucuuggcauaguguagacacucagauguuauuucucaggugagggaacagacccaugagcaaacaacugaacggaugagcgagcaugggcuuuuguccuugcaagacuccgcgcgcccuuucaucucagcagcaucugugaaacacaccuaccucuuucugaucuucauucucaagcaguuuugaaaugagaaccaaagcggcaacguuuugcucuugguaccccaggaccucacccacucccgacacucggggccugugugguaaggaucucagauccggaguguguguggcuugugugggggucugugacuaagggagccacccggcauacgguggugaaacccgaaaggacgacuugagcaaguaauuucugaagaaacccagcaggcagggcaggagaggcacgauguggaacaggaaguugcaacuuggccauuuguagcuccaucugggucuccuuuauggaaccucagccuggaagaagccuggcugcucauuucuaagcuuuaacaucuguacuggagaagagaagaugaguuucuggauuaaugucauaccaaaaccaaauaauaauaauaauaacaauaacaacaaacaacaaaacaauaauaaugaacagguaacauuuggucuugccuacauuagaucucucuauuagaaauucuauuuaaaauguuuguuugguuuuuuuuuuucccuccucuugggaccagucuuguuggguccccuccaugcuugguuccaguggaacuaaagggcagcaagcuggcugagccaucuaagauguacggucaccuccaccccugccuaggaccucuguacaaccaacaccuaagcgcuuggcugacagcugccguccuuuucuguuugccuuauugcuuugcgucuagcaugucagcucacuagagaaaugucaucugacuagggacagucaagagucaccuaagucucaagucaacaaggccacuauccgugcugcuucuccaugcggcucugggaagcugaucugucuacuuuggucccuaaaguguugacucuguucccuuugugucuaguauuuguuugaacacgccgcuuccaacuauauguguguguguguguguaagaacuagagaucugggggaaauggcagcagggguguguguggcguguguuugucgggagugaggggaugguacuuguccggaaggcucagaaaucucugugaccucccuuggagaaggagacuuccuugcagugucucccgaagaccccagguuccaacagaagacauugauucgccugguuaguuaugaccucagaacuucuuguggcucccuucuuucugauccagcucccaagcaaagccaaaggcagaacgaaugugggcagagacuggcuuaaggaagccuggcccuugcucugguccuccagauugcucucacuaaagccuugcuguguuccuuucuuagagaagcuuucagcccucuucuuauaggacacugugaaaaguaggcacagauccucucuaagcaugggggagacucuuugcauuuaaaaaacaaaaacaaacaaacaaacaaaaaucccaaaagaauucaugucauuguggaguauucauaaaacaaaagagagaacagauagacgugaaacaaacuauucacauucccagccacacccucugugcgucguucauuugucuauuuacuuccagucuuuuguuuucccgaccuauuaguugggcauugauuugcuucuaagcaaaaacugccauuacuagcauaccaucaucagugacaagagaaggacauauaucuguucagggcagguggcugggaccuucucuucucaguugcuuggacucugagaccauauauuagacaaggguuucuacucugccaccuuguuuuuguacaggacuguguuagggacagggcagagaaguccuuuucuccugaaauaguugaaguugacugaaguuccugugguguuuguagacagaaucuuucuagccugcagggagaaacugauagggccuucucgacaaaacccccuccaaaggcauuggacaaaacccuucucuaagagugcaugcaaacacguuucaaaggcauuggacaguaucccuaagacugcaugcccucacaccugaaacagcagauacccaagaacaaacagggauuccugguggccgaggauucucuuucuuaucuugggaaguugcacuaaguguuccaacuggaauauagaauugcaucuguaucccaacacaguugguaacugcaggagguacuguggggugauucagcucauggccaccuuauucccugauauucauccuaagucuacacaggaccacgggaucccuuguacugacaagccuccaguuugaaaacuuuacugcgugcuaggucauauuagcucuacguuagauggaaagacggaggccaccugccacaugugauucaucuccaccacagcuguuaguccuuuauuccugguaaacucuuccucuaccgaguuuuauucccaacaaugcuccuggaaugguuucaguucucuuggcucuaagaagguuuguaaaaauaccacuuaccuagacaaaccucaguuuucacaacaaauugugcugcaugacugucuggcuaucuaaccacaauuacaauaccuguacuuuauuuagucauuacaauguacuuaaaaaaguaagaaggaaaacagcuuuuucuaucucagccuccuguuggugacacggaugacauagucaggugucccacuguaggaaccacaguuagcauuucauaccaggaccaaaaucuugacccccaaaaagaggcuagaucuacauauuuucaucuuucaaaagaugaaauggguagacuugguuuaaguuuuaaaauugcagcuguuugaagaggaauuuucgcagaguucacuuuccccgcuugaaacagaggagcagauucgggacagucuugaaaucccccuagagucuguaagagauuguacaauccuuuaacucucuacgacuggccccagugaacaauaugcaagggccaccccauauccagauguugcauuuccuucaggauaauacagcagacuccuauaaggccccgggacugguccugcauuuugcauuuuguguguacagaucugugcuaagcaguucuuugugacgggacuaauuuuuaguguuagaccauagucuuuucuaggccuuggaacccuuauugaaccucuucccgugucuugguaucgagacauccucacugugaggucucugcacuauagaacuuugcugacagccgacguauaugcgggucguuguggcagccugguugugucagugaccuucacguggcuucuuucuuaucucuaaacucucuuauuaggauguguccgugcuugcgacugcccguguccaccauccuaggaucuccacguggacauuaaaaaaugcaaagggaaaauaagaugcuaacagaggucuugagaagacagucaaggaaccagggacaaagcaagcugcuggccacgcagcaucugccaugguccagaugauuucuacaugucaaucuguaacaccauccuuuucauauauaagaauuggcuccuaccuuacugggguugggggucggucuuuuuuuuuuuuuuuuuuuuuagggaaaacaugaaggugggcugaccucaaaguccuuuuucuauccucucauccaggcaccauccaaaggaaaagaaaaaaaauccuuuaaaccuucuggggauuuggguacuauaggguuuguucugcuagggggacuguccccccaaaguguuaccaaggacaaagggcaaggaugaccauuucuuuauuuaagccgaaagauuacaguuauaaaaaacaacauuucaucuuuaugccacauacugaaauucuucuccuuugaaaucucuugggccaggucaacacaguucaaauuacucccagcaacaaagacuucauggugcaugcagagcugagaguucuacaucuucauccaaaggcuguuaguggaagauugacuuccaggcaacuggggugagagucuuaagcucacacccagugacacaccuacuccaaccaggucacaccuauuccaacaaggccacaccuccaaauggugccacucccuuguccaagaauauacaaaccaucacauuccacuccuuggcccucauagacuuguucaaaaacaugagucuaugcuaccgaaagaaaggguggacuguaagagccacgugacagaaggacuggugugaaaugcugccuuuggagcauagccuggcugugguacucaggaacuccaaagcacgugugguuaccugcacaggaucaagccacaaagaucaguugagauuucaacgggcaauucgacucaggagauugggaugagaaggcucagacacacaaaaggaguagacggauagguugggacgccuuaauauucuauauauuaauaguguguguugccagggacauagacgcaugagaugacuccauccuuaauaaccuugagcuacuaaugucuaacaggccaccuagcaaaaggccaucucggguccccguguuuuguuugacugccagggucuguuucaacagcucuuagcgaggcugccgggcuugcaucaggguuaaagcauucucagaaagauuuggaccauguaaaucacgcucgggauggucugaacuccgggggauuugaauuucuucuccuucauugcucaaggaaggggagaaagaaagaaagacagcaaaaaaaagcacacccaaacuugugcauugaaugagaaauaggauguauuugcauucccuuccgaguguguuugcaaaauacagacaggcaaguuugaaucacccugacuuugaaagcgugauuuugagcaauuaucuggggggaagaaaacaccuccuucucacuaaauaggucugucaagaagagucauauaauacagcccaccagcgcccaauaacacaugugcacugguaagccggccucagccaauuaaguggcaaaaugucggcuugcaucccagccccuccucguccacagacagauuuguguaaguucauuuucauagcggcguguauguauccuuagacuuuaacugacagauucccacagcgaggagagcagggaguucucaauuacaugguuagcuaggcacuguggauguaugcuccacggcuucuagacagaagcaaggcaaagagggaggcaaggacuaacaucucuggugcagcaagacuguuaauauuuuagaccaagcuauucagcuaugucuguuuauuuagucacaggagcaagugcuuuugaauuccaaacccuaaagaaguuugcauuuguaaguaguggcuuacagaauagucucuucugauauauauuguagccaucaaaugaauacugucuccugagccucucuuucuccuuccuguguuggcuaaauuaguuuaaucagauuuuuaguccucuguggcugauauugugaacacugcccaaacuaauaaaauuagcccgagaagauuacguguaagaccguucguaauuggagaacaguaauugggacugugggcuuucuuuuggaggcagcaugagguauucuuuuguuuugcccugugaaauauuuguugugagcgucuuuugccggcaugugauguugaugcagacuuaccuucccuugugauggguugacacagaaccuuucccuucucuuccucuucccucuccuccugccccgcuccuccuccucuuucuuguuuucagaugggguugggguuucaucucuucgagguugaccccgcacucaccguucuccagccccagccuuucuuaguucugggauuggagggauaucgccguuccuggaucacacgcauaagagaccccgucugcugaccuuucguuuuugaguccacuguggucccaugaccaccucccccccccccccauccacacuugcccacuguauggcauggacuucaccagcauuuaaaagucucucugucuaucacaucagcucacaccagguacccucuauaccgggaaucugugaccaucgagaaagguaaagcuccagguagcuaauaugggcccaguuuuauuacgucaccuccguugcaauuacucgacauugcucucguaacacagaggcugcuacagacgguaugccaaugaacagaugugcuguguauugaugaacuuuacagaaacagacagcagacugaggacuccaggaauuauuuguuagcaucugccccgugugguaaucccaggcagagaaucagagugacauugccuauuuccacucaggcaagucagugucucucucucucccggugcuggcccgucuugucguuuuguuuugagacaagacuguuuagcuuugguuggccuggaccucucaaggcacaccaggacauccuucgguuuggguugaucuuccugucauuugcccuaugaucccuggggaacacagguacacagguacacaauuaucuaucuuauuucuacugcuuuacuuaacaccacggaagccccccucccuccccgcccccaagggugccuugaaacaaagaugauaugcagauucuucgucucucuuucaucucauccuccguccacucggaaguggucagauguugccagauuagcuucagugauuucugcagucaugucugaggaucagccccugguaucuggaguugggaguggacucggugaaugacuagaaaggagaaagauaaggaaaaggggccacaggggaagaggacggcuucuuuuaccuuuuacucuuggcccauuaggguuccaauacugaaauuuguuuggcaugguaagaugacacuggcugacauuugagugaacacaagcaaccccagcuaagguucaggggucacugagucucugcccucccgccccacuccaucccuaugucucaggagccaugcccugggguccagguuuuagacuuugugaccguuuuuuugggcagcaacuuuagucgcagccgaggcugccugacaucugcaugagauucccucccaggacucgauucugaagagaucuccauuuccucaaggguuuuaugggcacaaaugcaaacacucuguucugucacucugucacaacccauuaugucaggagagaggaagcaguugagccuguaagucugugucacaggcacacagggcaccuuguagcauugucucagaugcggcuugucaacaaccacagagcuaaucgccaugucaggggcuccugagccacuaaucacuugacaucagggcggauccaggucuccccccaucaggaggagagugaaaucagaagaggagggucugauuucucaggacccuccuccccucagagugcugaccacucuccccagcuggaaugcagaaguuacggcccaugccaguguuccaacugacugcuuccuccuguucaaucagccaggaucucuuagaggagacaaagaccuugacugaagcaggaaugugauguugugucaaggggucauggcucagagcccacaaugcaucaagcugaccuccaauucuccuugcugaguggauuugcaagacaucccagggucacaagggaucugugaugcaggcuuguucuacaucgccugggaacauggggcggggguggggggaaugucaagaucaucuaggaaccacucagggacaggagcacuaccucccuccuccaccuggcucugucagcauuucccuacgagagaugagucaaauguugauauuuuuacacaugcgagacgccggcaguuuucaacccgagaugaaugagaaacuuacugaaacuaguucaucauucuuacaagaagccacagguggaggggcuuggaggccuguuguuuugaaaguuaccuggaggaccccuaccugacuucccggccuagagagacauaucucugauauauugucuaugcaccacaagaacaauuaguucuugacaucggcugguugcucuuuucaaauucggggcgauugauucccuaaauacguuggggcucugcuuacuuuaccaugggggguguucuugcuaugguuuuguggaagugacacccagguagggauaauaagaaguaaaaugucacauacaccagaaacuugucauuguggagugccacagccacccaacaucagucagccaucaagcgcucacucaccuuccuuuucaggcaugguugugauuccagucacuaauauaguuggggugcaugcugaaguuacaaacugucccuuucugucauuacaagaaaauuuaaaguacuaauucuaucaugugugcuuacguguucccgugugggugggugcacguagauaaacauguaugcucaugaagguuggaggucaguguugggugccuuccucgguagcuuuucacccuaccucuugagaccgagguucgcagaaucuggugcuaggccagugacuuagcaagccccgucuccugucucuaccuuccagccccgauggcauguguggucauaccuaguuucuugacaucgguuacaaagccacguuccccccagaacccuuggaaaaaucugggcucaguggcaggcagccauaagcccagugcugcugcucaggcagagacaggggcagagguauccccugggcucacuaggcagccagccuacccgaucagugagcuucagguucagugagagacuuaggcucacaaacuauuuuggaaauuaguugaggaagacacccaggaucuaacacacacacacacacacacacacacacacacacacacacacacacgcacacacacacauucauagcacauaccuuuuaaagcaaagucgugguuuuccaguaugguuacucugaaaccuuugcugcuugcuugguccucuuucucaagcaaaucuugaaagggaugagauaaaugggcuauaaagaucaagggugccucacuuuuuacauccuuuuuuuuuuuuuaacugaaaguuuagacuguccuauuaaacauggggccuggggacaacuggggaaagacuucuucaaggacuuugcauugucccucauguuucacgauuuuauuuuauuuucuucuuuucuuuaucuuuuuugcuucuuuugaugcugaguaagucugugcaggaccgaauuuguaguaucagaggcaaaggaaagaggauugauucauuaugugugagugagaggcugugcgccgcuggcccaggcucugcugggaccauccagcucuuuacaauuguacuuucccaaaguuuccagcuggauuuucccguguuuaggcagggagugcagcaccgguagggucugaggcuuggagaaaggugacucugggcccaggagcuacauccugccuucccucauuccccucugugguagauccagcaggccagagaccuguacuuggggauuugaggacacuuuaggaaugaagaggaugcuuaugagggucaaguuagggucuagagaaaccauaagagaaagugaauuuuccaggagagcgucacuggccugagccugagcaugaaguaucugugucugggucuauaggagguugagggcuucuagccagagaaggccaccaaggggcuguaacuuuugguugagggguucaguucaccccccccuugauuccaggaggaauagcaacacucacuacaacccuguccauguuguucccauuggucagcuuucugaaggcauaaaaagcaggguacccaagaguaaaggguaaaugguuagggagauguuagacuguagcauagggauuggguuagucuguuagacuguuagcauagggauugguggucugugaccuccccgucauccccucagcuccaccuagauacccaucacagaaacagagugcagauacagaggugucaauuuaacauggucuccaagggaucaggccaagcagcgcaccuguuucuuaccagcuguggcaaaaggauuuucauuuugcaucagaaacaagccccuaggacucccugguguuaagaagacuugaaucuucacagaaagauagaaauaggagguaaucgcagggaguuccgugcugucaguccccacccaaccgguagaacuagcaaugaucucuagagaacccaaguuagcagaguuaucaguacgcuugagcuuccguugauacaggauggacccucccuccaugguuacucgcagaagucuuacagaguugaggucuggacauuuaucugggaaaugguagaaaccaaucaggaaguuguccagaagggaguauaagucagcagguuugcagagagucagaccaagugccuccauccuccugucucuucuucccaugaaaccucacugcacuuugguucucagccaugggucucguggcaccccuccaugugccucuggccgacccgguucugggcacacagucaagguuuagcuucgguggauuuccagaauccugagacacuaaagggccacagcuguguuauugcagacucgguggguugcauuuuaucagcgcaaagcuugcacaucacacugacaacagcucuuuguuaauaccggggagcccccauaagcccccgggggaauucugucaccacccaaguugaaagacaguuuagugagugggccagaacggugcagaaugaaauaaaaggagaacauacaaagaagaaagagagaagggguaggggagagagagagagaaagagagagagaugccgagggaagagaaaggaaagaagcgagagaggggcgggggagagaaaaagaaggaucacaccaccaggacugcuacacugucccgaugcaccucugcccaagucuuucugagucuuucucuccauccucacuuggcaucuaccuauuaacaaacaagaaagcagguggugagcagaaugccagugguuuucccuuaagagaagggaggugucacucuggguaaaaggaauaaaaucuccagagggcgcuugucccuagaccggaaccgugagggaaggccaccuuauuuacaucuugguuauuucaucagauuuacauggugacuuugaaaaugggggaggggaggcuggagaaaaccgaagcauggcagccucuccaugucggcugaggccauggugauggcugaagucaaagucaaagagaaagaagaauccuagccguggucuaacaacgucuuggguugcuuucccauccucccauccucgauacaaggcacugguuauggaugaucgggucuggaucaaagcgaggguccuacccuguucuuccagaucucagagccucggcucccuucucuguaaaauguaagcuguguguauguguguggggguggggggguggggggggcaacaucccugaucggugauaagaaagcccagcaagauggagagcuugggccuccaaagggcuggacacauggccuuauccauaguucguaugugugugugugugugugugugugguuguaugugugugcaaguguauguguguguaugugcauguguuguaugugugguuuuguguguguguguguguuugaguguaguaaaacccaucccuuaucucacuguaguggcacaauaccugacgaaagcagcuuacgggagggacagucucuuuuguuucacagguuagggguacaguccaugaaagaugaggaagccacaguggcagaaacagucagaaaacagagugaccaaggcugguucuuagcuggcuuucuccuuuuaguucugagcaaggacucccagucuguggaaugaugcuacccacugcuucuaggugauucuagaccuagguugauaauauuaacaucauacuuaccuuaaaagguuuucucucccugcugguuucccggagccuuccucuugaaugcaggcaugccgaaauguuuuagacauggaagauucugcaguaaaaaggaccauguuuccuugagaccuuccccaugagcaaagacuguguggaugcuggccuugaacuuggcaggugcugguacucuuguagcucccucguucuuugugcaguguucuuugaggugacagcagcccacuacggccccccaugguuuucaguuucagggugcaucuugcuggcaccuuuaucaccucccugcuguuccauuucccuacuucucaaaagaccuccucccuaaaaaugaagggugaucucccuccuccuccuccccauaagcuagugcucaguaggggcugacuccauaguguacccuugugcuggccgcuauuugccuuuaugaggcuugcuauucugcuauuccugaugcugcuaggaguucugauuccuagcccaugaaccuuugaccaaagauuuuccucuaucugggagggcgaugcucuggaaccuuaagccaucuggaagaccaucagaugaaggguguaggaagcaagaggugcacaaguagguggcucgagcagagggacugacccuaaugauuuauggaacauaagggguacacggagggauggagagagagagagagagagagagagagagagagagagagagagaauaaacuccaugcucucuggcuucacuacagcucccuggauuuaaacugaaggacugcugggaguuuucugcuguuuucuguacaguucaccagucaaagcaucagagucuuaaacacauagaacccagcacacuugcaccuccauccuugcaucccuguccacccacacucacggccuaaugcaauguacagcugggaccugcaugaugcacgcgagaguguguguguguguguguguguguguguguguguguagggggaguuagaacagguuuggcucuggugagcucaucugugugugugucucuguaugugugugucugucugacugucuguauuguaagaauguguguguauguguccucugucagaggaaagauauaauuaccacuugcuuccccaccccucccauccuucuguccuaaucccuagauggaaaguugguccaagguagccugaaagcuaaacugaggguuggcucagcagaaagauggccucauaaacacuagcaggaaggugguaagauggaacagccugccagggcccucgcucccugagggaagugucugccgcacccuucuagagcuacagaaauagcccagggcauggcuggaugcuacauuggcuuucucccuaaaccuuguaaguaggcaaucaggguuuaacgacccacacauuuccaauuuuuuaguuuaaaaaaauauaugcauauaauuuuuacuucauuuagaggcucaucuucaaaaaaauaaaaaauaaaauaaaaacgacgucaugacucccccucuccuucacguuccgaugaggaaaaccagacuauuuaugcugcguuuuaggcuuuuuuuuuucauauauaauuuuucauauaaaugcacauuuuacccuucuuucggggcggaaauuuaacuuuuguggaaaugugauguguguuuaaauuaccaauuucauaggcaauaugucugauaauugcguagagauaccgaguuaacuuguagcaaugaguuuacgugacaaagggacaucaguuuguuugcaguaagcagaggauaagggagcggaaacuuuacuauuuggggaggcgugggguuggggagggggaggagcagguuggggaagggaggccaugaaauugcuuuuuuauaauuaaaaagggaaucucggauguuuuauaucuugaauauuuacaauaaaaccuuuaagagcuugucaagaggguaaugugucauuaacuggggacucugccgcaccucuccucucggacaugacagugccguuaggauaagagaagaguaauuauaguucggccaugcugccaggugugauaaaugacuaaucagcaggcgggaaccgcgguucucaaaggaggacuauuacaguguuaucagcugcaggccuggguguacgggccuucgaacagggauggggacaggaccuugcuuccugcucgccuuggcacugggcuccugagcgagccccaugccuggagcgcgccccgugccucuuaguuuugucaccaguggcuuuguguggcugccaccaguggggaaagcaacacacaggggcuccagcaaucugccuccuguuaauauuuauauaacacguucgccagcguggugcaaggcggcuuugcccaggguggggauggcuuugacggcgaaagaaccugugagcagccugaagaccauugugggcccagcuggccucuugugcuccucucauggcugagggacacagacauuacugcaguugccuuugguucuucucacgugggggacaaggaagcguuguucccugagcagacuggcagcuaggcccuggccccgggaacauagggacgacauuaugguaguccuucuagacacuugcccuaaaauucuuugacucugcucaaaacagagccccacucuggauuugauuuauuugcuuauugugaucaggaaauauuuccuaacaacguagaguaaaacaggggagggcgccucugcaucuuuucagacaaacugugcuacaccaaucuggucgcacaagucccuugauuuuccccucccagugagcugaaugguggcccuggaguggcaaccccauucaaaaagaacuguuuggaaauacacaccaggaaacaggcaaacgaauaaagggagguccaaggaaggggugcauauaguguguguguguguguguguguguguguguguguguguguguuugagauaaaacagcacuuuugauucaaagguuauuuuuuuaaggcuuacauuuuuaucaguugacauauuuuaacagggagcccugacugaagucacaaaaauuacgacucccagcaccuagcuacuuaucugacaaacgcaaagccaguucucuugcucgcaucaccgagaucagauuucagaagggggaagaagaagaaaaaaaaagaaugcagagugccuugcuacauugugugcagauaaccuugcaggcaggaacucccaaaccagaauagaaccuucccugaaauaaugggccgggaagcccaaucacgucacacugucauaggcaguggggguggguggggguggggugggggccggaaucaaaagggggagaaacucauuucaucucaguuaauggcagggagacgcaggcagagaaggacuuucacuggugcgacaaagacugggguuuucuucgcggucaugcaacauuugcgcuuauacuggggcuccuuucagaagccgaaaagccauuauuauaauguggaaaagauggaaagaaauccucccuuuuggacacuggaagggcagaugaggcgcagagccgcuuuucuucuccucggcccccucuccuuuuccucucuacaaaauccgcacagaaagguuccuguccuccccacccccccauaacgggcgaaggaugccaagaguaacugugcccuuagauaaacugugugucuuggcugcacaccuccuuucaugacuuagcuggcugggaaguagcacaaacgccuucugaccccagauccaugucucuagcauuguuuccgaauagcagguucuaacgcaggugcacagccaaugcuugcucuaaggguuuagcugggaagauggaagucccugcugugucuacccagaugccugccugucaccuacugccugugguagaugugugaggaugcuuucuagugggcagcgcacaaacugggaagaggaaaagaaagauuuucuuucuuucuuuuuuuuuuuuuuuuuuugguuuuucgagacaggguuucucuguauagcccuggcuguccuggaacucacucuguagaccaggcuggccucgaacucagaaauccgccugccucugccucccgagugcugggauuaaaggcgugcgccaccacgcccggcaagaaagauuuucaauuuguauuugcucucucucucucugauaaagaaugcugugcuguuuaguaaaaacugaguucuuuugaaaaggcuagagcugagccuugggacuugguagcuaaaagugugcuuccgugaccuaaugccaagaaaagaaggugcaggggagaaaggaggaaagaaagggagaagaggaaaugagagaagggaagaugcccccaaagacuggcuuguccucacagggcugacaggaacagugagauggcauacccagccagccuuugauucucaggccugguuaagugugaagaacaccgaugacauucuagucuucaauaaaucacuauaaaaauguuuauggacccugcaauuuacugucuuuuaaaugcaaauugaaaggggggcaaccacugcaaguguaaagaagacccacccgugguggccucugaaggaauuagaaaauaacagccgucaauuuucguagaugguaugaccucaagugggaccauuucaaaacgauuuucacaucugugugugugugugugugugugugugugugugugugugugugugcgcucgugacagcucugguaauuuauuaacgauauuucugugacuggaagggagauggagaccagaguggaguuaaaccuuggcuggaaaaggggugguauuuuucacuucuccggaggaaggaggugacucaaaagccagaucucgaaaguuauuuuggcaaaaugcaaaucuuucuauggaagucagcucagacauaguuuuugcuuccccccgucccuccuuuaagccgagaugcauguuccuugcauagaacucucuauuuagaaauauggaagacaaagucaccuugaaaauagcagcacugagccagguuccuuugcagcugugugcucugagagagguggauuuuacuuuguggauguuguuucuaacugugucauaaagaagcggggcauaaaccaucaacuauggggcacaguucuguccccacccagguucaccuaguuuggcucaaauuuuuccuuacacuugaccccaaugucacuaugugcaaaaacgguuugaaugaguugcaaugggcagguguaucagugaaguguuuagccuggagccagaccugugggcaagcagccugagagucucugguucuucucucaaugcacuuuuacagggccagggacaguaugagauggugacccucaaaugcauggggacaucuugggaaacaaacaggguacagugaaagaaagacccacagcccacggaaacgggcgacucugccguucuuccaacaacugccucccccucuacuucccaccugccucugauggaaaacaccccaagucgguaccauuuauagaaccguggcuugcaaacuauuuccccaucccacaacacaugugccauaaacgcugcugagccgcauccucauuugcuguuggagagagagagagagagagagagagagagagagagagagagagagcacauuuugcuuguuuucaaacacaagcuccucucugcaccuuggagggugaagccaagaucuguucucccuggcagccccucgcugaaaugugcgucgcuggcaagcccugccugcugauagugccgucagagcaggcugucagauuccgaagcaugccaccaucugcuuuaacaaucuaaugcucuuccauguagacauauguucaaguggcuugcgagcgugccgcaaggggcucccacuaucagggaggaggcagaggaggcgguggagggggaggauaccucugcagcaggccgcugaaaccaacugaaauaaaauuuuaaaugauucuaaagaaaauguuccuaggaagaacuuccacagauaaaauaaucucuuagaaacccacuccaggaucagcaacaugacuacguaccugcuauguguauguagauaaucagagagaucuacagaaccggauuuuuuuauccucuuccuggugacagccuacagauuuuuuuuuuuuuuuuaaaucaguaucuccauugagccuucugggcccagcuacccugagauuucaacucuacauuuuaauuuucauuuuaucuauguugaugcuggggaugaaguaaguccaagaucuggugcaugguaggcaaguccgcccccaacaugcacgcccccauagucuuugaaauguuucacuuuauuuauuuauuuauuuuguccuuccuaacuuuagccuaaagaauugugucuguauacaguggugcuuauuaauaaacacacguuguuaaucacuccaagaagccaagugugugcuggcuguguauuugucucaucgccuuuucuucguccccuuagaagaugaugaugcucaggcagacuugagggagggcagcaacuauaaaagucucaguauguguaauagguaugauauugauaacaacaacaacaacagcaacaauaauaauaccuccaccuagaauuuuggcaagaauuagcugacucagaugaauguggccaucacaguccucagaagaaggaauaaguaaaucagcuguuauuugcagccaacccaaaaaaacgggcuggggaccggaauagauuuucuaugcaaauuucacccuuccuuccugggaaugucugaauguuucacaagcugauguggagccuccaaaauucuugaagaaaaauugcacaacaggaauaaaaugguuuuuuuuuuucuuccuccgcuuguaccccuaaacaugcuuacccucuuugguccugugggcuagccucugcguccuccuuuagacucggcgacuucagugaaacuaucuuuuuuuuuuuuuuuuugcuguuguuguggugguggugguuuguuugaauguuuaguuuuucaccuuucuguccuggggcccaaagcggagcauggugucuacacagcuggugcuguacguguuugcagaagggacuuuggacucuuaagaguuuuaaggacuucuccauuuaggaauucagacagacagacaagaggaaugcuuaaacauaucaguacucauucuggguucacagcuggguucucccaccuaauauuagacagguucauagaucuagugaagcuucagugucucaguauguguaauagguaugauauugauaacaacaacaacaauaauaauaccuccaccuagaauuuuggcaagaauuagcugacucagaugaauguggccaucacaguccucagaagaaggaauaaguaaaucagcuguuauuugcagccguccggugugugaaugaaucuugcccggauggaaugacugacuguuggaacacaucugucugaccuuuaaccuucggacgcaucuucgaaauccuucccugucagcaucucugaaaugcgagcacuuuuggaaguuguccuuagccaaguaggggugauaccaagcuuuguucuuaucugugcauuaugcaaacauacaaagagcccaccaggaaucucgaaggauaaguguuggccgcuuccaagaaagucucaaagaucauggcaggggccucagccuucuaggagcuaaguggucacugaaagaccggcacagguagguguggccacuuagaccuugucugguacaguuccaugggcuagaacgcucaguucuggaagugauaaucaagauuagcuugcuucacauaauugcgaaauucuucuucuaagaaggaccacacccccaugacucccaauaguaaaaaagaaaagagucaugcuggcagacgcuugaucuucgaugauucagaguuacaguuauucuggggauagaggacuuugaaggcggagacauuuuaggaaugccauaauaacuuuuuucuacaguauuuucacuuacauuuuuauuguauacauaagaacuaucuauagcaaaaccuacguucucggucugaaagagaucuugaaauaaguauaauuacacaaauucuaagugauacaaaagggucuugcccuuccccccccccccccccuuucuacacagggaauaaaucccagagccuuguguggacugggcaagcaugccaccacugagcuacauccccagcuauaugguugauagagcaucaaccaaccuaucaggaucucgaaucaccuaggaggcaaacuucugagcaugcccaugaagggaguaucuggaccagguaaacugaaguguggagagucagcccuuaaguauggguaggaucacuuucaugggcuugggccccuggaugcccaaaaccaagaaagcaagcagaguaccaggauucaucucucccugcuuccagacugucaaugccaggugaccaaccacuccacacuugggcuggcaugcuucucugccaugguggacagcacccuugcgcugugagugagaauaaacccuuucuccucaaguugcuucuuguuggguauuugcucacagcaauugaggaaagcaaugagcuggccauuaguuuguaagagagaaugucauuauguagcccaggcuagccccugacuugccauccucuugccucugccuccugaguacugagaugacgaguguucuuccaccauaccccauaggccauauuuuaacauacaacacucucccuuccuuuagagaguaagaaagcaacaacaucuguaaucugacagacuuaggaaaacugacaggcuuagcccucaacuagaguauuuaaaugguuccuuucuccgggcguuuggggcguggagcgggccuuucaccugggaccugacucuccagaguuugcucccugccugcuucuuccaucccguuagcuggguuccuggauguaucucagcaauuccucaucaaugccacaccccaccuuugccugugauauuccccaucuuccuucuuacucuuuauguccucuuugugguaggucgaauaagggcuaccaacaauguccaugucauaaugcccagauccuguugaguaucuuaagauugcaaacagggaacugaagugacagaagaaacgaaggucgcucaccugccgaccuucagcgugggagaugauucucaauggccuggugggccagauuuucucaccaguuuccuacaguggggaagagagaugcuguugaaucacagggaauugcacaggcaaaggauuagacuggaccucaucagcucugcagauggagggaggggcaugugcuaagaaaggccaguaacuucuagaagccaaaagaggccgugaaccagauucucuccuaugccuucuaucaggagccugauucccagauacauggauuuaaggauacauuuggacuccugaccacuucgaucauaaagagcagaguugccuugagcaucuaaauuuggguguauuccuuacggcagcaaaggcuaacuaacacccgcucaagccauucccuugaaacuuuucucugucuucuacaggcccucagagcaccacguacccauucuucucgcaacagccuguccugucacacuuaaggugugugguaggacagcuuaauuacguacggccugucuccucauuaggugugggcaggaacaguguguggcucacucuccuauucccaggacccaccaccgcccaagggcucaagagcagcucagagaguauuuguagaaugaauaaaugcaugagggagucaaugaauacauuaauuaauuaaucuguaggagaaagaagggcaagccaccaucaacuuuaauuaagugcauaucccauguccagggccagugagggggcuacagaauuccaggaaccagaucugcccagugacaagcuggcagccuugcccucucucucaagacaaaggccucccaccccuuccauccaggauacaaugggcugcucuucuacccucccccucccaaucucagcgggagagucaggcugaauauuucuuuaagggaugcuguugaguuuucuuccgggggagcaaaggauuuguagaaaaacccagcguguaacuugaguguuccguguagccagauaucggugccaagcuaaauuugugugugcagcuucuguuuaaggcaauuauauaguguauaauacccaguagagaaauuaaguccaaguacauuuugcccacagagauuauccucucaguuggauuuauuuuaaacaacuuuuugccccuuauacauuaagacgcaugcaauaaaucacuuauguaauaaacugcaguauauuauguggaaaaaaaugagcgaguggcgugugugugugugugggggggguggcuuccaguggagccagaccucaggcaugaagagagaggaggggaagggacuuggaaggagggggccgcugcaccagaggaacuuggagaggcuacaaauggaagcaucuccacagcgaaccucaggcugcugcuggagggagcugguuauguaaugacugcggcaguggggcuccagagaaacuuuuuccagcucggcuuuuccagagcauccucccagcuaauguucauuaccggggguggggguggggguggggguguucagaauuaggcuggaggcuggaggaagggagauggaggaugggaguuuguauuaaagaugagaaaacagagaugagagcuuucuguuuagcagcucuugggugagcccuccauccagacgcugaaugauugcucuucauuguaaauaccaauggccaucaucuaucccgcagagggggggucucaggaaaacgggggggggcgugcuuuacgagaaguagcagcaaaugcguucgguagcaggccaccgggcuuccggagugucuaguauacaccagcaugcuguucguucuguauccgaauuucuaaucucacaggcgucuuaugcuuuucugagccaaguccaacaacuuucgccgggguagccuccagcgaugaggauuccuguuagcagaaaaaugacugugagcuccgacuucgagcagggccucgaguauuuaccuaguugaggcuucccaaaugcacuaccagagggcacuaugauuagucccauuucucaaaaguguaaacugagguuuuuuuccuuuuguuuuguuuuguuuuuuuuuuuuuaacaaaaaucugcccccaaguucucuccaucuggaaggaaaagagccaggguucaugccaagacccaucuggcucccaaaugcuuucuggcaaucaccaaguuauacaaccaauucuagaugcggauccgagaaauaacuucauggugagacuugccaagggaggcugcuugccuccuuccugcaggaacacauugcagcucacaaaucuacgccggcuagaaaaaagaaaaccaauacugcucagaaaaaacgcuugcaaacuucccggcagaaagcccccuguucaccguggugugccugccaccggggaguggaaguugaggggugggggugggggggcacgaagcacggucagaagcuaggaguuuccggcugaagaaccuccuuccagagccccuagaggagagcagaggagccgcuccaauuuccaugugcgccuuucucuaacuuugagagcccaauaaaacccagagugcuggguaggaaucagaggcugcuaagcugcuuguaauuuacgauuuagcgucgcacaguauaaaaauaggcagugaaacugaaaggcaaucaagucuauugucaccaggaaugggacgugaucugacauccgccgcugccgagagcccgcuguguacugggaauguaguguauaugguuucauuuuaucucgacaucccuggagucuggccccugucauuuaucuguucccgaguuacaaagcgccccacgugcuacuaguagacaacaaccaaugcauuuuuuuguuuuuguuuuuauuaaaucccaucauuuucuggcucaauuuuuuggggggggggguagggauugcuuugucucucaaucuguuggcuauggggcaaaggucacggggugauuggugggugggcuagcccauaauuaccuuucuuacugcaugaguggcuaaguggggggcuccgccucuggcuucuuuagcgugguggucuuagagagguuggaucuuguagggcguacaccucauagcugccauggcaaggucuucuccgacugaccuuggacaucacaggaagccacuuccucucaccauaugaggagaccuuauagugaguuuaccaucccuggcacacugggauucaaugcagggggacauaaggcucuacuuccuggugggaagacuauugaagaacuuguagcugcauuuuguaagccaucugggugucuguggucugcauccucuuuguccccauagcagauccuucuaagagauaaggacccugauuuuguuugaccgggucccagugcuaacccagggugacucagcuagcuucuagcugccaccucagggucagggcugcucacuucauggaggucaggaagcagcaagacgggggauggcgcugggacaggggucagagucagggugugaccuucaaagccaugcucccuaguaucugccuagcccaaguaggucuaaucuucuagucucuuuugcuuccccauaaaguugucaaaguaugaaucgaucagugaauuagccugaugauuaagccagccagagccguuaaugauccaauuauuuuccgaagcuccaccucugaguauuauuuugggaccacgccuucaaagcaagagcuguuugaacaguaccuacuaccucaacuguaacauagcguucacuccaaacugccuuucgcucacagaagucuugagacuuuggggcucauuaacaaaucaauuaaagugucuggcaacacaaaaaucauaaaccagaauccuggauucuccuucaagaagaauucccgggguuaacagagaauccauucaugucugccaguccggcuuugacucuuucucauuuuccauuggcccagggguguaggaauggugcugaaaaguacucaggggcagacaaaacugcgguuaaaggcagcccuccucggcacucugcccucccccacccccccccccaccucuacuuagcuuuacugguuucuauuauaacccacccagcaaaggacagcaugggccggugaacaugggucagcauucugauggcugugggcccucagccuguguguuccccaccccucuuaaauauccuuuugaaucccauacauuauguuaggucugcccgacuucuguuuauacggcagcaaagcggggacggcuuggauuuuggaaguuucgcgggaagguauuaaaugugcuuugaaacuacuugaaaguccagcugugugugcuuuaguuuuauauuuagcccuaaauuagagacuccauauaccucaaguaauaaaaaggcucagcagggacucagguuuuccuuacguuggccccgggguugggcaccaaugagagaauuuauuauuuauauuuagaggguuuaauuucguagcuuaauucugccuuuugugaugguagccgccccaccaccacccccagacacacaccuuggauuucagaaaguaauagcugucuuccaaucaccugcauuucauaacagugaagagggaaaaggagggaggaagcacaagcuggccuucuuuccaucugacccugggagcagccagaaagcucagccaggaugagugccugccugcccugcagcccccaugcucacgcuggcauugaauacccugcaucaccuugcucucugccuucccaagcugcauccauauaaaguucccaagagucuuucccagaccaaaguccuacagaucccugcuguuccuggguagagcuggaacacacccuuccucagacucacuuacugccuacacuacaggacaggucaugcgaacaaccgggagcuggugaccaaggaggacggcaguuacucaguguccuauggcugccacgagauaggggaugggcuaggcaacucagaacagaaggccguauucucucagucucagaggcuauacaguucagagcagcagccuggccguauucucuuggcaagaucuggaccggauuucaccccuguuuacacaaggacccguuggcauuuccugaccauucuugugauucagaccugcagcaacauuccaacuugugccucuuucugcaugcuuccaucuucuuguucuguaacccccauguuucuauaggauauccuuuaaaaacaagacaaaacaaacaaaaaguagaagaguuaccagaauugggagccauagugauuugacccaauaaccuuaccucaucuccauugauuacaucucaaaggcuccauuuccaaaugaggucacauucugaaguucuguguaggcauagccacuuucacagaacucuauccagccuaugucacacaugaguucucagcacauaguuagagcacagcucagaccaagaggaaaacaaaucacggcaaaccggugcacacggaauacccugagggcauucgaggagcaggggacagaggucucgucuccauucagugggcaguugcuguuaagcaucaggcuccguccuaggucgugagaguuaguauuaguugucaaggugauaggaccagaaguaaggaaugggcccauaguugggggauuaucuuacuuugagaggggaagaccugcccacuguaggugucuccauucuccaaacaggaaucguggggacuguugucuagacagggggacagagcggauacaugcauuaauuguucucuucugacugugaccagccacuucaaacuccugcuguguugaccucccugccaccuuggugugguguaaacugaaauugacaacuaaaccuuucucuccuaaguugccuuugucagaguauuugaaagaagcggggugcagugggaaagggugcauagcucaacaggauggagaagggaugugagggugggucuggggcaagggagacaagacaaagcuguacuuugcaacagaaggaauggaaucugcacagggcuugaaggucuucaaguuugucccaccagccuuuucccuuucugggaggcaagccagcaccaaggaacacagggguucaaccucagauccuauuaguccugccccacagcacgucucuucccuagucagugccagacucagccauucuguaagccugacugaaggccgacaucauaacauacggcagcccuccauaagauacucuucgcagucucuuccuucagacccucuccugucuugaaucccuagguuccaauugaguguggacugugcgccugggagggacagagcggacugacaccucagcucaggcucagggggagaacuuuuacugguaucuuugcaugggggugggaacuccucacuucaaauaaaagccagauguccauccuuguaggcucugaucuacagucacacauuccugggaagcagagcauccugcaucagugugcccgaccugagaacagcauccccacaaggcaacuggucucugcucacuucugauaacgcuuucaucuccucuggaguuuuccuugcaguuucugucuucuuuucugugaacucuucugaaguacaaacucaagguucaaacaucugugacaagggucuugugugccagugugccuacaaaguacagcacuuacuguucuguuaggacuuggcccuuccaucccacucaccaaggguuaaaucuuguccagcacuugagaucucccuggagcugggcaagcaccucagggauguauuaauguacccagcaacuugggggacccaaucugaaguccgcuggaagcuuacagaagccuccccuccucuuccucuuccuccuucccuccucuuccuccucuucuucccccucuuccuccuccuccuuuuucuucucccuucuuccuccuccucguuuucuucuuccuucuuccuccuccucuuuuucuuccuccuccuuucuccucuuccuucucuucuccucuucucuuuuuccuuuuccccuucuuccucuccuccucuuccuccuuccccauuccuccuccuucucccuccuccuucuuccuucucccuccuccuucucuucuccucuucuucuuccuucuuccucuucuuccucugcccccuccuccucuucuuucuuuucagucaaauugccuccaccccagggaggcagccccccacccaacucagucuuuucacuugcucaguaccucccugucagguguuuguaaucacagguuuucauuugguuuccugguuuaguaacuaacaagaucacaagaggcauccccuccccagagaggaccagaggaggcucuauuggcuucccgauuuuuuucuuccucuuguccuuuugucagcuggcauucgacauacuucccgggcaguaauuuagaaucugucaauuccugagagccgcuggggagcugagccaucuucugcguuuccuccuuuccucgcucgagccugacuugggucugugagcuggcagggagcgagaucccucucugggaaggguuacugcuauuuaaggaagggccuggguuuugucaaguuugaaagcuuuucaacaucuuugccgggaugggaucgcaggaggggugguuacaacacaucagccuagagcgugcugugcccagcuucugauuuauaucaaaauauacuuuccuggggaguguucagccagcagccgggcacggacacauuauugaugguuuccuguuuucuauugucccugaauggaaaaagacuuuagagccuuuaaauuuucucaagaugucuguguuguccugugccauccccucaauuuuccaugguaugaaaaauguaaacguggcugcauuugguucaagcaacuccggcagugucugugaagguuucuaagauuuuugaguuuuggagaauaucucucucucucucucucucucucucucucucucucucucucucucucucucucucucucuuuaaccuggggcuucacuagaccugacaaaaacaagcuaaccuaaucucuauugcugccuucugaacauccaucagauucccccuucucugcauguguuccccaauagugauuuauagacucauucuuuuaaggcagauaguuauugaaccccccacgccccaguuucauagauggacaaaccugggugaaauauaaagcccuuucuccagaggacagggcuggugagugcuucuaguccaguuuugucaaauacagacucucucuuuuuuuuauuuguugacuuuucuguuuugggggacaaguuuuccauguuuagcccuggcuguccuggaacugucucuguugaccaggcuggacucgaacucauggugaucugccugccucugccucuugggugcugggauuaaagauuucuuugcucuauuaccucccagggcaaauguagacucucccuuacccccgucucuugccuacuuacguucagugucuaaucaucuacuucucuugcccuagcauuuagugggcauccucugcuuccgugaguauucacuuagugacuacccauguuggaguuuggcuuuauuucucccacucuaacauaacaauccauugccauuuuggagcugagauuaccuuggccugguagccauagcaacaaauugacuuaaacaguacagagacaguuaaggcuaugguaacuguaauggaguuuugacauuacaauaggaggagggaggcgaaggucauaggaccccuguuggaauuguagccacugcccccuccccgcccccggcccuugcccacugcaagcgaucauggaagaugcuagaggaucuuggcagccaaaggucaguugaaaguaggaccccaugaugcauucuaggaagucauuauccauaauggcguaagacuuuagggugacacaacuauaugggugucacucaugcuccucgaagcacaauaugaucaguucaacaaguuggccuuugguuggaccuugacuaucuagugucaguguccuauaacacuuguucauguguccccaggaaauaagucaccauaucgaguauguuugcacucagauaggaaugcucccuccccaagaugccagagaaagaugaauccaauggacagaggacaagcagaaaacggaugcucaauugugacucacaaggggcugcauucucccucaauuuaaauguggagguccacggaacgucuauccaucaggucaugccuuacgaucugauuguuugcacuuagcuucccuugaauuccuaccauguucuagguacagucauaggugccggugagcgaacagcacacagagcauaggagacuccaguuucacaaggcccucuggucuugcuaagacucugaagucagagggacugaaugaccugcuagguguuuuucccagucacauuccuucccucuacucaucugccuuacccugaccccaugucuuccuuugcagauugguaacuauucuccaucacagcugucacacaaaagugagaacccaaggaaguaccacguaggagaugcccacuucuuuuccaaugagcgauugcuuuuagccaaugacaugccacuuuuaggaggagggcuggcccugcucacagccauucaucaguuuggcuauccacaccuguagcaccucuguuuccuacccgcucccaugcauuucucaauucuacacugucuuuuccauccucugaugaagcugugauuuguuuccccaaagcccugcauguuugggaaaaaaaaaaaucuggcaaguuuggaagguuucugaaaucccuccuaccguaucacuggaaaguacuauucaguucuccucccacaggggacggauagaggugcugauacaaccagauguucucuguugcuggcugcucucuagcugccuuguguccauuagagagcauggacuugggucggucauuucaccccuuucuccagucuccagacuaccccaccuacguuacuuuuuagauggugguguuaccaccugcuuuuuaaaggucaagagcacaagcuucaggaauguuccuaagcuuugucuugcacuauuuuauuugucccaaagcuggcucuccauccuugcccuugaugugucuaccacgcccgaucuucugagcucaguagaugcuccguuuccuacaguucuguuguuucuuuaucaccuguuucuuuaucaccaugauguuccugccucacugcuucuguaaccaaggcccgggccacacccuucuagaguaauagacacaacccuuucccugggaaauuuagggggagccaaagcaaccacccuuagucuccugaaaaugaacauaguaggcuguguguuucuccuaaaagugucacuuguuuuccucaaaaccaaacaaacagacaaacauggaguucggauccucuggauaauauuaccacuagaucuauaucaggaagaaugauguauacaguggcauuaaccacaggcuggggagauacauauucucuguauuaucuagcaugugaguuauccaacugucccauaccagaggacacaaaaugcuggagaaagccugagacauguuggcuaccuguuucucugguagagucacauaguaaauacuucagacuuuuuggucuucgauuguaguuaucacaacuaucuaucucugccuuuguaauagccaugggcaacacacccaccaauggucauagcuguguucuaguaaaacuuuauuuauggacaccaacauuugauuucuauaugucauaaaaauauauucuuuaguuugcucugugugcguguguguauaaaaccauuguuuuuauaaaacaaaaaccauuaaaaccauuaaauuuuugccauugcaaguuucagggugaguaaauccaucuuugcauuuuuguguagucaaccguggacaguuauacuaagcccgugagcuauccaaagacagacuggagggcacgauuuggucuguaggcucuagcuggcuggucucuagccuguagagucacuaugcaacgaaucaguaauacuacaugccaaaauuaaaaacaggcggaauaaaguacauauuuugcaagccuccgcauggaauaaguuaauauuuuuacacuaaaaaauugccugagcuucuuuguagucgaagcagaaacgaaaaggggaacgaguuccguacgagucagaaccaucauggcuuccaagaauauuccagguuaaauauggcagugacauuuucauuuauggucucucauggugucccuacugacucuuccuccuuaaugcuaguuccaaaauauuuguucuauuguauaaaaucagcaggcaacugcuuucuggucauuauaauaguguauauuauaucugacagucauuaauuaaauacuagcuauccucugaagccaaagccaaauagugcuccacgaacauugggaucugucagcaaucgaugugauuuguguaauuugugagcaaucagauacuucauccaaaaggggacuauugacuuccuugccuaucuuggaagaaauugccacuugguccaugucuaugcagaccccaagaggagaagagauuugacaauggucugauuaauugaaucagugguuugggggaguaggcugucuguauugauccaauuaaauagauaauugucagaaucgaggucacgucuaucaaagccagagagauuguuucaaacguauaaugcucacccaaucaaaguaagccaucucuuccucaugaaaccaagcaaaaccaccugaguccugggcaccuuaaguggcuuaaaccaaggucuccccucucucucaguauaugauuaugugcuaaauauaaugcuucagauuuugguuccccacagaugcaagggucauuaaugaaaguaugaggauuggaaauauccaaggcuggacuacagcucuauggcaauggcuccaugguuaagaucccuuguuauccauguagaggaccuaaaucuaguucccugcauccacacccagcugucuauaacuccagcuccaggggacccuacgcccucuucuggccuccaugggcacugcacucacaugcacaaauccacacucagauacacacauaguuaaaaguaaauaaauaaaaauaaaauaaaaaaagcugagacuagcacaagacaguaguugauuuuaggaggaaaggaaauaaaauaaaacagaaacaaaaccagaagaguuggugguguucuccauuauuuauugguaaaccugcuucuuaugugucuugaauaaagaaggcaucucagacugcuggcucuuuugacacuccguggaggacaguucuccagccccggauagugauggaauggaagaggaaaaugccaugccggaagauccauguuuaauuccuguaucagacucaaaauccagggcuaugaugagaccucacuuaggauuuuaggccagcuaagcugcuucucccaaccucuuccgucucuaucucauggcugugugaguaauagcuaguacucaggcacacagcacacaggacucgguaguugucuaguuuggacuguuccacuaucacaaacaugcuuucucagugugucacuaccccccuaccccuuccuucccuuguugaccuggacaggucaugagcauccaccagcugcuagcuuuguguccgggaacaguguuuuacaggaguacaaugguaaaggaagaaaugacgggcagaaagaaagauuguaaucagagcagcacuagccagggauugggugagagcagccccuagcccagggcuggggagagaggacugagaagucugcaagagcaguccgggggacaccuugagauguggcuuuugauguguccuugcagauaagugugcaguguccuguguuaaccauugagugugaauccaagcucugucacuggcuggcuauaucucugaaagccccauccccucgcuucucuggagugacuuuuuuuuucuauuuauuuuuacuggauauuuucuuuauuuacauuucaaauguuaucccauuuccaggucucccccccgcccuccgccagaaauccccuaccccauccucccuaccccugcuuauaugaggguguucccccacccacccacccacccacccauucccaucucccaguccucaguuccccuauacugagguaucuauaaagccuucauaggaccaaggaccucuccucccacugacacaugacaaggacaucuucugcaacauaugcagcuggaaccauguguacuccuuuguggauggcuuagucccuaggagcucuugggggacugguugguugauauuguuguucuuccugugggauugcaauucccucaacuccuucgguccuuuaucuaacucuucuauuggggacccuucgcucaguccauugguuggcugugagcauccaccucuguauuuguaaggcucuggcagggcuucucaggagacagccauaucaggcuccugucagcaugcacuuuuuggcauccacaauaaugucuggguuuggugacuguauaugacaugaauccccaagugggacagucuccggauggccuuuccuucagucucugcucuacacuuuaucuccauauuugcuccugugaguauuuuguucuccuucuaagaagaaccgaagcacccacacuuuggucuuccuucuucuugagcuucauguggucugcgaauuguaucuugguuuuuuggagauuuugggcuaauauccacuuaucagugagugcauaccacguguguucuuuuuguaagucaucucuucaccucauagugccucaguuuccuugccauuaaaaucagggugaugguaagaaccauccugugguaguuaaagugauuaaucgcaguauuaauaaauacacucaccaauuuaaaagacaacacagaaguggcugguaagcauuaguugagauucucacuacuuuggucauguaccauuguucaaguuugcuggguagaaagagggagacagaaaagagacaucccaggcaaauaugcauaaaaggagacugaaccagcaagaggaacagauugaaucccgugcacagcacagagcucuaagcagguacgaggggagggugcugcuucaagcuaucuucacacacaaagggcgaccuccuuguguguccuccaugauggaaucucccugagccugagcagccgcugugagauuacaguguuuaguuuugccgcaaaaguauacaaaguaugaugcucacuguauauaaaagugaagggcuauguuagugaguuuagguuggcagggcucucaggggauucuugacaacaaauuguggauaacuaaauaggucaccccaaauuacaaagcuuuaauagaagguggagguguguguguguggggggggaucugcagaaggccuuuugcugggagggcagcagguggguacuugcuccguucauucagagccauaucuggagugcuggcccaguguuuugcaaauacaaggcccugauuauguaccuguugaaugagugaaugauugaaugaaugaaugguugauagacccuuaaaaacaaagcagagccaucuucaugucucuaugcaaucugaacuuuucugguguuuugccugccuugucuugaaauaaccgagcuccaacggaugacagguacggggccucagcucugcucuugagaaacucucuauauucuggggcucuccaucauuuuuguaccuccuucugcucuccagaauuguguucuaacuacauaaaauaaaacaugcaaguucacaaaggaugcuaguuuugucauaauucacucaucaacauacaaguuuuagucccggcauccacagaaccaacuccagcaaguugucugauaucuacacgugccaugaccugcacucgugcgcgugcgcgugcgcacgcgcacacaccacauacaugcauaugcauagguacagagacagagaaacacagagagggaugguuagugauagaccuauuauuaaccaaaaaauagguaaaagugguauuuugagauuacaggaagcuaacugucauuugacagugacaaagucacuuaucauuaacuugacauagcauagaaacaacugaaggaaaaaauagucucaaucaaguaauuguuuuaaucagauugauuauaggcaugccgaugaaagacuguaugguuguuaacugauacaguaggaaccagcccacacugaguggcaccauucccuaggcagaugauucuggccccuauuaaggaauuagcuggguaugagucuaagugagccagaaauugagguagcaaauagcauuccuccauaguucauguaccaaguuccuucuucagccccugcucugacucccucgaugauggacugugaccugguaguguaagccaaaucaauccuuuccccccuucaguugcuuuuggucagaguguuauaacagcaacaggcaggaaaugagaauagucucagaugccugugauauuuugucagcuuguguccuaaacaagggagaaagcaaauuuuaauucagaggggcaguagagaagaagcaucuagcaucuuggcuguccgaguucacccagagucucacccacagaugcuuagaugagggucuugcgcuaaguuguguugaccucauaaaguggcugaugguuuucugauaccagaucaccuugguccacccucaggguaugagagaugcagcccuagcaccuguaucucucauaccccgagggugauggcccaggcagaucccucugcauuccccaguaaauguuggacaaaugacagccauuaugaccacccuacuuugagcaugucuaggacagugauaggcaagggacaaagaaggcuagagcggcaggcuuucucccagcagagggaagcccaaagcagagacaagggaguaccaagcuuuugcuggagaauagagaggugggauucucagggcuggggacagacagagcugucagccaagaucaaguccaggugcauuugguggcaggugugcuaagaauguggcaggugggaaagcugugucuguggggacaaacguggggcagagagggaccuuaacccgauacaacaugcaaguggagacccuguugugacugagcccuuuggcuucccugugugcccuuccugccggugccccaguugugaguaaauaaagcugccuccuuuaagucugcucucugcgcccucucgcagccugcucucccgaggagcagagccccauuauauucugcaagcaucuguuuccaugaguguucauucucucuccaauaauaccgcagcaggacaaagaggagcggggaaaggggcagacacgcaggauauccgucccaguuuuaauuacaaguguucguggcgguggcauucauguaauugggggggugauugaugccaaauaauaagcccuaauguagggggcuggagcccaagaaggagggggaggccacaagaggcggcagcucccaaccagccuggaucugggacaacacaugucagcggcugcuuggacaggccaccgugggaccagcuuccguguuugccaacucuacaugcaaugucccuucuucgggcaucaguuuccucccugagcgagcacaucugaugucagagcugaugacuggcuuuggaaagaggaugagaugggagcaucuggaaagcaucuagcacaagacuggcuacacagcaaggacacagugcugccgccuuauugaaaacuaauaauaaaaccaagagaaccuauaaucacuuucacuggcaccgucccguacaacaauuauuccacuuaaagcauggggggauguggcucuggggcuuugucauuagaucuaugugcgcacuugaccuaauagaaagcuugaaagcaacggauggcaacacaguccaucuuccucaagucucuggagcaguguaaugcaagaauuaccgaccucucuuugcauuuaugcaucgcaucucuuccuugaacucugaauguuuuauagagcgcagaucagcaucuagcuuccuugucaugggacagaugcaggauaggcaugguuuccuggaguugucuacucaauggagccuuggugugaagcagacagagggaggggggcaggacaaaaagcaucccacagugcucaagugcacgaagggugggugaugggugggggugggggcgggggucauggcauauucugcggucccaaccauugcacuuccuaccuauaucuccaagggaauuuguaacuuacucucuuccagccuugaguccucacgaaggaauaaaccuuuuuuuuuuuuuuuuuuccauuuuuuauuagguauuuaacucauuuacauuuccaaugcuauaccaaaagucccccauauccacccacccccacuccccugcccacccacucccccuuuuuggcccuggaauucccuuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuaggguuggggcuaauauccacuuaccagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggaucuucugguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugaauaaaccuuaaaggcuuauuuaggucauuccuugauaggaacacaaaugagaauuggcgugagaaaucauugagggaagacugaggccaaggccacaggagcaaagaucgaugaggugaggcugaggggaccgagcuggccacaugacuucauaggaaggcauuaaagcaggacaauagcuacaggcaccguggagaguugggagugacacuuccugggcuggacuucagaacacaaugcccccugcucugagacagggagauucacucuccagacucuguugcgguucggugggcuuuguccucugagaagugcagaauuaagaccagggcuuucagcgcuggacugugugcauccugaaaaagagaugcucucuuagaaccuagaauguaagagagaggccuuaacagugggcugcacaggcagaucccaaagcuaauggcaugugucuauuuguuuuagugugugcacacacguguucaugugcaggucagacgacagccaugaauaucaucuaccuccuuugacguggggucugucauuggccugaaacuuaucaaucagaccagggcugccuggagcacccccguuacuccccaucccccuuccuacacuggcacuacaggugcauacuaccacaccuggcauuuucaauugagcccuaagaauccaacucaaguuccuuaugucaucaaggaaaguaugcuaccagccgagcuucuccuagggcaccaggacacaugcuuuuguaagaggcaaaggcagagguagagagaugagggcaaagccuaggugaaaacgaagcagagcuuggagacucaacucgaguccaacgguacuagggauggccauccaucccuuagagacuaccaaaggaaccccacuuuacugagagaaugccuuuagccucuuguucucaagggugcugggacaacaacuucaagccaacacagauaccaggaagcuaaugugauggauauagacacaauagucuuuucgaugaccccaugacccacauccaaccugcugccuuuuuccgcaugccaaaccguuagcguuaacaacccacaccuuccuuuacauucuucacuccuuucugcuuaauuuagcaaucccagccucuaaccuacccugacaucccuucucugucuuucgguuacucugcccuuugucaccucggccuccccuuccuucccaccuuucacccugcuauccuucagaucucagcucagcaucccaaucucagaaauuccacccacccuaggccccagccucugcuggccagaauuguugccuuuguuccaaggucucuccgaaccacaauccccacuuucugccacuuacuucagccugccguucuucauuacuguuugcaggaccuuggugaauaucucccgucuagucucaacaagucauugcaauuggaccaaaguuaaaccugccaggagauaggccagggcagccacucgguaagcacucauggacaccaagugaauaagaaaaguguuuuguaguagagauagugggaacaguaucuggaugacaccaugacauucacuccaaauggaaaccuuccauaguauuuaacuuuguuauuuaugcuaaguggcaggcaaugaaguuauuuuuucaguccucugcccuaggccugccagccuccagccuugcacacacugucuaucaguaauauuacuguauuagugcauagcaagggauaaccucuguccaugguccucugggggucccugccuaccccaggucuugggggcuauccaauucucaccucagcuucuuauguggaccuuugaucugaauuauggaguuccacaaaucuuuuccuuuuugagccacauggacuuggugcugggcucaaggugggcuuuuaggagcaacaguaccuugaagacacuuagcucagcgcugcuucccaggaaggagcgaugacucauggggagacgcgguuuuucucagaaugguuucugugguugucucgagucuucugaagacccucgaaaacagagcagcaaaagcgggacaucuuagggcugugcagagauagcaucuccguagguugaacaugacuuugcccuauuuuccuuggguccucaguacuggcacagugagugguaauagaacaugucccggugagugaacagacuuacuggcggucucuuuagacaugucaaacuguaguaaccauauccaggccacaguuacacagaguagaauguuaaacacuuguccacaguguuuggggacuacugaagacucaugggaaaauacaggcugcaagcugcaggcccguuucccccaucucucucuucccuucccucuucagcucaccaaacauuuuauguuuuaaucaacuuaauauuuuaaaaaacaauaugcugaaauauauauauauauauauauauauauauauauauauauauauauauauauuuccagcaucacucauguauucauaaaacuaguauuucuggguuggaaauguagcucgguugguaaaaugccugucuggcauacacaaagucccggguucugucgucuguaaaaccuggcgugguagugcaugccuguaaucccagcauuuggaagauagaggaaaggggaucagagguacagggucacccuugacuacuuagcaaguucaaggccagccugggcucugugacacccuguuuugagagacagagagagagggagagggggagagggagagggagagagggagagagggagagagagacagacagagacagacagacagaggagaggagaggagaggagaggagaggaggggaggggaggggaggggaggggaggggagaggagagaaagaaagaaggaaggaaaaagagaaaaacagaaaggaagaaagaaaagacauuuauaacuuuaauggaaacuugcuuuuucuuuaagcuucaggcacugauacacuuaauuaugcuuuucaacaagauuuuacauauuuaauacucacuuucagagcuucuagguaucucaauuauuaauucuacugcagauuuauuggucuuguggcucucucuuuaguguaaagguuguagauccaucaaacauuguuugcugucuucaaauuucaacagugcuuuaaaucaaaucgaaaauccaaaaagcaguauaacuccauacaggcaccugucuucgugacugagaagggccaagccccuacaucuuaagacuuccccgugguccugauagagggucagcaauggcagugggccagaauaaucagaaaaugguuucugacauccaguggccagagagcagcgucugccccaaagaugcuauuuauaaaaguaaacgcuuacaaauggagcagaguguaaccagaacuuuaugaauaaguaaugaggucuaauuuucuguuauuauaaccauuguuuaaaaaugcaugucugccagggcaugguaaugagucuguauuacuuaggaaaauccuaugauucuguccuuauuuuuaauaauuacuuugugacuucuucaguggaguuuuuccucuaucagagucuagauuagaucucggggagggcagucagacagaugccaucacugcauucccaaaggagcuguggcugggccaagaguggcagugugcugcaggcagccauuaaaucauugccacaccuucuccuuguagguuuggcuuauucagagucuagauagacaucucccuccccucccccucucucccucccccucuuccccuuccccuccuucccucucccucucuccuuccccuccgucucccucccucugccuuucucucuuuuucucucucuguguuauaguauauguguaugacauaauguguauaguguaaucugucuguuugugagugugcucacacacacauuuuuuuaggagaguugcacuuucguuuguauacacaugccuauagaggccagaggucaacuucaguugucauuccucaguugcuauccacuuuugagacaaggacucuuacugguuuugaacuaaaaaaaaaaaaaaaagacugacugguccaacaagcuccagggauaugguuaucuccauuucuuuagugcugggauuacaaguauauaacaacaugccugcuuuuauauagauaacaauaucuguaucuauagauagauagauagauagauagauagauagauagauagauagauagauagauaggaaggcacauagacggacagacagacagacagaagacagauaugggaguuccucaggcuugcaaggcaagugcuuucuugaaugagcugucucuucagacccaugccagugccucuucaccaucgagguguucauugucacauucaaacauccugccaaucagauuuacaggcaguagucugcagggaaauuacacacaguagggugucuuucaaaggccaagaacuucuauagaguucagcagaagccugagcaguguccuugggugcacuggcagcuugagugugccuccuugcccuggguacugugugguagguguguggaugucccuuugcagaugcuguguggcacuggcuggauauucuuugucccucuccaaccugacacugauggagcuucuccaucugacucugcaguuaggacaccaggcccuuuauccacuuccacucuucuugcauugagagagauguguaucuuccuuuggacuggagauggggacucuuuaguccuggggaaucuaugcuaauaaccuucuuaagagugagauaaaccaaucaccaggagccaaggggaaguaggcagcuuugugacagccacauuagagaugugaguccuaaccccagugacacuuuucccaugcaugggcauuuggggucaauccgccucacagcucuucguugcacauaaaaaucucccagauuugggcuguccaucccacucugguccagacauggcaggguccaguucucaggcaggugaaugacugugccagugaaccccacagggaccuucaguuccgucuuggagaagcuaaacauagcagaauggauagacucacaacugaggccacacacuuuuaccugacuagugguggguccagggaccugcaagccaagccuuuuaugaugugcuccugacauuuuuuuauauuaauguuuucugauucucuaccuacaauguuuucccaugcuguaggaggaugcuauuuuaaacauuaauuguccuaaaaagccucauacccaauguaaaacaucggucccagagaggcacucucaggaaauggaaagcccuguuauuaggaaugacgauaauuguccugacaucuaucugugcauucaguaugucuuuacaagauaacccaaauaauggaauugcaaacaaaccaucagaauguagauggguaggcaccuccuggcugugugugaugcccucagcuuuaaguagcuaugccuucuuuaggcucuauugagauguacugccaacuguaggguccugcccccugauuucaccuaguaaguccaagacuagcaucuucaguuuccuaggcuaccguugaccuccagaggggcuggaaaccagccagguuuacaaaaucaaguuccuaugagaacauaacaucaaagcucuucccaccuuguagccacuugcuacuuuguagguucuucugucuuccacccuuucuacguccuaacacuagauagcagagagaaaaaaaaaagggauagaaaggaaaaggugccauauuaccauuagacuacuuccugcugaauagagcugucaaguuccuuggagcaaguuuguucuuugcccucaggauaucugauuauuucuucuuucuucuucuucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuccuucuccuucuccuucuccuucuccuucuccuucuccuucuccuccuccuccuccuccuccuccuccuccuccuccuccuccuucuucuucuucuuucuucaugcaugacuacuuaacaaaaugugaccaacagcaaccaaccagcaaccaacaaucuacccugccucuggcgggaccugagcaauuccaaaaauuccaaacauuauauacaaucgcagaaaguaucugccaaaaucacgccccugcuagaacaggaagaaaaucagcugcuguggacaaucagaagcagcccauaccucacaccuggggaugaaaugaaaccuuagucucauaauaguaccguguguuuugaaaaagaaaccaaauguuuaaaauugucauuacauggccugguggcucuuucccagauugacccuauagagagaaucucuugugcaauguauggaagcaucaccuucaauaaaauaccgcugaccuguuagcuucggcaggauauagggaggugggaguuccugcacagggacaggauuucugggauagucaagugcagauggguuugccuugaacucugaagaagauggucgcaugauacugaaggagagguaacuagccacguggcaugacuuaggguaguuuaaacgggguaacugaguuaugagcaaguggaaacaggucaaagguauuggccuaggugucuacuuauauauauuaagugucagagccauuauuuugggaacaggauagaaaagccuguggucacaaacccaaaggugguguugaucuucaaaagcaaauaucuuagaugcuucugugacaaugcccccuguuuucuuuuccuccuccuccuccucuuccuccuccuccucuuccucuuccuccccccccucuuccuccuccugcugcugcugcugcuccuccuccuccucuuauuccccuuccuccuauuucugcauauguauguggugugggccuguguucucauguucaugaauacacauauauguggguacacaugaguguuuguauagagguccaaaguuaaugguagggaucuucucucagaguucucuguuauauuuuuugaggcaaagucucugaaugaacguggauguuaccagcuaguccuagcuaaccaccuugcccuggaauuccccggucuuugccucucaagugcugggcuugccauucuugcuugguuuucaugugaauuguagggaacccaaccauagcccuuccauucacaaacaagcauauuucucacaaagccgucucucuuaggcaugccugcuuugguuuaggaaagacaauuauuuaaaaaugaaaacacuucuccacuaagaaccgcccugcagcucaugacaccugcugaccacaauguuacauaugacaggagaggauuauucacuguaacccuaaaugucaccauccauucuucuuagcagucuauuggacucaggguggccuuuuaaaguauuauuuuaaaauagaacauaacagagcucgaaugaucuucuaguaagauuguugaaagauaaagaaaggcaaauccacaaucacgaggggcaugauuuguccucuuguaauucaccagcgagccacuccacugugggcuauuugaacuuacauucucugccugaaauauuuuacucuaauauucagggaaaugaagcaaagauuaaaacgucaaggccagcaaaaugauuggguggguacaggugcuuuccaaagagcccccagauucaguccccaggacauucaugauaaaaggacagaaccaacuccauacguugaccucugaccuccacauaugcucuauggacuuguauguacacauaugcucucucucucucucucucucucucucucucucucucucucucacacacacacacacacacacacacacacacacgcacgcacgcacauacucgagugaguuauuuuguuaaaaaaugauauguuuguguguccaugugcaaaugagugaggugcccucagagaccucugacagagaugucagcuccccuggagcugguguuacaggcagcuguaaccggcccaccaugguuucugaugaaguucauggaggucuuuuacaacagaagcucuuuaacuacugagccaucucuccaucucuccagcccaauaaaaauaacuuuauauaaaaaaauaacuuuauaaaaaaaacuuuauaaaagagaauaaauauuuaaaagaagcacacagguaagcccacccaccauccuguucccaucucaacucccacguguguaugaggaagcucccaggcuguaccaccuagaggccacaaugaaacuuucuagaucagugacguagcagaaacagcuugaugccaucgaagcuggacaagacaggcaagcuguaguagagccuggaaacaaagcuucuagucugugccuuaggcauaaguaacggauauguguuggcuguucuuuuaaugccuugugauuagaaucgaggaauaugggaagucacagcuucccagaaaccucucugcuccgucccaguggccuugaaaacuaagcauacaucuccaccagcauccuuuggcuugaugcuugcauuaagacccuauauccucccugcugaccuccuggcccagccagugcugggaggccccugcucucuagcccugaguauggugcagguucuucucaucuucucauccucuuuacuucuccucugccacauccuuggggcuguuguuguagacugcuaucccucugggcacgggauggccauugcacccuugacuuccagguaugguuguccuaagagaccaacguaagaucaaugccauuaauauuucaucauggaagcagagagugacccaugaacuccaggcuaucgguuguaaucuguagacagccuuuguuaugaagaaggggcucacaaggccacuucccucucugagaacauguaggcagugaagaguuacugggaaggaccgagacauuuucuguaguuguguagccacuugugaguuguguacaugguacucuaaguaacccucacccugcuccuauaaauaaccccacugaaaggcuuugaucgaccaugcuagacuuggggaaauuucuuuggucuguuguugauacccuauccggaaugaaaagacacuuguuugucuccccagauagagaucacaacaguuccaugugccucucauuggccucucugugugguuucccccaaccaccacauccccuggccuccccaccauacugccccagcccacacucaucacacagcaccucugcuugcagaagaaugcauggaucauuauucugugucccucacauucagcucuccaguuuaauccccagccuugccccauagaguuauugccaguugagcuccuuauaaacgucuggggugguuuuuuuuuuuuuuuuuuuuuuuuuuugcauuuuuaaugaugugcuaggcucuugacaagccuuucuuugguccggcuuucucugagcggugccuauaggcaugaauuacuggaaccuuugguauuauagggacaggauacaauggugugccuuggucauucccucuuugagaguaucccaggugacgcccuagagcucugcuuugggaagacccuugacacagugccugcaccugauuaaagaaugguggaguugauuagcaaugucuguaguagacgaaggauuaggaagauagaagaucauugcuaaauauuugcuguuaagacucuggaauuauucuguguaagaagaaauaaccuugaaaugugcaguaaaguuacgucaggugaucuuuagacacaggaaugaggaucagauucaguggaggugccaaaggucccuucccugugagggauaagugguuuugcugucaugucuccucagcuguacaaacagaacaugagauuaagugucuuaacugucguagguccugccuuaggugcacaccucaagccuagugugggcuacauacuaauagacacacacaggccuuccugucucggucuaccaaaggcuggguucacagauguauauaucugugcugaacuuggauaaggguuuccuuauaggauggccaaucuggucgaaggcauguugguggaagagacuggaacacuacaagugucaccggccaaaggucccacugcuaauaaguaaccgaggcugaauauaaaucuagauguuuccaagguccguagccuucugcuaccucccaguagccgaagcaaaagagacacgcuguagaauccuccgggucccuggauaccuuacguuuucugcugaaacguaggcucuccagucccaggagaggcaaacauugguuuggaaaagauggauucuguugacauuucuagucaggcugagcuguccucucuccuucaaggucaucuaaaaaaaauuuuuuuuuucauucccaaggccgguugcucuccuugcaggggacagggggugggggguggggggggaugacuguggauugugccaacagcaauagcagcugcagcuaaagguuggagccuccauccaaggaaagcuccuccccuccucaguggccaaaggcuaauuaacuccugauggcaaacagacugcugugacugccugccaguucccuuuugaagagcccucuccagcaugcuccuagcuucucucuucaacaauacacucaaaugagugacuggcaguguguagcuucuaacucccaggggggcucugcuugcccccccccccccccccccccccccgugaaccugggcagguggggggacacaugcccuuagugccaauggugccuuguauucuguuguuguuguuguuguuacugcuuuuccaaugucacuuagcaccuuguuugcauucuguuaauaguucucuucccuaggucagacaccagggcccacaccuguaacccuagagcuuuggaggcccuaggcagacugugacaagguugaggucagccuagacagcaaagccacaucaaaaaccaagcccaggggcuagggaugcagaucgccaaggagagcgcuugcuugucaagcaggaagggagccccagguucccuccucaguaugacauaaacuaggcacagugggacauacauguagucccagcguuugggaggucgaggcaggaacacuggaaguucagcuagucagcaagcugccggguuacaugagaucuggucugaaaugccaacugagcaacaaauaaagaauuaagauaauaaaagaaaccauuuuaaaguacauuuuuaaaaauuccccucaguaaggcaucuccuuaaguuaagagucacaauaaaacaucuggaagugggaaaacagaugauaugagaaaggagaaaaaaauauuccugagguaguauuagguuaaauaaaaacaguaagaaagaagaccuuuaugauucuaauuauaaacaaauggcuaaaguauggacuuacauggccuagacaugcauagggaaaaaagccagauguuacugacaggcagguuagucugugaggcccagaauaacaaccauuauccccuaccccaaauaugacuuuugcuuccaacaaauaacuccuucaaacagggaaaaaaguuugcuaggauuuccauuccuuuguuuauuuggcuugcuguguuguuuuuguuuuuuguuuuuguuuuuguuuuuuguuuuguuuuuuugacacaagaucucagugcaccaggguggccucaaacuccguauuugagcuuagaaugacuuuacgccccgucucucucuuaauacaaagauuuauuuucauguacgugcauguaugugucugugugagcguuugcuacaugaggccccugcacaggccagaagagcaucaguccuccagagcuguagcccacaggcaguccugagucaccugacacaguguugggaauggaaggcaguuccuacaagagagcagcgugugcucucccccaugacccaucucuccaagccccuccuugaguuccugauucuccuauuuccaccuucaaagcgcuugagcuuugaaaacauucuugcucuggugucuaggugcaacugaggcagaucuuucuagaaguguucagcaaagugcucccgagcuccgccucuccuccacucucuggugugugaguucagagaaccuggaggccccaucauugucaccccagccacaaggaucucaguggcuuccucuauggcaauaaagggaauccccuuucugcucgguucuuucugcagaguagaugcaucucaugaagcccuuccaucccugcuuuuauguuuacagacuuugggggaggaaccuauucuccauccucuugaauaaaccacacccagacuuuuucuaccuaacucuccuuuuaaaaaagcacuuaaaaaaaaagcccaacacgugugugaauuaugucgggacaugcauguaacauacugcauguacggaguccaaagaacagcuuucuggaaucaauucuuuccuuccuccuuucugugagcucuggggauaaaacucaggucaccaggcauguucgacaagcgccuuuaaaccccugaaccaucuugccagccccuugccugccuccugguguguuccuggaugaaaggucauaugcagguagaagaggagagacaggacuggcuugagagucugugccccaugagcacaaagcccaccuucucucccaaaaugaggucccccccauugccuuuggcaucaugucacagguggacacaggcucucuggccgaccuucuggcuggagcgcagcagcagcucguuggcuuuacugccucacgacguccaccuuccugaucaaugcuuaucaguuugccaagagacagagcccgccacugcagagauugaucccaguuauuuaucucccugggcccaauguaaauuggucaauccuauucgcaugauaaaaaucauaaugucucaaauuacuuacucaauaaaaugugggucugucuauuauuagugaucauuaggguuauaaugcagccuggaaauguggagcaaauuaacugcucaugcaagccgugggcccccugugugcagcuaaucguaugcacaccguuccaccgggcagaaggguuugcaagagccauuucagaguaggaagggucacacccauacaccuuuuucuucuuaaucugaauuucucaaaggaacuuuuaccuaacauacaauggaaccacaagaguuaccaaaaagaagaagaaaaacaaaauagaaaaaggaaaaaguagaaguauaacuaaaaauaaauaacguauuuuaaugguucuauucccgugucauuagauuuuugaauaaugaugcaucaaaauucuccuuugagagaacucccacagaaccccuccuuucuugucugucugucugucugacugucugacaacaguuucucucccugaagcuuccuacucagugacaucacgggacagguucuauagucacgaugaguucccaucguaccuuggccggggccauuuccucuguggcacaggcuuccuggacacgugggcaggugggaggcucugacugcaacggcuggugucuggauaugagagagguguagcuuugaguggcagcgucaguuuagaagaaaaugaaaacaauacucugcguguaaccuguuuccugugagggugucaggaaaccucacaaggaacuucacagaugaaaacuaugagauaaauagaaauaauggcaccgugccaggaaucggacauuuuuacagguguucgguguauauaaagauuucuucuagagaggauggcuuuuuuuuuuuuuuuuugcaauacagucugacacaagauccaaaccaaagaugagauuuaaauggauuuaaagaaagccccuaccaccaccaccccuaauaaacaaauaaacaaacaccacaaaaaaaagcaaaaaacaacaacaacaaaaaaccacuuuggaucaggauccuacuaguauucaagugcgccugacuuuaggccuguugggauccagguucauaaaugguaccaaaggauuuaauuaucucuuucucaguuuucaucaaacaccccuccuaguacuaccaaaggguaggaccaccaccauggcuucuucuuaggccacucuggcugcuuuucacucuggaccaacaucaugagccagaggcugcgaaacucucaucagggaggccucugcccugugacccuuccuagcaccaggaaguaacguuagcuucuaaacaaccaugccuugagaaagucacagcggguggcagcuggggagggggacccccaaggggcuuugggauauuauaaacaaaagaaggggaccggguaccaagaauggaagcugcaaagguccacucuguuuaggcaugcccuggacucaucuuuuaguguuuaaagaggaugaagacuuacggaaaggccuaggggggugacuguguagacagaggaccccaaaggugacugauguugggagcagaacagggcucuguugaagggcuuggguucaggagacugggaaugacacuuaauaacuguaauucugguaacugcucuuuugcacgugucuauguauguguuauauguguaagcauguguauguguguaugggcuaacgcgugugggaucucugugugugugugugcaugaguggaguggccagagguugccaucaaauaucuucauagacauaagacauagaccuuacaugcugaggcaauuucuaucauuaaauccagagauuggcaauccugccagucuggcuacucugcuugcucugacaauccucugccucugccuccugggaccuggggaccugaaguggugguucucucccuugugcuucaaacacucuacucaccgaacccucugucuagccuagguaggccugaucaauugacggacccucauuaaggccuccauguucugaaguguuaaaaugcccuguuguauuagaguuuuugguaagacgaccgaucagauaacaguugugagucauugcaucguuagugacugcuuuguggagagauuuucaaauuuuugccaugagcucuggaagaugcaaagcuccuugaaaagagcauuucugguucugacaagaugacuucuccguuuugaauuuaauagccagggagagcgcgucuuuccgaaacacgcacugggauuaagcgcuuggauaacacacagacuucacuucugagggagcagaaugaaaugcaagccugagauucagugauacucacuggauguuuggccuaaugggaaacuggccagagcuucauugccaggugugcagcuugcagcuugaaauauggcuuggcuccuccaucauagacacacauccuguguggccucugucccucagauguuccagugacccagauauaaugacuucucuuuucaaccagccuccuaccuuucaaugcacucaguaauguguugggccauucucaccucuccaucuuaucuuugguucugucuuggggguaucaucugcaucuacuuuccaucacuguggcaauaagccaccacaaauuuaguggcaugaauuaauaauucaaauguaugucuuuacagucaagaauacaguuuuguuguguaucucuaccugugguuuuguuuuguuugaaggaggguuuugguaccuuguuuugcugagguagggucucacccauagccuaugcuggcuucaaacuuuccaucuuccugccuccacuuccgaaauucuagauguauuucaucacccuggcacacaaguccuaaaaucaacgugucauccaaucuuaacaucuauagcaaaguccauuccuuaccuuuuacagauucuagacgguugugacauuccuuuguaugugaccccuucuuguaggagccaaacacaucaucccagccucuucaugggcucauauauccucguccuuguccucuuccucuuucucuucucuagccugucaucaugcaagcucuaacuuugaccugccuucuguccuauuuguguguuugugcgugaguaaguguguguguguguguguguguguaucuguguguguacaugugcacaugcaugcacauacaugcagagguuagagaacaaucuuggcuaucuuuccuccagcacuauuuaccaaguagguucuuuuuugaguaagggucuuuuaccagccuggaacucaugggauaguuuaggcuaacucucucacauaccccaggagucucccuacaccugccuuccgagagcagacauucaagcaaacuccucugugcccagcuuuguuugaccuuuguucugugcauuggacucaggugcucaugcuugcaaagcaaagcacuuuacccaauaaggugucuucccagcucucuuccaucccuuuauaaagacccuguguucagucuacucagauaacccagcccauucccccuuucucaagacccuuaaccagagcugcaguauccaccuggcucugucaaguaaugucaucuccacugguucccaagacaaagaugugaugucccagaaagaggacaugcuucuccccugucauucuuauauuuggugauggcauagcucacaagugugaauguucccugcaaaagggacuuugaugcuguugaagguguccaccguuggagagcugggaaugugagguguggcuuggcccucaccucugaccuuaucucccuacagcaucuaaccucugugugcaucucagcuucugcaacugucaaaucaagagguagaugaggugcaagguccccucggagcaucuaaaugucuuagauagcuuccaaugacugauuugucaaaguuucauaggguagaugaacaggaaguccccccccccacacacacagacauggagacuagaaguccaaaaucaagaugguggaauggccguaaccugugaacacuuggguaccuuucccucgccacgcccuagguucugguggugacuggaaguccuggggaccucuuggcuuguggaaccaucaucucaagcugaaccucuuuuaucaugcaggcugaugccccuguguuucugucuauuaucauuacuuauuauuuuguuauugcuuugcuuggggguaaggguuucaugguauucguuugagcuagccuuaaacuugcaauucuuccgucucagccuccaaagagcuucaauuauaggugugcgccacuacuccuggcucucaugaggauaguaguccuguugaauucuuuacaugugugaagacccuacuaccaauccagguccucuucugaaguccugagauggacagaaaucuugggacucccaugagggucuguguucagaagguagagaaggaaguauguuagaaaggagagaugaggcuuggugacuuuuucucagccuuuccccuugacucuguuuugugaccauagauggaaagucacaucccagggcagcugcacuguagguacucacucaaguuuauuuguacuccaaggaccgccuaacagauggccgugaugucacuggcccugcaaugcugccuaccagggugaaaauggcaaccugguaacucauugacucaaagccacacacuguucuaugacuggauugaucucaaacagucauacaaucccacagccucaacacuuccaaggacucauagauaagauaacccaacauauuuccuauugcuuaaaaucugaacuccagagucuccugcaagucucaguccuguggucagaguagccuaagacccaucuccuuccacucucuaaaaagauagaacucuucaaagguacuugguaaagacacuaaguaacgaguuucagaucccagaggaagacuguguuuuauuccauagggcacacagaagccuccuugacaaaugcuugucuuuagcuuucuauuuuugaacuggagggcaggccagucaggagcugaccugugggagagcuugggggcuguguuugcagcugagggaaguggucaugaaccuugccaucccugauaaacccagauggaagcucagagccucccggccccgccgccccacacacaugcugugcaccuggacggcuuucuaccuguuuacaaauuaccccuguuuucugcuugguucagcagcaacuguuuacccucccccgugauguaauuagggcuucagaguucacgggugucuauuacgagcucuccuguguuuugucuuggcgcuucguuucuguagcaguaaucauauauauauauuaaaauuugguaucaauuguuuggcuaaauuaugcacagugggccauccuaaccugccauuaacauaacauaugcuaaacaauguguugauucccuccccacaucccccccccuuuuuuuuccuucucccugauaauuauacuccaaagcaucaauugcuuauucgggcaaauucaacuuggaguuuuucucauuucuucaaacuuucaaauagucucgcuggcagcagaugccgacccagcacuccuucagcugccuucccagguagcggggcaguuuucuugcugagaaaggcaagugccacacaguagucacugccaucagccuugcccugaugcuccaagcugagccacuguuggggauauugucaaugcuauuccaagcggagcagcacccaagccuuggggugaugaucaaaacuugccacaggugucgcuguacccauagguuccccuccuuggacaaacagcaaaucuuaggugacaggcacacauacuggacaugggcauacaaaaagacugaaagugacagguuucugguccucugacaacuuauaaucucccgugaggaaucugcaauuuauuuuucucaaagggguuguugaauaaguguuuuaagcucugcgggcuguauacuccaucucagcauucaauucagcggcugcaacucagcagcagcaagccugugugacaggcaaacuuuuauccacgaugaaaauugggccacauuugccaguguuugacccaguguccaggcagggaauauacccaaaguaaugaaguuuucuuuguaaaugaauuaguuguauuuuuacgugcaugaguguuuugccugcguaaguguaugugcuccauacacaugcagugcccuaagagaccagaagggggugucaaauccccuggaacuagaguuacagacuguugugagccaccacacgagggcgggaaaccaaacccaggcguucuuugagggcaguaaguauccuuaaccacggagccaucucuccagccgccaugguuuagcuuuguugauaaugauacgcuuagacugugcuacgugacuuuucucagggagacaugagccgacagcuauuccucccagaggagggcuccaaugauuaagcaaagaaaugacugaauguaaauccaguuagugagaagccgagccuacuggccuuucuuacaagagcaucguaagucacaaauagcaucacuaaaaauccuaccccgauucaccaaaguuguacccuuggagcccccuggagaacccacccccaccccccaccccagccuccuguccuauuuccaggcagaucuugucagucuccucucccuagcaauuguuacuauguguguagguaaccuugaaaggggccuguaagucuuaacgauuuucuuaaacuuccugagccuuguauguuuccuuagcuccccaagucuuuugugccuaucuuaucuccaggggagaaggugucaaacucuggggucgcagcaaaaacgaacacugcaguuagugggaggaagaagacaagggcaugauguaaacaacacuaucccacugcagaacaccagggcgcaucacaccagggugcauuccuaaaaugaguccacacugauuucauggaugagugcacacagggaugcaaccgagagaaucuaaaaacgaggguguugacuggcccagagaguauguaacccauguguggcauaccugggacaguccauagagugugaccugggaggcccagcuucaguggcuaguuaaaaggugucuuuggguuuacaguggagucaaaacuccaguacugagcaguaagcagcagguagccaugcgguagaggucaggaugauaagucuuuguggccacagggggaauacacauggaugggaguacucugggacauauuuaacauuaccugaaagaggagaguaugaguggggcuuuggaauaagaagaggcuguuuaugucaguaagguuugaaaggaugauaggccaauugugguucuaccaugguguaacaaggggaguuucuguacuaauuucucaccuccauggggaucucuauagagguaugcuaggcugugcuggucuuaaacaaggcucuguuauuacagauauuaugccuagcucaguuaauuugcuuuuuuaucucugcaugacauggggauuccaguguagguucaauguguauguaauacuuuaccuggaguggugguucuccacaugucucucauccuccugagaucagcaaagcccaaccauuucuccuggcagaagcugaagucagcaaguggacacacaugagccuucuuggggucuaggcucagaacugacaggaguuccuguuagaaaccuugaacagcuguucacuaagucuguuccagucccaugcagaaaacuacauuucccagcauuccuugugguuucgaauggucaugugaccaagcaagaaucccaggcugaggcaaccuugagaagcuucuuuagucauugcaagucacagaguagagcccaugucucaggaacaguguuuggaagggagcgaguaaauaacucaccagaucaccuauuuuaucuuauaugucagugagaaacaaacugcuauuuuauuuuaaacaucaugcgauugggcuuuccauucaugauauaaaaauagccagugaaucucuuuuuccaagacgacucuuuucucaccacuggccaguacuuucucuauggauauuuccucccaacaggaucaaaucucaaaccacacguccauuaacuaauuuuagggaacacccaauggacagggguggaauucacaccuauuuauuucauugggaugauaacagauggaauggcuagugcuuccuggguaauagcccugugguuaggccuaaguggauggagggcuguggugcucgauuugagcgaaggcccucagauggugacagauacucauggcugcuaaucucggccguaauuucucauuucuccucaauggcuucacuuuuuauggugguuauauugaugaaugcagacgauaacugucagcuuggcugggaaagccugguagaagaauuuuaacaacccagcuuguauuuccuaaaggcauagaacaaggcuuugggccuucacaggcccagcccaucuacccaccucuucucuuuccucuuccccugaaccuaugcuagcccacagauuuuggaagauuaauauuucuacaguaauuacaaugcaaaccacuacauuuuuuuuuaaguccccacuacuucauauccaauccaaguacaaagaaaaaggccuacaagagugucuauccuugugcaguggccucucccucuaucaaggagcuuagacauaugacuuauuuuguaucaacaggaugugucuuuucuguggcuucaccaugaccaucaagacugucuaaguuugcuauggucuuccaaaccaaagcuacucaguagguccagugagacccaggaagaaugacuguguccuccggaucaugggguguggggugcagaacagcagggggagggaauggcaggaccaggcagggacgcaggagcagaauaaagcagcuaagcugaggaaaagaaggaaagggagccuugucaucuucuuuauuuucccaguccaagggggugugugaaccuggcuucuguugccgugauaaauaccccgccagaaaguaacucaggggaguaaggguuccuuuggaucacagcucagaggugacaacagucugugacuaugaaaagguuagggcaggagcuugaggcagcgagucccaccaauaccacaggcaagaacggagagcaggcacccauacuguaugcuugccgcuucuuacauucugcuggcuuuguuccuugucuuacacagagcuugguccagcuuaugaaagagcuccacccacacauaggauaugucuauauggcuucccccauccauuaacagucaagacagcccccccccaauagacgugucuacagaccauuccucaauuaagaucucuucccaggcuauucuaccuagggucaaguggccaguugaagccagucgacaggaggaacaacccugaagcuaaguucuuagagaaaguuaugcaucaccuuuugcgucuauguggaacagcucaaugggaggccaugccuuucuauaccuagaagagcagcuagauggauggggaggccaggguguguuuucuuauugagugcaugcauucuuucagccuuucuuuuuacauaaguuuauguugagauuuaauuuccaccaauuagaaggcaagugaagucauuguaauggguuccuccaccacagcauugccuccccacacacaggagggaaugaggcuggagcgcauuuuaaguagcuaaaguuucaccaggcugcgagugcauauccaauucaauuucuggaaaaaacuuuagauuaauuagguuuauaauuugcacaguaaggcgauguaaauguguugcuagcacuuggguuuuugcuuaauccucggaguggaugcuuaaucuuuuuaauauuagaauuaaagcaacucggaagauaugaauguuaaucuaauuauaguccgaucacuuuaauuucuuuaauguuuuaaacaacagaacaacuuuacaaauugguuuagguuggggaaccucugagagggcccugcaucucaucaguaaguguaguggaagggagcugggcuuugggagaacucucuuaaguuuauaguuaugcaaaugcgagccauuaaucccuggggagccuggcacuuacaaggugugccugagaaaucccccccagccucuaagcuuuaguuagaaggaagccaccaacaggagcaaauagcucaauggcaccgcagccacccaaagccagagcuuucagagaacuuggaagauuucucucucuucucuuuugcugccguuauuaucucaaagagagugggaggggaagaaaagagaaagaauccgagcaggacacaaacagugcuugcaaauuuuaucaccucauuauaauugauaucugcucucugagccaauaaaaggagccguauucggcacuagcgguguaaaaucuuuaauguuuuaggcugucaagaguuggccguggugagguugacauaauuaucagcugaauagaccaguauauaagaucuuuaccuccccuaaagcaugcugcaccagggaaugcuccagagauggggaaaggacucaucaagcgugcacggauugcgcccuggcuucaagcuuguuuuaguuaagucggcaagaacaccccagagcucuccagucucuuggcuccuacuugguguucuggacaaggcuucuaaacaggcugcucccuugcuuccugcaggggcgaaucuucaggacgacaauguggagaagcccuuccgaauggugcucccuggccucucagacgugauaagcagaauucaucguuccugucuggaacuaauuauguauuuucauaaacuagaaggcgguggaaaagaagccaagguuguguuauaaaaugaaccauaaguuugaaaauuaggaacaauuccaaugcauagcaauugaguucccccuccaucccauaaucggagagcacauuacgucccuccaucccauaaucggagagcacauuacguauccauuacgcagacaguugccccacuggccuguagacuaaugaaucacuuugauggaccuccucuggggugggguaagcuuagaccuaaaauggcauccagugccagugacucugaaacugagaaaucauucaaggacaaaacagaagggauacagaaacuccucaggcauggacagucuagugggacagagcaaccaauaggagaggucgccaggccacuggcuaccuuguguugcauugcguuugguuaacauuguacauuugcuaccaugguaaacuuagaaaaugaaugcaaacauguuccuacucacucacucuacagguucccggcugaguucagggagcacccgcugaggcuuuuagguucuuguguucugaagaaauaaauuggguucaaggacucacgaagagagacaauguagaagaaaaagaaggaggaggaggagagggagagggaggaggagggggagagggaggagaaggagggggagagggaggaggaggaagaagaggacagggaggagggagaaggggaagaagaagaaggagaagaaagaagagaggaggaggaggaagcagggggacuagugaucugagaaaguaaaacaaaacaaacaaacaaacaaaaugcugagaaacauuugugcagcaggugaguucugacucuuucgagggcauuugcauagcauuugccuucuccuguguguauguaacagacauuuucugugugcugcauguggcucggguagggaaguguuuucacucuuucucugacaacuggcuccuuuccuauauuaaucuuuuaaaaauuaccuuuauuugaggcugagagauggcgcagcaguucagagcacuugggguucuuccggaggacccagauuagguucuccauacccgcgugguggcucguagcuuugaguaaugcuaguuccagggaauccaacaccuucuuucaaccuucuuuuuuuuccccugcauguaggaaaagcacauauaaauaaaauaaaaguaaauaaaucuuuggaauuacauuguggcaucucuguguguguauguuuguguguguguguguguguguguguguguguguguguguguguguguguguguauguaugugugugugugguguguuuguuguauauauaugugugugguguguucuguguguaugguauguauguugcauacguguguauauuuugugugauaugugcaugcaugagccugccuguaaauuuuugauugccucacccccgcccccccagcucaccaauagcuaacaaaggcuccucuacuccccagagccccucccuguuagguuguuuuuugaagaagaauaaacagccagagcacacacccuccaauguaagagauccuggcgagcaagcauaauuuucauaugugcccuauagaaguguucggccacagauuugcucuuccugaaagccaggguaaauggacacaaccucauugcucugaggaugcugagcuuaggggcugggcucuuuccuucuuuuuauugguuugugugguuggaagcaggguggggugggggugggggaucagaaagagcagcuccucggaugugugcgucuccuaaguacugcgucgucuuccuuucucugcucucgugacuaaucuguuuagcaaguauuuuccauggaguggaggcuuuauuggcagaaccacuaacuuuaauaacagaguuuagcacaacucagcuuguaaaaaacucagucccucuauuaaacccucagcuuguaaagccgucagcccucaccagccccuuuuuaaugggcguuuuccuuuuucuuuguuugcaguuuuguuuguuuguuuguuuuuguuucaugaaacagggacucccucucucugugaggccuacucagaaaucuuccugccucaggcuuugaguucugggaugacuggcuugcaccaccaagccacaccucucuucucuagucuuuuguuuauuuauuuauauuuucuuuuugagacaaacucugguguagcucaggcuggcccuugaacucuuuugugcagccaaagacaaguaaccccgacuuucugacccucccuccuccaccacccaagugcugagauuacuggugugcucuaccaugccuuguuucauuuggcaccagggucagguccguggcuuugugcacuuuaggcaaacacucuucauucuaaacuggagcuccaagcccauucucuguucugggggacuucgaucaugacacuuacuuuagauccaaagagucagcuuucuuuuucccacuugacgucaagaugucuuaagcuugggaaugggaccuagggaacccugaaggaacggggaauucucuagaaccuuggaauauuagcgcuuucauagaagaaaaucuguaccucggcaaagagccguaacggcacaagcgacgaugccccuuaguuucaauguagguaagcgucauuuguggcaaagggugacgugggacaaauguauuauuuacuuacucacgucacuugagugacauuacucucaaccuuggcaauccuaaaaugagaugggauacacuuugcacuuaggacuguucuguacaucauuaggugucuggcagcaccucugaccuuugcucuguaccugccaggagcaucuauuugccuuagaccagacaagcagcaucucuaaacaugacaauguccccucccuugcucuauugagacugauucucuccucaugccucugacucauccugucuuucuuucuaaguuuauauuaccucuaagacauguggaaauuugaacuucauucucuuuacagaaagacaaucugcuuuuuccaaaccauuauuccaaaaaacaaaacaaaacaacaacaacaacaaaaacaaagcuaaaacaguuuucauguaugccagcacuuggagccuguagaauauggugcuaaaauuaagaauacaucuaugugccccuaacugccagacauugauuaucuauugcuuucuaaaaugccauugucaauauuguuccccauuagaaguauggaggagaaaaaaacauaugaaagaguucuagaaagugccagaagugauuuggcagccuuggggcagaauggaagcgcuuaacccacuaauccaggaugggcacucagggagugcucagcuguuucucagaggcacugagagcauuucagaguguggagcggaguuauaguucuguuaacgguggaggcaacaauugccugcaccucuuucagauccaucgucaagucuuccagcagacucggguaugccagccggcuugccccagcaugggggcacgaauuggaguggaaaucaaugggcuagcguuccgaugcaauugccccaaauuaucgaagagaggagaagaccacuguaauucaccagucacggcauuuuuaucgacuguuuuuuggcuaagcauugguuuggugugauuuguucaguccucaggcccagucucaccagaguucuugcguaaauaccauuauuacuguggccauguuucccuguugcugaacagaaccgggggggggggguugaucuaccuuaacuccugcauugccauaggauacuuggugacuccugggguggagggggggcacuacagacaaaccuuuuacccuugauggacaacuugaauugaccccaucuccuaccaagucccugcuaagcagaaagcagagacacuggucuauguaacugccuaguugugguguuuuuccggggagcccagaguccaguccguagacgaucucaaccacaagaaggugaauccaggcauuggaaguauaggucagcaacuaauaguggcccguugcugucccagaacacgcacgcuuagguuccaacacccaaguguuguaguuuagcuccaccuauaacuccaccuucaggggaccccucgggccucuacaacaccugcguucacaugcccaagccuacauaaagacacauacauauguacauuauuuuaaaaaauaaauaaauuuuaagaaaagccaccaaggacggauuaugaauuccagcucugccauuuuguggaccuuucaugguacuucccccacccucucagcucuguguuaaugugaauucuuucugugacaacggcauggcaugguccccucucuauguugaauuuaaaaauaacuuuacuauccuaaauuucaccugauguccagaaggcaaaauguaaugauucucacuuuaacccuuaugucuggcucacucccuagucucugccuguacucaggcagugcauggaaaguaguuucacuaaagacacacccaauuucuuucaaaauugaaugcaucugugucugaaguucaaauuguacugugaucugucaaggucuuguugccacuauuuuguuuggggcugugcagagguaggagccaggaucucucucucucucucucucucucucucucucucucucucucucucucucucucucacacacacacacgcacgcacgcacgcacgcacgcacgcacgcacgcacgcacgcacgcacgcacgcacgcacgcacgcacgcacgcacgcacgcacgcacgcacgucacuuuauauuggcugacaauucccguuacuggaucagcuagaaaagaccucauuucuauaugcacuuuaaacccagggaaaccuggaaacacagaucaacaaagggggugcugagcaccucaaagcuaaaguaaaguuaaaaacaaugacuguuggacagauuauaguugcuugucgauaacaccaugcugauagcaugcauccacgucaacaacacccacuuccggagaggauuaucaacucuaugcuucaugggaaauuccuccuccggaaaaaugauguuuaaaauuauuguaaaguuauguuuuaacuuaguucacaggaagucccaaacagguggaagacuuagguaacaauaaugguguuugcaaggaauuuauuucaugcuaggauuacaugaauaugccacuauaguuuguugucaucuugaaacguauuguuuugccauaaaacacaggguaacggcacucucauacugaaguccuuaaucuaguguguaauugcuuaagggaagacauuaacuacauugucaacuaccuucucugaaacagaaggacuaccaggaagaggugugacuucugcagcaugcaaaacaaaaacaaaaacaaaaaacaaaauaaccaaaaagcaacaaaauaaaacacaaaaaaacaaaaaagacaaaagaugcucaaccuggcuugagaauuugcugguggggucaguuuuuguaucaagagaagagaggaaagaagaugcagagacuuugucuguggagucaaccaggaaaguucugauugguucuuuucuuacacuccugccauccauguuuguugaugacaguguugcauuugugcuacuuaagagacacucuguucugauuccuauaccaugccuuccuccuccucucuguccuccuucccucucuuccuuuuuuuccucuucucugaaguguuacuuuuggucccuuaaguucaguaauuuagaguuuguccuugguaauucuucaucagagggcuccauuuuaucccuuaaaaacaacaacaacaacaaaaaccaacaaagcugauaaauaagagaccaauuuaggcuguaguugauuauauuucuggaugugagccagauguguaguuaaucuaucaguauuccuuguccucacuugcauuuagagggaggcuuacaggcccucucuuuccgcugcuucauuuccuugaacuuggagaccugauccacgaucaucccccucugcccccugcuaaaacaacaguuuuugggauaauacagacgcugaaacacuggcucugccagccaccuugugaggacaggcuggccuggguuuuacagcacauuccucucucugauggaacacuggccacaggcuguggcuuggugagaaucuggaaugaaauuccagaugaauucuaggugaaguaugaaauguggaugcccaagcuuucugaugccccugccaaacgcagaggagucuuagacuguggccugugcccuggaaccuuuucagugugcgcuuaguagagucucauuaugccugaccagcgcuuacugagaauaaccagcaagcucacacccuucuaugucggggccaggcacaccaggaagaaagucgagaaauaccuuucaccuacucagaaguuacuggacacuugugggguaucucuuggucucauuuuacaaagucaauuacaaauggaguuucagucucauuuuuauuuaauguaaccaagaggucauuggcaguauacggagaagcccuucaagggauguggaugcagcucagguuggcccagaacuuggcuuagcaugcaagaagauaucagaugugauggcucaugucuuuaaucucagcacaacugaggugaagaucaagaagaucagagucucaaggguaucccagcauggagaguccaaagguagccugggcuaugugagaucuugcuuuaagaagaacaagagcuuuagugcauucuuuuuaucuuuaagauuugcagugucucuguggguaucuucagacagcuaugugugcgcugugccuggaguggaugauggccugugacugucacaacuaauggugcuugaucaaugcuuauuacgugccaaaggcucuugugaggacccccuuccacccccaaaaaccauggaauagauguuguaauucuuguaacagagagagcguaagcacagagauguuaaaggacaugcuggaccugugauggcaggcccuuugggcagaauccagauuugcagacucacacugcaucugaggccauccuaggggcacaucccauggaugcuaaagagacccacguuggaacuaaggaccugucgcugcuugagauuaaggaagaaaugauaacuguauuuucuacugggugcuauucccaaaccugccuuucuugucugaacuguuaagaaggcccauggaaagccgagcaccguucaaaaggcuccggcucuggucaguuugguacaccacucaagaguguggagauguacugacuaaguggacuaagugccugccucccugucuucuugagaagggauucauguagcccagacuggcuuugaauccaugagggugaccuugaacuuccuaucaucuugcuucagccucccaagugcugugauuacaccacgaugcccccgucuauggggugcuggggacagaagccaggacugcacacaugcgaggcaggcaccauccccagcccuaucuucucugcuugaaagcauccagaucucugacaaaacgcuaaucguaggggugaggguggggugaagggacggaggcacgauacacucagugaccacagcugcugcagcuguugacucuaucacuggaccggguccauugaccaagacucagagcugggucauuggacauuuaaggucugaggccgcaauggcggcugauugauggugacagcggcuucugggaaccaggcacacuaaacaggagagauggagaaagugaagacuggacuugugcugcugcccuguccccaacccuugcuuggagcugcuccccuuuggguggauuugaacaucugcaugcauaguaacauagagcugagcuaauguccaucucaggcuggcacuguucuggggucuuuacauauuauguccucaugcccuguaaagaccagagcagacuuauauggcggacacucauauucccuuuauuuuaauaggaugcauaguaacuauagaccaggccauuggauauggucucagugacugccuccuaguuccagcagccgaggaugcgggaaucacguucucugagcaaaggaugguugaggaaaccugugugcguaauaggcuugggcuuggaagugugacaguggacuguccuuuccucaguccauucgguuucagagccuggaguggcuggcucccccuaacucaaggaggggaggguggggagaaagaagucaagcaggcaaggggcaccagcacaucccacagugugaauccgcaaugacaucccaccccaccccaccccugguccccgcccccgcugccguauucuugguucugcguuuauuaauaaaaugcccaguaccuucuggcgugugcuuugaacugcuuuuaauuaucuccaguuggauggagaaaagguaauggggaccucauaaucgccguggagggaacgauuggaauuuuauuuccauggggggaaggcagacauuguuugccagaggaguggagagagaggccucuuucaaaguugaggacacuucccgguaccacacagcguaaaucacugugcaaaccacgcgauuauccccugcagaggaaucgagugugucuuuaugggauucuucaccaagcacuuaggaauaaucugauauaaaacagcgggguggaaaguaaugacaacuucaaauuaguuuaaugaauguuuacauuuaaagggggggguuggcuuuucuacaauccugaaaauacaaaaugacagcucucucuccuauuucugucuauucugguaacccucacccgcuuuuuucuuuuuucuuuuucuuuuuuuuuuuuuuucagcccugggagaaagguggcuuaacccuuucagugccugggcucucuucucaaggacgcucuccuuuguucggcuuggguaggaacaggucuccaaacuguuguccauaaguagcccuguuauacaugcccgggcagcuuugggagaacaucuguuuuaagucaacucugacacucaauccaggaaaaaaaaauuccuggcucuccaccugcucaggggucagucacccacccacaccaggcagagauggaugguggugugcagaugcccaggguauuuuuagcugcauguuggcagguaccucgcuuguugaaugcagcguggaagcgaggguuuugauaugccaucauguuauuuaaaacuagggguggguaccgcagcccucaccagaucugauucccuacuucugaugaagaaggauuuggguuggcaaaggaaggagaguuggagauguucccaucacucccguugugaggaguacaccucaggcugcuugguccaagggacagcauucaccuucagaucugguuauccaaccuaagcuauccuguugcauuugaaagcaacauuccagcguguucuuagcuauguuuccaaacgcaaguauuuccuguuggguugguucggggcccccugacauuucugacagacccauuuccauccuaagguugccaaccuggagauagaauucgaguggcaaguuaugcaacuugagccaggucuaugagaacaguauggagaacauuaaagcaagaaauagaaagcaaaugguagccccaaggguauggaauacccagggauguugggaguggaaaggggcaauuccaaacaccaauuuagaagcacgugccaguccguuuuggccuuguaggcaugguuagagaaguccaacauacccauggcacuguuguuuuugcuuuucucccaugccugccaugccagcaccucaggaaaccucaguggaccauccacagccuccaggaguaaaaauaguuccucagcggagcaaggcugcuuuucugugaaauccaaggacuuaacaacccaauuagccaauagggugcgugccccaggagggccaaaaucaguuuugaagugggauuugucaaaggcaacaagauuccuccgaagcaaacagcuggccacucucacuuaacucaaauaucgcaugaacccagacccucauuuuccuggagguuucucuagccuggcuguuggaggagaaguugccaaauauuuguagauuuuagaagucuuagaagugggcagaacuuucuaguucuccagcaggcacuacaaucaaccucuugucugggguuuauguaaaugaucuuagcaaacgaucuggcucuaaggagcuugcuuucgucagaggcaaaggcauauuguaagauauacuuuauacgaagucagaguccaagagaaggguguuggugcagagcacacuaccauggcccuggcuuccguccuuuagaaagcguguacagcugaacagaggaacaagaucaccauaacaguucaaacugcuagaucagaggacccugcgagcuccccucacagggauaaacucauaguuuaucucccuguaaaaacagacaucaucccaaaggcaguuuugaagauuaaaugagauagcacgugaagaucacuugaucacaugaaggacagcacccaugguaauaauaccaccuguguuagcacuugcguuacagaccacaugugucauagaucagacgugugccuggagacaggugguuaggagcaccuggaguauccauaggaacuguugcucccgguccuccugugagucgucaaagguggcacagaguuuucuugggaagaguuggggggaagcaauuguugggguguccacugucugguggcauuccuuugagggcugaaacgagagagggugacagcagagacucaauccugagcacgaggacaggacucacggacucaaggggagagggcaggucucacagacucaagagggggaccauuagucuaggugagucgucaggaaguaagaagagugacagaaaagaacucagccuguaaauugucugcccaggaaugucacgccagugugugggcagagagggacaagaacgugaggagagaagauacugaguagaggaagaaaggaaccaggagguuuugauggcaacaaugcaccaggcaauaaugcaccaggcaacaaugcaccagggugggugguuaauaggcaaaggagcugcguguaccagcacaccaguauacaccugcauaaacgugaagggacauuugcaaagccgcaggguuugaugggaugcuuggacaaguucccaagugcaugcauacuugggacucaauuucggcacccaguuggcacuugcucuugugaguauuuguaggcguguuuguguguguuugcauuuguauagguguguaagcacuuguccacacuuaccuacagaggccagcagauagcccugggugucaucucucauguuauccauuuauuuauauuuuuucuuuuuuaaagauagggucucccacugguuuggagcccaaccagccacagggaaccaccugagaucacacaggugcccagcugugcccagcuguuuuuacagggguucugggauagcagcuccuccugcuagcaaggcaaguguucuacccacugagccccacuuugcuuuuggugagaguuuugugcucagcuguuaggagcaggcacuguccauucagaagacuagaguuaguccccagcaccccagucagguggcucacaacggccuguaacucagaauccgacgcccucuucuggaucccauggauaccugcguacauacccacacgcagacaagcacacaauuuaaauguaaugaaagcaaagaauuuuuaaagcuuuugcuuuuccuuacuaugggacaauucagaaagacaguaaguauaaaaaccugguggaauuucgaugaauuaguuaguuaacgauacgcuaugauuaauuaauaaauuaagcuuccagaauuuucuuauguaguucccaugaccaguguuccuagguauggcucgucagugcuuuagaaugcuuccacagcucuugucuuccccguccugugccuuccccccuccugaacuaaacaucuaacccaagaccaacauuuucaucgugacugcuggagcuuugcuaagccaccccagcuucaucuccgggccugucuccugccuccccuucccaccaaccuaccaaggucucuuucuuucggcuuguaaccuuugaacuggcacuacccugagccccacccccacagccacacagggcugguuccugcugguuguuucucaaucacugcacccucuucuccugucacaguugucucaggcaguaauugucccaauugucacuugcuuaacaucugugucuuacacuggaacauuacggucuccaucagggucggggaaaggagucuugcccucaguauagugaacagcauuuccaucguacgcuuguacgcuuaggcacugccgagcuccacccagagucuucugguugaggcagcaaaugaacugagaggggugcaugauuuccaggaagucuccuuaaauguccuugcccugaaggcucaccucccuacagcugucaaagcccucagagggcaacauuagggccagacaugcaauuguuugagugcccacccauuucaauaggggaauuucaaucugccuuccucugggggccucuuccccuccaccagaaagacuuugcuuuguggacaaccaucuccauccugagagucagacgagggaccauauacuuguggcuugucagcacuuucuacccucacuucuggaaguuugcauccuaauuuugaugguaguugcagcacccacugguacccauugucaucuaccacgguaaugucuggcagauggucuggcugggugacagagaugaugggugaccguacuuuccugucugggaacucuccuggguuccagccagugaugccacccuuuuuauggagucucucuuagauacccacuuuacuaaagagaucuucccagaaaucaacguguuuaacaguccuuuuucuuaucuccaaguucugaccucugaccugcuugcuuuguucuuccuaauguuuccauuacugcacauguuacuucuucuuuuuuuuuuuuuuuuuuuuuugguauuuagggggugaucuccuccucuacuagcagguaaacccuccacaccaucuucuucauccaugcaucagauccuggcaaaugcacagaagugcccggucaacaccuguuuggcugaagggaaggaagugcugcuuacuugacgucgcaagcuaugcucaaauagcaaaucuuugcuuggcaucuugugacaaagccagucucaccagauggcaucuccugggauugccuaugauccaggcaaaagauccccagugugccaauaaagaauuugccuucaggcagaaaucuacacaaaagcacacuucuugcacauccaaaugcaucuuacaguuggccaugguugcaggcugccugggccugucagcuguguaagcaagcacuacccagggcaugcaugggucaagggaggugaaagaggauugcagacauaccuuuagcguuaguggaaugagauacaggugccugaggagagagcgaugguguaugaacuuugugaccuuuguaaaaauggcaacagccacuggugauauuuaugagcugucuaaggcacuagacuaucccaaguaccucccaaaauuuuagucuuucgaagccugucacaaucuuaggggauagcgcaguuauguccccucauggaaguacgugggggaaagugaggcaggguuugcuggaguccuucaggggucagcagcaagucccugugcuccugcaggguaccucuucacugucucugccuacccaccccaccugagacccaagugucccggucacguugcucauuccccauugucgucccuaugguagguaacuuugaucaucuauuacacuggauuaggaaaugccaagggcaauagugcuaaacaccacuagagauguauagugaugguccuucuacagcgguuagguugaagagcacugucuuacaggcagaggccgcagguugaauaaaagcaggaaagggcaugaacguucucuguucucagcuuccggacagacugagaagugagaacucgucaccuguauaaauccccuggccaugaacuucaccaagccuuccgugccagcacggccuaaaccuuucuagaccaggagccggaauaaauccuucuguuuaguugcuucugucaaguacuuuguuauugcacugaagaaaguaccaggcuugcuuuggaaaccacucgugccuagacagccccagagaagagcuaagaaaagauguuaaaaagugagccaggcguggcagcccacagucauaacuccccacuccaccuccucugugaguuccaugacagccugagagguggguagggugagacauuguuucuuggggcagaagcccacacaugguaaaaucuugcccaaacauuucccaguucuuuuaagcccaggcuuaagauuuaucuuuuguguguguguggagaguggugauggugguagugguugugguggucaugguggugacagggucuucuguaguccaggccucagacucccuacguagcuaaaugggcuuugaauuuucaguaccugcauccccaucccccaagcgcuggguaaacagacgugucaacacaccauuugugugaugcuggagaugugaugcuggagaccaaagcuagcuuggugugugcuagacaagcauccuagcagccaagcuucaugccuggccauuuaucuugaagcacauuggaaaggcaguuauucauaaaugucacaccuccauuuguuagauuuccaagcuguuucaccagugagacucugagcagagaaggcaccugaaaacagaguccagaaccaauguccugacaugccgccgggugagggagguaggcucuugguacugcccuggacaaaggugaagacggccacguaaccucgugaccuggagcgggggagaauaaagaucacuugagccugccgcaccugcccgaucaggguuaugaugaauaccauuuggaauugccaguucuuguccacgcucagcgaaggccgcacgcgcuucgcauuaaucaccacgagcaaacacaggcucccagcaaaagagccagaugagugggaacaaauucaaaacagcuuuauuucauugacagacaggaccuuuuuuuuuuuuuuuuuuuuuggaacucggcuuuaaaaaccuuuuacaucucugucucguucacacauugcuguggucauucauauuuauguaaaccuuuggaaugcaguguggccuguucaucacagccuguggguaggagaagauucgcaggaagagaaccauuacgugaacuuuuauuugaaaaagcuauuaaauaguauaaauggaaaugauacuaccaccaaccauuaugaaguaaacggucgucugaguuuaaagaaaccuuuuacauuucaguguacacauugggaaacagccauggccaggcagugguggcucucgccuuuaaucccagcacucgggaggcagaggcagguggauuucugaguuugaggccagccuggucuacagagugaguuccaggacagccaggacuacacagagaaacccugucuuuaaaaaaaaaggaaaacugccaugaauuaaauuaaacaauguguaucuagugaagauggcaguuucugcuguuagacauugaguaggacaaagauuuaucugggauuaaccuguguuuugguaagugguacuaguuaguccuaagugacagugauuuauaaaucaguguugacucaaauuaccagauggagucaccccaaacccucuugauucaauauccccccaccccuaucuuacauaaccaggaguuacccaaaccuuuguauuuuauagucaaagcaaucuauugauauuaaaacaucuggaauuaucuuaaaacaucuauugaaaaaaaucugguucuuauccaucaauaaauacaguauauuucuaauguauauuguuucugcugaacaguuauuauucuaagcugaggauaaguggcucuagccuguuaucuuagcauggggaggcugaggcaggagaacuguugugaguuugagucuagccuaggcuaugaaguaaagucuaggucagcuacccuaagcuugaaagugagaauccucacauucagccacauaaccccaaacaggaccacacacacacacacacacacacacacacacacacacacacacaccauacaucaaaucacacacacauagaaaauuuuaaaaagguauuuauugcauaggaguuugaguaauucaauggcggucaucuacacguuggagagcagagaaccuggcagcugcuugggucaggaagcgggaagcuuccaccucccggugugaugcugaaggccagaauccccauggauuggugucagauacacagugcaaggcugaagucucaagucugugggcgcugcgagcaaugacguuacacacucccucaggcagaacaauacacggucuugcaaguguaucuaaugcaaagucugggcacggaauuccuauccuugccaguuuuucccaucccagcuacucgccgccguuuagauaacgccacucacuuuuaggguaggucucuccccucaguuacuaucgacaagucaauucucucuggagagguggagaugcgcuucauucuucccugacaucucucaauucagucaguugagaaucaugacuagucaucagacuguccauguugaaggaugccggagaaucauuucacccacgugaggguauagaaugggguggggggagagugggagggguggagggaggaagggaugcguuucuaucccuguuguugcccaagaguacaugcuccauacccaaaccagauuuuacuuuguuuccuuuucaagucuaacuggcuuuauggcuucaccccuccacccccauuucuucugcauuggccguguuuggucccuuaaguccugagaaggcuucccuggcucacugccagcccagacuuggaaucaguagcucucuaugccuguuuccucaaaccaagcuucuuguccuucuuggccuccagcccuaaauuaucauucguguucuaaucauaguucuuaaguugguuccuugauugcuccaagucauucauccugucaguagaaaaaagaaagaaagaaacaauuugugguuccauuucuguguuuguuaccuuucuguugcugggaaaaaaaauacccaagugacugagagcaacuuauggagacuuuguuucgguuuaugacuccagggggcuaaaguuuucaccuuggcggggaggcauggcugcuggagcuggaggcugagagaucacgucuuuaaccgcaaaugugaaguagagagagugaaauggagguggcccgugcgcgcgcgcgugugugugugugugugugugugugugugugugugugugugugugcuuaucuuuucaaggacuuccaccagugacauccaucccugcaccaaggcugcuccuucuaaagcacacuaacaaaccacaccaguaggagaccaaaggcucaacaccacccaagccagugcaaaguacuucucauucaagccaccaugauaucagaggugugaguuaaaucagauuccaggcugaggcuggugggggguggggcuggggcuggggcuggggcuggggcuggggcuggggcuggggcuggggcuggggcuggggcuggggcuggggcuggggcuggggcuggggcuggggcuggggcuggggaauuguucuguuuucugggaaaacagugcuacaaccagauccauauccuggauauacaagcaaagccauguuuuguuuggaaugguuacuugaccuuucccagauccacucuucuacuguucguaguuucaucguugggauacacuuucaggauguaucucagacuggccuuaaccugccauguagccaaggcuggcuggaauaccaugauccaccagcuucugucucucaacugcuagcauuaccagccuccucauucauucccuuuuaaacuuguaaacucguauggauauucucuacccugcagaggcccagggucccauugccugcagacuuguuccaucucugguagacucauggccucugugugggacagagugggaacuauggugugaguccuuucuggaccaagcaagguuauacggucucuaaccugugaugagaucuuaacaugcuuuuucugaagaugaccuuucucuucuucauucguguuccauagguauuggauagauuuguuauugcaaauaucauuauuaugacacaaauuaguaaugccuuacauccuuauuuaacaccaucuuuggggcaauggcaacuucuuuaucuucucuugguucucagagccugucuguauacccaucacacaacacacucuuagugcuuagcacauucggagcaaaucuuugauugguuguuuucagaugugcaaguuuacaacuagcacauggguagcugguuucgggcugggauuugggcugagaugcagaaacuguguaugacacuuuuagcuagcccuaaaccagugcacacauagggacaguggucccucuggccuagcauuagaaaaguagaaguaagcuaacucaaccacuacaaucuuucauguccacuuaccuugaguuucuuagugagaggcaaaggcaaaaacagcccugcaaggugauggaauuucucugcgagugagcaggucuggguaugucuucuugaccuucugcuaauaaggagugacgucacuguuucuaaucaaaugugcaucuguuuaagaguugaaccaggcacucccaucuagauaugugcuuuugucgauguggaucauaggaucuguguauuuugaagcuauuaaguucacaccuguuaaauuuaccauuuuaauuuaaaaguuuuaaauaaagacauaguugguuaaaaaaaaaagcgcuuaagccaggaaggaagacauggagauacaguccaugaucccaauacucagggcagaggcaggaggaucucacguaagaaaccguucugggcuauugaggagauucugucuccaaaacaaacagaagcaaauccauguuugaugugucccccuuuaacuugcccauuagcuacaaauauaagguucuauuucuguuuuagugggcugggggcaaugguuugagaaggaaaggcuuucacuguggacagauugaagagcacguguuugugagacuggcagacuagcucaguuaguaaaacaacugcugugcaggcauggccgaucccuagaacccauguaaaaaaaucugggccaguguugaaugucuguaacaccaguguuggggaggaagugaaaaacgagggccccuaagcuauuggccaaccugucuaauccaauagaugaacuucggaugcagugagggauccugacucaaacuaaauaaaguagagagccuuuacacaugcagacucacauaugcacuuauacaagcauguacauacaugcauacauacauacauacauacauguauaaguuaaaauuaaauauguaucuagagggaagccuugggcuacgggaccuccaccuggucuaugggaggaagaaugugacucuuuacuucccuuuuauuuucucuuuggagaguuuaccaaugaacggccaacguggggcaccuggaaaagucugggguuugggauauacaaaagugaacaaagcuaagcauccaccguaucauuugcuggugaccuaagcugggccccagggacuccauucauagaacaggaguaauaggaacauccucagaugccaugaggauucaugagggcacaucguuaaguauccaugccuuggucaguuggccaucagggaucuauaaaagcaagauguguguuugugcuggccuguggacugacucuagugcagcguaucugacaauacgauagauugucaggcuagcauugagccccuagcaagggcuuguugguacuaugacacuggagggucgaaccuaggaccccaggcaugcuagacuaguguucuaccacugagcuacacagccagcaagaguaaaauccaccaggguaaugaaaauauuuuuaguacuccgaacaguuucuuuuccagucuuccuuuuccuuauauguuuugugugacauaguuuuggccauggucuuuguucuuuaaauguauuuacuaaaugacuacauguauauaacagucuuaaugguaguuaccacuauacuguuccugcaagaaagaaaacaggcaagaaguacacacacacacacacacacacacacacacacacacacacacacacauaucuuggcaaugagcuuucuucuauuguaaccauauucaaauacauaugaaguugcuuuuaaugauuauguuuaaguuuuuaaaaauuauguauauauauguauguggagggguacaugugaguggaaguuuguguggagguuggaaaaagguauuguauccccuggagcagaaguuacggggaguugcaagcugccaaagaugaguacugaaaaccgaacccugguccugugcaagagcagugugugcucuuaaaugcugagccaucucuccagucccuaauggucauguuuugguucuuguuguauaaaacaauaaaugucagacuucaguuaacucuaagucuagcauuagauaucuacgaguucccaguuuucaacagcgcaaacaaaugccuuucgagcguuuuauuucuucuuucuacaugucaucuauuuuuuuaaagaugcaucuuggacaucgcaucauuagucauaggaucugagccagugccgcuuugcugagacuuguacaaguuacaucaaccaggacuaaguaugguuuucucaaagugauauugugagcaugucccgacuucgcauuagggagcgaaccaucucauuuuagugaaagccguggguuccgcauggccacacauggugucauaauugauccuguauagaaaucugaguaaagagaaucacuuuuuccuacuaacaagaugacuugguuucuugccauugagcuggcccucucggaaacccuaaaaggucgccucuucaccugaauucauaguguucuuucucacccuucugcaucagagucccaugcgacucccaugagccuauagaagacuugagcuacugugucuuucagagacuucaaaacauggugucuggcugccucuggcuguccaguccaccuugugggccagcauccguggugccaaagcugcguaagcuagcucaccuaaucacuguggguacuggccccaagccugccccugcucccucuccugucuccucuucugcacgugcauaacaguguaugugaaggccuaagggcauuucauaggugccaucuaccuuucucuuuuguuuuccuuuuguagacugucucucaccuggcuuacagcucguugggcagguuaggcuggcaggccaacaagacucaggguucccguaucucuaccucuccagcacuggaauuagagaugcaagcgagccagcacaccuggcuuuuaccgcugccuuuuccuugaccuuagccaguugacgcuaucugaaacuaugacuagucaggugauacggaaagagccgcaagcuuuagagucaaacagaucagaccaaauccuuagcuucuccaccuacaugcagugugacuucucuuucaaacuaucugcaguccuagccugccucagcuuccugcccggcacagugccugacuguuaugagauuuagauuauuuuauguucggagaugauaccaguggcuuaaauucagcagagacuuaugcacuaaacauaacaauaucauacuauucuuuccuccuuaugauccuaggaaauagcauuuaugcgggcguguguaugcuuuugugugagcauaaugcguauguguuuauccaaguguaugugaaaaccaaaggacagccuuggguauccuugcccaggagccauuuacuucacuucuuuuuugagacaagguuucucauuggucaggaacuugccaauuagucuaggugggcuggcuagaaauccccagggauccugcugccccagccuucucagcaccuggauugcagccaccaugccuuuccuaucauuuuaguuccgaggaucaaacucacuuauuuucucacacuugcacagcaagcacuuuacaaacagagcgccccagccugaaacaguggcuuuauugguauucucgcucauuuuauaggugcgguuucuagaggugcgauauaaugcugaacuguaugcaguugccaguuggcgggcgaaaacuguaggcugccaucagcuguagcauaauaaucucagccucacagccaaaaaaaaaaaaaaucuguuuuucagugucugcucucuaacaucuaaacccaggcuuuucaauauuaaaccgaacccaguaauacuugggcacccugcugggcccagaugagagacuuaaaaccuguuuuuuuuuggccaccuuugcccaccuccucaauggacccaagucucagccucuuucugugcugacaaauaucagaauucugaguuucaucguggaacagggaacccagagcaaacacaguggggaaaaacuaccguggccagggcugacaauguguggcuggguggggguggggggagcacacaaaaagcgugcaggcaugcucagagacccgacuugaaugguauuucugagaggaagcuaaguaggggcugaaaaugggcuuuuaaaauacagcacauaaggaugcaauucacaacgacgucuccucuguaaacacgcagcugugggguuugggaggcucaacgcgcacauaccgacagcauacaaauugucaaaugcuuaaaguuccauuaucgcagggagggccuugcccaguguccuuaaauggucccggguuuuucuuccccuuugagccacgaguuccgcgucccucacaauuuauugaugaauauugcauaccagaggucacauauaaugauuuuccagauucuuuacuuuuaacguugcuugcuucuaggauccuuuaagggggaaaaaaaucaaaucagauauggagguuggucucccaaacuccugcagggacucugggcaaagacuguucacguacaauauucucagggggugcuguaguuaaccucugcucuucuccagugccugucuccugauccuuucuccuagaccugugauccuuuuguguuaugggugaggacaugguugccugaggaugggcgcacauaugugagugcagaggugugugcaccauaagcaugagcauguggauguggagaaccaucucaggucguacuccucacgugucauccaccauuugcuuucugaggcagagucucacucuccggggccuugguaaguggguuaggcuuucuggccagcuguccccaggaauccgccugucucugccucuccagaucuuggauuuccagcuucuccuaccaugcccagaugucuuagguagguucugcugauggaacucaggcccuccagcuugcaacccagugugcuaucaugcgagccuccuucccagcuucuggacaugccuguucuuaugauuucuuuguggcccuucugggagaugcucucaccugauagacagguccuuuucaauaccuacccagggcucgggaugaaaacgcaaguuccuucuggagcuuugcgucuagacaauuuuucguuuuucagucuucaucuacugugaaaguuuugggguguaacacuugugagcuguuaaccuuggggcuccccacaaugugaagagacccuuaaacuccuggccccuggucugacuuucuccauauuugcugucuccauugucccuugaauuccacagguugacaaaguccugugaguuagguugaacuuuugucccugguaaaccugucagcacagaucugcucaggguauguguggcuucuaaauugccuguugggucucacuacucgggauggagacuauggccauguuuuauagggguggugaugccaguguggaugaacuuggacgucccaugaaugacauccucugaacagugcccaaagcuccaguuuuaaccuuaaccacauagaaacauguauucccuuauccuauccaauaucauggaggaugaauucccuggaagaagggaauugcaucccugagaagcaaauuuuaccugagugugguugcucauauauggaagcccagcaccuggaaagcugagggagacuguugugagcuuaagaacaacuugggcuauguaguacacgucagguuagccagagcgacauagcaagacccugccucaacaaccucaacaacaacaacaacaaccuaaacagacaaaucaaccaaccaaccaaccaaccagacagaaaacaagaccaaucaaacaaacaaacaaauaauaauaauaauaauaauaauaaacccccaagaucuugagaaauaacucagcacuugcugcucuuucaggggaccauccauccauccacucaugcauucaucuacucaucuaucccauccauacauggauccauccauccauccauccauccauccauccacucauccaucuauccacucaugcauucauauacucaucuaucccauccauccauggauccauccauggauccauccauccauccauccauccauccacucauccaucuauccaaccauccaccuauucaucuaucccaucuauccauccauccauccauccacccacccauccaccacagaauacucuccccugugacauuuggagccagucuucccuucgaguugguugccccuuccccagcuauucuuuuggacugguucucauuaucccgguuuccccuuauaagcuggugccauacucuguaacccucagagaucuuuaaacacuuggccuugacuuuucauucacucauccuuucccuguccaccaccuaacucacuuucuuacccugugacacuuuauacaucugacgacagucacaguuauuagggcacauuuaugucuaacccagucuuugcaacugggaacuauaccauuauuuuacagacacugcaaauucuucaaacaccugucuuuggaaugagggagcagcgcuuaaccaccaauguuauugaaacauaugccucucugggcacagcuuuaccccuuugaguggauguagaaaauuuggcagacgaaaaauaagcaaauugauccucaagcugucccuucuaccaccugggauauugauugaguuaagauaccugauuugauuucucccacagauauagguugaguauuuauucuugaccaugccaagcccugagauuacaacaaggauugaaauaugaaagccauugcccuugugggcuuuagugucugcaaccgcuagaaacuuuucaagugaacccaacuaaaacagccuguggagacagagaagacugggauauuaugcuaaaucaguguuuggugaugggaggucccaugcaguccauaacaaaguggcucgucccccuggucacucuuagcauaggauacugacuuugcaugcugcuauuuaugauuuugccauucauaacagcauacagaguaucauggacuccaaacuccaaauucuuaugagaggcucagaaaggaugaguagagucccccauguauaccuugaucaaguuuucugugucagaagacagaauuuucuuagaugauucuaguuuuuauuuuaagagaaagagaacagauuuccuaaaauuagguggcaucauuaauuccuuuuaauuaagguaauuuauuugagccugaucuaaugaaugacacaugccuacagcaccagcaaugcagaggcugaaguaaguggaucccuagacuagauaaucauacccuauguuaaaaccaaaagaaaacaaacaauaaaauuaauaauuuccuuuucaaaugagcucuucuuauauagucauuauacaguagugaaaaagguuguuguguuuacaaauauacauacacacagacacacacacauaaacugacacagagauguggauccuaacacacaccuacaaacacacagaacaaacacauggacacagacauauacagaaacacucagacauacaccacagacagacgcacaaacacagaaacucacacagaggcgugaauacuaucauauguagguauacaaggacacaggcacagacacauagacacugacauacauagacacacccacagacauacaccacacacacacacacacacacacacacacacacacacacacacacaccacucacauuuuuucagccuucuagauuugcaacaacuuuaucgcaggagcucuugguacacauuccaggggccgugguucccaagugcucugggaggaagaagacccagaggaguacugggcagaaacuuccugcucucucuaaggugauuauugaaaagcugcuucuuguggucauuucuacagugguguggccuagggagguggaucuuauauucuggaaucauucccaacuuucccgucagcgauaugaagcuagacaaaaauuguaaucacccugucccuugguuucuucaaugggccaggcuucucacacugcaguccauguaaauggggggggggcauauuaauggauagauagcucagaaacccaaggagcugggaaugucuuaguugguagaguacuugccugacaugcccugggcucaucucgagcacugcaugagcuaggcaagacuaugcuugccccuuaauccuagcacuugggagguggaagcagaaagaucgggaguucaagggcaucuuugguuucacaggacguauaaggccggcuuagguuacuuaaggcccuugcuuaaaacgagaaagaaaaagaggaacacaagaaauggaggagagaaugagaaugaggaaagaaagaacaaaggaaggaaggaaggcaggcaguuuagacggacaggcagauaacaauuaccaggaagcuaagcccgccuccccucccgccccgccaaugcaggccauauaagacacagagcugccuugcccaguagguucucaugucaucuaucugccucuggucuaaggcugacacuuugcucuacaugagugacaaagcagauugcuuccucccacuccugcggguuaagaccccuuucccuaccucaguuucacucugacuggcaacuucacucagaaugaaacauuagcaaaaaaaaaaaaaaaaaaaagacucaagauguuggcugaacagcaaagggagagucgauacaagauucaaaaccgagcgccgggagaccacucgugagaaauuccauaagcacaacggugugguuuaugucacaaucggucuguugaaaugaagccgccggggccagguggaaugcuagcauugucaacuguagccucaggccucagaaccucuuaacucaguguuggcugguggguuaaacaccggggagcuuaugacacaucugcuucccugacaggcaucugaaaaagggaaaaaaauugagcacaauugaaagcaacaugaaagucaguuugcuucagccccgugucugcugcugacaagggguagcauccccgcuguagcguagagacaauaccaagugcauggauuugaucugagagcuaaacggggaagggugagacccuggcacaggacuggggcaagcaggugcuuagcaauggagacuucuugggggcauuuucuagaccuguggaaggguugaaaauagaccaaagaagcagugugccuggccccuggccaaucuucauaggauucguagguauagagcagauaccuccugcaugaacuaugaccagccagccagggcuuuggaucuuaacacauuuagcccccccugcauaggccauuucagacgggcagcuuggucuuuaggaugucgcuaaguguugcccaccguacacauaaaugauagcagaggugcacaccgaguucagggagggucuccuuuaaggaguucagggggacaagaugaagcuugucuaauucugaacucuguaugggagagcugcgagugaccuccccugucacuuuuaguuaagacagggcguuggaauucuggccuucgccauuuggcucuucucaccucgguuauaagcuuagacgauauaaagugaaggaagagcuccaacauauuagggccuccauaaucgaaucuuccuggucacucuggcuaccaucaaacacuacagcguuccuauuucagaacacaggguagagauaccuccuaacuccgcuuaauaacggggaauugugugauuugguucacccaauagaauccgaccaacagucacauauuucauguccaggaggaaagaauuugagagucacugugagcccuaccucacccuccuuuuguggccccagaauccagaaaugugcuguccacgugagucuugcccuuucccuuccgagucccuguguugaccauggucaccugaguuucccugccagccuuccuacugacugugggggaaaugagccuuuguugccaguugcugagauuucagaggcauuugcuccugcaauaggacccagccucucuugccauaaaacuuuacacugcauuguuuuauucgucugcuuaugugugauuaugacuccaaccuccuuccaaauguguuacaaacucuaaugcaugaugaggcaauuaaguuccaagccaaacagagacaacugcacagcaccgagggaauacaccguuacaaucagcucgucccuaacacccggcccccgaauucacuccaaguuuugacucaagugcaaagagagccauguggaguucagcgauucucacugaggucuugucuuaacuccuuggcaacuuuuauguuuuccuagggagggucuuuugccagauggucgcaauguucaucuucccguuucguuuuaaugcgagcugacaugucuccaucuuccugcgguggguuucuuuuuaugaggucgugcuuugcauuuuucauagaaagaauuuuugccuccccauuggggagcccacccuugcaguuucugugggggcugcuugguuaaccacucgccugggguuuaaggcaccgccagcaaagccagaucacugcaaacuucuugauuuacacucugguggcgaggguuugagaugccacagagaaacaggaagaagcagguucgggaagcccaaguaagagcuaggccacagcucugguggugcgcuuggcaugcagaaggccagaugaagaaagacucuucuguccgcagaugggcuuauuauuccuagugaagggcuuaggagggacacugacuuuguggaguguugaacagagagaaagaagguacaauguaaguaauguguccugaucaaaaugaaugacaaaacuaccuaaaauaaauagugaaagugaacgaaaccauuccaagacacaugcauaggauaccugcuauccuagcuauucaggaggcuaaagguaggagaauuaaaguucaaggucugccugggcaguacugggacccuaucucauauuacaaagaaauaaauuaaaaggguugggguguagucagugauagagcauuuaccuaaggcuagcaaaauuuugaguucaauucucaguaccauaaaauaaaugaauaaaugaauccuagaguuaauaggcuuauaucaagcaguuuauaaguacccgcuuuccaacguucacauuaauuccaugaguuaggguuggucacauuuaauacaaagaauaaagaaguaggguugaggcuauagcuuaacagcugagcccucgcccaguguaucuuuggguucaguuacuaacuagcaugaaaaaagaaggaaggaaggaaggaaggaaggaaggaaggaaggaaggaaggaaggaaggaaaggagaaaguuaggcuuuuaguaauauaaagcugaagcggggcugguuguguaguucagugguuggcagaguauuugcuuagcauguaugaagcucuggaauggacacccugcuaugcguaaaauugggcaugguacugcaccccuauacugcaacccugaaaccccaaguggaagcagguugaucaggaauucagggucauccucacuuacauaguaaguucaaacccagccugggcuacacauggcuaccucucucacacacagcaggggcugaugaugaucugucaggauucgaaggcuaaggcacaaacucagcaaugccacccuucuucguuggcacucuuggcagcucuguugacuguuuuagcuuucuuccaaagucacacucuaaaggacucuuggaucccagcggccaaaacuacgaaacuauccucuggccuguuacaaagcugaccaucaaaaacacgauggguggcuggaccagacauagugcuuaauagacaaaugaugcucucugcuggccuaggagguccccucagggucucuguugugcugagcuaugagaaagggcaucuccaucucacaguucacugggcagauguaagcacagccuugagucuuguguuucuccccucucugcugccucaucacauuggaaaagcaguuuuuuuuucaacaaguugcauccaugcaaagaccaguagguaaauguaauccaaaugcagaauguuuucuuccuuguaucuagaguacucaggaauugaacucaugccucauacauucuaggcaacuggucuaccagugaguugaagccucagcucuagaaccaagucucccauuuuuaauuucaaaauuaaaucauuguuauaaugaucuaccugaacaauaugucauagucuacgaauauauuacguauuaaccacaguucuaccacagucaaaggaauucagagguagcagcagaaauauggucaguaagaaagaaaccaaacucacauuucauguuuugacuguuuucaagauuuuucuuuuaaagugaucacauugucacuuuugagugugaacaugaaaauuccugucacagagcagaaguucaaaaaacugucagaacccucccuugggaagcugagguaccuuucugcucuccgacuuuugauacucacagaauuucaaaggcagaucgcaaaccugugaguuuuaguuucuuauuacaaauuauuauuaugacuaugugacgugcucugaagaucuggaguacaaucuccccuauguuaccuguuggaggagaagugacuuauagagacucguggcagaagcaagauauguugucauuguaaacaggugaauccuucucuccugugcccaagaguagauucuaggaugaugaguguagaguauaagcauacauaacuaacaacagucuugugcccuacugagacccuucagagcccagaaagcccauggcugugaguggguaugacaagagaggcaagaaagaagagcugaggcugccuugcugacugcacaccuagucucuggacugauaccuugggaccuccaugaggccccagggaugauuaaugcuuagaggggaggggaaagguaguaugguaaggaccaaccaaauucacaagcuuuccagaacuuucuggugcaaauucuauaauucuaauacuaucacuugagucuucaagaauggcuuggaagcagguauggaaaagacacauacccgagauauagcacaauggaaguuaagauaggaaggucaugaguucugaccuuuaaaaauaauuuacaggaaauccugagcuacauaaagaggcccucagucuaaauggaguaaauaaauaaauuaauagauaaauagugccaccggcuucuguuuuucuuuagacgugugugaagcauggagaaaggagagcaagacagcugaaaauauugcuccauugguagagucugcucaacauggaaaaagcaaaacaaagcaaaaccaaacaaauuggguuugauugcuagcacucuauaaaaauaggugaccaggugugguagugcauacccuugcaaucccagcauuggaaaguagugguaggaagaucugguuucaaaucauccuugucucuacagaaauuucaaggucaucuuggguuauauaagacccaguucucaaaaaacaaauaugaaagaggaggaggaaguugaagaauguuucagacuagaggaaugcucuagaaugaacuagaauguucugcacuugaauacugaacccaaggcucuaccacaaugugcaacagcugaguuuuucucucauccaggcaagcccuuucugcuuauccaccaucucuucagcuucccuguuaaucugauuccacaggcugagauuguacccuuugacccccccacccccccacuagaagcuaccacugacuuccucagaugauguggaaagaagaaaacuuuuuaugggaucacucuaucuguccccuaacacuguuagcuccugggcuuacuuuucaaaguuuuuggguggcacauuuuaagguguagagaguagcaggguaugaccauccauggcuguuuccuguaacacaccaugcacaguagacuuguauuugaguugauacccuuauccccuagagucuuagguccacaugaaacaaaggcaggguaagccaagcacugggguguggucucagagcaagccugguugaugagcagcaacacuuuccaucagagacugaagaagaggcugaccucaaggccaccaacauccucugagccuauguagaugcuacagaaucagaccaagggaugcaguguugucucuggggguuucuuuucgaaaguaaaaggguuuuuguuuuucuagcccagucucguggagaccacucuaguuuccauuuuucucagaugauaauaucuacagagaggguccuccaauuguggguauaucacuucucuaacauguggcccauguuuagaaccacacaauacuuauuaaucaccacaauuaguaucucuugugggcugcugagauuacccucugcugaacucccaacauucaaagagaauucaccacaauccccccaaugaacagugacagcaaugaaggcccaugaggcucccuuuuaaagcugaaugggcacacaguuuaccuucccccuucaaaggagacccuguguuguguagcuuuucaguuuacuuuucuuccuaaugcuaaacuuggggagcgagcaugaugaacucaacauauccugaacauaaccacuaucagccaggggaucaaguccaauuagcuuggcacccccauacccuucuaaaauucaauguacaaggugcacacaaaaaucgcguuuucaggaagucaucuggaaggugaagacaggagaugucucugucauguucuagcugccuagcagacuuauuaaccuuaaauuguuuuauuucuaacaacauguaugccuaugggagauaggcacgugugcacagguguucucagaggccagagacaauggaacucccggagcuggaguuacaggugguugugagcugccugcaguggcugcugggagccgaacucagguccucugcaagagcagugugcacuuuuaacuucugagccagccaucucucuagcuucugacccuuucccuaucuguagaguaugccuuguaagcauggagaccugcauuugaucucaggacccaugcuuuuaaaaaaaaugccagggauggugacagaugcuuauggucccaaguugaggagguggaggccaauggauccuuggagcuuguggguuagcauagaagaauugaagagccccaggacucagugagagacccagccucaaaacaaagcccccacucccacccccaacaaaauaaacucccaaacagcaugaauauaugagugccuaaagaaugacauuggaaguucacacacacgcaagguagggcacacaagcacacucacucgaugguaggacuccaccuuucuauacucaaacuagggguugccucuggcuaggaucuuugaauugucgcacuagcucaguauuuuuccggucucucaagcuuccaggaagagugaacccauuauccauuuuagucuggaggacccugagaaacuucacagaaaaagcauguuuuccccuggaaggcuguuuugagaagggcaccaucgugcacucacuggauggccccuguugacaugccgacucugggggugguucagcaggggaucugggugccugagaaaaggagugaagaaauuuuuaaaaaaaguaagaaaccaaccgagaaaacccaagagaaaccgaaagacugcacgcuggaacaaaagggagggggcagccagccucaggaccugggcgguuaaggaacuggcuucgacaggaagugggcaggaggcuguuuucaguacacucaugggaacugagcuggaaagugcuguggugagggucuguggaaaaagagggcucuaaucaagcuauaaauaucuguugcuuugaaguuuuaugaccaacaauuaauguuacuggaaggcacaucaagagcuauuucuuaacuuggugggucugagugggccagggucaggguaugagucuagccucaugggaggcuguccuuacacauuccucccucucucucucucucucucucucucucucucucucucucucugcuauaaaauaguacacaggugucuagaggcauacaccacaguucauggucaucuagcccaaccauccauccauccauccaucauccauccauccauccauccauccauccauccaucuaucauccauccauccacccacccaucccuucgaucauuaauauguguuuauucaagaucauauucaguaaggaacagcuagacaaaacccuugaggcaggguggagguuuggggaaugcacuuucuuuuaguugggaaaggagaaaacaaauaaaaaaaucaugucugggaaugagaagugcucucaaccauucagaagucugugcuaaaaacuagaagcucacucuagaggcugugcgaaggaaccuuuucugugggaaguugcugcaaacagaggcagaggcagaguauaguggagcagggagccaccaaguaccaaaguucuggggcgugugcaucaguggaccucaggauucaggaguccuggccacugcuugcucugaaagucuugaacgggcuguggauuguucccaguuauacacuaagagcucccuaaggucuuauuugguugugccaaaugucagcuuaucauuucuguaauaugcugcccucgaacuugaauuuucucccacuauaacaaaacaauggcagaacucgucgaaucccauucaaccccucaucuccugcuuucaggcacacacugauuuguacgcucacuguggccucaguaguaggcuucugucuggaaucacauuugugcucuuccauagguucaggagcacaguucuuuguuccccacuguaggucuaucuucaugagggaagacaucaggaguugugggaaucuaggaucuuggcuucuggaaccugagaugacccggcaaaaggucauagcacaaucuggaaauguuugaccuuugcaaaggaguaccugaaagguaccuucuagugccugacucaguggugcccaccuaagaaugcucuuacucauuugauagagcagcucacugaaaaucucggauagaacaacgucuguuuuucaguguggacgucuccacuugugggauagcauuuucuccuuaaaggagugcauaauucaaauaacuuccuuuucagguucucucucucucucucucucucucucucucugucucucucugucucucucugucucugucucucucucucucucucucucucucucucucucucucuguguguguguguguguguguguguguguguguuuuaagaagggauuucuucuuaguuuccuugggugcaaggaucaguuugugacugauaggauucauuacacacauguuuagcucgcccauuauuaaggcucuaacaauauuaaaaucuaaauagauacagagagugaagaagccuuugggagccaguaauccauuguacuggcuuucuugaaauuagcaauaaaauggcagcccguuggccuguuuuccucuuucaccacuaugguaacagagccauaagcuguaucacucaguugacccuaaaggaucaguucauucucugcuugggaccccaagcucccuuuguccccaucucugcaccaugaaaccccaugcaucucccaggagcuaagcucucacuacccugaaaugggucgugggucucaggccgauccagggaagaggcucaugucucguuaguacauuagguaauuuuucuucagccagaucuaacuaaauccuaugaugcucuuugucuagcagaagauaggguuggcaaguaaugaauuaugauucaggcugggacagguuuugggacagagucugcccaggacugggaauagagaugaggaugccuagagagcucucuccauguguuguuucucaugacacagucuucagaggucacucccaugugagacauuucaggcgcucacugaaagggguuucuccaccucccucucaaaagugaagcccccaguaaauuuacucccugacacuaaacauggaaauacaugagcucuugcucuuaccgcugaucacguggcuuuccuauuugcauugcuacguauucauaucuuuguuggagcaugugacagccacagguuaaccuuagacauuauuccucagcugucauccuuguuuuuuugagacagggcuucucacuagcccaaugauuacuaaguagguuagccgguuagccggugacccacagccgucuuugugcuucucccuuuccaguguuaggguugcacuugcaccaucacagcugacuucugaagugggccuagagauugaacucagguccucuugcuugccuagcaggcagucuacagacugaacgcucuccucagccuuuauaaaucuauaaaacaaaacacuaucuuucgcuuuuuauuuagccaagcgucagcuauaaaaaagauaaaggauugguuaauuacugugauauaaccagucuccauuaaugaaaagaguaucaauucuaaagaaagacaucuggacaagaauuauguugcguguguguguguguguguguguguguguguguguguguguguuuguaugugcgugcaggcacgugcacuauggugagaacggauaugagagugagaaauguauugguaauaguuuugcuuuaaggauggggcucuggcgugcuuuccuuugcauuuucucauuaaaaacaaaaccaaauaccuucaauuaugagaucaaaaagacguguucaguggcuucuucugacccaauauuuuuuuucuuguuucauuuaaaugaaauuuuuauuugcauaaaaauuguucuuaugcugcaccggauggcuguuucuuuuaauggaagagucauuuuacaauugcagugguucagccggccccauccccuacacacacacacacaaacacacacacacacauacacacacacacacacacacacacacacacacacagagcaacacacacagagcaaggacccagcuugucuuaugagcucuuggcucuccaggccccaggacccugcuugcucaaagacagacacccacaacuaauaucaagacauuaguuuuaccacggauuucccagcagaagccaagggugggcucuugguaacuccugugaacaucaaaaggauaaucagauauuaauuaauccugcuccucuuucccagaccgaugauaguuucucuccagcuguucuccucaucccccagggugaucuguuugaagcagaagugguaaauaggaaacucagugacucagccaagacuuagucucaccagagagccuccuggccacucgccucauuccuuucuucgcagggacaaaggacaggaaagcuagagcauuuuguuauagagaauaaugccagagagggcugucggaugagugagcgaguuaacggagaauguaugucgacucaagggauccuucaaaagucgcugcauaauguacacagauaaauuacuuaccucuaacacuucuuauuuccccaucccuugcucugugugcaucuaaaauguauccccuccagcacacauauuccugcaaggcugggagcaccguuuggggggauguugcccgaugucugaggcaggagcaguggcuucaauggcuuggcuuaccaagagcacacuugaaggauugcaacccugcccaacucuggcuuuagugcuuaaaguaugaggucacuguaagcucucacaaccauggaccaguugcaguggcuuccuuacaacgaugcacaguucccucugcgccaugagcucaaagaaaccucugcucucuuaaguagccucuuuccaguguuuuguagcagcacggaguaaaguaauguacuccuugacgccgugaaccuaggaauacacguucucguuuguaaaggauugccugguggauuugcuuccagaaugccaugauggacucacaguuuuguuacuguuuuuacuuggggguggcagggggaugcacauucccuguauccuaaagaacagcaaacaacaaacaaaaacaaaaacaaguaauaacauagcuucauuccaguaucauuuucaaaaauccaucugaaauuaauucuuuaaaaagaaaaaaagucagggcugacaaauuguccccacgaguaaagaaaaguauuugccgauaagccugauggcccaaauuugauccccaggacccauguggcagaaggaaagaccgacucuuuccucuuuaaagaaaucauaaauagacacugcagcaaugaaaggagaggaguccugugaguaauacuguuuccuucauuaaaggagcugauauuuagcgacuggacaccugacgcugccuuggcccacagggucaucaguauuagcuuacaggcauuccaguaggcuucuccuagggaccuggcaacggcuuaugucaucaucugcugccacuaccugccacccuccacccggugugggugguguauaaaaggacagcuagccaccgcaguugucucucucuguuuccaaauguucgcaggcuagucuuucucuccccuuuuauguccuccucuguccccucccuucuccccccucauggcuuugcuccugucugucugucugucugucuacaugucuacuccucugucccuucuccagguccucacuccccacucccuuucucaaauaaacccuuuuauaccagaucuauugcaugguguaauuucucagagagacaccuuggcaugggccggccagguacucccccuugccuuauuauauuucauaacaaucaguccaagcuggaucugcuguuaggagaaugucuucucaccucccugaggagggaccugccuucaaucaguagcaguguugacaucugcauucuuugagauugggggagggggggucuacuugcuucugguuuauucuagauucccuuuaaagugacuuuugauacccacagcaaggcuaauucucuuccuuccuuucucagcaaugcugugccuaccuuccuauugcuaaauggucuccuaugucucggauacucaaucuacucaaggcaacaugcuuccagaaggccccugccuuggucugcuuuguacaauccuuugcaaaccucuagugggguuuucuuuuucuagcaguuucucuucagugggagaggccacaagagauggggacaaaagagccuacguccugugucauagauguuucuccaaggaaagcaagcugcuuucaggcuuuuuuuuuucaccccuaugaauccaugucugcuucuccauagucuguaucagguuuacuuccucauggagaaacugaggcacagaaaaaaguaauggcagguaagucaucaagcaacagacaaggccaaaguggcuaggacuccagccaucugucuuggaugauggugagacugucuucuuuagaggaaaggaacagaaaaggagggggggggaagagaggagggagaaagaaagaaagaaaagaaaggaaggaaggaaggaagaaaggaaggaaggaaggaaaaaagaaagaaagaaauuagauagauagauagauagauagauagauagauagauagauagauagacagacagauaaacagauagaugagcuacauacauacuaacacaaagggaggccaauaugguuaucacuuaccaagcaaaagacuuguuauugucguugucaucgucaucaucaucaucaucaucaucauuucucucucucucucucucucucugugugugugugugugugugugugugugugugugugugugugugugugcauaugugcucauacaagugugugggcacccccagaagacagaaaaggaugccacauuucuuggggcuggagguacaagcgguugugagcugccucaguacuuccaaucaaguuccaauccccuaagaacagcaagcccuccaagcuaccaagccaccucuaguuuggaagcagagaucucugcccagaugcuucaacugaugucucuacaauucagggacaagagaagaucuggauggaggugggaagggggccagggaaaagcacagaagagcugcuggcugccccuuggggggcguuuugcuuucuguggaauagaaggaauguuuucacugauggguucuuuuucuuaagauauaaaaacuugagugcauguucaccucccuggcgaggucuuguccuagaggcaaggauuaucucccgggauauugggagggggugucacacugggucaguggaugcagagaagucagaauucucuuccccaaaguuccugcuuuucucaauaauugcauaaugacgucuuugaugcucuggcucccaucuccagcuguuuccuuaggcauuuauucaaauuccaaagugccauucacaguccagcaggaugcauauuuguauuaggguccaaaaaaaauuuuuuuucuuuuuuggcucacauuauuauagcccauggcagaagauucuagcaauuagcaggaaccaaaagugauaauuuauugcaaccaacauugugaucuaauagucacacauuacaaaagcaaaaucucgggcaccacagagcuaucauaagcuccaagugcuuccuaaugucuuuuguuugcauuagaaaaaaaacccacauaacucucucccucugaacaccagaaagggcucucugaguucucagaaggauaacauucaaaacugcucuccgaaggggguuagguagguacucuagggguacacauugaacaauuugauucuguuucuggaagaucuuugggggaguaaaggucccuuuuguccugcauuuaaaacagauggucaugucucacauuuuaaagguccuagcauuuaagcagugggcacuggccaugagugcagagucucaggaugagagaagugggcaaauuucaggcccuucauucuaagaucacaucuggaccaauugauuuggaccucugcaucuugucucggaucuguacuucgagggggauuuccaugccaccaaggcacagaaauuacaagucagacgguaagugggguccugccaggugacugaggcaacgugguagagaugcuucaagucuuuuauaaucauaucccagcauccccgaagucauuaauauguuuggaacauugccuguccaccgucuggagagacuccugcagaaucugaugcucgguacaugggauuuuuugaucugggaaaaagagcaaaaccuagagacaguuuaucgcucagccgauucuaaaccuagcugcccaucagaaucaugugcgagcuugaaagaaaaaaaaaaucagacuccugggccuuaccuucuagacauacuuaugugcuuacugaaggauuaagccuuaacuguuccaaguggauguacaucuggggauaucucuucuuucagaaaaaaaggaaacugagucacagccuucucccagauggagaauggagauggaacccaaagccuugcccuuacauugugaauuuuuuuucuccuggaucacauuguugcaucuuagcgaagaaaccucauuagcuaacccagcaaggucaccaggggcagaagaauacauucaaggauugcuuagcaagaggggccuugggauccuuuccuuagcccacccccacccccaguuacaucucagucaguuucuccaaaauguguaaugugccauuaauugagcaaacauucccccccccugaucacauccauguccuccucugcuaaacaacaacaacaaacagagauugcucccucgugacuucuccccuaaacugugaaagauuuaagaaguauuuaccaauaauauuugcccaucaguaaagcccaaaccaugauguggaucgauaaggcuauuccagacacauacugcugaaaaacuuuaugcagaguaauagucuuuuuuuuuuucuucuggaaauaaacaucuaucuuccacuuuucacaugaaacacaaaacccucccaaucuaucuuuugaauuaucuaccuuugauaaaaauguauuugucucuguagaaagagaaacaauauagagugguacacaacaauuagcccuuguacuugggagacacuagggagugguggagauggagauggagauggaguauaggcccuguguucugggaaaggggaugaagauuugucauuuuagcugacacagaucuaggacuaucuaaguauucugauuuuuuuuauuuguuucuaagaaauggaaauugugugugugugugugugugugugugugugugugugugugugugacuuucagaguuuucaauguugccaacuaauucaucuugcuuuuauuuuuaauguguuuuauaaacacaugggcaugggccaacagggaugcgagccaucuguaguuccaaggcuuccaacuugagaucuucaacuaaaaguuaggcgacugaagggugagagaagagauuaugugagggcuaugagucagccagcaccugcuacagaacgagagcaagagggagauagaugccuauuaggguauuaacugcaaagaguucccuucucugccugugugagugccuaggcaggucagaaauuguuccucugcagaaaagccaggacucccaucaugcuuugcgcugcagcugaugccuggauagagucucuccucuagauucagguccccugagauugucaagggugauggcccuuucugaaaggccacugacuguggacuugggucaucuuugccauguaccuucccaagaagaccuugauucauauuugauggggcaaucggaagcuguggccuagcccagauggcuguggaucuaaccaacucugggcaggugcuaaaauugggggaaaaaugucagagagagagaaauaaaaucaagaggacaagaggacuguaucauccuuccugggagucuuaguuuuucuucauuuucuuuucaaaauaaaauaaaauaaaauaaaaagguuguuucaaauaaccugagaugugagcccucagcgauccgauuuacaaaggcacccuugggucugagccaauacaagaugggcuuguaucuuuaaguagccuuuauuaccacaguaauaaacagcaaacgggcccaaaucuuacaggcuuguguuggcuuugaccaaugaaguagaacaagaccucugaauaccccauuaguuccaggcugugcuuugauggcuuucugaaggcggcucuuuuucuacacaagucaccagccuuacccgugucucuuaacaaaugcucuugacaggccgcguugcaauuuuucugcauguucugacacuuuaauucaguaccuccaagcuaagcacucagccuaagccggugcuucagcaccuuggcaccacugggcugcaauuaaaauaacacaggaaccaaggcugggcuugcagaaauagucuccauucccuuuggagcacugugcauuuuuccggucccccauagagcagacaaguucucccuuuuagaguagaagacagugagauuuacugaugaguuggccacuggcaagaauacugauuguaucuuagacccaauggggucuuccucugcaggggucugaaauaaugucuucaauaaacuuagcaccagcgggaagguugcucaggacuggaggggaggaaagggaaaguaccuagggugaguuuggcgaggacccuuuuuauagaccacaucuccaaacgacuacccgacuacccgggagaucugcuuguuauucucagucuuguucuggaaagagaaaugaaguagaguuccugaaaguuggucucacuuuaaucagcucuuuauguagagaggucuuugaagagauugugugugugugugugugugugugugugugcgcacacgcaugugugugcacauuuguacaugugugucugugugugaauucaagcccagucuguugacgugaaugguggcccaguauugcgaaaugaacaagauucuguuuauccgugucccuuaacccagucuccugaugacacucgcaagacugagagacucuuuuggcagguaggggacuuucagaacuggaaaucugguaaauuucccccaauuauuuuaugacaaaggucguuugcaaggggauuaaaaaaauaugaacuccagaccccagcuagagggagugacugaguuuaagucagugcaguggauauuccuggaacuacaacuguccaggggaaggcuuuucaugcaggccaauggaggaagggcugcacugaagccaagguccacagaauuuucugugcuuccuagaaaaagugaaagauagaaacuuucugaacagaacugccugccuuucccccacucuucccccuauuuuucuugcauuuagaaagcaggaggggcuguguguauuuacccucugcuucuguguccuuuauaucuacuuucuagguacuucauuauagacaguugaacuacuuaagagcaguguuuuaugguuuuguuuucaagaaggaaugcauuaguggggcugggaacaugguucaguuaguaacacacacacacacaaacaacaacaacacaaccuauucccuuugaauccagcaguauggaucucuaguccaggcucugggaaaucagagauagaagaucccaggagcaaccugacuagaaagucucuggaaauuggugagcuccagguuucacgagagaaacccuguucuuacacauuccauacuucauggaagcuccuugggcuggaggguaaacaauucaaaauagcuucagggaaguuccugaaacugacaagauucacuaggccacucccugccagaguaauagcuucaggaagucccugaaacugacaagauucaccaggccacucccugccagaauaaacacuaaauguugugagucucccucagaaagaaggaaguagagcugugaagaagacgcuggagacaagagcagcuaugugaaagaagcagaaauuaguggaucugccucaauaagguuuagaccaaguaaggcaccuagaaagggcauuuuccaaccuguugagcugccugcagguuaugcagugggcuccagguuucccagcucuugugagaugccuccuguucugggaugggccuuggcgacacagaggucuucagccauuucuuugccccguaaggaaccccuaauccauauuccaguaaguaacccccauaaaacagauuggugguaucugugcuuuggucuguccuagguccccuaucagggaagaguagacauguguaccacagaaugucuccccagaaauguuuugucacacaacaucuacacacaagcacacacauaccugaacauguauaccaccaugaaagaacuguacauacuuuggaggaaguagaagacucuugcaggacacuacggaguaagagguuuaaaccguacuauucuaaagaaguuagcccauggaagcaguucaccccuuucccuaucacaggggacaauaaauuaaaaaauaaauaggugaccaaggagagcuaugccaugggugcuuauauagcuuguagacuuuguaucaaauggugccguucagaugaguauccccuaaauuccuucugcaaaagacgucaguagaaaaaugaaaaugcucacuacugcuaugcucaacuauuuagacuagaggacaagagauaccuuagacaagagacuugucuguaagaaaggaacaggcacauggaugcuuacucucaucuggggucuccuuucccuugauaccuuugugaaucuuggaccuguggauuuucacugaucugccagaggagagcagauaugaaggauuugaggagggcugcucuccauugcaaucagcaacgaccaggucucgcaggcuuggcaagagcucuuguugccuuuguuuggaggaagucaccuccugaaauucaguccccagggaguaguaaaagaguuucugaaaaccuugaagaaaacuaucuuggucaguaacauguauguauagaaugccaguccaggcagcagcuggacgugguaccugcucagcaaauagaucaggccacgggugaaauucagggaucacagaguuucuacagugaauggacauaauuuuaaauuucauaguuucuccucaaagcccaagggaucuuucuagaucauuccugucagagucauuccuuaggggugguauuccauuucuuaaucuuugauggggacaaagggcagaauguuucccugggccuguuggucacuguucucguugcuguggccuggcagaggaacgguuugauuuggcuaauggcuuuagggucgaguccaucaugcugaaaaaggcauggcuauagccgguaccggauggggaggcuuccguuuggguaaaccaggaggcagaaagggagguucuagaccccagccugcgggaugguaccacccacuuucaaagugguucucuucucaguucauccucuucagaaacauccucacagacgcauucagggggugucucugaggugcucuaaguacagucaaguugacagcaaagaagacucaccgucucaggcacccauauucuaccccugugacuucugccaucucuagcuacuugcccuugucaaagagaacgcaaggggggcagguucagaauggcuuuccuuuuccuuugucucuuggcuuuggugagacccgccguaucgcucuucagcaucucuauacacaggcaccagguccccuaagcaguuaaaucugaggauguaauugcugggcucugcugaaccucucagaucacuuuaaucccugcccugucuuucccuauacauuaagcaaggcuuugaccuauugacuauagagucccugaagcagcuggacuccccauuuggaaggcuuucuggagaggcgucuauuaauuuauguauuuaauuucuguaugaagcaaccguucuccucccugcacagguauuaaaauaccuucagggcaaugcagcaacugagaggcaaaagcauuagugggcagugcucagcagcucaguggauaccaccaggacucuguccuuccucagaucucaugacaucgaucacccuaugucccaguccccucccaggucucugaauuccccuuuggagagugccuguuucguuguguagaugaagggcaggugacagccugguuccuucuguguucucugguuugacgggaaguucggcuuuugcuaacaguucauuuuaaagaucuuagcacaucuagucacauuuaaaauuaccuguccaguccagcuccaacuagcuguucaaucauuauugauacuaaguauguuacuuaaccaauuggaucugucaaaggcaucccaucucuguaucaucagcaugaacaggagggcgaugagcccaaggcuccguguaaaaagcacagauaaaccaaggaugcuaugccuaugucugaagaccuuccuguagguauacuuuguaggacagagcaaguggcagguggcccugucuuugaaggaaaggguucauuuauaacaaugauggucaaaauuucagagagaagaauggagaggggaugauuugggugucacaagcaauggcugucacaagauaagggaacugucucauguuagcagcgcccucugguaaagcucacuaaggaccuugcccaagaugguaaauaaccaucuugccucccuccugggagaugcuaaagcugaacucaaaggaagucucaaggcaggcaacaggagcuauguuagggcagugccuuucaaaucuugaaacaugguaacauauuugaggaugaaguaacagcaugccuacauuuuuugugugugugauauaagaacauuuauaauuuuuguacauguauccuauauuuaaaagggcaugucauaaccugagugugugaguguguguguaugugguguauauucacgugugcuugcaacccaaugucaccaaagcuuuccagaccucaagacacagcauuagagggggccugucccaggguucucuguacccagcaggcugucuccucagagcaagucuggucucugggaaugaggagacuacuuaaaaggaaccuaguguccucaaccaggaggacaucuugugagggaggagaaccaucagguguagcucacaguugaguguguaguuuccuguuaaaaccaggaaagagcaguauaggagaaggggacaccuauuggggugauuuacaugggacguggccagggacuugcuauggguccucaguggaccauuaccuucuuucaagucucuagggacagcauuagaaaaggcccacucugaagggcauggacacacauggucccuacauaacagcagucugcuuucauuugcaaccgugaaaaaugauuuucucguucuucuuugagacaaggugucuuuugccggccuggaaucugcugggccagcaagccuggccagcaaguuucagggaccugucuaucucugccuccccagcacugggguccuaagugcuuggcuuaacauccauucuggaggaucaaacccugguccucuugcuuauauggcaaacacuaccaaccaauccauccacccggccccuggagaaagcacucccugaagcccacucauaaaaaaaaaaagcucacccuccccaucagcaaggccagcauuuucaaauuugguguagucuuucuucaaaugcuugucuuccaaugucagucagauacggccuaugaucuugugugucuccuuugcauccuggggcucaguggggugggggcggggccgggcccacuuuucaucucuguuuaguaccugggcccuaucucccaguguccuggcugccaggcauugugcgcucugcuggauguugacacagauccucaucucccugauucccagcgccuaucaagcuacuguaacuuuaaaaaaggauuugacaaagacugccuccaguagcugagcugaaauaagaaugucuccggaguuuaauggaucaaguagcagugauagguuuuauggcccuuuuuuacuuuaggguauagggaagagagaagcaggcagguugguuuuaaauucaaggauuuauguuguuaauccuccgggcuaauuauaauuuaugggaucuggcaaauuaauaugcgguugcuauucaaaaaguagagggcaaugugaggcaggcauaaacaagccuuguucauuuuuaauuuauuuccaccaauggagaauauuaaauaaaaugaacacuaggguauuuuccuccaaguuugguguucauuauuuaucucuaaauuaugaaauucauguaacaacucuuugcuuuccuuuuuuucccccccacucgaagaacccagaauucuugaagugcagaacgggcuaucugggaagccaucgguagcucucucucuacugcauuuauggcagacucagugaucggcacagagugaagccagccuuccuagcgcgcacgcgcggugcuaagggcuaggauuuaucacggaggguacugggauuguuuggaaguggaacuuuugcgugguacacuagcuuaaaaucccagcuuccugggaaacgaaagugccaacgcugcaaaggaaagggucucccccgauacuuuuuuuuuuuuuuuuugucuucagggauuugggagcaaucccaguuuaucacuagccuggcagauguugagcuagggcugaccccacagucggacuuucaagacuuuaauggagcaaucacgucauacccaugaccuccucucccauuucagcgucguucccuauggcugcuugggggguccuuuuaaauaauucagcuucucacccgugaacaucuggcagagaaugaauguucgcccgguugucagcugugaggcagguagaucugacucauuggguaauugguugcacuaguagaaacgagggugccugucccucccugcauucuguucuccccuccccgccaacccccacucucuuccuccuuccagcugccagaggccaucaaaugcagccuggagaauccuucagcucuggguccaaggagcagguuggaguucuaccccccaccccccgcccccagcuguguagcucagauaacagcuggagcagagaacaagccauucucucugcuagaauaucugacccaguucuaacugggaaagagacugaauacuuugccccucaagucauucuuguucuggugugaagggagauuuaguccccaccagccccuccgcaccacauuccaagguccucuuuuccgugccuuucagcaaugcugggaacuucaucuuuuguacacuagucagcaggacagugaggguccgucccagugcgauggccgcagagaaguguuugcuuguggaaggaagcuggagcagaaauagcuguuggucccagagucuuuggaucauguuugauaucucugcucagcucuccaucagcugagugccggacauaugaccuacaaccucugggcugucuuaucagcacaauaagaaucgaguccuugguuugagggugcuuuuuaugagaaagaagacauagggaaacacugcauacuucccaacuugcuauucauggucagaaaauggaaguggugaaucgggccugguagcacacaugugucaugccugauucauuacuagcucacggacugagugacuuaaaggccagcauaagacauucaaaggugccacgucucaauauaaaccuauacaauggcugggggcauagcucaaugagagagugcuugccuagagcaagcaaggcccugggcucaaccuauaguucaagaaaagaaagagagagagagagagagagagagagagagagagagagagagagagagagagagagagaaagaaagaaagaaagaaagaaagaaagguaauucugcacuggcuguggauagcgguagcaguguacauuuguagccacaguauuugggaggcuggggcaggaagaucaugaguucaaggccacccugagcugcauggugagauuugucuuuuucuuucuuucuuucuuuuuuuuuuuuuuuuuuuuuuuuuuuuuuuuuuuggucucaaaugaacaaaccaaacagaaauggugguucugccucguucuuccuucaucaggacgugucccggguuagcacauaucuguagauggggauuugccaggagacccagcuggaacuucagugcacaugggcaucccagaggcucugcagcaagagcaucccaaggcucgguggcuguagggaauaaugggucagucauagaaagacuucccaguacuaggagguuggaguaugucuucuggaaacaacaagaacucagaacauauaagccacucaggcacuaagauacggguuggagagcuugcugccuauggauuguaaacgggugaagcucagcugcucuggcucucucuugguggagcacucccacaugcacucacagcaucccacuaagugccacccauaagcaugauccuuuuugcuagguaucucaaccaggucccagccacacuuugccucuucccaugcuugccugaccccuaccuaggucggaucacagccuaggcuuggucuggagaaucugcacucucccucuucccagcucccuccuccuaagaggaggacuuagguaguccucccucuaacacucagugugucuuucuucuugagcacuuauaguuaccacagucaaggcuccugccuuagacuuccuuccgaaauugacuggcagguagcagguccccuugaaaacccauggaagcuuccaugugucugguucccaucccuucauguccagcuggaaaucuugacggacugcaggagcuagcgagauggauggcaugcaaauguccuggugccccaaacuguuuccuaagacuugggacauccauucauuugugggcuucuggcuucuccagaaacugacauuucuuuugacauucccccucucuaaggcugucuagagaaucccguuguacacacccuccucucccaggcagaggaauaagacaccagguuuguaccgaugaagcuauuucccacccuuuagaucccagccuuucuccucuucucccaccacauaaaagacuaagaaagcacucucgugaaauguuugcacaucauuuaaauauucauuuccauuaauuuauucauagccauaaaguuuauuaccuagaauauagcgucauagaaguuuagagccguaagacaccagagaaaucauccccuuucagcaccucauuuuacagccgagggaacuggggugaaguguccaggagacaccccaaggucaagucugaacgagagccacuauggagaccuaaagccgcgggcagauguugcggccuguguagcugcagcuguauacagaugagaaccugucucgguccuggcauccgcagacacuguauuuaucaguaagguuuucccauucauccuggagucaaauccuguaccaggccagcccaggacaggcuucuggagaacuggacgguccagacacaauggagcugugguguagagagacugaacacacaagcacaugcauauggaauuguaccaaucaugcagaaggcuccagggcaaacacacaagcucagcccuggagaacagagaugagaggucagaacacagaggagcccagccuugcuuucuuugaaguaggaggaaggggaagcagaagcaagccauugcaagugcuuuuguaaaugguuucuuugggguacgcaugauuuuagaaaaauccaccuggaaaacugagggagauggcacaggggaaacccaccaucaaacgaagucaccaugggacuggcucacucacugcccaccugcugucuccugagaacuuacgccaggacaucucuuucugcguacucggugucugugugugugugugugugugugugugugugugugugugcauucugggcgggggagaggggaggguaagauuuuaaauaugcuuaugugaagaaaaauacucaugauuucugaaacgcaaguuuaacuggguguccuauauuugaugaggcagcccuagggggcaucagaguacauagagcaacuacauagccagagggaccccaaccucugcuugcuaggggaagggcugagcagguauuggaccaagacacuuucaccauggugacaagaagauuuuuugggggggggaauagaugucaauaagggccagguuggaggcuggggagagguuagcuuaucccguggggauaggagcacaucugggggaggcagaagaaagguguccaagaaagauacauggaguaucuuaugccaagaguacacugugugcuguuaacucaaaccuggaucucuuagcauuuagggugagccaucguauguacuuuugggugauuuauacauguucggcaaugagcucgaauagcauaugaccucauuagauauccccuauaucccuaggcuagagacagcagagccaggauuugaacccacacaacuuaaaaaguucaaccaacugguguuuaacgugcaaauaaaucuuuugugggggugaaucauguauuuguacucccaucaguugaaaccccaaauugacauuucagaaggaauguauacuuuucuuaguauaaauauauuguaaugaaugccugaagacuggagccagaguacccagaagugaacgccccaggggcagucauuaguuccugugaauauagccugccuuuccugauucuuuuccguauaaucaaagaggagggugcacugaauuagggugacccacaaguucaacagcaggaguuugguuuuuuuuggggggggggcgauuuggagaugcccacaugcuuaugaacuuauaggcacugguuugugaauauggaagagaaugauuuugccauaagccaaggaaugaugagagagagagagagagagagagagagagagagagagagagagggagagagagagagagagagagagagagagagagagagagagagagagagagagagagagaggaauaguucucccuuagaggcuccgagggagcacagcccugagagcaccuggauucugauaucaaggaccucugaacugccaaagaguccauuucugcugucuugagcaguuggcugugugcuaccccacccagaggaaugaacacaguagccuuccucaacauacccaagaguuccugaagauguacccuccugccaaaucaaccagcaaccccaggcaggagcauggcagaucagacagugagaggccauagacagaggccagagguagcccaccaacucccuuuaucuuuguucccuggugacacugagggaggagcuuggaggcaggcccaucuugaaggaagguggaccaucagcucacccacaggauuacagcaacagggaugagauuugccuugccagcaaagccauaugcugguuucugcccuacuuacaugaccccaugugccucccaucaggaaagggauuuguccccacagggcgggguuccaucccccacucagcuaccuuggcaaccugauagcuccuguucuuuauacuccuugauccccaagggcuguuggugggcagugcuccucuucucuuugaccaggccuuucuuuuucuccaccgguaugagcacaauucauagaggugcacauacgaaauuggggggagggcaggauaguuccuugaaacuauccaucggggacuuauuugauauagggugaucuaugaagcaagggaggucacccagggugugggauucagcuggaggccagaggggggccaggaaguaaaccauucagcugguuuugugaccaguaagacacaagcuugucuccaugcuacauagcaaccacaacaaaucaucaguggccaucaauuacuccauggucagaauccggagacucaauacaagccagaaacuaagcuaaagucucaggcucucgccgaggaucaacaaaugacaccaaggcuacgugccuggagauugucccuggauagccucugguccuaucuuagacccugaacuaagagaacacuccagggauuagaggaccaggguaaagacuauuccaacaggcauagagaaaguugaagccacagaggaaaaagacuguguaggcucugaauuguuuacguggccaacgaaagagugcacaugcaaguucagcagagaagagcuuuaucuuugaaagagagagaaagaagcacucugucuacuguaaguaaccacgauuaacaugugugugccucccggucuuuuuuuccugucuucaugcugcgaucacccaccuccgcacaucuggcacgcugcuucagauuuuucuugacauuauacauuccaucacguuguuacaaagacuucaccgcgguucuuauuggacgggaugcauccguuuauccucuuccguaccacggagcauuuaaaugguuuuaaauacuuuugcugucagaaagaguguucugauaaacaucuuugugcauaaagcaguuuccauagaguucccauuaugcccuuaggauagauucccagaaauggaauuacuaggucaaagguugagcacauuuuuuuuuuaaagguuccugagucauauugccaaauugcuuuuccaaaagauuggucgcaauuuaaaugagcaaaaucagccuuuaagagucugguuucucugagccaauauugagugcauauucuuaaaaaaaaaucauuccuaauacaauaaacaaacaaauggcaaguuauuguugguuugaggggggggggcuuauuguuuaaugccugaaagagggagaauuggagacucugaagaaagagcaaaaauuuaauuugugugugacauuaaccuggccauuuggaucagaugccaucuaaagagauuuccauauauuccuggaugagaagcggacauguaagagagaucauguucugggggacuugacaguagcaucuucuggagauggugccucucucagaacugggggcccucagccugcaacccucggguuuucuggagaugccugguagcuaggugcacaagcaagcaucagcacuugucaggggcccuggcauucaaacugcaguacacacugcugaucuggucagggaaugagauggggcuguaacgacuggccaaagguacacguguagaaaacaguccagcaaggaugggaaguggucagaagagagaggucagcacacugcccccuuccccacaucccccuuggagauguggcucauagugacuggcuucucugagacacuaaacuccuguguccuugaaggcgagaccugguggccacgcaugagcagcaugacauucuucauuccacggacgaccuuucuguccuuccacagugcccagggugugcagugaccucuugccagggacucuuauuaacagcaacaucaauuucacauggcgcuuagagcaaacgacccugcauucauuuccuguggauacuguaauaaaugaccagaagcuagggagucaaaaauagguauuugugaacucguguuuucgggcuaagaagccugaacgugacacuguuaccagaggcuuuaguagaggguaacucauuccuauccuggcuucugguagcucucaccguuccuugacuuguaguagcaugguucgagucucuuuuguggucucauggucucuucugcuuuggucagucugaaaauuuucucugccuuugggauguguuuguguguguguguguguguguguguguguguguguguuguuuuaacugcuuguguagggaagcuggcauugcuaaguuacugagaagaaacagucucagaauucuacauucauccccaaaagcagccccucgucucuaauaauaaauaaacugaacaucgagauauuaaaacaauuuguccucaauugaaaaagaaguugugaugugugugugcgcgcucgugugcgcgcaaguguguguguguguaugugcauguguguguuugcauguguguuugugucaauauccaacccaucucccccacucccgccccaguaucccacccccaauaacucuaauacugaacaaauccaaccaauauguuacggauuuaauacagcaucaggcucccccagguacaauaaaauaccaaguuaagaguauuaauuccucaccagccggaugggucccagcugugcacacgcguguggggcgugaggguguacgcucagcgggugcaggugcugacggcgcuguuccaccucggagcacgcgggccgggaacacagcuguuucucaaauccuccgccacucgcugcaaacccucuaugaaguugugcuaccucuggguacaauuaaaagcuauauacacauuucaccagguaguguuagaaauuuaggcugagccaaaaaacggaaagggagaaggugggagggagaaagaaaugacucccuuguuaaggcuggcauuaaccuccuuacccugccuauugaagcaauaaagcuuccaaaugccucauggucuccaguguuaggagaggagaguugggguguggaaaagguguuagagaggagccuuccugucuucuuccuguuccuuccugcuuccuucccuucuucccuuccauuuccccuuucuuccuucuugccuuccccccuuucucccucccuuccuuccuuuuuucuuucuucuuucucccuucuuccucucuccuucuaguucucccuccccuccaccucuuuuucucucuuucuuuucuuucucccuuucuacauucuuucucuucuuuucccacuuccccucccucccugucucuuauuccucccagucucucucuuuccuacacccccuucuuucccacucuccuuaccaauuccuugcuuaaauuuccccgucuuugcuucugccucagcacccaggccuguccguauggaaacaucuaggccuaggcuaaggaagauagaauuagaagaggccaagucgacauguggaaggccuggaucuggcagcuguuuuggagaaaggggccacaauaccucagccacuuuuauccuuaccuugggaaacugauuggcuuuacagccugggcuagcuuccuuuccauggcgggccccaugcaguaagucuccuggaacccagccacagaaauggcagcugaggcuccagggggcagggacaaugacuguguucuguggccucaacauccacauagccacugcuuucaaugcaggaaccaagggccacucugaucuuccuuugucuucguuaacacacagaaaaaucugaacuuuccaaaaaggaccucuucccaaaggaagaggaggccaaauccugucacugcaagucugugccugucuagugguugcaaucagagucccgcuguauaugagagaagagggcgggccaggaaagccgcaguguccuaucaguaagaggaguuggacauguaugaaaccugguggggauucgcuuccucuggccuuggaagaggacauaagagcuacagaucugggcauggaugccuuuuuuaggauuacaaaggcagguauaaccagagcuauagaauugcuauaaaccuuaacacuuuacccugcaaaaugguuuagaugcaaccaucuugccauggaagacaaagcuggcagauaaagagacacugguuaagauucuucuuuaaaauuuauuuuaaaaacuauggguuggugggugugcaugcguguguguguguguauguguguguguaagccagugauagguaucaaauaucucccuugaucacucuccaccuuaguuuuugaaauaaggucccucucugagccuagagcaaccugacucagccaggguggcugaccaaugaugccccgugaucuacccgucucuguccacacaucccuuuucagugggugccgguccuccuguaaguguaccaugugcuuucguccuguuuccaggcaccgugguaggcgcacucuugugucaguucuccauaguuccaugucaauauauauauauauauacauauauauauauauauauuccccaaaauuaaugacugaugacauugagaccccuguagggaaccaacaacucuuugguggcccuguuugguaggaagcagagacggugaucaaaauagccugagccccaggucucuaggaucuccccuccucucagccacuguuuucuagaagccagagccuccucaccugucagcugugggaacgugaaauaaagggagugcacugaaugaaugcugguuaaaaacagagaugcuauaaagaauucugucagacagcauucuugauccuggggaaauucauauccccucgccauccgauuaaugaaucaaguagaagagauugaugcguggcagcagcccuuuagaaguaggcagugucggggucugauuaaaccgauaccccggcucuccugccgccuggauucacuagcgaaaucggugccauuaggaggaauuacuacaagaggcccagcaaagcacagcuaaauaaacgcugccgucuccaacccugcgauugucuuauuaaauaaucucauugccguuuaaguguggaccaggagcuccugccuccgaaagcccgccugauuaacuauauagccuuggccuccaguugauuuuauaaacuucggauggugccccagagggcaaagcuuccuguugucaauucugccuguugcuauagauaccgaacuccacaaucaguaauuagagcaugcccccugccccagaacuggucaaaaggugcagcguguuuggcaaauggucuuaaaagcauccgcacuggaguggaagucuaucuccaauagugacaggguuuguuuuauucauaggcuugaaguaaaaaaaaggagagagagagagagagagagagagagagagagagagagagagagagacuaguuuauuggaaaccauagugaaacauaaguaauuauuaugguuuuauuuugaaacgagucuauagagccaaguuuggccuugaacucacuggguaguaggaugaccuugaacuucagguccuccugacuccuuuucucaagugcugggauuuucuauucccaguguauguggugcuggggaccaaguucagagcuucccacaugcucagcaagcgcuuuuccaacagagcuacaucucugcuccccugugcucucaacaauagcaaugagaugaguuuccuuauccagguauguuaaucacaagaaacaggucauccaaagaccaccuuguuugacucgcccuagguaagaugggguccaucuuuacauaucuuuccugcggagcucugagcaugggccucagcccucuuccauccuugugacugugggcugcagaagggaaauggcagaucgguuuaugcuauuuagugucgcaaagcagaccuugacagugcuugucuuaacgcucucugguaaggaggacugaagcacuuacagaguuugcagucuuggcuguuuucuuaaaaucaaagccagugcagcucccuaaaguggagaagaauaaggaggaaggcccacguuggacacuuguggaugauaauuaaagauggcggcacugaccucauuucuaaaugcgagaaaacaaauucucagagaauaauuggcuuucccaaaauugcucauuuucuugucacacaucugggauuaaaaucuauuucuuucuggcuccaaauauacaguuuuuuuuuucuagaggaauauuucucucaaguauuuggggcucucugcucugcccauuuuucaguuugaaaaucaauucugaaauuccaaauggugcauauuuaaaaucguguuaaaauuuccucacaaacgcuccacugccugcguggucugccaggcugaaaaucucaucgauguuuccaaagugcugucaauuguauuuuugauuccuuuaaaaccugccuaauugccuuguugauucaaacaccccaagaaugcuuccuaaaugcuuauggcauccaauagugucgggagauaaauggcuugcgagaaugauuugggacaugcaaaugaagccuccagaagagagcauguuaccuaaaucccgaccuuauaacagcuagggaaucuggccauguuucaagugacauucucuuaugagaugaauaacaacaagccugagaugauguagacuucagcuugcauccaagugcagagagacuagcuuugacuggaauucagucugucauugugucucccaaugagacagguucuggcaagacuccacuguaucucccuugcauggggguacuucacagcuuuaacagggagaggguuugagugacuaucaugcccaucguucuaagggcaaagagaaaaucugccaaauucauguuauaauuguuacugauaauaguacaaauacacauuuuaaguacauuuauuuucauguguuaucccuaccauaaucccuaccucaugagagguaucaucaucucuuuguuaccuaaguuucucuuugacuugucaaguauuuauuggguuuuccuaugaguacacacacacacacacacacacacacacacacacagagagagagagagagagagagagaugugcacgcccacagacacacucacaagauagaaacauauauuaaaauaaagaugcgagguuaaaauauuuacuuuuggacagaaaugucuucucgugguuaaauaucaaagaggaaaggacaaaagacagcguguggauaugucuauguuuauagcuauacaucauccuuguacgugcacauaugcucugccuacagauuccuucucaccuacucuucuccugaaacucuauaaucauuucuuugugcauucucacagacaccuuuaugcaacgaugcgaugauguguuauucucuuaauguucuuccugucccaugcauacuucauuccucccacuugacaauauaucuuagcgauggccccaaaucagcauagaaaugaugucuucauuuuuuuuuuaacaaccggugacuaugucccugcacagauauuucauaauucauugaacucguucccuguugauagacauuuggguuguucccaaucucccacuguugcaaauugugcugccaccaguaaccucuugcagacagaauuucccaagccccagagcagauuugcaggauggagccuagagaugcaugcauuggucauuuuuagagaugggaaccauuugccccacccagaggcugcucuaguuaccccucccauugugcaguguaggauggggggugguacuucuuggccuccucccucagguggagaagggggagacugcguugguaggaagcugguucauggcucccgaauauccuagaggagaaacuuugaugccacagaagauggaccugaagaaaaaaacagacccaaggccacacaucuaugcaauaugccuuuguccacugggcaggguguugcgacgugagcugauguagaagcaagagaagaaaaaggcaccagagaggcuuguugcugaggaggaacugggaguggcauaugaggcaggggaaugcugacgguuauuuuggaccuacucagggcuguuauccaauaagaaagaaaggcagagagauguggaagaugcuggucuuggcuucaugaagaugcugccaucaugagcaagaaccuacuguucauuauggaaacccccuuuuccuugacccgagucagagcucuuuccuaccaugccagcccauagaagguuauccacacaccucauuuugcgagucccaaaucucuaaaaagcaagaguuuugguuuuuuuuuuaaaauagguuaaauaguuaaaaguauauuuuccaaaugcucccaggaaccucauaaagccuuuauugucccugccacagguaagaaaauuaagggucaauauagagguuaaguaguucugccaggcucacauagcuguugugcgguggaauagguuggacccaguuucucuuccguccuaggcucucugacuuguuggcuacggcaguagcuagggugggaaagaaguggcaggggcuuuauuucccccaaauggauuucauuuaacuggugggauucuagucuuccacuauauccaaauuguuccucaaguguuaaggugaguacaucugauuuugaaaaguauauuuguaagcuagcaggggugggguugaaaucagcagcaagagagcagaaugcauaucuucccauuaguuaguucacuaugugaccaggaaaaaaaaaaaguggccccagugaagauuuuguuuccauugcccagucaggaaacccaggcuggcgguaccaucccauaucccacacaaaggcacaacuguaagccaguaugcagcaaaggugacccuucucugggcuaaagauguaauuuuccauaugcuaacagagaagucuagcuuccugucucugcagaaagguuuaaucuuuaucagaauggcucugcagauggggccacacacuguggcucgguccaccuugaugcuauccagccuuugcaagcauccagaugaguuuaagagacaguaggggagaagaaacugguccugaguuuaccaacuuuuugguccaagguuaagauguaguuuuagggcaccccuagauguuaaacgguuguaugugaaggagugcucacuccagcuaucugauuguuaaaaauaauagcaaaauuaguggaugguuguacuuuaaagcugcauacauuaauuuuagacuguagaauacagugcuuuguagguaacaagucugaugcuucagaaauuuuaauggcuuaacacccaagaagaugucaggaacacuucaaauuuuccuuaauaguaaguuccuuaaagaaaaaguuuaaguguuuaauuaaaaauuaugcauaugaauauuuucccuuccucgugugucuguguaccauaugcaugccuggugcuaguggaggucagacuagggugucagauccccuggaacugagguuacagauaguugugagcggccacgugggagcuaggaaucaaaccuggguccucugaaagagugucaguuguucucaccuguugagccaucucuccagcccccuuuauauguuuuuauuagcauauauuaguuaaaguaggugaugguuuugaugauggcauucucagguucguuuauaauguacuuugauuguauucaccccucauuacugucucuuauucuccucaugccuuaauuuaauuucuguugccaagaugagauacccugaaaaagagaagcuuagagaagacuggauuuacuguagcucacaguucuaggaugcagucuguaauuucagggaaaugacagugacagaaggcuugcagcaauuaauuaccuuaagucacuaccuugugggaagcuccacucucacacacuucaggacugccugccuagggaaugacgccacccacacugggcugacucuacccacuuacaaaauaaacaaacaucauuuaaaaaggaaaagagugaguucuccuaugggcuucacauccgcggcauccccauguuccuucuuugcugcuucgacacuugccaccgugcauauguauguagauacggaaugaagcccaggucuugaagagggugggaaaauacucucuugugccugagguuacuuagagauuccuagagguccuuugggaagacuuauaaaaacuaagaguuagguuugcagagcacuugccuguccugugugguguucuguucccacucagggggaugcagacacuauggucacauggucuguucuucaauggcuggucaguuaggcacuccaaucacaaguaaacucagaguaaccuaggacaacaguccauucauugggacuuaaaaaagugcugccaguucgagccucauccaaaugggaauucucagaguguggagauggguucucacggggcuaucauuaagaaggccuguucccuggcugcuccgauggauucucaaguucuaaggcaaugaguuacugccggagggcugaccaggaggaucugcggcccuugcaguaggaaggggugaggauugcguuccauccagagaccacagcauuuucagucaccagagaaaguccugagaugacaggccuccaacaaaugugggagcagcacauuuucuucccuguuucccuaccuccuaggucuuccuaccacguaggguguuaucuccuugaaaggauggcacuucuaguagccuacugauggcccauugaguccuggagggccauuuauacaagggagaaacagaguaacaaaaucaaaaggaagaaguucuccucaaaagcaccauuugccccugagugagauguguuccuaggaaggaaacuuugcuuguaaacgggcaaaacaaaaauauccuccaaacccuggaggauuugagguguuuuacaacucaucucccaacuuaggagagaaaacuggacugcugcuugugggauuucuccccccucagaaauaagauccuugaguaagcuugaacagcuuaggaaauuugaagaaaugauccuggauggcauggccacaggaaugucuagaguugaguacaagguuggccacccaggagcccauaaaccaacucuugacccucguuguacugacuacagccgugugguguucagagucgugcuugagggauagaugucuugcuccuuccgugcucucuuuguccaggaacugacuucaaauauuaaauuucagcaggcauagguguuuaagcuacagugaagccuucugcucugcuacccagcacaugcagaaacacacacacacacacacacacacacacacacacacaccccaaaacaaacagcucuaacacuguaucuccuguaucggcaagcaaucauaucuauauguauguuuauguaugcaggugccugugugcaagggaguagaggucaaaggucaacacuuugucuucuccaguugcucugcaccuuaauuuuugagacagggucucucaguaagucugaagcuugccgauuagguuauacuggcuggccaucaagucucaggaauccuccugccuccaccuucccagcacugagaucacagguaugugcucucacccuuauauaugguucuuggggauuucacuccaugcucgcccagcaguuuaccuacuaaugccaacagagccauucucgggaccccugaaagacuacaaaaccucacuuggcuguauaagguuguuuuuucucucaguuuugagacagggucuugcuguguagcccuggcuggcacagagcguguuauaugcagaagauugaccuugucauuuguggugacccuccuuccucugccuccugagugcugagguccaaggcacaagccaucaucccacuccgucaguugaauuuuuguuugcagucaacaaggcagcgugguaaaccugaaagagcagacgucagcuuucucucaggcgggauuagguugacucucagcuuuggaacuuguaggugaugaaucuugauuaagaauacuucucuuuuucuagaacccuucaggacagacaaccgaaaacagccacaggagguguuaagugaacagugcccugucauucaaaaugaccagcauuuauucaggaaagacauuggccacaucucccacggucuugcaggaaccaucugaacuuuggguucaacauuuguccucaacauugggacauuuuucucucugucguuucucuuugucccuuaaacauuccuuuuuauuguuccuuaaaaaaaaaaaaacaaccaaaaaaaucgcguauaacccuuugaaguuccuccuuauauauugucauuuguaaagugcuuugcaaggagccuuuuacaagugcuuuaccagagugagguaccucagccucuugaacuuugaguucaguugcgaaugugcagcuuguccugucugacguccuggccccucugaaagcgaguaucuggauugucccaguggccaagagaaacaggucuaacgcuuuaucacaucagcguguuucacacugggauuugaaccagauggaggaggaccugguuuguggugggugggccugcuggcugcgccuucgccucagcuuccucagggaugccugggguuuguuccucuccuuagauuucagaauccuggcaggcagaagccuccgugagcuuuuccuucugccuccgcaugacguuuauacaaagaagucgcaggcaugcuggaaaccuuucuagcuugcugagucuaggguaaaguccccucuuccccuccacccaucccaguuagcaugaugcacagccaaauuauuguuaucaucaucaucaucauuauuuuuauuauuauuauuauuuauuguuauuauuuuaacaacuuugugaaaaacccagugagugaagccguagauuguacuaagccaaugaaauacauauuguaguuucuaccaccagucauccccuacuuugaccuuuaccuugucaaccuagaacacaauucauucauuuauuuauuuucauauguaugacuuuuuuggcugcauuuguaugugugcaccaugcacaugucuagugaccguagaaguaaaaaaaaaaaaaaaaaaagaguguuagaucuccuggcaccagaauuacaagcaauugugagaugcccuggaggugcugggaaccaaguuuggauccuucgaaagagcagcaaaugcccuugacugcugagccaccucuccgugcucagcauuuaaccacucaggaacuuugugaaaugugaaggggcucacagauuucacagggguaccccauuaugugcuucuucaguggguguggguacguagaucucauucacucucaaaccuugaccccggcucacacuacaagaggagcaaaaagucugggaaaagaagggggaguacaguuucaaaccugagguagggaaagaggugcuuuccauuuucauguauuuaaacuaaggcuccguacaccaacuuucccugcauuauuguuuguuuguuuguuuuaaucuuaaugucaugugaggcacagucuuuuugagaucuuauaaaaagacguaagcaccacuguguguuccuguuguccuuguucaugguuggcaaugcagagcucuauauuguuucuguaguuuuaaaagucaguacaugcuccaguaguuggugacguuuuccuagugggagucagucagaccuaggcauguagaauuaggguggaacacgggcaguaauggccuuggucacucuccaacaaauguuucuuuccaaaaaccuucacaccauuuuuuuuuccaaaaucagaauugguuucuuuugauauuuuccaaaggagagguuaguauaaaauuugaucaauucaugcaaguguuccaagaaaaagaaaaagaaauagaaggaacagaugugaaaggccggagcuuaugcuaucuguguaaacaaaaccgaaggaggggccuguucuauccugauuguaccugcuguagccacagugacgugcaggaccaaucagugcuuguacagagguccaggaugcaacuaagguaguaaguagcucgacgguggagcacaagccuagcaugcuugaggcccugaguucaauauccagcacugggaaaauaguuauacauauagcuaggugguagaguauaugcuuaacguauagguaggaggcccuggguucaauccccacucuugcuaaaacaaacaaacaaacaaacaaacaaacaaacacaaaacaaaacaaaaaguagagugccaaagugaugucucaggaguuggaaaacauuggcuugcucuuuauuuaccuuuaaaacgguuuuuaacugguauucuaaaaaaaauuuuuuuugaauuggaauaucucuaacaauucuuaaauuucauuuugcguguggaguuggguagauauuaauuucuucaucaccuacuucuuuuucugcucugcacugccuuccuguauucuuggccaaauguucuaggagguucuuuucauuuaugguggagaccuuuguggaaaugaaggaaaugagcccgaugccauacacuaauuaugugcauuucuguucagcauucguuuuccacuguggaauuuuuuuucucacacauagcaauguaaauuugacauguucacguguaauuggacuacggguggugaguuugagagaacaccauuauaagccugaauuuuugaaaagcaaacgaauguggggcuaccaaccucgccugaacaggaauguuucuuccuggguguccacguggaagucaggaaaaccaagagugcaggaccacacuugauccccugcucauacauauccugacaaacugucacaggcaagaugggcuguaagaccacggggcuggcuacagaaagcuggccuuuuguccccagcuggcauggauuucaggggcaggcagggaggggcugacuucuccuuucccagugugauuugaggcuaugacucagcaugccucccccaccccccaguuuccagaaguaugacggaggccccaguguccugcaaagugaauaguuguacggguagaugacagcgaccucuuggccuuucuagaaagaaugcaauuauguuugucacuucccaaaauuaugugugcaaacuguccaaacugcaagauauaucuaacaagucaauugaauuaaauuaauccucccccugacccaucuuaaagaaaucuggaagggaaauagagcccugaggagaauagagacgagggaacugaguggagacuauuaugauauuuuauuaccauaaaccgccaagggucacuugcaacucucaucuaccagcuaauuccaauuccguuaauaugaauauccucuggcuucaggaaggaaauuccuuggauuuuaugggucucccuggcaggaacauuugacucuaaugcuucccuucuugugauacaccacguuuacacugugucccacccauuaauaccuccaguaaguauuuccucgaugggccucauaaaagucaccauacuuccuuucagaaaggaacgaggagaucagagggaaccguuguuaacaaacccgauggucuuggccggaggugucaagaacaaauccagcaauguuagcuuucaucaaaaguguuugccccaauucguuuuguaagugagagagccaaucacgacugucggcuuccuuggaauuuguaacaucacuggagcaucugugaggcacacugucuuaguuaggguuuuacugcugugagcagaaaccaugaccaaggcaagucuuacaaaggacaacauuucauuggggcuggcuuacagguucagagguuuaguccauccucaucaaggugggaacagggcagcauccaggcaggcauggugcaggcagagcugagaguucuacaucuucauuugaaggcugcuaguagaagacugacuuccaggcagcuaggaugagggucuuaaagcccacacccacagugacacaccuacuccagcaaggccacaccuacuacaacaaggccacagcuacuacaauagggcuauuccuucuaauagugccacucuccgggccaagcauaugcaaaccacacacacccuuggcuauguccgugagaaugauuccagagagguuuaacugaucagagauacccuuccugcaaguggguggaaucaucccuuggggugggggcccaggcuaaaggagagaagaagcugaguaucuuuuuuucaccucucucugcuuccugacuguggaugccaugugauccuaucugugccuucaacugcgaacaucuuuaaacacucgcuuccuuaaguagucucuccucagauguguugucauagcaacagaggaguaaucauugguacagucaucuuugaaagcuuggagaccaugaacuaauuuagcauuuaccaauauaaucccuguaugagcacaagaucauuuaagugugaaaacgggguagugacaccuguuaucucguauguuaauuaaaaugaauucaaaacaauguuuagaauggcagaaguuuuaggauagaugcucuuuggguuuaggcuuccuucuuucccucacucagcuugacccauuagcucccuuacauuaucuggaagcagcaccgaauuucuagguguucaguuuguuggcuguugacuuugaauauugucgucauuaguacagacuuguuauaauggaguaagggccucaguguguugggaaggagauggagccguucucuguccccuccucacccucuggcuuccuucucuuccucuuccucccgcucaccuccuccuauccucccuucccaccccuuaaauucuuaaugacuuccaggugugacucugcuggcccaggcucccaagaccccauccugaggaugcugggccugagccuccacaaacacaagaccaaagauaggggggugucgugggggaugcaacccaagcacaacaucgggagaugaggagaaagaaaccuuugaagcuuuguggaugaaacuaguaaauaauucuagaugaggccuaacugguucacauuccaagaaaggaaaaugguuuuacgcaaaccguuucccuggacccaguggauucuugcgaauaccuuucaaccccgugauugaaagcccaaggccugugauccacagcaggguccacagccagaaauaauuccccuagaaaacugccugggccuucaaauggccccugauuguuuuucuuggauguucuacuuuccaaaggccagaaauuguuucagggaaccauuaaaguucgggaagguuuuauguucuaagagcaagguauugcacucauaggaaaaccagcaauuagucacgaucauuucccuuggagaggccuacaacggucggucuauuucucagccuuggggugggacuugcaguguuucaacaagacccuuccauacugcguccagagccuucccuucuuuucuccauaugacuugguuucccugggucagguuaagcacuacucgaccuccugugaauucuugccugacacuuuuagcaucuuucuguggcaggggcugccuccccaccugacuaugguccuguuugcugugcacagauuauaaagucuggauuucuccccacaguagucagacaugccugagaucaauuuacuccauuuaucuaucugacagguacuaccugucaccugacacuuugaaggguccccuccccacccuccaagucuggccaucaucacagccuccuguccagacaacuugcucucacacaucggucuagaggugucuagcuggcugucauuuaccaaagcugcgacaucaccucucauuugucuugagcucuucagucccagcagagaccauggcacacaguagguaugcaggaaaugcaacggggagcgaaugcuucccaggugcuguaaacacauuaagcuuacaggagccaagagcaaaacaggcuggaagccaaagauaauucaagcaggaucgggcucccaggcaaucuauucguagcagagucuuucucuaccuacauucuuaacucccucucguauugaugacugugcucuccugaaauauuacagaaacugcccugaacaaagauggaugguccuaaccucaguagucacaccuguguucugucucaucuaccagcuuccgugccccaucccuucugucuccgaaugguaauaauaguaacucauaauaauagcucaaaauaauaauaaucauaucugggauuuauguaucagcgugccucccaagagggcaaauaaaccauuuuggacaaagcaaagcaaaggacggaucuucuugguaccacugcagcucaggcaaaggcaggagagauuuacagucaaaugccaucccaaggaaguggggcuucgugcuucguuugcaugugggacucuggcuuagaguugcucacuuaguucgugugaacugccaagugaauguccgcgacacacuuugccuguaguuaaugugacaguuagugccagaggaaacucuuuacauuuuucaagggagccccguuacauugaagcuuugguggaaacuucuguuggucauuuucuucuggugucugaacgcguucucuguugugucuuuggaaagaagcuguggacauuaugugccaauuucuuuaauuuuguuugguuucuuuucaguuaaaggaucgcaaauggaggauggaagcauucugaugaucuggucgaauuauuuauuuauuuuuauuucucugaguaccuggggucaguagaugauguuugcuuuugagaauugaauuuucccaaggaaaaguugguguucccgugaggagaggacaguaagauaagaaaagguagaacuggccuuagaaaaaugucuguggcucuaaggauggugucuguacaaguuuguuuauauugucaaucugacguaucccaggaagggggaaccucaacuagauaauugcccagaucagauuguccucuggcuauaucuauaggagacugucuugauugauaucagagggcccagcccguauuggguggcgccaucccuaggcaggcguucccaggcuguguacaaaaacaaucugagggagacagagaacuggccagccuauaagccguauuucucugcaguuuauccuucaguuccuguuugaguuccuuccuggacuucccucggugaugggcugggaucuggaagagcaugcuuaaauacucuuuucccucccucguugguuuuagucaugcucuuuaccauaacaauauacggaagcuggggaagucuuucacuuggucuggcccauaccuagaagccucuucauaaacuguuugaaagcaaguuguaaugucuccaagggggacuuuugcacugcugauucauucagugccagcauugauucaaaaccuggcggcugaccacaguuccagccaagccuggcaaaacucacgcaccauggggccugauaaagcgguuuuggauuuguguguuuucuuacagugccuugcaucucagcgcuguuggaaguacuaagcuucuuaccuguuuucuuucuuuuucuuuuaaaaagaucucaucuguagucccaagaaacugacaaagugcaccagucuugcccaggaauacagaacucagacauuauaccuaaaaguagguuuagggauaugucccuaaaaugcaguccauucagucugacagaugagccggguggccaacagaaucuugaaacuucuguguucuuuggucggugacacacaggaugcugcuguucuuagaacugaguucauuucuacaggggguacuaauggcagucccagcucagcauccccuaaaccaacaucccccagaccagcauccaucagcccuuauauuuuuugcccucuugguagugaugagugcuuagcuagucuuuugugugcccuccagcauggcaccuucuggaauucaccagacucuugcucucugggaaaucagcagaaaacgaugccaauucuugauuccucuugaacuucacgcagaucucuccccucugugccuguaugaagacagcaaguagccugcagccugcuaacugccacauucgugauuaagacacaccacacacgucuucauguauaggcguagaggccagccugcuucagagaacaccgugugccugcucaucuugccugcaccucuuaucuaggaaacuuaagcuuucaggaugagugauauggagaacaugacaucuacuugugucauuagauggaugucaauacuuuugaccgaggggacagguugcaacacaccagucugaaaaugaacagacucauaguuauccagaaacacuucuuguuacucaaaugguuuccacauaggaggucucuguggccuuuucuuucaaugucccuacuaggaagggugcuuggguccuggguuugaaauagagcugguuagaucucccacuuucuacaagagaaaaucaaaaccaaacgaauuuuacaaagcgaacacaggucuuugaccugcuggcauaaaucuuugguuggaggaaacaagcacuuucaaaauucucauuuucaucagaaagaaguuuuaccugaucguuugaacucuaaaagacucuaaauuuaaaacaucccaccugcucaucccacccccaacccccaccccugcacaaacaaaccccguuuguucuucuuccucaaaccccgcccccugcucucaagcagaaaagcccggaucacuccuugucuccauguuucugaaaagccacccaaaagugaccauggucaccacccaccccacacccaagaccaauaaaacucccuugcuuuagccugggcaugugacuccauugaccucuacccaugaaucagugaauccaucugagagcugccucucaauaaacccgcccucauacucuugauguggcuugaauuggcucguuacauugggagagaaaccugaaaguuaaccuuugcuccugaacugguggauucugggagggaugguuguuauuuucagccgugcaccccuuuguugagccugccaggcuccaguggauaacuccaaacccguggucauuggagaaggccuugguuaaaaaucagcgguggcucaggaauugugcagaagaguuuuguuaggaagaggggccauuggcagaggugggaaacagcuaagaggggggggggggggggaggaaugaauauccagaguacacuguauagacauguauggaauuacccaaacaaaaucaauuaaugguaaauguuuucugcugugccugucuagacagaagggcaaaagggucucagggcacuuggguugucuugagugacggggaagaaguggccacauggcacugucccacuuccugaagaauggcaaggaugggccaccacucauuccacaaaugcguagaguccucgagaggccaggaucuagacaggcucaccacagcugagaggacagaucagcugcguccuggauccucucacugcuuccauuuggaggaggcacaggagaaaggcaaggaaaucacaggguuauaaaaugacuucuagaaagugauaccuuccugugucucugggcaugaaacacaggcuagagagauuuaaaaaaaaaaaaaagaaguuggguggaaacgguuucagugguauugcagagcuagugguaccagcaaaagcccauugugccauguccugugggcagugacaucaugggugguagccugaguuuagccacagggcuaguauuguuaccagggaaacuggccccucccugcugcagccgaccuaacacugaacagaaaaccaggaagaaaguuguuuacuggaaagaauuuucauuuugaguuucaauauaaaaucagaggcucuguguguguguguguguguguguguguguguguguguguguguguguguguuuguguguguuuguguguguguguaugugugugucuucuuugaaucggcuuaucaugaaccauuucucaaguuacuauucauuuuuuuaguauuugcuuacucuuuuaguuauucuuacaugugcaugcuuuugcacguaugugcauguuuacauguguaugcugcucuguguguggauggucuuggaaaccagcagaggguguuggauccuuuggagcugaagucacaggugguugugagccacccagcaugggugcugggaaccaaaccaagucuuucaaaggaauggcaacugcuccucccaacugagccaucacuccagcccccacuagauuauuccuuuuguuuuuaagaaaggcaagccauaucuuacauccuguuucuguuguuuguguggguguuauugcuuuugauguuuuagagacaggauuuauccucuaagcagcccaagcuagguauggacuuacuuuguaacccaggcuauccuugaacuuaaucuacaauacugguuccuagcuccaccuucugagugcuggaacuauaggcaugugcuaccaugccaugcuuaguccuugcucccuccuuccuucccucccucccucccucccucccucccucccucccucccucccuuccuuccuucuuuccugcccucucucucccucccucccucccccucugucucugucucugucucucuccuguggguguauauguguguccaugcaucugugucuuacugugcagcccaagccaccucaaauuuccaauccuccugccucagccuccugagugcuggcaucgcuccacuccuggcucucaaauggcuauuuuuuuuccccacagcauuuuuagaaacacaaaggagaaggcugauuuuuuuuuuuuuaaaucuggccugcucuucaacguuaagugcacugauucaaguggcugcagauuuuauggcuucuccccagaacaggagcucccccuuuccauucuccucaggcucacccauaaagcuuuucuguuuuuugggggggggugugugggagggggaaaauucccaaaaaucugucugguauauauuacaaaaacuauuaccaccuaacacauuucacguauuuaaauuauuuguucuauuaaaacgucagcacaucucuugaauuuuaaucgugccugaggaucaaucaccgaaacggcugcagggaagacuuuacgacuuaccugaacaguggccugcucugcggcuuggcuguauagggacgcuuccaguuuaauacguuuuauuagcuggcgagaaccacccaagcagcuucuuuuagaagucuuauucuugaucccagugagaauuuacacagaaccauuagaaaaaaaauucuuucaaugacaaugaaaauuaugauaauaguagaccaagcgaauauuagccaaucaggguggagcauccugcuguguagcacacccaggcuucguggggaaaaugcccuuugaccuucacagcaguguuauuguaucuacacaaaggcugucuucauaguacucaggagaaacugggggcagagggacuucagugccuaggaccaccuagcuaguauucaggucccuaucugcuggaaugaggucccagcagcuagcccaccaugcaauaccagccuauguccgucaugauaggaucaacuuauuuuguucuaaaaggacagaaucuucccccugguuuuugccauugaucagccauguaggcuagggcagacuguuggccgucuuuaauguucagaucuuccagaggguacuugggguggggguauuaauagcaccuacuuggaaagguccuuugaggaacccaggcauuguguuagcugcccuuacuaagcugcccgguguuggucaucuacacaagagacagacacugaaaacucuagggagcaaagggcaggaagugcacaccaaacucugcuggccaccgggagcccaugggugcucagucuuuuucuccuguaucucugcuucuuguuugcggcaugacaaaaccgcugcugaguuuuccagagcgugcaagcagacagggaaugcuucuuggagagaaaagaacgcauccuucauuauguaaaguugguccaucaugccuuuccuagacucuugcgugcgaggagguaugcacauacauguguguguucagacacuggucagauaaggauccuggguguccuagccaaucauuccaccucauccccuugaaacagagucuuucacugaaccuggagcuaggcuggcagccagcaagaccccaccaugauccuccugccuccauaucccaggcauuaccaguacaugcccucaugccagccuuuuuacauggguucuggggauuugaacucagguccuuaugcuuagacagccauucucugagccaucuccccagauccccuuucaaaauacacacauacacauacacacacacacacacacacacacacacacacacacacacguauauggcacaugaguguaggggcuaugggcauaugcuacgacacucauauggaggccaaaggauacuugauagggucaguuuuccaauuacaccgagauuaucagggaucaaacucaucauuagauuuuuggcaaauacuuuuaccuacugagcucugaaccaucgcccuagucauccuuuuuuuuuuuuuuuuaagaaaaaaaaucucauuuauuugucuguaauuguaugucauucccaaaucuuuugccccauuaucucugcuauaaccacacagcuuuuuuucuggccuauuuuguucuccauugucaccucugcuggcuccuuucgagaucucucccuaaugcauuuucucucucucucucucucucucucucucucucucucucucucucucucucuccauuuuccuuuuucaauuuuucuuuggacagggucucuuauagccuaagcuagccucuggcuugauguguaguuaaggacaacccucuaccccugaucuaccugccuuugccuccugaguauugagauuauaggugugcaccgucaaacucuguuuaugcagcacuggggaaaccaggacuucauacaugugaggcaagcacucuaccaacugaacaccagccccacccccagcccagcccagcccaguccuagcuccccuagauucuuauaaagaauuuauuuacauaauuaaguucuccauaugucuuugccuauaaaugagacguuucuagauuuuguuggaaauugacauccacuguggguuggaacuuguugaagggauauuaauacauuauuuacuagaaugaauuaaauuuucaugucauuucuuuauuuacuuguuguuuuuauucuccagcaauguuauuuaugacagcaacaaauuaaagacaacuuuauggcucuaucaaugaaccaagaaaacauuuaccccaauuuagcagacacuauacacacaagaaaccacccucaaugcaguggaaagaguaggacgaucuuccaauaucaucagcauccagugcgcuguccacugcaccaucccauccucuggcuucuuccaagguuaucaagaacguuaguuuaaaaagggccugcuccaauauuaucccaaacagcaacaugguaaaaagccucccauuugaaucagaaacuagacaaggcucuuuacugugaugaucaguauuuacacagguuacaaauucuaaacauacauauuuuagagcaaaaacaaaaaugacaagugacuagaaacccaaaaugaucuucacuuaaaaauuauguguuuacaauucuagauaagaagcuaagauauucuagugaaagucacuagcaauaagguaacacggagaguuggcuggauaaaaaguaaauacacagaaauuaagggacuuuuccauacugcuugucguagauaaugaaagguaggaacaagaaaaaauuccaaauuaugaauaaagccauaaauuauuuaaguauaauaccauagauguaacugaauaacugaaugaugacaguuaauucuguuuauuuaaagggauuuauaauauaaugcacaucuacaauaguaugguuguaguggcuauuccugguugucaacuugacaauauuuggaaugaacuacaauccggaauuggaaggcucaccagugacccuuaucuggaggcuuggagauccuuaucuguaucuugguuugaagaucuugagccauaguggcuauggauuccagaagauugaaucuccgaguuuaaggaacacaccuuuaaucugggcuaugccuuucaucugggauuaaaggugugguggaacacaccuuuaauaugggcuacaccuucugcuggagacaauauaaggacauuggaagaagggagucuagcucuugcucuugcuccuucgccugcuugcugcgugagacugaguaacugcuagauccuuggacuuccauucacagcugcgacugaacaauuguugggaauugggcugccgacuguaagucaucaauaaauuccuuuacuaucuagagacuauccauaaguucugugacucuagagaacccugacuaauacaaugguguaauuucuaacauaggauaucucccucaacaaggguuacucagcaaauguuaaacuuagaagaauauuuuccugucccuaaucuuuuuuguuuucaaaauaaauacuuauugaacuuggaauuugugggcugauauaaaaacaggcuguguuuuugcaugauguauucuugguaacauauuuucaaggaaaaugggaagcaggccuauaguuuagucaagacagguucuugagguauucgguggggaaagggagagaaauauauggcagauugugugugugugugugugugugugugucugucugucugucugucugucuuuaguucaguacaacucaucaagugugcacccuucucuaaccacaacaguguagaagcccagggauccuuguguguugguuauuuuucuccuuugcugggaugaggcacucaaccuuggcaauccuagcugaaggauuuacuuggcuuaugguuugagagagugaagucccuccuagugggaaaggcacgguagaauuugugguuguggcgaggggagcagaaggcugcuggauuguaucuugauagacgaagaugcugagaaguuggaauauaacuccucaccugacccuaggagccuacuuccuucaaaugggccaugucuaaggaguugaccaccucaccaaacagugcuaccugcugggaacuguugggagccgcgcccacauucgccguuacaagauggcgcugacagcuguguucuaagugguaaacaaauaaucugcgcaugugccgagggugguucuucacuccaugugcucugccuuccccgugacgucaacucggccgaugggcugcagccaaucagggagugacacguccuaggcgagggauaacucuccuaaaauagggacgggguuucguuuucucucucucuugcuucuugcacucuggcuccugaagauguaagcaauaaagcuuugccgcagaagauucuggucuguugcgucuuuccuggccggucgugagaacgcgucuaauaacaauuggugccgaauuccgggacgagaaaaaacucgggacuggcgcaaggaagaucccucauuccagaaccagaacugcgggucgcgguaauaaagguucccguaaagcagacuguuaagaaggauucaacuguaugaauucagaacuuuucagcuggggaacgagaguaccagugaguacagcuuuacgagguaagucugaucuugaacuuucuaaggaaauucaagacagucuaucagaaguaaaguggaauauguuuggccuugaauuuuuucugguguuaggagcccuuuuguuccuuuucacauguuaucaagugauuaagauagggcugaaaauucuagaggaaauucaggacaagcuaucagaaguaaagcggggagagagaguaggagcaaagagaaaauaugguacacaaaauaagcguacaggccuuuccacgggucuugaaccugaggaaaaguuaagguuagguaggaauaccuggagagagauuagaagaaaaagaggaaaaagggaaaagaagaaagaucaauuagcggaggucucuaggaaaaggagccugugcucaucgcuggaugggcucggggagccagcucuuaguagcucugaagcagaugaagaauucuccucugaagaaacagacugggaggaagaagcagcucauuaugagaaaaaaggguaccagccagguaaagugcuagcuaaucaguuaaggaagccaaaagcggcuggcgaaggccaguuugcugauuggccucagggcagucggcuucaagguccgcccuaugcggagcccccgcccugcguagugcgucagcaaugcgcagagaggcaaugcgcagagagaugcgcagagaggcagugcgcagagaggcagugcgcagacucauucauucccagagaggaacaaaggaaaauacaacaggcauuuccagucuuugaaggagccgagggugggcguguccacgcuccgguagaauacuuacaaauuaaagaacucgccgagucgguccguaaauacggaaccaaugcuaauuuuaccuuggugcaguuagacaggcucgccggcauggcacuaacuccugcugacuggcaaacgguuguaaaagccgcucucccuaguaugggcaaauauauggaguggagagcgcuuuggcacgaagcugcacaagcgcaggcccgagcaaacgcagcugcuuugacuccagagcagagagauuggacuuuugacuuguuaacgggucagggagcuuauucugcugaucaaacaaacuaccauuggggagcuuaugcccagauuucuuccacggcuauuagggccuggaaggcgcucucccgagcaggugaaaccacuggucaauuaacaaaaguuguccagggaccucaggaauccuucucagauuuuguggccagaaugacagaggcagcagagcguauuuuuggagagucagagcaagcugcgccucugauagaacagcuaaucuaugagcaagccacaaaggagugccgagcggccauagccccaagaaagaacaaaggcuuacaagacuggcucagggucugucaagagcuugggggaccucucaccaaugcaggcuuagcggccgccauccuucaaucucagaaccgcuccaugggcagaaauaaucagaggacauguuuuaacugcggaaagccugggcauuuuaagaaagauugcagagcuccagauaaacagggagggacucucacucuuugcucuaaguguggcaaagguuaucauagagcugaccagugucgcucugugagggauauaaagggcagaauucuucccccaccugauagucaaucaacugaugugccaaaaaacgggucaucgggcccucggucccagggcccucaaagauaugggaaccgguuugucaggacccaggaagcagucagagaggcgacccaggaagacccacaaggguggaccugcgugccgccuccgacuuccuauuaaugccucaaaugaguauucagccggugccaguggagccuauaccauccuugcccccgggaaccaugggccuuauucucggccgggguucacucaccuugcagggcuuaguaguccacccuggaguuauggauugucaacauuccccugaaauacagguccugugcucaagcccuaaaggcguuuuuucuauuaguaaaggagauaggauagcucagcugcugcuccucccugauaauaccagggaaaaaucugcaggaccugagauaaagaaaaugggcuccucaggaaaugauucugccuauuugguuguaucuuuaaaugauagaccuaagcuccgccuuaagauuaauggaaaagaguuugaaggcauccuugauaccggagcagauaaaaguauaaucucuacacauugguggcccaaagcauggcccaccacagagucaucucauucauuacagggccuaggauaucaaucaugucccacuauaagcuccauugccuugacgugggaauccucugaaggacagcaagggaaauucauaccuuaugugcucccacucccgguuaaccucuggggaagggauauuaugcagcauuugggccuuauuuuguccaaugaaaacgccccaucgggaggguauucaacuaaagcaaaaaauaucauggcaaagauggguuauaaagaaggaaaaggguuaggacaucaagaacagggaaggauagagcccaucucaccuaauggaaaccaagacagacagggucuggguuuuccuuaguggccauuggggcagcacgacccauaccauggaaaacaggggacccaguguggguuccucaauggcaccuauccucugaaaaacuagaagcugugauucaacugguagaggaacaauuaaaacuaggccauauugagccaucuaccucaccuuggaauacuccaauuuuuguaauuaagaaaaagucaggaaaguggagacugcuccaugaccucagagccauuaaugagcaaaugaacuuauuuggcccaguacagaggggucucccuguacuuuccgccuuaccacguggcuggaauuuaauuauuauagauauuaaagauuguuucuuuucuauaccuuuguguccaagagauaggcccagauuugccuuuaccauccccucuauuaaucacauggaaccugauaagagguaucaauggaaggucuuaccacagggaauguccaauaguccuacuaugugucaacuuuauguacaagaagcucuuuugccagugagggaacaauuccccucuuuaauuuugcuccuuuacauggaugacauccuccugugccauaaagaccuuaccaugcuacaaaaggcauauccuuuucuacuuaaaacuuuaagucagugggguuuacagauagccacagaaaagguccaaauuucugauacaggacaauucuugggcucugugguguccccagauaagauugugccccaaaagguagagauaagaagagaucaccuccauaccuuaaaugauuuucaaaagcuguugggagauauuaauuggcucagaccuuuuuuaaagauuccuuccacugaguuaaggccuuuguuuaguauuuuagaaggagauccucauaucuccuccccuaggacucuuacucuagcugcuaaccaggccuuacaaaaaguggaaaaagccuuacagaaugcacaauuacaacguauugaggauucgcagccuuucaguuugugugucuuuaagacagcacaauugccaacugcaguuuuguggcagaaugggccauuguuauggauccauccaaauguauccccagcuaaaauaauagauugguauccugaugcaauugcacagcuugcccuuaaaggccuaaaagcagcaaucacccacuuugggcaaaguccauaucuuuuaauuguaccuuauaccgcugcacagguucaaaccuuggcagccacaucuaaugauugggcaguuuuaguuaccuccuuuucaggaaaaauagauaaccauuauccaaagcauccaaucuuacaguuugcccaaaaucaaucuguuguuuuuccacaaauaacaguaagaaacccacuuaaaaaugggauugugguauauacugauggaucaaaaacuggcauaggugccuauguggcuaaugguaaagugguauccaaacaauauaaugaaaauucaccucaagugguagaauguuuagugguuuuagaaguuuuaaaaaccuuuuuagaaccccuuaauauugugucagauuccuguuaugugguuaaugcaguaaaucuuuuagaaguggcuggagugauuaagccuuccaguagaguugccaauauuuuucagcaaauacaauuaguuuuguuauggcaaauagcucagcugggauguaaacaaaaguuuccgagauuguguguuacuuccauucaguaugagaaauuuacuagggcagcuaaauugucaaaaagucuuuuucaguauauguuacagaauuggauggcugaauuugaacagauccuucgggaauugagacuucaggucaacuccacgcgcuuggaccugucgcugaccaaaggauuacccaauuggaucuccucagcauuuucuuucuuuaaaaaaugggugggauuaauauuauuuggagauacacuuugcuguggauuaguguugcuucuuugauuggucuguaagcuuaaggcccaaacuaggagagacaaggugguuauugcccaggcgcuugcaggacuagaacauggagcucccccugauauaugguuaucuaugcuuaggcaauaggucgcuggccacucagcucuuacaucucacgaggcuagacucauugcacgggauagagugagugugcuucagcagcccgagagaguugcacggcuaagcacugcaauggaaaggcucugcggcauauaugagccuauucuagggagacaugucaucuuucaugaagguucaguguccuaguucccuucccccaggcaaaacgacacgggagcaggucaggguugcucuggguaagagccugugagccuaagagcuaauccuguacauggcuccuuuaccuacacacuggggauuugaccucuaucuccacucucauuaauauggguggccuauuugcucuuauuaaaaggaaagggggagauguugggagccgcgcccacauucgccguuacaagauggcgcugacagcuguguucuaagugguaaacaaauaaucugcgcaugugccgagggugguucuucacuccaugugcucugccuuccccgugacgucaacucggccgaugggcugcagccaaucagggagugacacguccuaggcgagggauaacucuccuaaaauagggacgggguuucguuuucucucucucuugcuucuugcacucuggcuccugaagauguaagcaauaaagcuuugccgcagaagauucuggucuguugcgucuuuccuggccggucgugagaacgcgucuaauaacagggaaccaaguacccaaacaugugagucugugggggccauguuuacauccauacugccgcaucuuggauugcuuuucaaccaucugccuccuucuuaugucucuguuuaccccuaacccuugccaacuccuaaacgauuucccaugucucaaauguaaucaucuuguaaaugugauacagaaagaaucagagaauagcuuauguuugaaacuggcuuuuauucuuucauuugagagugcuuauguagggagcgcucuacugaccgagcuaucuccccagcucaggccucucuauuguaaccacauuuauucuauccaguggacucucuggaaauucauccaaaucucugcaugugacgaugacgcuuuucuuacucagcaguauucccuggucuguuugaugugggcccauagcuuguuuaaauccacccuccuuaaaagaaauuucaggauagcuguugagaagaaagguguuuuaaacaucuguguauaaguauuugcaugaacagcaugguguauguguacuucuauauuguuggacccccuuugcuucuguguuuuggauagcucaccaguguuuauuucacaaucugucaucucaugagaauccccaaggagaagauauuacuuuguaaauauuccacgugagacuucuaguucugugguucaaaggaugccagaggagagcaucccuccuuucccaugcccaggucucaacugaauccucaugagccaccaugcaacucagcuugagcuacauaaaauacaaugagccuucacucaugccucauaacucaucugccugccuacacuuuggguucuucuucucucuccacuggcauucagccgcagauuguugcauuuaggcccauggccaaugggauagaguggaagaccggcucugaggccagugcucgcuuugcuuagcguggucccucaguucuguugacauggacauucugucugcacucagucagucaucuugcagcauggguguuguggguuacacagggacucugauaugaggcuuuagacccaucuaugcacccaccuuuccacacuauuggaaagggggaaugugcauggcaauggcaagaaacaguauuaucugggguuaaacaugggauuuaaauuuguuuugagaacuaacaaggauguacacccuuaauugaggacuccucugaccaagcaugugagcauauuacacauaugugugcucauauggaguccagacgacaacuucagguauugccccuuggguaacuugguuuuucagcuugaguuuuuugguuaguuaguuaguuugcuuguuugguuugguuugguuuuucagcuuucuguuucuuuuguuuucaagacagagucucucauugauuggccuggggccuguugguuaggucaaugagucuaggaaucuauguguuucugucucacuaaugcagggguucuguguacaaaccacccugcccagguuuugcuuguuuguaugcuaagaauugaacucagcgacuugugcuuguguagggaggacucuacuggcugagcuauguccccagcucaggccgcucuuuuuacuuugaccaagaacauucauaaaugugacccacaucuucaccaagguuagcucuggucacucuguagcugaaaguucccaucccagacuucccuuaugaguaaucucugcaacugccaaagagaugcuuagccaucuaccaaaccuuucuuuacuuccaguugagaaaacuuauauaggacaugcugcuuucucuauggugacugacaccauguugaugugucccugacauggugaguaaacccacccucucuuuggucacagugagacccuccauugcacugggagaagggaggauuauguaugcagacaacaggucaacaucacccuucuguggucagcggcugaacuugacaccacuugguugauguucgucgugucaccaggcuugcuugaagugaacacugccauuguauugagauuucaaagcacaaggccugacuguucugacucugcucaggagcuaaaguccuuucucuuugaacuaacacagaaccugguagccaaaaacuggcuuaccaggcaggaaagaaaugggcauuauacucaguggugagggucuauugguuuugcaguacccugauagagucucugacagccagagccaccuaagaggaguuuugauccuacaguucuuauaacuggaagguuaccucauugauacugaaggguuaacucuaaugugaucauugcucucuucucugugauuggcagggcaccuuugucccuucuugucauuuuagugaugaacuuucuuauccacggagcugugggugucuagguucugagucuuauaaagcugucaaagaacccuuguuaugaggcugaaaauaguuuuuguuguuacuauauuaaucauaacuggaggucauauguuauauuaccucuucuuuggucuccuccaacaucauuauugacuuuaccugccauuucuuccuauggaguaaaagauaguucacaauuucauuuuucucagcaccaccuuggaaguucuguuuuauccccacaguguguaaagccggaggccucgagaaggagcaggauucgcugaccuuugcugacagaaagggugauggaugggaugaagcagggcacagaccagcugggacgaaagcaaguguaggcuaagcauccucccgcuacugaaucaagaguaagagaaggcucugagguggagccaagaggcagagagucgagcuuuuauaaaacaaccaccggucugugaugaaagagagcuguggacagccagcucacgauauguggagugcaggaaaccaauacagagaucagcuuacauauagugccauaaauaucaggggagucagcacucaguggagacuuaacagucugagaguguccacuccaagagagauaggacucugagcccuauaagaaagaucuaggagagaaguggguucugggcuuagaacacaggagagagaugggagggagggaggggaagagggagagggagggguaggggagggagaaggggaggaaaagggaaaaggagagggagagggggaggaagagggggagggggagagagagggagaggacuacuauggccugaacuguccccuggagcuuguuagaguaagacacacugaauaggagauaugugggcuaucugucugugucccagaaaggaacacaaugaauaaauauguaacuuguaugaagcccaccagagaacaccuaaauuuuacagggcaugaacucuggcugucuuccauuuacucuucucaaaguccuggcagguggaccuacaguacucacugugagaggaagcaaagaggcacagaaguaucaaaaggccaucugagaccugccaguccuaagaugugaacuuagccccaucuggcuuucuauacggggcuuccuaagcccugaccaaacuuucugaagugucuagagauacaucagccauuccaugaagccuuauugaugagaagaaagcugagaacccuccuuugaauggaauuuuuacucaggggcauucaggaauguccucaagauaucauuggcauuagaggauccuccacucagaaggucuuggaccauuauguagauagucagggaguagucgaccacaaugcauuucuguacauuugaauuaacaauacuaagaucuagucccaguguuuuaguuuuggguuucauuucugugaagagacaaaaugacaaaggcaacucuuauaaaggaaagcauuuaauuggggcugguuuacagguucagagguucaguacauuaucaucauggugggaagcauggcagcauccaggcagauggacauaaugcaggugaaggagcuaagaguucuacaucuugaucugagagcagccagaaggagacuccuccacacuugguggagcuugagcacaagagaccucaacacccaccuaaaaugugaugcacuuccuccaacaaggccacgccuauuccaacaaugccacaccucuuaauagugucacuucucaugggccaagcauauucaaaccaccacaccugguuauccaagucucaaugcuaucauauuaaucaucaccuaagggucacaggaggccuucaucuuuuuacacacaguaugugugcaugugcuugucuauauaugcauucaggugcagggauguguguguguguguguguguguguguaggccagaguauuuccugccaugucucaggagucaucuacuuuguaguuuugagacaggaucugucacuuauugguugagcuugacugguugaccaguaagccccagggagccuccagucucaaacucaccaguguuguaauuacaagaguaugcuacuguaucuaguguuuuagauguuuucuggggauggaauugauguccucuuaccaacaugguauagagacugaccuagaucuguaccuacuaagauacuauaccuacaaaccacuugaaggagccucuauggguauggaucuagauacagcuugguugggaggugaccucauuucuauauuccugacuaguuccugagagauacaaaugugaauuauuugaaaaaagagaauuauaacggacaauauuauaucuagaaauauauuuuaaagaaaccuuuuuuuucuuaucauauagcauuggcaccugguacauuaucagguuaaccaugggcacauacaaaaaucagauagaaaaaauagguaaaggagaagaauucuugcuuugaaaguagucuagguaaaagucugugaucauggcuggaugucuauuaaagaugaugggcauucuuaaaacucccaaauacaggugacugccaugaucaucuccauacuaaaguacauaaguaaacgaaguuuauaauuucuaggaacucagguugcuauuucuuuagcaacuggaauuugcauauuuuuuucuguagcuaaacuuuaucuauuacuccuaacagguacuaaugugauugucucuaagucuuaaauuuuuuuuuccaagagcaggaaauguuuuaauuacacaaguggguuuagauuuuacacaucuaguggaagguguuggaaggaaacaggacaaauucuuaagcaucagaagauuuucauagucagaguuagcaacccaacaauuaacaagauaugaaaagaagugugaauccacggaugauauuuucuggaaacccugcuuacgaagauaauuguucaugaauuugggcaguuauggcagguaucacaggauucagauuucaggggugugggagcaucguaugcaauuugaagaauaucuaugggcuguauacguauuaccuagcauaggggcuucugcaguuuaaauacuuaguggaagaaaggcuaguuauuuaaacuccuccucucugucucugccucuguuauuuaaacuccuccuuucuuucucugucucucugugucucucucucugucggaagaaggggaaaacaauaagauaacuugcagaaggcacauuaucaucagaaaaccgaagucauuaggugacauggcuguacccugagggacuggaccccaaccuggaagaaugacacagggcagcagacagucucacagacauguugauaguauucauucuguucucauuucuguuaccgugacaacauaucuugacagcaagaaauugagggaagaagggaucaguuuuagcucacaauuccaggucaccacgguucauguguguaggaaaugcccagugucaggagucagagaaguugcauugcaucugcagccaagacagaugaaugcgugcucacucucuugcuugcuuguccuuggcuugauuucucuacucuuaagcaguucaugggaaucgggcuugguagaaggcagcccccacaucuguuuuaugacauugguagauugggcagaagcaaguaaaaccggugcaaaauauggauaagacuggggaaagugggggugggguggggagaaaccuuuucauuccaagcucauuaguccauggugcuccccacaguggacuucccgcaugaauuacuuaagacaagcccucucucagguagacagcccauccagacucucuuccuagguugauucuaggcugugugaaguggaaccgaaccacagcaggauuuguauuaagguaaagcaagccuaaggaacacagggacucuaaauaaaacaagacuggacaaacuagaagacaaagaaggaagaaggcaagugcgugcgcgugcgugcgugcgugugcgugugcgugcgugcgugcgugugugcguggaaauaaauagaucaauagaaucccaagcuaguuuagcaagauaaaccaaacgugaaaaaugaauaacgaagugaaaauaaaaaauuaaagucuuacucaagagccugucaagacauggccuuuggaacacguugacuguaauauaguguguauggacucggaggucuugaggacaccugcuugaauuuccagguuauguucuagacuaaggaccuggguaauaagcauaugaguugcagagggaacagauaguuuauuaacaaagaauacacuucuuaacaagggugcgggcuaagaauugggaaaggcuaaaacccaauggcaccugugugggccagauguggccaucuggaaaacaggcaacauccccccaccaauguccugcugcaugucuacaaugguguggagagaguuguuuaaaauacucgucuugggucuagagggaugguucagugauuaagagaacuggaugugcuuccagaggacugggguucaauucucagcacccacguggcagcucaaaacugucuguaacuaauacccucauauagacauauauguaggcaagacaccagcgcacaugaaauaaaaauacauaaauuauaugaaaaacacucgucaugaugccucucuacucgucaugaucgcuccugucaaucaccuuuucggucggaaagaaagccucgugagcuauaucgucucuaguccagguuuaucucccaccucagaaucaggaucacaucaauuugaucuuggguuugucaagcuggaagcauagcaaaacaacaguaguaauaagcuacuacccucuuugcuuguaugggggggggggacuaaaguucgucaaagaccgucaugucugggaagcacacagcaaauaguagaaccuucauaaaugcucaggucuuguaaacaaugacacuggguaucuagaggcuuaggagcacaugaccugcucaucucaagaggagacaugccaagaguugggaggacacacagaagcccaugcugagagaaagcaagugggagaaggugaaacugugguuucuguggcaaagagcaggcccgacagaguaucacuaaggauucaggaguaugaauacucccagcagggcuggggagauggcugaguugguaaaaugcuugccagaggagcaaguucaagccccagauucgauguaaaaagauggaugugguggcggaugcaaccccacugccaaggagguagagacagguagauccuuggggcuuagauggagucgccugacauauggugcugcuaccaugacucccacugcaccuuuagagacucuggcuucacccuggccaacaggaccucgcuuagggugaccccuccuguaauuauuccaccacugccaacuuccuugaccuacccggucaagccaucuccuaguccuugcugguucuugucacacucguucauccuuuucuggggaccuuggucaucagccucuccguuucuuuguucuguuccucuuggauauugcauggugacagguguuuauaaucccagcucuggggagguagagacaggaggcucucuggggcuuguuggcuuagcugaauuagucggcugcagguccacugagagauccugucuuaaaaacaagguucauggcaccagaggaaucauagauggguuggcuuuugagcucccaugcccaugggcacccaaacacaugugcucaaacauauacauauaugaaauaaagguuuuccuuacauucuccagucuaaagcaagucagcuauucuggcuuucugugcuguguguguucauuucucuguguuaucuuguugcguguucauuugcuucucauguguauuuuucuauaauaaucugugucuaggaaaacagggaucuggaucauggucauaggucuaaaaucagacccgggucacggggcgugggaacucagcacguucaugaaugagcaaaugaaugaaugaacgaaugucugaaaauacacuguucauuacucugucucuagcuaacucaagaauaauuuccuaaagagacucugagaauuacuaaagaaauacugcguggacucugccccaguaggcuuccgggcucaguguuucuuuaauuucauguaaauuucucuaaguaaauauuccuuaaaagugaauaaaauuuuauuucgcuuuaacaagagaauauaaaaguuaaaaaggucacuguaguaauaggcuaaucucaauuaccagggcagccuccgaaacccucccucccaccuaaucucauucgcugccuacgcagcucaccgugugauuuccaacacagcuaaaugaaauuacaaagcaguguuaaauuuauuaaucauuuaauuagcuaaaugucccugcaaguacucgagagaugaauggcaugucauuuucuaaugcaauuugccucgcaggcagccagggucagagggaagcuccuggcaucuccaaugaguuuuuuauaccacaccuucuauuaagagaccaucacaauaccaggaugguaucugagacuuguccauaggacaaggcuuggauauugauauaaaaauaggcugccauccucaccugaguuuuagagaagggcagaaggguagcugaucccccccccccccccccccagugauugccucuccugagucuccuuugagggcgaaucuuuucauauuuaacaagccacugagcaaaccagagcaaaagauagcagccaguguuaaacgcaugcucaaucuaguuuuauaucuuuaaauuuacucagucgagaaaaauuuguggagugcgaauuccccucaugcuaggugacuuuuuaauccucguugagccaggauuuauuucccuccgccagccggcuagcuugugcuugacaucuugggguauuuugccaugcucggggguuuugaaggcagugugcaugugugggggguguccucuggcagagggcuguggcucucagccuucucccuaccccacgaggaggguguagguuucuaguauuuuugagauuugaccuugacccaggauuauucccaacuguaaggacuugugugggguggcugcugcucacgcuuccugacugucaguguuuacacagaaacacuggcaucaggcgugaugucccagcuaccuuggaaggcgacgcgcagugggugccuugugaggcugugaauaucccacagacacgaaucuguuuuuuuuugagaaggaagcugucgguucugagaacuguagcagaaagaagcuuugugugugugcauguauguauguguguacaccuuuguuuugugaauguguguccauguuucuguauauauguauauucauacauaccuagauacauguguguguguguguguguguguguguauguguguguacauguguggggaggggcuggguucuauaucaagugucucccucaauuacuuuucaccuuacuauguuugcuauuuuguguguacaugugcccuuccaccccacauacaugcauguaccaugacacacaugugauacucagaggacaacccuugggagucccaucucaguauguucagagaucuaacucacaucgucagguuugcaguacaggugcuugccugcuaagcccccuugccagccagcccuuccuuccuuccuuccuuccuuccuuccuuccuuccuuccuucuuuccuuccuuccuuccuuccagucucucucucucucucucucucucucucucucucucucucucucucucucucucucucucuuucuuucuuucuuucuuucaagacaaagucccucucugaaccuggggcuuagcauuugcuagaggcccauggaaccuccugccuucccagugcuaagauuacggucaugugcugcagcucuugggugccggggaucugaacucagguccucaagucucuauggcaaauacuuucccaccugaggcaucaccucguccccgugaaggagaguuuugagcgaugaacgccccuccuucacagagcccaccuuguggaggcaagacguucugaacugagggagguagaagguaaugagucugaaugugaguucaaccugaugcuuguuauaaacauagagacaagucucuguugcucugggcccuagcuuucaccauccauaagguaggcuuugcacgcuaacaccuauagcagcucuuuguaagacugcagcaaaagcgaaagggugucuggggaaggacaccucacgucagaagugaaguugagggguggcagauacauuuucuguauuuuauguuuccaaagcaguagcuuugagccgacaugaucuguauucacauucaacucagcaccuucuucuucuuggucccuagcacagcauuuaauggagcuuugguuuauuggauaugggauggaaaucauaaugguguaaaucagaggagaaggguaugugugccuuuuuuucucuguguacuuagaaauuuaucuguauacucuuacauauaaaaugcaaaugugaauuuacuuuuuugcacucgucuguggugcacauguauggguaugcugugugugugcuuguucacauauguauggaucuagauauguuugugugugugugugugugugugugugugugugugugugugugugugugugucugugugugugcauguugaggcaggggucacacuguaacuuccuuggcuggucuccaugugauaugaaguagggacucucacuugaacucagaguucacugauucagcugcucuagccagcuagcuugcuuucaggauccugugucaucuccugagaacuggccauugucccugcucagcauuccuguggauccuggagauucgcacucuuguccucaugcaugcguagcaagcgcuuuguacauccauccauuucuccagcccugagaauguacauguauaugcacacacacacauacauauaaugcacauaacaccuguauacccccugccacacauacauacagauacacacacacucacacucucaccauacacacucacacauacacacucacacacacaaacacacucacacacacacacucacacacacacacacaaacauacucucucacacacucacacacacaaacacacucucucacacacacucucacauacacacacacucacucacacacauacacacacuuucacagucacagcaucuagccugcugacuauugaugucguuacuauuucauauuucugcuguuccaccguugcagugaaaagggaccauuuauccccuuaagaauuuugauguauugccagucaugggugucuuagaguuauaauccucauaucacgaccacaacaacucauauaaggggcaauauuuaaaugggacuggcuuacaguucugagguuuaguccauuaucaucauggugggaaacgugaugucacacaggcagacauggugcugaagaaggagccgagaguucuacaucuggauccucaggcaguagaaacaacugucccauuagaccuagcgugagcauaggagaccuaaaauucuguccccacagugacacacuuccuccaaaaaggccacaccuccuaacagugccacucacuaugggccaagcauucaagcacaugagucuaucugggccauaccuauucaaaccaccacagugagccuuguuagacaggcuugccaugaguuagcugaaggcaguucuagaugugcuuccgugcugccucuguggauaagcauggcugccuuccaaucuucccucugcuucaccuggcuaaauggccuugaacuucuuugccuucuuugccuaggcuggccucgguuuccuuaucucuaggcacccacuucccaccugagguagagaugaacuagaauagaaagcccauggcacaagcuuggcccaugaaauaaucacugaaugcaaauggcuaaagggaggauauagacagcaggaaagaaagagaaagagcgagaaagggauggaagcggaaaugccccuugacauagauagcacuuguagauuuuucacugagacacuucuacgaccucuuaucucgauugucccauuauuauccuuuucagaagcacauacuaagacccaacccccuuuauccagguucuagcgaagccuagagauacagacucaucucugaaaggaucucugaaaggcaucacaggcaguccacaguggcaggaaccagaaacaacacacccaucuccucugccugucuuuucuuggguugcugugacucaccagugguuaagaaguugaugucuacuugaccacgcgucuguccuccgagcucuuguuaaacaugccugccagugcacagaagugcuuggcuugauacaauugcuuccaugggccaggaagcccuuguguuagucuucugcuugagagaguggugguuuccugccuugccgguuugagaucagugucaagcagauuagaacgacaugcccaggcuccagcucuucucucccuguagucugauuugaguucgaaugcuucuuucagcuccuagagucagcacuggcaauggagcucaguggguaaggugauugccuagcaugugagaguccccaugcuugauccccagcacaggguaaaaccgggcguggcgaacacacuccuaucaugcucucacacagcaucuaaaggcaguucaagguugugcuuggcugcaucucgaaauugaagcuacauggaauauaugaaaccuugucuuaaaaaaaagaaaagaaaacccaaacuauuaccccauaaauaguacauuaagcccuuagcuaucucaguagcacugauuuauaggaagacaacaggcgaggggagacauggguggucucaauuaucaugggcccuugagauacauuauccccuuggcacugagacccuggaauaggcaggacacaaugaaggucaagcucagggaagaguaaccgguccuccacaggaccacgacuuccauuuuccuuccugugcccacuacaggccuagcugaagccucaucuaucaggaauccccauugugaagcucaaggacuaagaccaagggcagcuugaaaauuugcugcucucuggaguaugcuaggggagcuauaagaagccugggagggucuggccauucugccucgaucuauagaucugcccucuuagaacaacagcaaagugaagcagaggugguacuuucugcugccuguuuuucugucuggggcccuugccauauauauauauauauauacugccccuuagcaaacauguuuauggaccaaggauuacaaguugguaucagagacacuugcauaucaguguuuacugcaucucuauucacaauaggugauguggaacuaauccaaguaacagaagaauggguaaagaaagcauagcauguguacagagugggaccuucuuucggccacaaacaagaaauuauaucaacauuagcaaaacggauacaacugcagacaaucguacuaagggaauuaagucaauuuuagaaagacgaauauaguauucauucuuacuugggauuccuacgauuuauguagauggguaaaauaauguacauauaugggauuugaccguagaagugaagcugucugggggacaaagggacuaggaggaguggggaggcgagcaguguaggaaggauggugcggguauauagucaacacaccauaugcucauacaacauugaaaaauaacacuaaaaauuuuauaaaugcuuauggcauugguaaaaccuucacaaugcugugacccuuugauacagucucucauguucuggugacccccaaccauugcuaauuaaucacuauaauuuuucuacugucacaaaugguaauauaaauaucugcuaugcaggauaucuggaauucaacuccccaaggagucacuacccacagguugagaaccaccagcuuucuugugggaauccuggguuauaauuuguggcuuagaagcagcaccuuuccauacacacaggauagucccgucuuuggaauuuauucuaacacauagcaugaggcuucucuccgcaaccaauguuuagugacaguaguuaacaccagaugcucgcccgauggucaccaugcaucccacugcagcugauguacauauuccagggaggcacagggauaugaagccugggaaagagagaaggcuagagcgggagacagagaggaggggggaaaggcagcacagaggccgguguggaagaaaaaccaagagacggggcuggcagagggacugcaagugugagcacugaaugcacuggaggcagaggggucagugagagcauaggggggacaguugguagguauccagccaguccugagaaggaaccucagcaguucugaaccccggcuuccucauuuguaaaaguuggggaaugccauuaaaguaccuaauuaauagaauccaccugacccccuaagacauauuugcauaccggcugacuuuggacaaugccuggcacacaaucaccaacuaauaugaguuuaccgugucacugaagggaaagaggggacaggcaaggcaggcaaggaggacaugggagguggagagucuauagagccgacaggaaggagcccacuuagaagcagcugcugccccuucugccuucuccagcccugccuguauuucccugccgucugcagccauggcuuacauacgaacagugggaagugucagcuaaacauggacuuuagccacacgcacaauaggcaggcaggagagcguucacacauucaguuugccacauaaaagcuuuuuuuuuccucuucuaugagcaacuuuauggcccagggacuagacuacaaaaacuauaauaccauucuuuauuuuauagaaaaauauaaaucaauacauuugugucucuuuuaugagauuaggaaccaugacuauggagacaagccaggaucuagacaccuccuuccuuaaacccagcugauucggguuuuucccccacuccuuuuccccccuucaucuggugaaauauuuucaacuaacuauuuaaaccagggagauggacaagaccucuacuuccacacugaguggauuuuauaacaagaagccauuuucgcccccgacagacugcccuugugcccgccucugugacuuugagguccucauuauuguggguuuaaaugaaggguguucauucaggcagggauggggggaugccaccaggcaucagagcuguuaucggguccuucuaucaggccaagugacaggcguccagagugggaaugcggaacucauggcagagaccucuggcugacaccaaaggugacccccucacucucaaccuugaaagggauaguucccacuuuauuaaaaugaauuucgaaagggccgcucugacagcugcauaauuaaauauuggagugucagcgauaauuuauuccacucgcaugcgguggucaggucccuuucacuagagggucagcaggcacggugacagaggcaaggagacaagggacucuggcccuuugucauuuguguagcuccaguccuaaaaccggaggcucaaaaggaagaagaaaaaacucaaagaaacaaaaacaaacccucacuuacauacuuucacacacauagacauacauacacagagaaacacagauacacagagagauacacacaaaauacacauaaaaacacaaaaacacauauacacacacagacacacauguacacacauagauauacauacagacacacacagauacacauauacacacaaaauacaaauaaaaacacagacacacagauauacauauacauuacauacacauacagacacacaugcagacacacacagauacacauagacacacacauauacacacauacacacagguagacacacacacagauacacacacaaacacacauagauacacacacaaacacacauauacacacacauauacacacagacagacacauacauacauaaauacacacacauauacauacucauacacacacacacaggcagguacauauauccacguagacauacacaugcauacaccuauacacacacaaacagacacauaccaucccaaaaggacguagaguaugcaugcagauagacuguuuuuauucaccaggcacagcucuguaguucaaguauaggacccauucucuaagaacagugaauaagaaaacguugagcacacaccucucaccuguauuuauaucagguuacccagaugcauagauuuccccuaagucucagacauuccacaagcaucacggcuaagguggaauggguaaccaaggccggcaaggaugcaagaaggguagggcaucccuggaugugaaauucucccauacuaauucuaaaguugaacacuucacucuagccccccccccccacaccccggcccugccucaugggcggucauaccagggucaaguuuacauguggguacuuguguuaauauuauggagagacuguggccuauuuaaacagguguccuguaaacagcaugguuuucagaggaagacguuggaucuuuucuuaugauuaauacaacuaaauuucccacugcaaccagaggcauguugcuuccuaaaugucuauaaauacuaugaaaacagagccagagugaauucagcacagacccuccuauagguuuauucuuugagaugucggugguuugcuuuguuuccuucuggcuggggagcaguugaguucacuuccuucuucagcagcucagaaggaaugaguuaguggcuccugggguccgcugucuguaaggcugugcccaccgccgacccacacagaagcacuguguuggagcacagucuaucauuucuuacuugacccugcccuguuuacuccggcaggguacaagcagcagccaagcuccgcuagucagaguauuacuuugucacaggcaggcuuggccacuccgaggcaggcugaacaaauuacaucucucagucggucgacgaaccggcaacagaguuauaacucagucuaaacaccggucccucuuccauuaccuucauaaccaaggucguacuaaucaacucaauuaccagcccucuuggacauuuccauaauguuuucugcuaguugcucuccugugaaaauuucugggucuaagcaaauuaaugccauuuuuauaacuaucuacguuucagggacagcgaucuccuuuggagagauggccuccccagacacaugaagggggagcuuugcuucucaggauacugugaaggcacacacaggguauuuccauggaacacccuccaccauguuuauggugcaaauaaaucaacuagcuuuuaggaaaauacauuauugcaaagacauugacaugagucccuccuggaaguggggugcuaaguccccuccccaucuccuuccuccaccccacucucaaucguagcaagccggacauuucagcuugcacuguuccagccuugaacuucaugagaucaagaggacagaauuucacgccgcccccauuguguuuuauguccuuauuuauugaucuguaugguuuguuucuuucccaccccaucuccaucuggguccccuucccuuuguuauagaaaugccaggugacacagucuguucugguuuucacugaggguucagaaucacccagggugagcaguaguccaugucuucagaauucccuuauucauacugcuggguuggcagugccuugaagaugucagauuggcaugcccauuaacugaaauucugucauuaaaagaaacguucccauuuaaaaaccagagaccuaccaaggcucguggcaucagcugaccucuggcaucucugaccuuucaccuccagugcauguuucaugcuauugagcagagagaaaaccugaguguggugucacaugccuagaaucccaccacucaagagauggaggcaggaggaucagaauuuuaaggccauccuuagcuacaggauaagucugaaagccaccuugggcaacgugaaacuccuuaacaccaugagauucaugugcuuauaguuagucaguucagugaauaaauuacuuuugacauauauccauucucuuuauaaaaacagauuuuauuuuuauuuaugugucuaugagugucugugugugaguuugugugccggguugcagguagcuguggaaggcagaagaggcucuccacagauucccuggaguggcaauuguaagcgguugugagcucugccuuguggcaguucuggaaaccaaacugggucuugugaaggagcaacaggggcucuaaaccacugagcuaucaucucuccaacaccguguucauucuuuaaugaacuugguguuuuguuuugcuuucucuaaaaagcucuuuagcuaaguacagaauauacacuaaauucaacuucauugaaauacuuuaguuuauucaaaaaaaaauaaguuaugccucaaauaugaccaggugcugacaguucuacuucuaagugucugcugacgaccccaccauucccgacacucucuucugccaucaguagcuucuccuaagggcauugaccuugacagggagggcauggugguggcaggagagagagguggcagucugcguacaugugcaucaggccugagcuaaccaccuugcuucugaugucaaacuucucacaggcucugcuugggcuccuucucgacaucuuaaacuaagaugcaauggaaggcuggcugccugugccaucgucccagaguuacugaagcccagugaggccgggaugagauucagacuucgacuacaaugauuucaucccccugguguuugugagcauggcuauucacagaugcaggccuaguacuggggaguccaggacaagaagauuugcuuuugaggccacccugggcuacauaacuaaacccugccccaccuccucuuguagcaaacagacaagcaaaaacacuuacuggguuuuauuuaucuuuuuuuuuuccuauacauuuuaauugauucagaauucacacagcacaguuguuuuagaguauacaauccagugguauuuaacgaaccauugauugaauguaccacauuuaauuaugucuguauccaaugauggacauguuguuguuguuguuucuuugccuguuucuuccuucuccucuccccuccccugcccuccccuccccuccugguuuugggcuacccugaaugacacuacugcacacacuccaagccucuggaccugcauuuucauuucucuggggaaauucaccugcuguagaauuuuugaaucuuaagucagcucuacacuucacuuuccaagaagcugccaaacugcuuuccagacgggcuaaucaguuuuacacgaagccuccauccuuagcuacuucucuguauucuguaggcacuggacuuguuacggucguuucugcagguuaaggagucacuucaguagcuguaaucaaaccccagggaccugcucuccaugcaugcagcccugcaagccagacaaccacaggcaccucuaguccauguuacuccaggcucuuccugucccugccugcaccacucaaauuccacaggacuggggaaaugguggcuguguggccuugaaaagaggaaggaagggagggagugauaaugagaccuacccggugcaggcuggauuucccagaggcuuuccccucagcgcuggggcccaggaaguuccucccacuauguggaagaggaagcugauuucuaccacuccuucaucuuacucacucuuccaggauuugcucccaucucccagauugagcccagggucagccuccccggcccacugucaacaccuuaacauuuuacaaaacuauguccagaaaccacccuuuacaaaaggaacauuuucauuguauaaacuaccaggcuuugaaaggugagggcccagaaaggcugugaucugggucauggagcugacuugcuucguaaagcaggcuuaacucacagaaccuggguuugaucccuaaaaccacagcgcuggggaggugaaguggagccuaaggcuugcuggcuaaccagccuaaccugcuuggugauuucaaugcuaauaugagacguugucucagaucuaagguccaaaguugcugacgcaauuaaaccuaagacugauacuuaacuucuacauccaugugcacauuccuauauacacacucacacauacauacacaugcacaaacacacacacaaucaacacacauauacacacacaucuaagcacacauccauacauaucuacacauacauacacaaaaagugcacacacauacacacacucuccaaacacaucuacacauacauacauacauacauacauacauacauacauacauacacaugugaauccacacacauauacccccauacacacauacaugcacacacauacacacacacacguacuccugaugccagaauuuggagacuguaagugaccccagaagugacaugugugcauauggacaaggcaugaacuuaccauguagcaaacauaauuccauuuaacugucaucuuguauguccccaaaguucagagccccauggcucagaagaggaagcugagacgcagagguaucaaauagcacaugugagauagccuguaagcugcagacucucuggacacuauggacuacagucugccuccagcacaucagaugugauacuugccaggcagcgcagacuucagaucauaaggccaggccuucaaaggccugugacugcgggagguguggggauuguacagaagagaggcugccuuuuccagcuucauauaaaacuaaggaacacagacaaauuuaaugcuugggucccggagcugcaucauugauuaaagaguucagcaugcaagugugaggacccaaguucaaauccccaggaaccccuguaaaagccagcugugguagcauguguugguaaccccaauuacaaugggaaguagggucuuccucaguggugcucagcaaagauacugugucaagcaaaccggaaggcaaggauugaccccuccagguucugaccuuuccaugcaugauguggcauuugggcuccucuauauccccacccccaccucucucuuucacacacacacacacacacacacacacacacuacagugguuccugaaccuggaccugcaggagaucaccaaacaccacuguuuguugcuguugcucuuccucuucccccucccccucccucccccucucccuuacccccucccuucuccuccuccucuucuucuucuuccuccuccuccuccucuucuuccuccuccuccuccuccuccuccuccuccuucuccuccuccuccuccuuuacuuguuuuccuucugcuuuugaaacauggacuuacuauaugguccuggcuggccuagaacuugcuuugugaaccaggcuggccucaagccuguugagauccacccaucuuugccucccaaggagggcucagauuaaggguaucaguucuugggauucaucccagcuaggcuugaaagguccucuuauuuccuuucaccaccccccuggcugucuuuggaaaccaaggagccaggccagaagcaaaaaguggggagaaaaaucuggagugugucuugccugcguuguacaaaaccguguacagcuagacaaugaagcgucauucuauccaagaacgcaugcaaacguguguggaucugcugaacagggggcuguaaagaccucacucaugggaaagauaccuggucugagcacaggugccugcucugagcacaggugccugacagaaauugccuugccuucuggacccucucccuggcuguaaacugugggaagggccuagaugccacugcugucuuccugggggugccuuagagguggccuggugggcauuuggaacuagguauacagaugagggacauccuccucucuccugcacagagagguccaaaauagcucuauugagcacuauuccauagcuugcuugguacucacucccagggccaugcacucucagagacacgguaucucuucugaaaggagacaugggaauaagauccgaaaacuggaaucuccugugaucccugccccucccaaugcccaaccccaggcuccgccuuauucuggaacaguuuuagauagcccuuugcccuucaguaacccaauccaaucauggguucccagugggagcaauucucugcugcguggcauguuuccuucacgcauuuuucucagccauuguuaucucaguucauccuggcacuguuauuuccggguuuuuauccaccguaaaccagacacacagcgagcagagaccagagaggccaugccauuugccaaaagucauccagcuaacagaugauaaagauagaaguagagccagaacugauggcaggagagccgcgcuuccuccgccuucccaauaauauuucuuugggagggauguuguaucuaucguacaaccgaaccgacaugaccacuuaacucuaucugcagaugaaaacgauaccagccuccuaagucagugagcccuauucauucucuaaauaaaugucagauuaagaaaauguaaucugaccaugaaucacucccucaaaggauugcacgauuuccauuguagaagauaauuuuuuuuuuuuuuuuuagaaaaaucaaacagaaaaccagaagucaguuuucacacucaagcauuucuucuucuuccuuuacgggaaaaggucuccuuaagucuuugcaagcuuauucgaggaggguuuuuuuuuuuuuuccugacuuucaguuucuuuccaaauuuagaagaacaauuuauaauacuguaauuugcaaggucauccuuuuuuuccuccuccuccucaccucccccuccucucuucuucuccucuucccucuccuccccauucucccccaucuccuccuaauguaagaaggaaauaaagccuuucgaguuguaggaaaggcacgguggcuguaauucuucaucgaccugggccaagguuuugugaauuucuguggguuauucaggcccugccuacagauuguaaauacauugacuuauuuaaauauuuccccaugugcacucccuaauuuaaaaaaaaaaaagugagauguugggaaauguuucugagaauagacaaagggauuagucagccaggagaagccaaauggaagaggaaguagguuaugguaaguucaagaaugguuuauuugcugaccaaaggcccagcaccuagagcguaagaagggagcagcuauggagcgcacagauuaacguggaagacaggagacaccaacacguggcagcaacccucgguuugugugccugcagaugaugcugaccccagggagagggucugaguuuaguaagggcuuuuauuucuagaacgcaucuaauaauaugaucauacauccuuuauuaaauaguauaacacuguuauuuauauucucauucugaacaaauguaaugaccacacuuaccgcuugcccauuuccuauaaaagacaaugguuauugcuauucuaccuagaauuuuauuuuuuugacuuucuaaaacaugaucauuucauuuuuaaauuauguggggcggaggcagggguagcagugugcauuggagagcagguucuuucagagacuagaggcgauggaccccaggaucuagagguacaacugguuaagagcugcccaggguaggcgcugggagccaaucucgaguccucugcaagagcagcaugugucuuuaaccccugagccucguguccuauccuuaaaucauuuccuuugcuuuccuuucauuggcuugguugguugauugauuuuuuuuccuuuuuuacauucuguugcucuuuuuccuccuaauuuaaauuuaauuucaucucucaaccagcuuacaggggacauacacaguaccacguaggucgucguucuacauuacauggaaacacacauuuaguuuuguguuguguuuucccuaagguuuuuaucaaaguggccccugaccugaccgcagaugcucugaccaugaguacugugcuaacacaagcucaguuggcaucaaucaagucacuggagggaagcugauucuuuaacugugcacgacagccuucuagugcuauauugcuuuccgccagccaaucuccaaucuccguccauaucaaaagcacuuuacuguagaaaccaguaaauuuguucucucucucucucucucucucucucucucucucucucccacccccugcuauuguuuugucuucuaauguccugacaacagaaccagucuucgaaauuauauauauauauauauauauauauauauauauauauauauguauguauauauauauauauguauguauguauaauauacugaagcaaauucaaucacagaagcuuuuaaaaccuaaagucucaggaagcuaauucaugugcccuuuuaagagggcuuccugcauugugauacacacaugggcuuggguucaaugcagcugguggccugccagguuaucaggcaggucauccuggcucuuaggaaccuggagcuccugcagaagcccucggaggcagggcaaaccaggagccucccccugugccagcaagugacugugcuucuugccagcuagcagguggaagcagccaccuuguuaauuucucucauugccuugauggugucaccuuuuguucaucccucaccuacauugaaccccgagagagaaggaacugagugugucucagagcucugccuggcucuuggcauuugggggugccuaguuucugcaggugcuguggugcagagauccaggcuucagagccaggcagagacaugugauugggaaggaagucacacauaucugaaaaccucugugcuacaaggcuccauauuucuuucuuuuugggggggugggguggguggggguugagacaagguuucucuguauagcccuggcuguccuggaacucacuuuguagaccaagcuggccucaaacucagaaauccgccugccucugccucccgagugcugggauuaaagguaugcgccaccaugcccggcuaaggcuucguauuucuaaagccaggcauaguggcauaagcugaugaucccugcgcacuaggggcugaggcaggagaauuaccucuagccagcuuggggcuucacacugaaacucagugucacacacacacacacacacacacacacacacacacacuuuguagaucugcucuggacugcaagaucacugacaggagacaucacccaugcaaaauuagucugcccaguaaaacgaagugucugggucagaguaccucugucccaucugcuccccccaaaugacuguaugcccggaggcuaggcuaucugcuuuggaaggugcugcgaacuucuuuuuuaaaaucuauuguuaucggaggggguggcacacaugcccuaccuaauacacguguggcggucagaggacaacuuuuaggagucaguugacuccuuucaccauaguccggggauugagcucaggucauuaggcucucauucaucaccuuuaccugaugcuucaucucuccuacucaugugggugucuuuagagacucugcuguuuccccccucuccuuccccucccccucccucugccuccuccucucuuccucccccucauuuucuccuccccucccucccucuacaccucccccucuacccucucucucucucucuguuuagaauauagaaauauauuguauauucuauauuucuaaauuguagcaaaugguuugcugauuucaucccuuugcauucaaaaagacagccaggauucucucuggaaaaaucuucccuggcauaaaauaccauguuaaucagauuugacacacaugccuguugaugucgccagggucccguccuuacauccacgucagcguagaacaaaccuugucgguacacccuguaccaucugcuccccuccuggcccuccugggagcuaucugguccauuccagaugcgaagaccauucacuaaggaccuuagaagcaugggaugcuuugggcacuguggaggagcucagagaugucugacuguugggaugguccacaccagccuucucauccauccucacacuggaaacaaagggauuuaauggagugaggcugggguaaggaagagagagaaagaggacuucugcacagagaauugaauguuaguggcaacccauggaucucuagagagagagagagaucaugucaguuuucaugauaggaagaggccauagcucaugagcacccacagucaaaaccacaggggggaacaucaugucuccuacaaauagaacccuucucuauaacuguuuuuuuuuaaacaaacaauuaacaaacauguaaaaucagcuugaagguucaauggcggguugguguaucuauccaacuggaauauuaugcagaaaauaaaaacucccauugagaaaaacaugcauaacaaaagguuggaugucaaaaaugggauucaaaauaaaauauaucauccaacuagaaauaaaugaaaaggccaacuagauguguuuagugaguuccagggcagugugggucacaaacaacaguaaaauaacaauaaaauaacaacaacaacaacaaaauucaaaagagaaagagaucagaggagacaagaaagagaagagagggggcugugucuaugucugagggguguuuguuugguuuuuacuuuucaaaaaauuuaacggauuucacuggcuuuagaaucuuaaaaauugugauuuuuaaaugccucaccaggaaaaucuuauggaaacuggcaggauaccauauuuuuaggcuaggcuaccugaugguucguaauacuugcguguagccagagugucuuccugaacuuggccuaaagagguagaucuuguggguuuguagcaggaaaggucauggaggggugcauucgaugcgaugcccaucuggggcugugguucguaggcaaagcgaaugucuucaacucagccuccugccagaugccucuggcuggucaagacugugugcgucucuccuuugccucagccgccaagcaguaacugagaaaccgagugucccacccagaaacacaguuagugccuggcccagagaagcaugccacauuccucaagauuaaaagcagacuguggagagcucuugguggagagaugcuuucugugcaaguaugaggauuggagcucaauccccagaacccacauaaaaaagcuggauaaccuacaccuauuaucccagcacuaggcggauagagacagggggauucucagggcucacuggccagucagucuaaccaaacugugagcuccugguuuggugaaagaccuugucuagaaagacaagguggagagugauugacugggggaaacauccagcauguaccucuggccucuacaggagcacaugcaagcaugcaugcuugaacaugcaugucacgugugugcacacauacauaaauauuauugacauacauaaauauacuaauauuaacuagcacacacacaucaauaaauauacuaauauuaacuaacgcacaccagacugaugucuguugagugauuccuucagacaaggaacgcaggcaguaugaaccacggaugugguauuauuuuacaacauuuuacgcacuaaggagaaauacauuugauaacuuuaccagaaaacaucaugcuaauuaagaagaauauaaagaagguggcggaacagcuucuauggagucuuuacuacaugccauuuuguauaagugcuucuaguuugcauaauuuaucccauuuaauguuagcauuaaucaccagggagucugagaacucuuucaccugggucugugugauaucaucaugaagaccucgucucucccuccacaaugcuucuuucuaaccccuaaccuuugccaccugcugcccucugacaguaccuucuccuccauauucacuucagaaauugggaagucccagagaguccaacuauaaccuaaucaggauugauccauccacuuugacuuaaucacuuucauuuuuacuacgccuuccuccuucugccaaaacgagaugaacguguuagagguaggcuaaugugcugagugaaaaagacaucgcugccuucauguaauacugcauuaugaagcccagcugcuccucuccagacuaaagaacacauuucccauacugcacaagaccuaagauuuaaaaccccuguauggguuuuauuuuuacuuugguugggcuuuuuugccugcauuucucaguggccaccaggucagucacaaagcugugguucugagcagcccgggccucuucaucaugacaaacagacccuaugguuagcuccauagacagcucagcagccuuugauuuggucaucaguuccaggggaaagugguuuauggaggagaaaucccugcacucaggauccauggcuuucuguggaccacgucuaacccaguuguggcucccaucucaggaggacauacauugaucuugacgcuggcacucuuuuucugccuccuagugcucuuucauagucccugcaugguggcuuccagugaaccucuucagagucaccgcuccuccccacagauccugcucccaacccacauucuuccacacgucugggccuccagugguaccgugaccucuacacgaguuccuuuugcaaaugccuaugaaauggaagagaaacaccaccguuuucauggaacuguccuaggguuccauaauacagugguggguuuccaaccugucuccauaagagauucuaauuuuagcauugaaugacacuuuaaaaauauguauuuaauuuuuaauuuauguacaugaauguucaagcagggugugggagugaguguguguguguguguguguguguguguguguguguguguguuuauucaccuaugugugggugcccaugcaugccagaagacuauaucucaaauccuuuggauuuggaguuauugaugaucguaagcuucccaggguggacucuggaaaccaaacucagaucccaggagagcacagaaaguucucgugacuuacagagccaccucucuagcccuuaaaaccacucucacuggaauuguuggcucaucugcacagaacugaaucaggauaggugagacugcucuagcaggcagcccccccccaaaaaaaaagccuuauaguucaaccaccaagggguguauuucuguuucccuacccaccaagagucuaaguuggugccccccgaaggugggagcugugucccaugaagugacaucaacuaccaggcuuugcucaggaagugacucccuucucagaucaccagagaguggaguuacaaauggcagugagcugccucaggggcuucuggaaaucagaucucgcuuccuggauggauagcuuagcccccugagccaccucuccaauccucccuuccuggucccaccuaaucacuuuugacuggucagaacuguuuuucucucuccacaaggcaagcugaguucaaucuggcuuuucugcccaggaagauaagcaaaagauuuuacuucucuuuuaguagggagggacugagagugccacagugggcuccgugggggcgcggaaugcuuuuugcucccuagaagguuaaaucccccuaucugguccuccauaugugucuguggaacgccuggacaccggaauguuagcuugcuuuccacuuaaccaccuugucauuaaacuucaaaucaagcgacagaccuuuucccucccuggcauugugagaagaccuucguuuuaugacugcccaccaaaaaaccgccaagggcuuuuaugaaggcggugcaaucccuucagcgauauuucucgucgugcggucaugaaaccagcgccuuggcauucugcaaggugaaaacaccccggugaagagucauuccguaauucaucuuuauguuagaaguguaucaucucccauccauuuccccgccagcguggaccaggccucgacuuuggcucuccuuccugccggauacauccucucucucucaucaguuuccguuccucccgccuaacccggacuacaaugaagagacguauaauaaaaucuuuuaauugucuuagcauauguugcuuuuauuagguaggcauaauugcauucacgggaucaccuacagaguccuuucgaauauaaaaauugaaauggcuucacacccugugcacaaguccuucgcagccccaguuuuccccuucgcugccucccguccccccuuucccuguaaaguucacauugaaguaugaacacggagaggugggcugacacacacggcggggcuuaucagcccucgagugcagcuguggcccagccaaaagagccacugucauuucuacgccauuuauuccucgccuggccucauugcucgcuuccucuaggaagaaauucuuucagaguacucucuuugucauuuauuuccauauuuuuucucuguucgcucuccccgggcagguuuugaugcucguuuaucccaaaggcaaggcuuuuaacacacuucugcugaccucugggggccaggcuccucccagcagaugcaggcagguaaaagcagaguggaaaagcuuuuaugguaucuuuucagcuccuugaaacccaucucccuccaccuuccaaccaucccguugccucugacugccacccauuaugcaaaagcgggcaaugauggagcagggagaggggggagaaucagccaaaaagguaccagaauucucuuucucugguaccaagcucccuccaucagggauaggcuguuaacacauccucauuacuaaagaugaggucauguugaacauacucaaccugaauagaagaagcauuggcuaacuuuauuuuucuuuaaaguugcaggugcuaaauauuuuaguccauagguccuaugucaaaaaauauucaacuccugggcuggaggauuggcacaguggucugugcucuugcuugcaacuacaguuugguccccagcacccaaguugaucuccagggaaucugacucccucucucccucuucuggucgacacaaguacugauuucaugugcacauauuccuacacacacacacacacacacacacacacacacacacacacacagagagagagagagagagagagagagagagagagagagagagagagagagacuuaaaaacagaauaaaucuuuaaaacguuacucaauugccucgggccauuugaguugcuauuauagcaugcuauaagcuauguaucuaauauacaauagaaauuccaaaguucuggaccuuaaacauccaagcuuaagggcugagcagauucacagacaagggcccacucccugguucacaaaugguaccaccucacucuggcaucauauggugguagaggauaaggaagcucuuguugacagggacacuagucucacggaagaggaccccacauucauggucugucacucaccaaccuuaccuuugaauacuaucacguucaaggggaacacuuuucaguacaugggcuuuagagacaugcugacauucagaucacagcaccagcauagcacagagaaccacaggagauauaaaaaugagugacugcauuucuuucuaaaaaaaccaaaaaccaaaaaacaaacaaaaacaacaacaacaacaacaaaaaccaaaaacaagaaaacaaaaacaauacucaaaaaagccuguguuuacuaaaauaagaagccggugaguuuuggcuucugggacuuauuuagcucacuaauuuuaaaucuuagaauuucuauuuaucuuccaagaaccccuagucugauuuuaaauaacucuaacucucuaaagacacaagggccuguauagaauuguuccauuuggaagguaggauauuauuggcagauacaaccucagguggcugcauucccagcugcaucuuccuucuucacucacuucuuuuuggaucaugggaauucauuuuugaaaaaaaaauacaucuugaacucucucacucaaaacauuauuuuaugcuaccucacagagcuauuuagaagugugaauauuguuguuucccauuuacuaugcagaauucucuaaggaaaucuggcuaucuguguuccugaguagugccacccuugaaagaggaaugggucucccaccuuaaaccuaccacucuaucaccaggaccccugaguguggcuagggccuagggaacuaaugaacugcugagaacacacgugggaagccccagaaauuaacagucucacaaaguaccaugggaacagugucauauucccaaagcacacagguuaaacucaagagauguacauagcuugucuaaaggccaagggagcaugcuuaccuggaucagcccaaggucggaugaagguuaagcauccaaacccgugagagcaucccuccaucuuugugguuucacugaagccaaguaugacagcugaugucagccaaucgccuuugauccugaguauccuucucagcccccucuaccucuccacaguaauauuagccaaggaugggcugugagguagcagcauaugaaaugagacccaggagucacaaucuggaccaaggagacgcccaggcaugugauccuguauguucauucuguugcauucagccuggcuagaaggaagauggccccaaggucacccucaauucagggugcuggcauaccuacaccucuggguccuucagcgguggcaccugcugagcuucuguuucauggucgaaccauucuaggucuacagugguccuuuuuugucauucugaguagccagguuuggugacucagaaagacuuaugaagggcaaaggaccagaagcaaccaauucuggugaugcaggcgcuuggaguucuguucugguguguggacaggaugaucaguuguccugccaucaucgucaaauggugcuaucugauaaacguacuuggacuuggcucagaagaacauaugugcccaaggucacacaggcagagaagcaggcccagguucagcguucacaucuugggggaucuuagaggagguucgguggccuccuucucauugccccuuagagaaugauuguuaucguuuggauuucguuguaucguuuacuaugaagugagauucagucuugauauuguaccucaugggacaugggauggucuucugcugugcucgaagagauuuggggaaucugaacauuugggcaaagaacacacaaaaagugaugugaguggcuaacccuaguuuuaauccauagagaagagaaugagaucugggagacagggagaaagggauagagggagagaggaggagggggugagaaggggagggagagagggagagagagagugagcaagagagugagagagagagagagagugcaugagcacaauaauuuauagauuggcauuuuuccuucgauccuuguaauacuuguuuauuagagauaauuugcuuaggcgaacacgaugcaaaaaagccaugcgaggaaggcuuuuauuaguuguauaccgcauggaucaauaguaaucugaauacuguaaaucugcccuguuaacaguuauuucuucaucagauauuaauuccagaguggucccccuacgcggcacagagguacgguugcugcugccucugcaagcagguuaacuaugugucuuccuaggccucugcguggagucucagaucaaggagaacagcaaaggguaggcaacauggggugaacgggaauccagaaccacggaagguguggggacaaaaccggaaaccaucaguuucauuuauuuguuuaauuuauguacucucauuccucucucucucucucucccucucucucucucucucucucucucucugucucucucucugucugucucucacugcucccuuuauccucucucucccaaaugauggauaauuaaaaaaauauauaaaaauuacgaaaaaaaauagccaccacuucuauuuacaacacuaaauaguaagccauggagcccauaggacaucccacguaccuuccccacucacaggcgcacacaccucguuacgguuggaaucacauggggcaucuuguuucuaaaauguguuaagaucuuuacacuauuauguuuauuacugaguucaugaaagacagcuaacaaaagcggcguccuaagaaggaaagcuagguuagucccuuuugccaaaugucaaugauagacauuuugugaccauagaaauaugcaggguaugcaugcauguguguguggguguguguguguaaaagaugcucuuauugguuaaaaauacauauaguacacaucuagaugagguucuuauuuaaugguuacauaguggucuaugauacagagugaccccaaucaagucaagcacucuccaucagggacugcuguucagcuuucacguugccauugcuguugcuuaugcgcuuagaaagaccgcaacaguccgcguucuuauccauuagucuuaauaugcugcuguuuuuaauucuguaggauagauucucaaaguccugucugacuucugggucaaaggucaggugacauaauuugguaucuuggauuuuuacucaguguauacaccaguaagcauuucucauauuauuaaaaacucucugcaaaaaggcuuauguuuuagcuuuuguuuuguaauugacugccaagcucuccaccguguagcuguuccaaagcugaccggauguuucccuuaucauagauagcgccuuugggggacuuccaguucuuugcuuuuuaaacacagcuaggaugaaccccuuucugcacaacucuuucuccucuuuugggcuucgagguaagacugcuagccagaggccacagagggauugaaaggucuuuuagucucaagauacugauaaucgcaggucagguuuggucagcagguuguauuuauaggcauuuguaacucuuuccaacuguugcauaaacccuuggaaugacucuguuucuugcuuguuaucauuaggacacugacacugaacgugaccacagugcaguaguugugaugguuccuguugauuggcaacuugagaggaucuagaaggaccuaggagacaaaucccugagcaccuugaugagggagggauuuccagaugaugggagaagacccaccagaacggugggcuacaccauugcugugggcuggaauccuugacugaauaaaaaggaaggagugagccaaggcuuuguuccucucucugcuuccagacaguggaugggaauccugccucaggauuucgcuacuccccaccgccaugaugacucuuggccaaagugaucccuaccucuccaaacuuacagagauauauuucuuuuuaaugacagcaguaagaaaaguaacuaacaguuuagggauccuaccuaccaccauccccaggcagacaguagauucugcaggaaacaaauuauauagagucgaagggcaucccaggguaucccaggguaucccagggcaucccagggcaucccaggguaccacagggcaucccaggguaucccaggguauuccagggcaucccagggcaucccaggguaucccagggcauuccaggguaucccaggguaucccaggguauuccaggguauuccagggcaucccagggcaucccaggguauucuuucaucucaagggugacaucuacccaaucccaccagcuugggggcucauggaaagcuucuuaggauccuucccaugcuuccucuuaaucaucugcuuagaaucauuguuucccagggugguacagcucuggcuaaagggaggccuaacaccccauggggaguuugggaccccagcaucaugcuggacauguaacaaaccaaaacuccguguuugugucacacaccgaucucccuguguuacccuugaauccccgccucaguauuggaauuuauuuuuguuucuaacuccaugucuaucuuaaacacauggcaucuuugugcacaggcuucucuuguaagaccucggugauaaugcagugguucucugcugggauuggagggagaggagggagggaaaguaauuagcagggccuauuauaaugggguuagcaggguuauucaugguuuuaaaguagaauaacaaaguguuuaaaagccaggauucuggagccaggaggacuggguucaaacccugaccccucuucuugcgagcuugugaccuuggcuauguuauuaaccucuuuaugucuuuauuuuacucuaaauaugggcuaauuauagugccuggcgcaucauuuuguugugaugguaaaugaguuucggucucugaguuacuguguguuaagcaaagaacaagcacuaugugguguguguguguguguguguguguguguguguguguguguguguguacaaaaugcccauagaugguugugcuuguguuuaguauaaucccagccgggcagaagaacuuuuaacaaaaaccucuaggcuggcaggagagcaggcuggggcugggguuaggagcuuugagugcagacaagcagagaugguuagguacacauggaucagcacacaugggcccuuauuugauacacacacuccaggaggugggucauguggcucaucuggucugcugcggugguucugucuaacagucauugagagcacuccacuguuggccuggguacggguacaaccaaagcuaaaagccuucagccuggagaagaaaggcaggcucccagagaagaagacccuguuggugccaggcuggccuuacacacuaccuguggguauccagaaaguuggguugccuuucuucuaaugggugucacaaagccaggccaaaggugugguacagguagugcccacaacaacccuggucuuuguucuuugucuuuagaaggacaaacuagaagaaaguaaagaauagagaggaagaugccucuugcugggcaccgugcgaacaaaugcuaucagauaugacauagagaccauucuggugaguagacagaagucggagcucaaagacauuaagcacguuguuuccuguuagaaaacauguucacuuuguaagucucuggagucagcaugcucccugcaaucucuggggccauuuacugcucccuuaaucuucuucuguugcucugagaacuuaucugccauaaauccuagcuggauggcuguguuaaguugugaacacugagcaaugcuaauguugcccacauagcaagugcgaucaauaacuaggugggauuugccauuuuuuuuuuagaucacuucauaguucacugaggaauguucucuugcugcacccacuuuacugaugaggaaauggaggcacacagccuuuagucaccucuuguagaucugaaagcuguugagagggugccccaguaaauuaagguucugaugucuugugagcuggaccuauuucugucucggucugcugucuguugcuaugauaaauacucuuaccagacacaauuucgagaggaaaggguuuauuuuauuuuauaaguuacaggucaucaagaaagagagucagggacggaauccagaggcgggaacuaaugcagaggcccuggaggaaugcugcuuacuggcuugcucccuagaguuugcucagucugcuuaaggaagcagacuuaacacaccccaggcauaccugcuaaggaaugacaccacucacagugggcugagcccuucugcaccaaccaugaaucaagaaaaugcucccauuggcuuuccuacuggucagucugaugaagcaauucuucaguugagauuccucuucccagauauucuugucaagcugauaaaacccaaccaagauaauggcagagccaggauacugaucaauaucucugugccuuucaagucuuugcuccuuccuucaagucccaccgacucuaucaccuucucucacugcugcucuuauguccucggaugucuccaggaggaugacuucagagccaugcuuuggugacuguccugguuuaaaugugagauaucucgcauaaggcucacauggcauuuaguuuuacugggugacaugggucacuugguggugaggcuuaagguuuuaaagccuggcccacuuccuguucauacuguauuuuuggaccauggacacaguuugaccagcugccucgagcucccaccucccaugucuuccucaucuuaaucgucucuucacacucuaaacccaaauaaaccuuccuuuuuuuuuuuuuccuguugguugucagguauuauuaggucacagcuauaagauacaucacuaguacagugguaucucucauuuccacaggccuucucaccucugugucugugucuauagggcacuucuucaccagagcuuucucuggaggaggcaaacacaggcacagucaaggguucuccagagaguagugcagaguagccaccauugccagcagucacugagagaucaucugaauauacuggugaacucgcccuucucaacgcugcugccgcacgcgccuuaguuuugaaucacucaaaugcaucgaggcaggcacaaauuacuuaggagucuagacagaaggagccaaaagaaaugguuuugcacagaggaucugccauucaccuauucaaucaaagcuucucaauucaccacaugaugggaagcgcuaacaaaguagaaagcauccaagcaagucuauaaggccagagaccagaaaccaauaugcuugcuuaugagcaauauccagaacaccagccuucucacccuucauacccccaccauucucaucgggcacugaccagaggacauuggagaggcucuuguccuugcagcucuuaacaucgaucccugaccaggcuuuauaauuacaauaccaaccccacagugccagccuguaccugcuucucccggggaacaagaugguuucuccucuuggcucaaccucccggcaucuuggugacucaucugacccugggcuugaaccaccuuucccagaagaagaggagucuugggagacaaagauagcagccagagaaggaggcaccaaagacagccaagauagauaacuccccucagcuaauuucauucccauuuucccaugauccuggcgaugauacaguuggcucuggcagaaugggggguuggugguggugaugaaaacguaucagucaagaaagcaugaaggaaugguuauuuuuggauaauuguuggcuguaagaggccucuuuuaaacguuaacaaauuaugagguuagaacugucccuggcacuaacauuaauguuguuuauaagaaucaggaaacgcaaaaauaauugacuuggagacuggacucccuccuucuggucuccuugugugcuuagaaaccuagagacaagaaaagccacagauguaauuucgugaacuguugaccuguuugcaaggcugaaagggagaccugacucccuuccccucugugaaucaaagggaugguugguuauuuucuugcauucagaauacuugaguccagaguuaguccuaaacagcacugugcucugcucacgccacugagucagacaggaaacucccuguauccaaucagaggagaggaaaugucucugggaaaccaacguucaaccucacccagcuuuagugcuuuaguggugagcagauugccuucccacccuacuuauuuauaguaucuugcaaaaagguuacacuagaguguauuugaccauaauuucccaacgaggucccuuuuguuuccuccucaaaaaaauucaucuuguccuuauuauuuguuagacaacccugaaguccaucccaacuacccacaauccauuugucaccgagguaagaacagaugggggccucucugcacugaucccugucagaggcgagcacauugucauguuucaugguuggcugcaagacuggaacagggccuuuugugagcugucugauaaugaagcauauuuggcagauacuguuauggggguuucauggauuuccucuucguggugggggaaggaggccauggguggaaggaaucagggaagaaaugaagcugaagauggauggaagugugcauagcucacagguuggguagcuuuggucgcucccuugcaagaggaaggacucuucugaguucuagaaagcaaugugaagaagaaaacauugaugcucagguacugauguuaggguucagagccauggggaaaaaaguauuuuaagaugcacacagacaggagauuucccugcaucugucugucugucugucugcaccccccccccauuugugugugugugugugugugccugugugcauacacgcauuauuaauauacccaauguucuugaguauguauccaaacucuuucuggauccuucacaugaccuauauucccagacauagucuugccugugacucaagggaggaguguucuagaauauacucaggacuacacugaccuaucugagguugaaagaaaagguuugggacucacugagaacaauuauaaugcuguuuggcccauagauacuuagacuaagaauuauacuccagacauauaagcuggguggguuuaaagcaagaaacucaugauuccccaaaagugcuggaguccaagguccaggcucuggcaggucugagguuucuuggggauccuucugccuuuuucagcuucucuugccuccucggagguucugggugcuccucugccucucugcccauacaguguucuuuccgugugcguuuccucuacuuucaacgauaacaguguuagaggaucaaggauccauccuacuccacggugauuucaucuuaaguaauuaugucuacaauauuaaugcaauuaugucugcuuccaaaugacaccaacccccaaggcacaggucuuuuggucauggcaaguggcgauggcaguacucuugcuaacucugacagaaugguugccauuuuggaaaaucagacccguugagcuaggcacuugcucuugcuuguccacccagcuucucuaaagauugggaaauugaaccaucaggaaguaugaugauccacaaucucacuccucaauugagggcccuauuuucccuccccagggccauguuuucagugauuuaacacgugacugcaggagcaccauaugauuuuuuuuuuuacccuaaauccaaaugcaugaagucuaacaggugucaaagaaucacaaugcaaucuccaaaccgaggauguuggagaaaacgcauauugcucagugagaaggcaagaauauuaagugugcagagcugaaucuggaacucugcaaagucucuuacguuugaguggaaaugauggacucacauacucugaacuccacugccuggguucaaaccccacuuacucaggugacucugggacaauuccuuaaauaggagggacuugcucccuccuccuuauggugauuaguaacaguguucaccauauagcuucauucauuuguuuuguuuuugcuuggguccugggaaggaguuuuagacaugguuucauguagcagccggucuaaaaacucucuauaucuccaaggguaaccaaaucuucucuuuccgaauaucauggcauuuccacgaaagcuaaucaaacuuccuccagugauccaaagauguaauugccaucaaucacauucuagcaucucugcuggucagcuuuuccugacaacuugacaggaccuagauucaccugggaagagggccucaaugagagauuaucuagagcaggcuggccucugggcuuaugugucagggguugucuugauuguucacugauggaggaagaaucagcccacugugagcggcaccauucccuaggcaggugguccugaacugcuuaggaggaaagcuagcugagcauauaauuagcaagccaguugacagcaugggugcagucaccuuugcucuugacugugaaugugcugagugagaccagcugucacaagcuccugccucagugacguucacuaaguaauggucuguggccuggaacuguaaacugaaugaaccauuucccuuuccuaaauugcucuuaugcaggguguuuucucacagcaucagaaguggggcuagagcagugcuccaaacauugaucccacaagcauuuauugaauacuuguaggcacuaaauucuucucuaguccccaaagacuuuuccuuucuuuuauauuacaaaacauacaaaccgaaacaacaacaagcucuacaaaugagucugccucagggugaucgcucucucugugugggauguaggcuucagacauaaugaaguuuacauuacacuuuaucucugggugcagugauggucuucaggcaacaguccucucacuucuuguguggcucuccauucuccuccacggaugacccaugauugacagugguaaagugcaguccuucuuuccuguauccucuuccuagcauguaccacagaugcacacagagaagggggaaagggaggaaggggaggaggaggaauagggagagggagagggagagagagcgagcuggagacaggagaauggaugaagguacguaaagcagagcugggcgaagaguccccuccuguccuccaugcaggagaggaaaggucugggaggcaggugcugggugaguccuccucugugguuucauacacagcucagaaguuaugacugcugcugcuaagcgauaugcccucuuuuuuuuuuuuuuuuuuuuuggcaaucacaugacuucuuuuaguuucuggauuucuuuucaagauuuccuaaaaucccuuuccuggaggguauuugcaugguuacggggcacagcgugcauugucagagaaauuacaaauugcuaauugaagcgccucugagaaucauuuuccuuuuguuuugcuuaauuuuccacacuuaggagaucaaacuuucaguuaaauguuuauacagcaauucagcccuugcaagccaucuguugccgagcgggaucucuaggaugcacagucucgugugcuggguugagccuuucaaaucucuuugcacggaggcagaauguuuaacccaugccagcagaucaccacuuuuauuuccaaauccccugccaaacucucaucgaucuccaugggucgcggauggagagcauuguggguuguccucuaucaguggcucagagcgcucaccucucucgcuucuccauuucuaucauggagaaggcacugaggggugcaggcagcauccuuagcaucagugcccacgcugcucaugaagagcugagcuaacacgcaccggagggaaaauauugcuucucacaaaugcucaauaauuauagucuuuguugcauucagauccauauugugacacauaguggaacaucuucaaagucuguguggaaaaguuaacagauacuugcuggugacagugaaaaaaaaguuacuauauggagaagaaaacugcauaaacagagagacauugguggcagcugggcucaaggcucugucuuugugugugugugcgcgcgcgugugugugugugcacaugugcacacagcuauguguauaagggcagguacacacgugccccagaguggguguggaggucagaggauaagcucuguugugagucgucauuuucuaccuugcugugacgugggcuccugaugcuguuuucccaccauguagcgagcaugagagcuccugggaaugcuucugucucagauacccacccagucuuaagaggguugaaguuacagaugcucacauuauugaggcuggcuuuuccuugauuuauuuugggauuugaaccuggguugcaagugcuuuuccccagcuccuugggggaaauuucuagccagcgugguauguuggcuucgagaagaccugggugaacagacugcauagcauauuucucaaagaauauuuauucggagcaguuccucuuccaaucaaaggggcccgggauucucuuuuucugagagcugucgaccaguggacacaaagagcaggagagagugagucuuccauccuaucucccugauuugcuuguuugcauugaagucuucggagcauaaaaucguugccuccuucccacaaagguuagggcaguuguucuccaucuugaaauugagcuaagcaaggugucuguuuuguuguuguuguuguuguuuuguuuuguuuuguuuccuuuuggugauuuaacuccuuauacauucagggacagaggguaucaaauguuugagucccuguguuuaaacacuugguacuaaacuguuugagaaaguuacagaagcugcagaauauagagccuagauggcugccugaggugggucacugugggugagccugugaagguauaguccagccguggcuccaguuuaagcucuuuagccaugauggacgugaaauacaguagccaccuacgcccacaggcagagccacugcagcugucuugccuugcacaucacgauggaccauacccuccaaaacagugagcccagauauaucuuaagcugcuucuguccaagcucugucucaacgaugagaaagguaucugauucaagggagaugaagauguccaucuaccugggagcaucaaacgagucccuguuuuaucuuccauggaaaugucuucauagcaaauuguuuuuggauuaaaaaaaaaaaacuaagaauaacugucauagagucauuaagcauagauuucugccugacguuuggaugugaaguuuaaagacuucacacaggacuuauugaugucucuggaugcucagcacaccgggaacuuccuucugcagacagccuuaggaagcuucacugugugggcucagagauccagcuaaguaagcaaaggacuugccaaaggccuggguuuaguccccagcacggcauaaaccacacaugguggcacaggcacuuggaaagugggguagaaggaucagaagcucaaggucauaguaaguuugugggcaucggggaugcaugagauggcuuugaaaaggaauucuuagugcuaggaguguaacuuagagguagcauucuugccuaauauauauacgcaaagcucuagguucagaucccauugcagcaacagcagcagcagcaauaacaacaacaaaauauuaugauauuuucaacuuggaugaaacuggaauaaagauucaauaaaacaucaagucuguuuugucaaggaagggaagucguuuagaagauacacucugauaauuaauuuguugaguuuuauagagcaauggucugugaacugcaguccaugggccaaaucauguugccuggcuaggcuuguguugggaguuuuauuagaacacggcuguagcuacucuggcacuacagcaaauggguuuauuucuuaaaccaacacacccugcuauuuacugucaacgaguucacaaagaaauccgaggacuuguaggaaucauuagcccacuggagguaccugcacguauugaaaugcagcugaauuuguuuguccauauauuuaaagaccaacaaaugaacaauaagauucugcgaaagguggucaaaguaggauuucuauuucuuggaggguaaaggcaagaagagugcaagugaaaucgggguuuagguucugagaaaauaucugaugcccugagauuuugcuuuucugagcauuucauguguuucaaaguagcuacaccgcauaaagaaaggaccuuuaucuuucccuacuuaauaaaagcaccccucccccguagucuucuaacuuuugguuagucagagcucaaaccuuauucaauugcuguagacaucacuugggaaaagcuuccaucuaauccuguuugggacgagcagaaaaguuuucaguguacaaaaaccaccaaauaggccaugacaaaaaauaaauaucacccacccaccaccuggcagggcugggaucagcccaaaguaucagagcuaaaggagcccaggcgauguaacaggagaauucacugaauaagcaccuauuuaaaagacggcauaauguugggaugcauguuuauaaaccuucucuucaguggagaaguacuuagugccacaaccacuuuaaacaaaauuaguggaaaaaacagggaguuuuaaggaguaagagaucagguauucuuggcucaccacacaucaagugauugaagcuaaaaauggcuuuaaauacugcaauggcuugaaacgccuuacauaaacugaccaggaaucuggggcauucgcacuacagacaauuuucuucuccuccggauaagggaugggaauuagucauagggguauuuccagauaauguaguuaacaccucacacuguauuagguaggcagagggcugugcuccagggagagaaacugcuccugccagcucucacaaggaauguggguauuuuuaaagucugagugaccacuagugagucauguccacagcaugccucccuuuugguguaaaauaacaagcaguacuuccaaacagucauuuaguuauuuguucaguucuuaauucaucuauucauccauacauccauccauccauccauccauccauccauccauccauucaucuauccagcugccuauccauccaucuauccauccauuuauccaucuaccugccaauccauccauccaccuguccauccauccaucaucuauccauccaucuaccuguccaucuauccauccauccauccauccaucuauccauccauccauccaacuuuucaguuccccauuuguucauccauucaacaacaucuaccugcucauucauucauucaucucaugguuauugagguggcauuaauauguuaguaaaaagaggcaacaaaauaccaagaccugaugagacuguacuucccuguaguuggacuccaucucuuucucugccuacaggcagaguucuaggaaacaguccugaucccauuuucccuccaucucaaacccacucugcaggcaaaugcaaacccuguaggcuaggagccuuguagaaaucuguaccuggaaaugaaguccaacgauaaaaggaaggcccagagaccugaagaggcaugcucuaaguuccaucucuguuguguaacauaacuucagagacaaggcaugaguucaaaccagaccugauacuuaggaguuguguagacuugagcaaguaguuuccucucucaguuuucuguaaccugggaagaaaacagcaaaucuuuuccaccaggaccacaagggaguaggacagggagaguguacauguguuccucuagucugcugacugccucauagccagccuuguauaagagaaagcuuuaugugagucacaacuuauagggaagaauguugcccaaaccacaucaacaguaauucaagaacaaaauagucaggcucuuacauuguuuauguuuuuuuuuuuuaaucuuagaucuguuuuuuaaaaguaccacuuacucaacucuucugcuagaacuauuugaugaguaacuacuggguaccucaaauuggguggggugcugggccccuucuucgugaaguugaacccugauagcacacacuaaccagccucagauugaugggcacugggggucaagagcaguuuguaucguaaguucgcagacgagggaaugaugaugggugggcuguccugagggaggauguccucuuucugugacaucaugugaagucacagaggcguuccuucaguccuuaccauaccgcgcauagcucugccagcuccuuccaugaccaagcucuaucacguacaguggcuuauuucugucccuuccucugcuagaggucccacucugcugacucagggaguugcuacuuuuccaacucccaaagguuucuugaucaccaaguaaacguuucccacauguauuagacuuuuaguuuccgagacaggcaccaauguuugaauugaauccacuaugcuugaccagaaaccaguugugcuuccuguuauuggggggggggcgaugaguauggguaccacgggaggaggauagaugcucugcuaucaccacagcuggucauuaucuguugaguguagacugugagcuagcaccacaggaguauauucugugcaccgucugauuccaucuuuaaaaugaaucaaauggguugagugucaugaucucaugagaacaagcaggcaaaguguguuucaggugguuucccaaucacccugcuggucgaagguugaaugagagguuggguauucuaagcugacaaagacgggcacuuggcagggugcuaggaacauggucaggaaugcauaccugugagggaauguggcacauggaagggucagugggaggacugagcugugaugccagaguaccaaguguuucccacaguccugagcagacucugaagccaagauggcuuucaucuaagguaccaaaccaugaaacggaugcucucaagugggauaaggagacaagaguaucguugauggaggcugccuccuggaaaggaucuagauagggcaagguagcucaccuggguuaagcaaaaucccugaagaggacucauccuucaaaagaaaauacccuuguggccuagaaaucaccuugaugcaagauggacauuucagcagaaucucacagcauccacugcucuaaagccaugccuggaguccaugcauggaacaggcucaggaaggaagaaagugacagggaaagcuacacagguggguggacaugggaacauauguucucugaaggagccagccaugagagaguuugagacucaugagaaaaucgagagugaaaaucagcagcugcaacaauuucacacucuagauucuagugugcuuggagugucaaucaaguagaaaaagacuauugcuuuucucuuuuccaugucauugguuuccagugugugugugugugugugugugugugugugugugugugugugugugugucugugugucuguguguauucauguguauuuauauuugcuggggagauacucaugcaaacauguguccauccuuguagaagcugacggucauccuuagaugucaucucucagaagucacccuccuuguuuccugagauagaggcucccacugagaucuaaggaacuccuguuuaaguauuguuucugaaggggcuaugauaucaccaaguccuagggacagacgcuucucaugcagucuccuguguaggaaucugcuugugucuucaguucgggaaguacccaaaccaaaggcugcuucaugguuugucaccuuagaugaaguaucagagaugcaguaugaagaaacaucugguuuuucucugggucucugaccccaggcccuucagcuuaagagcaugucacuuagcuguguguuggaagcuccuaugugccaaagggaucugcccaguugauuugugcugccgggcaaaggagugaguucugagcccauuuaaacccguucuagggcuaccugaaaaauaacucacucugccaggauuucccaucucaacauuacacccaaucucucucugcccugauaugcugcauacuugggcucugguuacacccacgcacuuuucugucuuuauucugaacccuucucuuugcuuugcaggguucuaggcuuguccccugaacaagaguguuauuuuauuuuauuuuauuuuauuuaggacggguuggaauauuuaucuguaagaauguaaagauucuaccuguagaaauaaacugccugguggucuaguccacuggugagccagggcauuguuaguucuggggucagacuugugugauuugaauccugguccauuauaucaagagcuacggcucaccugaccgucgguuuccucaucuuuaaaacagaacguugcuacccccgccgagucguugcugugucuaaugaggcguugaggugaaguuucuagaacccuguuuaggauuuguuacugauaaaaaaaaacaaacaaacaaaacauguuugaaacugugguugccuugggcuaggaaguaccugaauggaagccgcuuuagguuguggggaccacacugaaucaaugucuaaccucagcaguuuuuaucaguaaauaucaguuuacauuuagcauuuucccacagugccugacucaauggaguggcauuaugacuugcuuguuuuucuauuaacaaaauucguuaauaacacucuacagcgcucuugcaagaauucaguagaaccucugccucugggcaucuccaaagugccauagagagcauccaggccccuauguaggaucuacgucuuaaagggccuguccuguaaaggccaccugauucugaaugucaaggcacugccugcgaggccagacuuucuaccaccuggacacucugaggacccaccgcgcagccagcuugcauucuugcugacucugugcuuggucaccggcuguguuugugugccuuccuuuugacaagccaggcauuugugagaagcugaauccuaucaggugcagcagccagagguggggaaacgcagaguaagguguuccuugguguaccccauuuucgugaguucagcauuucucuacucugugagggcaagagagcuucaaguggagcucccggguggaugugccaggugaccugcacauacugagccauuaacccaugccuugccagccagcagaaucccaugaaguuugccugggacaguucaggucguuccucgauugcggucaggaauggcaccuuugguugugucgaguagggagaaccuaguaacgaaguucagaggugggaaaggaggacccucauagagaggcucugcauagagaggaaacaacaaccacugggaucaauggcccaagcaggcaaugugucaggcuguauucugacgcacuuggccaaggaacuuaugucucuacacuuaauucccauucagccugccaaccucuccaccagagcaaguucuggguucaaaucccaggcauccacaaagcacucacgagcaucggcucucagcgauuuaaggcccaaagucaaauucagcagcuaccagugaggcugauacaaaugcacauugauugucgcacagcagguaacuugugaucugcuuauugcucucuggacucugaacugaggaacccugagauuuuuuucugaagccuagaaggaauacuauuagaaaauucaaguuuauguucuccuuucuuuuuaaaaaaaauguuuauuuggguuuugugugugugugugugugugugugugugugugccuauggguauuuccccugcauacaugucugugcauacuguguauauagugccuguaaaggaaaggagugggcaucggauccuuuggaacuggagucacggaugguuguuaguagccaugggcaugcugggaacugaacucgguuccugugugugaguaccccaugauuuaaccacugagccauuucuccaacccuuugguuuguguguguguguguguguguguguuuuaaagcaaguguuuaauggggagaauaagaggagcagagugaaguggacagagaaguccuguuagaggggcacauagaagcuucuagaaagaacauuggagaaugguucaggcuuuucacaagggaaaugcccaucugcauuugugguggacagcaagccagccaaugccaucucauaccuccauuuuuucuuuucuuuuuaaaaaauuuuuauugguuauuuuauuuauuuacauuucaaauguuauccuccuuccccucugaaaacccccuauccaaucuacucugcuucuaugaggauguucccucacccaccuacccacucccaccucacugcccuggcauucuccuaugcuggggcauugagccuccacaggaccacaggccuccccucccauuuaccccagguaaggccauccucugcuacauauguagcuauagccauggguuccuccauguguauucuuugguugguaguuuagucccugggagcucuggggagucugguugguugauauuguuguucuuccuaugggguuuacaaaccccuucagcuccuucaguccuucccugaauuccucuauugggguccccaugcucaaucugagauaccccaguuuuucacuuggauggauacauguaccuuuccaauuuuaucuuuaaaauguucagagaggacauuuaugagaacacugggggucaugugggggacuggggagacgcuucaguggugucacuugccacacaaaguacaaauaguggaauuuggauuccuagagccuacgugaaagcucauaagcgugggagcuacccuuaauccuagaacuugggaggcagagacuggaaaucuucaggacuggguaacuaguuagacuacccggaaaaaaaaaaaaaacaaaaaacggagccauaguaagcaaaggaaagggugauugagaaaggcagcagucagucauuaucuuugggccaccacaugcacauggaccaaacacauagaaauauguacauacacacaaacacacaugcauguacaugaacacaaacauguauguguauguaagcauauacaugugaaugcauucacauguacagcauguagacacacauguuucaaaaaaagcuagccccaaaagaauacugcagcaaccaucaucuacuaaaacauaaacacacuuaauaaguauuuacugugugugcuugcacaugggccgggagaaagcuucagacuucuuagagcugaacaugggggcaucugugagguacuuaauggggugaugggaacugagcugugguccucugauacagcaggaagugcucuugagccaucucucucucuagcccugguggacuccaggcuuuuacugcacauaaccauuuugguacucacucaguggugccaccaucagugugcaucucucucucucucucucucucugacugucuugcaagggagauauuugcagauguagagcauguuuguuaaggcuggugcagggaugaccuugcguuuuacagugcuuaguaguuguacaaaugcuggcuugacuaugagcugccuuagucccacagcaaggugccuaucagggggguucauagccagcgagaugcccagggaugcugaaggagguuggggagaagggugacugcugcuugguagaaguguuuuccccaucuguuaagucucuuaaaugaagaacagacaaagacacuuugaucugcuuguuuccuucuuucaacccagaauaaacaggacgguagcuaccuaugaacuugugucugcucucuaacccaggagaagaccagcgucaucacaagauccugucaaaggcauauugcauuauauccuucauagaggcaguccaacguauggggguuugucacauggcugccagaagcuguacucuuucuaacuuuaguuucauacagcuacauacuccuaguagacaccugaucuccucuccuccuccagucccucccaggacaggagaguuccuauagauucccacuuaggagagguuagaaagggccucuccacacccaaggggaaugcucaaggucuuugccguggaaaagcucaggcagcgaagaaggcugugucugcacuugugcugugagacagcagggagagucgacuccauguguacacuauacccaugcuggcucugcguuccaaagaccuaacauuacagccuucuucaagggcuucagagcucccugugccaucaaauuagguuugaaaacuucaauaaaagaagucccgaaggaaacugucaauuaaugcauuuacaccguagcaucauacuugggcaaaacaucuucaaacacuaaugcuguuugccaaccauuaaagugagcaggcugcuugguuuccauagauaccuggaguaauggccucuuuccucucguuaaagcggaagaguuguucaguuucuuucuuuucuuuuuuuuuuuccuuccucuuccugcuuugucuuucuuaacuuuccuacuccauccccauuuauaaaaauaaaagauaacuaaauugaaaccuggcagugucauuugucugagacagauagcuugauuuauaaacucaagggauuucauuucugcucaucucauuauucugugacuuccuccaagacuguugguacuuccaggaaccagauuagaggguuuucaguugaucaaaguauuuccccagaucauucaauacagauacacacauacucagaaagaacucuuauuguucuacugaggaggaacugaguuuugauaacguguggagcagaaauuggcaaauuuuugccuguaggccaaaucuggcccauugacugauuguauaaauaaaguuuuauugacacacagguauguucacuucugugcauauugcucaugacucuuuugcagaaacaguguucaacuugaucuuuugcaacagagacuacagggaaacuauauuauuuacaggcuuuucagaaugaguucguagaucuucuguaugcaagauaaacaaaucagaguuuugguggaaucauuuuuguccuuucaaauaaguagccagucuuaaugugacucaggcucuacaucuuugaaaugguagaacaggacccucuuagaggauuuuaagaccggacuuggcaucuaagaaguaaacaaaaaggauuauguuuguuuguugcuaaaugaagacaaucaaagaagccuaccuaugacucuagaauuguucuuauacacccaagaaaaguguaugaaauguauucuaaauaacucagguaucauuuggggguguguguguguuuaugugcucagcaguuccuuucuguaaaagaagaagccagguuaggagugcauucacuuuggauaaagcaaacaaaagacaccacaccagucuaggaagaaucuuuaauuucuauucagcguuaaagaguuugagagagcuuuucccuuuccccccuuuuaacaaaccagcucaaguccaugccuuuagauuauaaaaguaccugaaaucgccuagaauaucaacaugcauaguaugucaguauuuacauauauuuacauaaggaaacaagagaaagaucuacaguuauuuacagucuacauaggggaagagaaaggcagcuuaauuguauuuccuaaaauacaguagcugaguaguuagcacaugcauauuuagauaauauuugcaagauagaaugcaauuuuuaaaaauuuuuuuguuuguuuuguuucuaguauauuugcaucaagugcuuuaaaaugcucauaacacccaggcagaauuauuuacucuggcaauuaaagcaacagcacacgcgaucauuucccacuaacuagcaacaagcugcuggugaaugaaauaucuauuguuucucauuagccccuagaccacagagaagcgcucuuucuguguaaaggcagugccugagcgaucaccauuaauuauggaaguaauaacaaacgagaugcucucuucuaaaugaaauaucagcaaggcugacaucuucaagccagagaaaugauguguuccgaggaguucucaaagaaaacacacacagcuaagugagaauguacccuauuugacauggcagggcuggccauggggguggggguaggggggcugcccaugagagcugaauuauggcaaggugugcuuucguaguucaagcugggaugacggaucaacaguucauuucuuacccugauaugucauauuaggaacucugcauuuuccacccaccgccaugguauuuuuauuucuuauuuguagaauuuaccagugacauagcuauauacauucugaauccuguuaacagucuaaacagcuuguucgaggugugcccugaaauccugccugcucuccacauaguuuuauauaauugaagagauaaagggacaggcaaacuaauugaagcuuuucuaugcagcaaaggucccccuauguguuucacuuauacuaaggagacaucuuuuuccccccauuauauuagaaccaaagccauugauucugucugacaaucauuuuuaaauuauucaguauacauggugaauacagaggcauacauguauauacaguauuuauaaauuauauauacauauaaguagcuacaacagguuaaagaagugaaauguaagauguuucaaauuaauaccugccaaauaucuucuuuuaucucuuauguaaguccuuuaucucuucguaaguccuucagcucuggcauugagguggaccaguuagaaaaugacaaugguaggcccaauguagaagaauuaagcuauucacaagaugcuuauuucaguggcaaaugucuauggcucuucuuuugggccauaucaaaguaacucaugaaagaagggauacccagaucggaguuccaucccacaagagaaaucuccaucuguaaaagaacuaaauggcaagcuguguugagcaauguacacauugugggcaacucaauggggaaugcccagggacaucuuuccugaauauguaaggccuaauccaccagaccuucccuuccaucuagugagaauugcucaagagcgauggggggcucuugauggggggggggggcggcacaaacagaauguggaguaaaugugcuucgagagacaaucuaagagaguacaugugagucaugccuuuucccucuucucauuggggguacuuccaccucucuccccacaaaauuguagggucccgcgaugugaaaugauccuaauuaucauauugcacacagaauucugucacagaacucguggguugucuauggcaaaugaggaaaauaggaaagguaccuuauuuauuuugagagaaagucuagaacaauccuugaugugcagacagagcccugagagcuuacagagguuggguugcucugcucuccaaccccaguuaaauuaaaaccuugccuggccucauguucugagaccaaacauuuggaugccucagaauggcugugauuggcucucuagucgcuuccuaggcuuaaggcucgggauggcagcucuauucuucuguucuagaaagaauuccaucccgcuuuccaccuacaauccagugguuccagacuuucucucauagaaaaagcaacacugccauggacuuuuguauucauucuauccugguuuucaagccaggggcucaaacuccucggggaccuuucuagaaaacugucuccuggcagagaucugacuuacauuuggugguguuuuacuuggauuccuucaaaugcaacaggaaaugucuggggucaucucagagacucucucugaguacuuggcugccacgggacaguuaaaugucauucuuucugccccuccauguuacucaagaggggcuuugcaauuuggguguuaucuguggcuggccugauggguuggcgucuuucaaugugugccccacccugggaucccuggcacugaugaacucuacagcuauguccgcacacccgagaaugcacuccguaccuucauucgagagucaccaggacaaaaagaaccggagcucuuccacacccgagaccccauguguagcaaaaggauuugugguaacgaguaaguucugaaacucacugucaaagucacugucaggugagcacauucucuucugcagagugaagggguaguauggcuuuucuggaacauucucucacacugguauaccuuguaaacaaauauccagucuacagagcuuugcucuccccccccccccccggcaaugaaggcuuuuuguaaggaaggcuuaagaacaaccugugcauuaccagaacucccgagggcuaggaagauguuuacaucuccgugucuacauaaaauauuugcaugcaucugagcugagccuguauuauucaaggcccauggaggaaucaacuguugggaauuuguaggaguuaauuugcuagggauuuauugggggggggggguguguggagggcugcaaggagagggauggguugguuugcaagucuaauggauugucagagccugccucuauggaaggcuauguuuguaugggaguuuucaaaaacagggcuggcuuuggaagcaaacugaaaguccuguaccuuucugguggagcacaggcaagcuuuccuaucagaguguuguugggagaugggcagaacacagagggcauguaagcaaccacguauuccacugguuuugauguucauucuuagaagauaucuaucaccaaaggguauauucuuuaaguuggcagaucuuaugccuggcagugccauuuugggucagguaauuuucacuuucuuucucucuuucuuucugucugucugucuuucugucuaucuuucuuuaucuuuuuuuuucuuuuuaguaaagggucauuugcgauugaauuggugggcugugugcugagucuucacuuuuugguguuaauccaaauggauauaauuucaauuuaguucacugacuaaaucaacaguggaaaaaucuccuuugaacauuuuucaggugaacauacagacagcucauauauuuaauuuaggccagaucagggcaucuaggcucugauuagugacaaaauagcacaaggaagcuugaguugaaugggaggugucugggaggaagugaccaaugugugucacguguuugggaaggcgguuuccuacacugacucauggauucugcgucugucagucugcgacugucacugugucuuuggacaggguccguucgaucuccgaaucuaugugggucuauaaaaaugaggaagcuagcugucccuggcgugaggacauugugaggauuagaaggugaugcugaugcuaggugcuagcagauggucaccucucaaugaaugcuagucaucguagcuauuggaauggucacaaguggcuggagcucuuuguucucuuucauugugguggaaccuagcugcuuauucguaagcacuucugguuguauagguagccguggugauacucugucauugaggucacucaucagagaggugugugagcuuccuuccugcacugacuacuccgcuuuaugaaccaguggaacauucuggaauaggaggucaauuuguccacugacaauuuuguucuuggauaguuaaguagggacacagcacccccuuggaacagcuugguuuuugcccuguaaaccggagauugaaauuauuaauugugggaacaguuaugucccaagcaccaagaccuuuggagaugaacuccagaauccagcguuguauauuucagauagaagucuuauaaguucucuugcaugaguguuuggggguggggggaggguaguaagaugcuugucacuacuacagcuuucuaacagaccaaucauuucacucagcaugaucuauucauugggccguggguuucacauuuggaaaguauauucuaugccuccaaaaccccagaugagucucaaugaaagccccgagggucugaagaugcaccugucuuuccucuuugccuaaccuucucauugcagcucagcaguuccaauccaccucuguagucacggcccacuucucaagagcugccugccuucccugcccuugaggcuccaagccuaaucuagcuugcacgguguguucccuuuccugaaucuauuuuuuuuuuugcauaaauugauuaauucagcauuugcucugugauggccugguguggaugugucuguaauaaagcaaucuucaaacaucuuccacucuuucaagucuuugaauauagauaugccaugacagcggggcaucuuuuaaaaugcauuguuacaccuccuucaagaaagggucuacucuuccuuuuaaaugagcaugcauauuaaagcagagucaccugaacgcuaaguuaauugugugacacguguucuuaucagaacauggacauucuaucaaagcacuaaguaacgcaucacagauaucaauaugugcugguuguuguuuuuuaaaaaaacauguuuuguuuaucagaaaccuccacaccuuuuucuucgaaggacuccauauccauuuguauccugugcugacagcuacaaauugauggccagccauuaccagauaaauguugauggaaggcagcgacuuaacaguuucaucccagcaaaggacuuuuggaaggguggccccuuuaaaucucagagucucaguaaccaaaggccgccccuauuuguguuccagguuucugagguggaagacaggauugcacaccugaaaaaugauuuccggcagagaccgauaaaccucuguuagcaaaguguucucagcuuaacacccaaacaagaacccuggacaguuuuacaagcauagugacaacugauggcacagucgaacucuggcuacucgaaaauguuugacuggaaccuagaugccauugggguaugaauaaaaauucuacuaggcuuccuacaaacgcucaguccuaggccaucagugcuuuaacccagugacauugcuguggguugcacgugcuacuuccccagcuucugggcagugacugggcacaaccugaagaaauuguucuggaggagacagacagacagacagaaagacaggcacacacgcucaagcacacacacacacacacacacacacacacacacucacacacacacacaaauugugggagaacccacagcucccgccagcauucauaugucaacggguuauuauuuuaucaccauggaucaguaaagcaauguugacaaacggcaagucguaccuucaaauauuacaccagcguuguuaacauuaauuccuuuaugugucacuuucaucuucucugaauuauguauggaugccccucaaaguggcgugaaagucauuugauagugauugaaguguucggggcagaggggggagcccaaaccccccaaacccuuucuuauguguuuaaaaauguuuuaucuucuguuagcggcaaagcuuguuugcuaaugagaccucacuaaugugguucugucucaggcugaugguauccagacucucgaagagcuggugagucccaagugggaacuuguuauuaaacuguugccacaucggauggcauaacgaugucacucgaagguugccauuggaacauuugaaaagaaaauucuccaaaaagcacauggagguagugggcaugggaccaacgagauacuugucagcacauaauugugugucugaaaagaagauaaagcaagagccaguggccaugugcauggcaagggcauggacccuuugccaaaagcacacaauuggucuuuggggcagcaaaguacccuguccuguguucuuuuauaaagcucguggcacuggcaguagaauuuggguuguaaacacccuaagacugauagcacagaauugaagugcgcaugcguggaacgcugggcuuuuaaaauugcugaagcauagguaccaaauguacauuuccacgaaaccagcccaacugcagucacuugccgaucccaacaaaggagaguacaucuccucgugacccacaaauuagcuugauucuggauuggggggggguuagaauuucuucacaaaagcaccauuuccacaaugcaagcacacagaccacaucauguuuagaaggucacagugacaaugugccacaauaggauuggaagaucucugguuuucacuuuccugaguggccucccuuggucuugucucaggguuagcaaggcugugggaggccagccugcugugagauuagaaccauugucugacaugagaaucaucuaugguuccaggagggggaagaguaagagaaggaggaagaggagaaggaagaggagugggaagaagaggaagaagaggaggagggagaagagaaggaagagagaaggaagaugaggaagaggaggaggggaagaggaggggaggaagaggaggagaaaaaaggaggagaagggauggauuuggaggugagcugauuggauucucucagccaccacauagacaucuguggcaaguugccuggucacucuuggcuuuccuugucagcuacaaaauaaaaaugaaaauccaagagagacagcccaaaguuuauccagaauuccaucuucaccuagacccugcagagagcugaggacaaacuacuguguggcuuggguuaccugagagaugaucucuguguucuacuuagcuaucagaggcccucuggcugcccaccuccuccuuacagaaugcagaggaaccccaucacugucugacagguauuuuagauaaacacaccuggugcucagcuaauggugaugaggaaaaacaacugacaaaagggaaaccaauugagaaagaaaucacugaauccaaagcagucacuguuuuggguggugggguugggggagaagcaggaggagucaaauauuuugagggaccucaagaagucacaaaccauucguuauuauucaauuacgcuucaaccacaagucauguucaaauccuggacagaugggaccuguccagcagucucaagcagcuaggugcuaucuaacuccaagucugcauccuacacuccuccauuccucucccacaggcaggccacauggcugcauuugaccaaugcauacaugaccacagaucccaacacagagacagacccauaaaaauccaagagagcuucuuguaaaauuguaaguucuugggauccugguucucgaaggcaccccugaccccacugauucuacauuuauggggauguucuuccauggacagucuaaacugacacaacuuaaacccugauggggcaggaaaaaaaaugauuacauuugaguagaggcagaaagccagcuccuucguaagcaaaacaucccuaauguuuuccugaaggugacaucuuguggugaccuuuugguccuuguuugugaccgcacucucugucaguggacaguggguugauccauugggaacuguccccccucccucauuaaugaucacaggauagcagaugaacuguacugguuuuaaauuagagccgugcucaccgugccucccuacgagcagaagccuauuauuuuuaauuauggcuugcaaagcaaagugagcucuugcccccuuuauaacaucucggacaauauucugucaguugcaaugacuugguaccgcaucagcagacacacccccuagcuacagccucaaccauuacuccugaagagaccggaaaugaucaaugcugcucacagagacuugcauuuugaaacaggcugguaggaaacaugccucccaccuuaggccauaucuuguuguaaaucagaauagauaugacauuuagagaaguguuuucuggaugaacuaauaaacacaucagcauagggacaugugagacuguguguguguguguguguguguguguguguuuaaauaucucaacaguguuguuaacccaucccacuccuuaaaagcacccugagcaaagacuacaggaaagaucuggcaccagucucucuugagccuuccacuugaugggccauaaucaagaguuguugguuucuuuuggacagaagguucuagaaagcucucggugucaaauuauauugggcuuugagaagucaaagggucggauggauuuggucuugcguguuggggaguauggcaucuccuucucugugccgaaguggcgucuggcaugauaguuugaaacacgucuuuauuucccaagccuuuuccuuucugagguguaaaaagucacaccagcuuuacaagcagaguuuauggacuuguuuuuccacagcugucgcacaucauacuucagcaguccugggcuuggagucaagcccuuggucccuccaauguccaaguggagaaaggccccgcuaaucuccagauagccaaaauggcaucgccuugucacucguuucuuaaaaaaauaaucgcuuuucuuucuucucugcuuuucagcaacagggagcugcuaccacugucuacugugcagucgccccagagcuggagggccucggagggauguauuucaacaacugcugccguugccugccauccgaggaggcucagagugaagagacagcucgggcccugugggaacucagugagaggcucauccaggaccgacuggguaguccauccagcuaauuggaaccccauaauauugggcaaaaccccacccaugcucugacccucaucacagucagccccaucauccugggugcccugaacuccaguacagggcaaugagaguagauaagaacaaucaaugggagaagguuauaacuagugggaagcagggaauuucaagagaugaugucccuuuucuaggacuggguuagucgugggacugcuugcuuuucugguguuggcccgcuugaaaauggaaucaugguuagcauguagguucccuugcucauuguaaaagcacacgugauuuucuaucaaccuuagaauaaccugauauccccucgacccacccagcugccaccacugccaacuuugccacccaagguuggcuuucuccuguuaauggaagaaaaaaaaaaccacacacauuguucacuucuucaggcugaguucaauccuggaggccauguuucacacuucccuaccaagucugagcaggcguggcaacuugagagaaaaacucaguaccuagucccaagagaaccaaugcgacggugccaucagagaggagcagugucgguguggugugcagagcuggugguucccagaagcaccauucccugaccuccuugccaaaguuaacacaagcaauucuuuagagauuauaacgagugcauuuuacauuuugcaaaccauucccuaggcaggcaaggaaggaggcacgguguccuuaagauacaugggauaugcuggaggugggaagcaaggaaguaguucccuccagucuucacucacaguuccaagaacaucuucuuuagcgacugucccagccucuaaguccucuggaguucacuuccccuggcucccccauccuaugcuuaauaaaagaacaugcuuaac

SEQ ID NO: 12428 - RNA, 913014 nt, Mus musculus
guuaagcauguucuuuuauuaagcauaggaugggggagccaggggaagugaacuccagaggacuuagaggcugggacagucgcuaaagaagauguucuuggaacugugagugaagacuggagggaacuacuuccuugcuucccaccuccagcauaucccauguaucuuaaggacaccgugccuccuuccuugccugccuagggaaugguuugcaaaauguaaaaugcacucguuauaaucucuaaagaauugcuuguguuaacuuuggcaaggaggucagggaauggugcuucugggaaccaccagcucugcacaccacaccgacacugcuccucucugauggcaccgucgcauugguucucuugggacuagguacugaguuuuucucucaaguugccacgccugcucagacuugguagggaagugugaaacauggccuccaggauugaacucagccugaagaagugaacaaugugugugguuuuuuuuuucuuccauuaacaggagaaagccaaccuuggguggcaaaguuggcagugguggcagcugggugggucgaggggauaucagguuauucuaagguugauagaaaaucacgugugcuuuuacaaugagcaagggaaccuacaugcuaaccaugauuccauuuucaagcgggccaacaccagaaaagcaagcagucccacgacuaacccaguccuagaaaagggacaucaucucuugaaauucccugcuucccacuaguuauaaccuucucccauugauuguucuuaucuacucucauugcccuguacuggaguucagggcacccaggaugauggggcugacugugaugagggucagagcaugggugggguuuugcccaauauuaugggguuccaauuagcuggauggacuacccagucgguccuggaugagccucucacugaguucccacagggcccgagcugucucuucacucugagccuccucggauggcaggcaacggcagcaguuguugaaauacaucccuccgaggcccuccagcucuggggcgacugcacaguagacagugguagcagcucccuguugcugaaaagcagagaagaaagaaaagcgauuauuuuuuuaagaaacgagugacaaggcgaugccauuuuggcuaucuggagauuagcggggccuuucuccacuuggacauuggagggaccaagggcuugacuccaagcccaggacugcugaaguaugaugugcgacagcuguggaaaaacaaguccauaaacucugcuuguaaagcuggugugacuuuuuacaccucagaaaggaaaaggcuugggaaauaaagacguguuucaaacuaucaugccagacgccacuucggcacagagaaggagaugccauacuccccaacacgcaagaccaaauccauccgacccuuugacuucucaaagcccaauauaauuugacaccgagagcuuucuagaaccuucuguccaaaagaaaccaacaacucuugauuauggcccaucaaguggaaggcucaagagagacuggugccagaucuuuccuguagucuuugcucagggugcuuuuaaggagugggauggguuaacaacacuguugagauauuuaaacacacacacacacacacacacacacacacagucucacaugucccuaugcugauguguuuauuaguucauccagaaaacacuucucuaaaugucauaucuauucugauuuacaacaagauauggccuaaggugggaggcauguuuccuaccagccuguuucaaaaugcaagucucugugagcagcauugaucauuuccggucucuucaggaguaaugguugaggcuguagcuagggggugugucugcugaugcgguaccaagucauugcaacugacagaauauuguccgagauguuauaaagggggcaagagcucacuuugcuuugcaagccauaauuaaaaauaauaggcuucugcucguagggaggcacggugagcacggcucuaauuuaaaaccaguacaguucaucugcuauccugugaucauuaaugagggaggggggacaguucccaauggaucaacccacuguccacugacagagagugcggucacaaacaaggaccaaaaggucaccacaagaugucaccuucaggaaaacauuagggauguuuugcuuacgaaggagcuggcuuucugccucuacucaaauguaaucauuuuuuuuccugccccaucaggguuuaaguugugucaguuuagacuguccauggaagaacauccccauaaauguagaaucaguggggucaggggugccuucgagaaccaggaucccaagaacuuacaauuuuacaagaagcucucuuggauuuuuaugggucugucucuguguugggaucuguggucauguaugcauuggucaaaugcagccauguggccugccugugggagaggaauggaggaguguaggaugcagacuuggaguuagauagcaccuagcugcuugagacugcuggacaggucccaucuguccaggauuugaacaugacuugugguugaagcguaauugaauaauaacgaaugguuugugacuucuugaggucccucaaaauauuugacuccuccugcuucucccccaaccccaccacccaaaacagugacugcuuuggauucagugauuucuuucucaauugguuucccuuuugucaguuguuuuuccucaucaccauuagcugagcaccagguguguuuaucuaaaauaccugucagacagugaugggguuccucugcauucuguaaggaggaggugggcagccagagggccucugauagcuaaguagaacacagagaucaucucucagguaacccaagccacacaguaguuuguccucagcucucugcagggucuaggugaagauggaauucuggauaaacuuugggcugucucucuuggauuuucauuuuuauuuuguagcugacaaggaaagccaagagugaccaggcaacuugccacagaugucuaugugguggcugagagaauccaaucagcucaccuccaaauccaucccuucuccuccuuuuuucuccuccucuuccuccccuccucuuccccuccuccucuuccucaucuuccuucucucuuccuucucuucucccuccuccucuucuuccucuucuucccacuccucuuccuucuccucuuccuccuucucuuacucuucccccuccuggaaccauagaugauucucaugucagacaaugguucuaaucucacagcaggcuggccucccacagccuugcuaacccugagacaagaccaagggaggccacucaggaaagugaaaaccagagaucuuccaauccuauuguggcacauugucacugugaccuucuaaacaugauguggucugugugcuugcauuguggaaauggugcuuuugugaagaaauucuaacccccccccaauccagaaucaagcuaauuugugggucacgaggagauguacucuccuuuguugggaucggcaagugacugcaguugggcugguuucguggaaauguacauuugguaccuaugcuucagcaauuuuaaaagcccagcguuccacgcaugcgcacuucaauucugugcuaucagucuuaggguguuuacaacccaaauucuacugccagugccacgagcuuuauaaaagaacacaggacaggguacuuugcugccccaaagaccaauugugugcuuuuggcaaaggguccaugcccuugccaugcacauggccacuggcucuugcuuuaucuucuuuucagacacacaauuaugugcugacaaguaucucguuggucccaugcccacuaccuccaugugcuuuuuggagaauuuucuuuucaaauguuccaauggcaaccuucgagugacaucguuaugccauccgauguggcaacaguuuaauaacaaguucccacuugggacucaccagcucuucgagagucuggauaccaucagccugagacagaaccacauuagugaggucucauuagcaaacaagcuuugccgcuaacagaagauaaaacauuuuuaaacacauaagaaaggguuugggggguuugggcuccccccucugccccgaacacuucaaucacuaucaaaugacuuucacgccacuuugaggggcauccauacauaauucagagaagaugaaagugacacauaaaggaauuaauguuaacaacgcugguguaauauuugaagguacgacuugccguuugucaacauugcuuuacugauccauggugauaaaauaauaacccguugacauaugaaugcuggcgggagcuguggguucucccacaauuugugugugugugugagugugugugugugugugugugugugugugugugcuugagcgugugugccugucuuucugucugucugucugucuccuccagaacaauuucuucagguugugcccagucacugcccagaagcuggggaaguagcacgugcaacccacagcaaugucacuggguuaaagcacugauggccuaggacugagcguuuguaggaagccuaguagaauuuuuauucauaccccaauggcaucuagguuccagucaaacauuuucgaguagccagaguucgacugugccaucaguugucacuaugcuuguaaaacuguccaggguucuuguuuggguguuaagcugagaacacuuugcuaacagagguuuaucggucucugccggaaaucauuuuucaggugugcaauccugucuuccaccucagaaaccuggaacacaaauaggggcggccuuugguuacugagacucugagauuuaaaggggccacccuuccaaaaguccuuugcugggaugaaacuguuaagucgcugccuuccaucaacauuuaucugguaauggcuggccaucaauuuguagcugucagcacaggauacaaauggauauggaguccuucgaagaaaaagguguggagguuucugauaaacaaaacauguuuuuuuaaaaaacaacaaccagcacauauugauaucugugaugcguuacuuagugcuuugauagaauguccauguucugauaagaacacgugucacacaauuaacuuagcguucaggugacucugcuuuaauaugcaugcucauuuaaaaggaagaguagacccuuucuugaaggagguguaacaaugcauuuuaaaagaugccccgcugucauggcauaucuauauucaaagacuugaaagaguggaagauguuugaagauugcuuuauuacagacacauccacaccaggccaucacagagcaaaugcugaauuaaucaauuuaugcaaaaaaaaaaauagauucaggaaagggaacacaccgugcaagcuagauuaggcuuggagccucaagggcagggaaggcaggcagcucuugagaagugggccgugacuacagagguggauuggaacugcugagcugcaaugagaagguuaggcaaagaggaaagacaggugcaucuucagacccucggggcuuucauugagacucaucugggguuuuggaggcauagaauauacuuuccaaaugugaaacccacggcccaaugaauagaucaugcugagugaaaugauuggucuguuagaaagcuguaguagugacaagcaucuuacuacccuccccccacccccaaacacucaugcaagagaacuuauaagacuucuaucugaaauauacaacgcuggauucuggaguucaucuccaaaggucuuggugcuugggacauaacuguucccacaauuaauaauuucaaucuccgguuuacagggcaaaaaccaagcuguuccaagggggugcugugucccuacuuaacuauccaagaacaaaauugucaguggacaaauugaccuccuauuccagaauguuccacugguucauaaagcggaguagucagugcaggaaggaagcucacacaccucucugaugagugaccucaaugacagaguaucaccacggcuaccuauacaaccagaagugcuuacgaauaagcagcuagguuccaccacaaugaaagagaacaaagagcuccagccacuugugaccauuccaauagcuacgaugacuagcauucauugagaggugaccaucugcuagcaccuagcaucagcaucaccuucuaauccucacaauguccucacgccagggacagcuagcuuccucauuuuuauagacccacauagauucggagaucgaacggacccuguccaaagacacagugacagucgcagacugacagacgcagaauccaugagucaguguaggaaaccgccuucccaaacacgugacacacauuggucacuuccucccagacaccucccauucaacucaagcuuccuugugcuauuuugucacuaaucagagccuagaugcccugaucuggccuaaauuaaauauaugagcugucuguauguucaccugaaaaauguucaaaggagauuuuuccacuguugauuuagucagugaacuaaauugaaauuauauccauuuggauuaacaccaaaaagugaagacucagcacacagcccaccaauucaaucgcaaaugacccuuuacuaaaaagaaaaaaaaagauaaagaaagauagacagaaagacagacagacagaaagaaagagagaaagaaagugaaaauuaccugacccaaaauggcacugccaggcauaagaucugccaacuuaaagaauauacccuuuggugauagauaucuucuaagaaugaacaucaaaaccaguggaauacgugguugcuuacaugcccucuguguucugcccaucucccaacaacacucugauaggaaagcuugccugugcuccaccagaaagguacaggacuuucaguuugcuuccaaagccagcccuguuuuugaaaacucccauacaaacauagccuuccauagaggcaggcucugacaauccauuagacuugcaaaccaacccaucccucuccuugcagcccuccacacaccccccccccccaauaaaucccuagcaaauuaacuccuacaaauucccaacaguugauuccuccaugggccuugaauaauacaggcucagcucagaugcaugcaaauauuuuauguagacacggagauguaaacaucuuccuagcccucgggaguucugguaaugcacagguuguucuuaagccuuccuuacaaaaagccuucauugccggggggggggggggagagcaaagcucuguagacuggauauuuguuuacaagguauaccagugugagagaauguuccagaaaagccauacuaccccuucacucugcagaagagaaugugcucaccugacagugacuuugacagugaguuucagaacuuacucguuaccacaaauccuuuugcuacacauggggucucggguguggaagagcuccgguucuuuuuguccuggugacucucgaaugaagguacggagugcauucucgggugugcggacauagcuguagaguucaucagugccagggaucccaggguggggcacacauugaaagacgccaacccaucaggccagccacagauaacacccaaauugcaaagccccucuugaguaacauggaggggcagaaagaaugacauuuaacugucccguggcagccaaguacucagagagagucucugagaugaccccagacauuuccuguugcauuugaaggaauccaaguaaaacaccaccaaauguaagucagaucucugccaggagacaguuuucuagaaagguccccgaggaguuugagccccuggcuugaaaaccaggauagaaugaauacaaaaguccauggcaguguugcuuuuucuaugagagaaagucuggaaccacuggauuguagguggaaagcgggauggaauucuuucuagaacagaagaauagagcugccaucccgagccuuaagccuaggaagcgacuagagagccaaucacagccauucugaggcauccaaauguuuggucucagaacaugaggccaggcaagguuuuaauuuaacugggguuggagagcagagcaacccaaccucuguaagcucucagggcucugucugcacaucaaggauuguucuagacuuucucucaaaauaaauaagguaccuuuccuauuuuccucauuugccauagacaacccacgaguucugugacagaauucugugugcaauaugauaauuaggaucauuucacaucgcgggacccuacaauuuuguggggagagagguggaaguacccccaaugagaagagggaaaaggcaugacucacauguacucucuuagauugucucucgaagcacauuuacuccacauucuguuugugccgccccccccccccaucaagagccccccaucgcucuugagcaauucucacuagauggaagggaaggucugguggauuaggccuuacauauucaggaaagaugucccugggcauuccccauugaguugcccacaauguguacauugcucaacacagcuugccauuuaguucuuuuacagauggagauuucucuugugggauggaacuccgaucuggguaucccuucuuucaugaguuacuuugauauggcccaaaagaagagccauagacauuugccacugaaauaagcaucuugugaauagcuuaauucuucuacauugggccuaccauugucauuuucuaacugguccaccucaaugccagagcugaaggacuuacgaagagauaaaggacuuacauaagagauaaaagaagauauuuggcagguauuaauuugaaacaucuuacauuucacuucuuuaaccuguuguagcuacuuauauguauauauaauuuauaaauacuguauauacauguaugccucuguauucaccauguauacugaauaauuuaaaaaugauugucagacagaaucaauggcuuugguucuaauauaauggggggaaaaagaugucuccuuaguauaagugaaacacauagggggaccuuugcugcauagaaaagcuucaauuaguuugccugucccuuuaucucuucaauuauauaaaacuauguggagagcaggcaggauuucagggcacaccucgaacaagcuguuuagacuguuaacaggauucagaauguauauagcuaugucacugguaaauucuacaaauaagaaauaaaaauaccauggcgguggguggaaaaugcagaguuccuaauaugacauaucaggguaagaaaugaacuguugauccgucaucccagcuugaacuacgaaagcacaccuugccauaauucagcucucaugggcagccccccuacccccacccccauggccagcccugccaugucaaauaggguacauucucacuuagcuguguguguuuucuuugagaacuccucggaacacaucauuucucuggcuugaagaugucagccuugcugauauuucauuuagaagagagcaucucguuuguuauuacuuccauaauuaauggugaucgcucaggcacugccuuuacacagaaagagcgcuucucuguggucuaggggcuaaugagaaacaauagauauuucauucaccagcagcuuguugcuaguuagugggaaaugaucgcgugugcuguugcuuuaauugccagaguaaauaauucugccuggguguuaugagcauuuuaaagcacuugaugcaaauauacuagaaacaaaacaaacaaaaaaauuuuuaaaaauugcauucuaucuugcaaauauuaucuaaauaugcaugugcuaacuacucagcuacuguauuuuaggaaauacaauuaagcugccuuucucuuccccuauguagacuguaaauaacuguagaucuuucucuuguuuccuuauguaaauauauguaaauacugacauacuaugcauguugauauucuaggcgauuucagguacuuuuauaaucuaaaggcauggacuugagcugguuuguuaaaaggggggaaagggaaaagcucucucaaacucuuuaacgcugaauagaaauuaaagauucuuccuagacugguguggugucuuuuguuugcuuuauccaaagugaaugcacuccuaaccuggcuucuucuuuuacagaaaggaacugcugagcacauaaacacacacacacccccaaaugauaccugaguuauuuagaauacauuucauacacuuuucuuggguguauaagaacaauucuagagucauagguaggcuucuuugauugucuucauuuagcaacaaacaaacauaauccuuuuuguuuacuucuuagaugccaaguccggucuuaaaauccucuaagaggguccuguucuaccauuucaaagauguagagccugagucacauuaagacuggcuacuuauuugaaaggacaaaaaugauuccaccaaaacucugauuuguuuaucuugcauacagaagaucuacgaacucauucugaaaagccuguaaauaauauaguuucccuguagucucuguugcaaaagaucaaguugaacacuguuucugcaaaagagucaugagcaauaugcacagaagugaacauaccugugugucaauaaaacuuuauuuauacaaucagucaaugggccagauuuggccuacaggcaaaaauuugccaauuucugcuccacacguuaucaaaacucaguuccuccucaguagaacaauaagaguucuuucugaguauguguguaucuguauugaaugaucuggggaaauacuuugaucaacugaaaacccucuaaucugguuccuggaaguaccaacagucuuggaggaagucacagaauaaugagaugagcagaaaugaaaucccuugaguuuauaaaucaagcuaucugucucagacaaaugacacugccagguuucaauuuaguuaucuuuuauuuuuauaaauggggauggaguaggaaaguuaagaaagacaaagcaggaagaggaaggaaaaaaaaaaagaaaagaaagaaacugaacaacucuuccgcuuuaacgagaggaaagaggccauuacuccagguaucuauggaaaccaagcagccugcucacuuuaaugguuggcaaacagcauuaguguuugaagauguuuugcccaaguaugaugcuacgguguaaaugcauuaauugacaguuuccuucgggacuucuuuuauugaaguuuucaaaccuaauuugauggcacagggagcucugaagcccuugaagaaggcuguaauguuaggucuuuggaacgcagagccagcauggguauaguguacacauggagucgacucucccugcugucucacagcacaagugcagacacagccuucuucgcugccugagcuuuuccacggcaaagaccuugagcauuccccuuggguguggagaggcccuuucuaaccucuccuaagugggaaucuauaggaacucuccuguccugggagggacuggaggaggagaggagaucaggugucuacuaggaguauguagcuguaugaaacuaaaguuagaaagaguacagcuucuggcagccaugugacaaacccccauacguuggacugccucuaugaaggauauaaugcaauaugccuuugacaggaucuugugaugacgcuggucuucuccuggguuagagagcagacacaaguucauagguagcuaccguccuguuuauucuggguugaaagaaggaaacaagcagaucaaagugucuuugucuguucuucauuuaagagacuuaacagauggggaaaacacuucuaccaagcagcagucacccuucuccccaaccuccuucagcaucccugggcaucucgcuggcuaugaaccccccugauaggcaccuugcugugggacuaaggcagcucauagucaagccagcauuuguacaacuacuaagcacuguaaaacgcaaggucaucccugcaccagccuuaacaaacaugcucuacaucugcaaauaucucccuugcaagacagucagagagagagagagagagagagaugcacacugaugguggcaccacugagugaguaccaaaaugguuaugugcaguaaaagccuggaguccaccagggcuagagagagagauggcucaagagcacuuccugcuguaucagaggaccacagcucaguucccaucaccccauuaaguaccucacagaugcccccauguucagcucuaagaagucugaagcuuucucccggcccaugugcaagcacacacaguaaauacuuauuaaguguguuuauguuuuaguagaugaugguugcugcaguauucuuuuggggcuagcuuuuuuugaaacaugugugucuacaugcuguacaugugaaugcauucacauguauaugcuuacauacacauacauguuuguguucauguacaugcauguguguuuguguguauguacauauuucuauguguuugguccaugugcaugugguggcccaaagauaaugacugacugcugccuuucucaaucacccuuuccuuugcuuacuauggcuccguuuuuuguuuuuuuuuuuuuuccggguagucuaacuaguuacccaguccugaagauuuccagucucugccucccaaguucuaggauuaaggguagcucccacgcuuaugagcuuucacguaggcucuaggaauccaaauuccacuauuuguacuuuguguggcaagugacaccacugaagcgucuccccagucccccacaugacccccaguguucucauaaauguccucucugaacauuuuaaagauaaaauuggaaagguacauguauccauccaagugaaaaacugggguaucucagauugagcauggggaccccaauagaggaauucagggaaggacugaaggagcugaagggguuuguaaaccccauaggaagaacaacaauaucaaccaaccagacuccccagagcucccagggacuaaacuaccaaccaaagaauacacauggaggaacccauggcuauagcuacauauguagcagaggauggccuuaccugggguaaaugggaggggaggccugugguccuguggaggcucaaugccccagcauaggagaaugccagggcagugaggugggaguggguaggugggugagggaacauccucauagaagcagaguagauuggauaggggguuuucagaggggaaggaggauaacauuugaaauguaaauaaauaaaauaaccaauaaaaauuuuuuaaaaagaaaagaaaaaauggagguaugagauggcauuggcuggcuugcuguccaccacaaaugcagaugggcauuucccuugugaaaagccugaaccauucuccaauguucuuucuagaagcuucuaugugccccucuaacaggacuucucuguccacuucacucugcuccucuuauucuccccauuaaacacuugcuuuaaaacacacacacacacacacacacacaaaccaaaggguuggagaaauggcucagugguuaaaucaugggguacucacacacaggaaccgaguucaguucccagcaugcccauggcuacuaacaaccauccgugacuccaguuccaaaggauccgaugcccacuccuuuccuuuacaggcacuauauacacaguaugcacagacauguaugcaggggaaauacccauaggcacacacacacacacacacacacacacacacaaaacccaaauaaacauuuuuuuuaaaaagaaaggagaacauaaacuugaauuuucuaauaguauuccuucuaggcuucagaaaaaaaucucaggguuccucaguucagaguccagagagcaauaagcagaucacaaguuaccugcugugcgacaaucaaugugcauuuguaucagccucacugguagcugcugaauuugacuuugggccuuaaaucgcugagagccgaugcucgugagugcuuuguggaugccugggauuugaacccagaacuugcucugguggagagguuggcaggcugaaugggaauuaaguguagagacauaaguuccuuggccaagugcgucagaauacagccugacacauugccugcuugggccauugaucccagugguuguuguuuccucucuaugcagagccucucuaugaggguccuccuuucccaccucugaacuucguuacuagguucucccuacucgacacaaccaaaggugccauuccugaccgcaaucgaggaacgaccugaacugucccaggcaaacuucaugggauucugcuggcuggcaaggcauggguuaauggcucaguaugugcaggucaccuggcacauccacccgggagcuccacuugaagcucucuugcccucacagaguagagaaaugcugaacucacgaaaaugggguacaccaaggaacaccuuacucugcguuuccccaccucuggcugcugcaccugauaggauucagcuucucacaaaugccuggcuugucaaaaggaaggcacacaaacacagccggugaccaagcacagagucagcaagaaugcaagcuggcugcgcgguggguccucagaguguccaggugguagaaagucuggccucgcaggcagugccuugacauucagaaucagguggccuuuacaggacaggcccuuuaagacguagauccuacauaggggccuggaugcucucuauggcacuuuggagaugcccagaggcagagguucuacugaauucuugcaagagcgcuguagaguguuauuaacgaauuuuguuaauagaaaaacaagcaagucauaaugccacuccauugagucaggcacugugggaaaaugcuaaauguaaacugauauuuacugauaaaaacugcugagguuagacauugauucagugugguccccacaaccuaaagcggcuuccauucagguacuuccuagcccaaggcaaccacaguuucaaacauguuuuguuuguuuguuuuuuuuuaucaguaacaaauccuaaacaggguucuagaaacuucaccucaacgccucauuagacacagcaacgacucggcggggguagcaacguucuguuuuaaagaugaggaaaccgacggucaggugagccguagcucuugauauaauggaccaggauucaaaucacacaagucugaccccagaacuaacaaugcccuggcucaccaguggacuagaccaccaggcaguuuauuucuacagguagaaucuuuacauucuuacagauaaauauuccaacccguccuaaauaaaauaaaauaaaauaaaauaacacucuuguucaggggacaagccuagaacccugcaaagcaaagagaaggguucagaauaaagacagaaaagugcguggguguaaccagagcccaaguaugcagcauaucagggcagagagagauuggguguaauguugagaugggaaauccuggcagagugaguuauuuuucagguagcccuagaacggguuuaaaugggcucagaacucacuccuuugcccggcagcacaaaucaacugggcagaucccuuuggcacauaggagcuuccaacacacagcuaagugacaugcucuuaagcugaagggccuggggucagagacccagagaaaaaccagauguuucuucauacugcaucucugauacuucaucuaaggugacaaaccaugaagcagccuuugguuuggguacuucccgaacugaagacacaagcagauuccuacacaggagacugcaugagaagcgucugucccuaggacuuggugauaucauagccccuucagaaacaauacuuaaacaggaguuccuuagaucucagugggagccucuaucucaggaaacaaggagggugacuucugagagaugacaucuaaggaugaccgucagcuucuacaaggauggacacauguuugcaugaguaucuccccagcaaauauaaauacacaugaauacacacagacacacagacacacacacacacacacacacacacacacacacacacacacacacacacuggaaaccaaugacauggaaaagagaaaagcaauagucuuuuucuacuugauugacacuccaagcacacuagaaucuagagugugaaauuguugcagcugcugauuuucacucucgauuuucucaugagucucaaacucucucauggcuggcuccuucagagaacauauguucccauguccacccaccuguguagcuuucccugucacuuucuuccuuccugagccuguuccaugcauggacuccaggcauggcuuuagagcaguggaugcugugagauucugcugaaauguccaucuugcaucaaggugauuucuaggccacaaggguauuuucuuuugaaggaugaguccucuucagggauuuugcuuaacccaggugagcuaccuugcccuaucuagauccuuuccaggaggcagccuccaucaacgauacucuugucuccuuaucccacuugagagcauccguuucaugguuugguaccuuagaugaaagccaucuuggcuucagagucugcucaggacugugggaaacacuugguacucuggcaucacagcucaguccucccacugacccuuccaugugccacauucccucacagguaugcauuccugaccauguuccuagcacccugccaagugcccgucuuugucagcuuagaauacccaaccucucauucaaccuucgaccagcagggugauugggaaaccaccugaaacacacuuugccugcuuguucucaugagaucaugacacucaacccauuugauucauuuuaaagauggaaucagacggugcacagaauauacuccuguggugcuagcucacagucuacacucaacagauaaugaccagcuguggugauagcagagcaucuauccuccucccgugguacccauacucaucgccccccccccaauaacaggaagcacaacugguuucuggucaagcauaguggauucaauucaaacauuggugccugucucggaaacuaaaagucuaauacaugugggaaacguuuacuuggugaucaagaaaccuuugggaguuggaaaaguagcaacucccugagucagcagagugggaccucuagcagaggaagggacagaaauaagccacuguacgugauagagcuuggucauggaaggagcuggcagagcuaugcgcgguaugguaaggacugaaggaacgccucugugacuucacaugaugucacagaaagaggacauccucccucaggacagcccacccaucaucauucccucgucugcgaacuuacgauacaaacugcucuugacccccagugcccaucaaucugaggcugguuagugugugcuaucaggguucaacuucacgaagaaggggcccagcaccccacccaauuugagguacccaguaguuacucaucaaauaguucuagcagaagaguugaguaagugguacuuuuaaaaaacagaucuaagauuaaaaaaaaaaaacauaaacaauguaagagccugacuauuuuguucuugaauuacuguugaugugguuugggcaacauucuucccuauaaguugugacucacauaaagcuuucucuuauacaaggcuggcuaugaggcagucagcagacuagaggaacacauguacacucucccuguccuacucccuugugguccugguggaaaagauuugcuguuuucuucccagguuacagaaaacugagagaggaaacuacuugcucaagucuacacaacuccuaaguaucaggucugguuugaacucaugccuugucucugaaguuauguuacacaacagagauggaacuuagagcaugccucuucaggucucugggccuuccuuuuaucguuggacuucauuuccagguacagauuucuacaaggcuccuagccuacaggguuugcauuugccugcagaguggguuugagauggagggaaaaugggaucaggacuguuuccuagaacucugccuguaggcagagaaagagauggaguccaacuacagggaaguacagucucaucaggucuugguauuuuguugccucuuuuuacuaacauauuaaugccaccucaauaaccaugagaugaaugaaugaaugagcagguagauguuguugaauggaugaacaaauggggaacugaaaaguuggauggauggauggauagauggauggauggauggauggauagauggacagguagauggauggauagaugauggauggauggacagguggauggauggauuggcagguagauggauaaauggauggauagauggauggauaggcagcuggauagaugaauggauggauggauggauggauggauggauggauggauguauggaugaauagaugaauuaagaacugaacaaauaacuaaaugacuguuuggaaguacugcuuguuauuuuacaccaaaagggaggcaugcuguggacaugacucacuaguggucacucagacuuuaaaaauacccacauuccuugugagagcuggcaggagcaguuucucucccuggagcacagcccucugccuaccuaauacagugugagguguuaacuacauuaucuggaaauaccccuaugacuaauucccaucccuuauccggaggagaagaaaauugucuguagugcgaaugccccagauuccuggucaguuuauguaaggcguuucaagccauugcaguauuuaaagccauuuuuagcuucaaucacuugauguguggugagccaagaauaccugaucucuuacuccuuaaaacucccuguuuuuuccacuaauuuuguuuaaagugguuguggcacuaaguacuucuccacugaagagaagguuuauaaacaugcaucccaacauuaugccgucuuuuaaauaggugcuuauucagugaauucuccuguuacaucgccugggcuccuuuagcucugauacuuugggcugaucccagcccugccagguggugggugggugauauuuauuuuuugucauggccuauuuggugguuuuuguacacugaaaacuuuucugcucgucccaaacaggauuagauggaagcuuuucccaagugaugucuacagcaauugaauaagguuugagcucugacuaaccaaaaguuagaagacuacgggggaggggugcuuuuauuaaguagggaaagauaaagguccuuucuuuaugcgguguagcuacuuugaaacacaugaaaugcucagaaaagcaaaaucucagggcaucagauauuuucucagaaccuaaaccccgauuucacuugcacucuucuugccuuuacccuccaagaaauagaaauccuacuuugaccaccuuucgcagaaucuuauuguucauuuguuggucuuuaaauauauggacaaacaaauucagcugcauuucaauacgugcagguaccuccagugggcuaaugauuccuacaaguccucggauuucuuugugaacucguugacaguaaauagcaggguguguugguuuaagaaauaaacccauuugcuguagugccagaguagcuacagccguguucuaauaaaacucccaacacaagccuagccaggcaacaugauuuggcccauggacugcaguucacagaccauugcucuauaaaacucaacaaauuaauuaucagaguguaucuucuaaacgacuucccuuccuugacaaaacagacuugauguuuuauugaaucuuuauuccaguuucauccaaguugaaaauaucauaauauuuuguuguuguuauugcugcugcugcuguugcugcaaugggaucugaaccuagagcuuugcguauauauauuaggcaagaaugcuaccucuaaguuacacuccuagcacuaagaauuccuuuucaaagccaucucaugcauccccgaugcccacaaacuuacuaugaccuugagcuucugauccuucuaccccacuuuccaagugccugugccaccaugugugguuuaugccgugcuggggacuaaacccaggccuuuggcaaguccuuugcuuacuuagcuggaucucugagcccacacagugaagcuuccuaaggcugucugcagaaggaaguucccggugugcugagcauccagagacaucaauaaguccugugugaagucuuuaaacuucacauccaaacgucaggcagaaaucuaugcuuaaugacucuaugacaguuauucuuaguuuuuuuuuuuuaauccaaaaacaauuugcuaugaagacauuuccauggaagauaaaacagggacucguuugaugcucccagguagauggacaucuucaucucccuugaaucagauaccuuucucaucguugagacagagcuuggacagaagcagcuuaagauauaucugggcucacuguuuuggaggguaugguccaucgugaugugcaaggcaagacagcugcaguggcucugccugugggcguagguggcuacuguauuucacguccaucauggcuaaagagcuuaaacuggagccacggcuggacuauaccuucacaggcucacccacagugacccaccucaggcagccaucuaggcucuauauucugcagcuucuguaacuuucucaaacaguuuaguaccaaguguuuaaacacagggacucaaacauuugauacccucugucccugaauguauaaggaguuaaaucaccaaaaggaaacaaaacaaaacaaaacaacaacaacaacaacaaaacagacaccuugcuuagcucaauuucaagauggagaacaacugcccuaaccuuugugggaaggaggcaacgauuuuaugcuccgaagacuucaaugcaaacaagcaaaucagggagauaggauggaagacucacucucuccugcucuuuguguccacuggucgacagcucucagaaaaagagaaucccgggccccuuugauuggaagaggaacugcuccgaauaaauauucuuugagaaauaugcuaugcagucuguucacccaggucuucucgaagccaacauaccacgcuggcuagaaauuucccccaaggagcuggggaaaagcacuugcaacccagguucaaaucccaaaauaaaucaaggaaaagccagccucaauaaugugagcaucuguaacuucaacccucuuaagacuggguggguaucugagacagaagcauucccaggagcucucaugcucgcuacauggugggaaaacagcaucaggagcccacgucacagcaagguagaaaaugacgacucacaacagagcuuauccucugaccuccacacccacucuggggcacguguguaccugcccuuauacacauagcugugugcacaugugcacacacacacacgcgcgcgcacacacacacaaagacagagccuugagcccagcugccaccaaugucucucuguuuaugcaguuuucuucuccauauaguaacuuuuuuuucacugucaccagcaaguaucuguuaacuuuuccacacagacuuugaagauguuccacuaugugucacaauauggaucugaaugcaacaaagacuauaauuauugagcauuugugagaagcaauauuuucccuccggugcguguuagcucagcucuucaugagcagcgugggcacugaugcuaaggaugcugccugcaccccucagugccuucuccaugauagaaauggagaagcgagagaggugagcgcucugagccacugauagaggacaacccacaaugcucuccauccgcgacccauggagaucgaugagaguuuggcaggggauuuggaaauaaaaguggugaucugcuggcauggguuaaacauucugccuccgugcaaagagauuugaaaggcucaacccagcacacgagacugugcauccuagagaucccgcucggcaacagauggcuugcaagggcugaauugcuguauaaacauuuaacugaaaguuugaucuccuaaguguggaaaauuaagcaaaacaaaaggaaaaugauucucagaggcgcuucaauuagcaauuuguaauuucucugacaaugcacgcugugccccguaaccaugcaaauacccuccaggaaagggauuuuaggaaaucuugaaaagaaauccagaaacuaaaagaagucaugugauugccaaaaaaaaaaaaaaaaaaaaagagggcauaucgcuuagcagcagcagucauaacuucugagcuguguaugaaaccacagaggaggacucacccagcaccugccucccagaccuuuccucuccugcauggaggacaggaggggacucuucgcccagcucugcuuuacguaccuucauccauucuccugucuccagcucgcucucucucccucucccucucccuauuccuccuccuccccuuccucccuuucccccuucucugugugcaucugugguacaugcuaggaagaggauacaggaaagaaggacugcacuuuaccacugucaaucaugggucauccguggaggagaauggagagccacacaagaagugagaggacuguugccugaagaccaucacugcacccagagauaaaguguaauguaaacuucauuaugucugaagccuacaucccacacagagagagcgaucacccugaggcagacucauuuguagagcuuguuguuguuucgguuuguauguuuuguaauauaaaagaaaggaaaagucuuuggggacuagagaagaauuuagugccuacaaguauucaauaaaugcuugugggaucaauguuuggagcacugcucuagccccacuucugaugcugugagaaaacacccugcauaagagcaauuuaggaaagggaaaugguucauucaguuuacaguuccaggccacagaccauuacuuagugaacgucacugaggcaggagcuugugacagcuggucucacucagcacauucacagucaagagcaaaggugacugcacccaugcugucaacuggcuugcuaauuauaugcucagcuagcuuuccuccuaagcaguucaggaccaccugccuagggaauggugccgcucacagugggcugauucuuccuccaucagugaacaaucaagacaaccccugacacauaagcccagaggccagccugcucuagauaaucucucauugaggcccucuucccaggugaaucuagguccugucaaguugucaggaaaagcugaccagcagagaugcuagaaugugauugauggcaauuacaucuuuggaucacuggaggaaguuugauuagcuuucguggaaaugccaugauauucggaaagagaagauuugguuacccuuggagauauagagaguuuuuagaccggcugcuacaugaaaccaugucuaaaacuccuucccaggacccaagcaaaaacaaaacaaaugaaugaagcuauauggugaacacuguuacuaaucaccauaaggaggagggagcaagucccuccuauuuaaggaauugucccagagucaccugaguaagugggguuugaacccaggcaguggaguucagaguaugugaguccaucauuuccacucaaacguaagagacuuugcagaguuccagauucagcucugcacacuuaauauucuugccuucucacugagcaauaugcguuuucuccaacauccucgguuuggagauugcauugugauucuuugacaccuguuagacuucaugcauuuggauuuaggguaaaaaaaaaaaucauauggugcuccugcagucacguguuaaaucacugaaaacauggcccuggggagggaaaauagggcccucaauugaggagugagauuguggaucaucauacuuccugaugguucaauuucccaaucuuuagagaagcuggguggacaagcaagagcaagugccuagcucaacgggucugauuuuccaaaauggcaaccauucugucagaguuagcaagaguacugccaucgccacuugccaugaccaaaagaccugugccuuggggguuggugucauuuggaagcagacauaauugcauuaauauuguagacauaauuacuuaagaugaaaucaccguggaguaggauggauccuugauccucuaacacuguuaucguugaaaguagaggaaacgcacacggaaagaacacuguaugggcagagaggcagaggagcacccagaaccuccgaggaggcaagagaagcugaaaaaggcagaaggauccccaagaaaccucagaccugccagagccuggaccuuggacuccagcacuuuuggggaaucaugaguuucuugcuuuaaacccacccagcuuauaugucuggaguauaauucuuagucuaaguaucuaugggccaaacagcauuauaauuguucucagugagucccaaaccuuuucuuucaaccucagauaggucaguguaguccugaguauauucuagaacacuccucccuugagucacaggcaagacuaugucugggaauauaggucaugugaaggauccagaaagaguuuggauacauacucaagaacauuggguauauuaauaaugcguguaugcacacaggcacacacacacacacacacaaauggggggggggugcagacagacagacagacagaugcagggaaaucuccugucugugugcaucuuaaaauacuuuuuuccccauggcucugaacccuaacaucaguaccugagcaucaauguuuucuucuucacauugcuuucuagaacucagaagaguccuuccucuugcaagggagcgaccaaagcuacccaaccugugagcuaugcacacuuccauccaucuucagcuucauuucuucccugauuccuuccacccauggccuccuucccccaccacgaagaggaaauccaugaaacccccauaacaguaucugccaaauaugcuucauuaucagacagcucacaaaaggcccuguuccagucuugcagccaaccaugaaacaugacaaugugcucgccucugacagggaucagugcagagaggcccccaucuguucuuaccucggugacaaauggauuguggguaguugggauggacuucaggguugucuaacaaauaauaaggacaagaugaauuuuuuugaggaggaaacaaaagggaccucguugggaaauuauggucaaauacacucuaguguaaccuuuuugcaagauacuauaaauaaguagggugggaaggcaaucugcucaccacuaaagcacuaaagcugggugagguugaacguugguuucccagagacauuuccucuccucugauuggauacagggaguuuccugucugacucaguggcgugagcagagcacagugcuguuuaggacuaacucuggacucaaguauucugaaugcaagaaaauaaccaaccaucccuuugauucacagaggggaagggagucaggucucccuuucagccuugcaaacaggucaacaguucacgaaauuacaucuguggcuuuucuugucucuagguuucuaagcacacaaggagaccagaaggagggaguccagucuccaagucaauuauuuuugcguuuccugauucuuauaaacaacauuaauguuagugccagggacaguucuaaccucauaauuuguuaacguuuaaaagaggccucuuacagccaacaauuauccaaaaauaaccauuccuucaugcuuucuugacugauacguuuucaucaccaccaccaaccccccauucugccagagccaacuguaucaucgccaggaucaugggaaaaugggaaugaaauuagcugaggggaguuaucuaucuuggcugucuuuggugccuccuucucuggcugcuaucuuugucucccaagacuccucuucuucugggaaaggugguucaagcccagggucagaugagucaccaagaugccgggagguugagccaagaggagaaaccaucuuguuccccgggagaagcagguacaggcuggcacugugggguugguauuguaauuauaaagccuggucagggaucgauguuaagagcugcaaggacaagagccucuccaauguccucuggucagugcccgaugagaaugguggggguaugaagggugagaaggcugguguucuggauauugcucauaagcaagcauauugguuucuggucucuggccuuauagacuugcuuggaugcuuucuacuuuguuagcgcuucccaucauguggugaauugagaagcuuugauugaauaggugaauggcagauccucugugcaaaaccauuucuuuuggcuccuucugucuagacuccuaaguaauuugugccugccucgaugcauuugagugauucaaaacuaaggcgcgugcggcagcagcguugagaagggcgaguucaccaguauauucagaugaucucucagugacugcuggcaaugguggcuacucugcacuacucucuggagaacccuugacugugccuguguuugccuccuccagagaaagcucuggugaagaagugcccuauagacacagacacagaggugagaaggccuguggaaaugagagauaccacuguacuagugauguaucuuauagcugugaccuaauaauaccugacaaccaacaggaaaaaaaaaaaaaggaagguuuauuuggguuuagagugugaagagacgauuaagaugaggaagacaugggaggugggagcucgaggcagcuggucaaacuguguccaugguccaaaaauacaguaugaacaggaagugggccaggcuuuaaaaccuuaagccucaccaccaagugacccaugucacccaguaaaacuaaaugccaugugagccuuaugcgagauaucucacauuuaaaccaggacagucaccaaagcauggcucugaagucauccuccuggagacauccgaggacauaagagcagcagugagagaaggugauagagucggugggacuugaaggaaggagcaaagacuugaaaggcacagagauauugaucaguauccuggcucugccauuaucuugguuggguuuuaucagcuugacaagaauaucugggaagaggaaucucaacugaagaauugcuucaucagacugaccaguaggaaagccaaugggagcauuuucuugauucaugguuggugcagaagggcucagcccacugugaguggugucauuccuuagcagguaugccugggguguguuaagucugcuuccuuaagcagacugagcaaacucuagggagcaagccaguaagcagcauuccuccagggccucugcauuaguucccgccucuggauuccgucccugacucucuuucuugaugaccuguaacuuauaaaauaaaauaaacccuuuccucucgaaauugugucugguaagaguauuuaucauagcaacagacagcagaccgagacagaaauagguccagcucacaagacaucagaaccuuaauuuacuggggcacccucucaacagcuuucagaucuacaagaggugacuaaaggcugugugccuccauuuccucaucaguaaagugggugcagcaagagaacauuccucagugaacuaugaagugaucuaaaaaaaaaauggcaaaucccaccuaguuauugaucgcacuugcuaugugggcaacauuagcauugcucaguguucacaacuuaacacagccauccagcuaggauuuauggcagauaaguucucagagcaacagaagaagauuaagggagcaguaaauggccccagagauugcagggagcaugcugacuccagagacuuacaaagugaacauguuuucuaacaggaaacaacgugcuuaaugucuuugagcuccgacuucugucuacucaccagaauggucucuaugucauaucugauagcauuuguucgcacggugcccagcaagaggcaucuuccucucuauucuuuacuuucuucuaguuuguccuucuaaagacaaagaacaaagaccaggguuguugugggcacuaccuguaccacaccuuuggccuggcuuugugacacccauuagaagaaaggcaacccaacuuucuggauacccacagguaguguguaaggccagccuggcaccaacagggucuucuucucugggagccugccuuucuucuccaggcugaaggcuuuuagcuuugguuguacccguacccaggccaacaguggagugcucucaaugacuguuagacagaaccaccgcagcagaccagaugagccacaugacccaccuccuggaguguguguaucaaauaagggcccaugugugcugauccauguguaccuaaccaucucugcuugucugcacucaaagcuccuaaccccagccccagccugcucuccugccagccuagagguuuuuguuaaaaguucuucugcccggcugggauuauacuaaacacaagcacaaccaucuaugggcauuuuguacacacacacacacacacacacacacacacacacacacacacacaccacauagugcuuguucuuugcuuaacacacaguaacucagagaccgaaacucauuuaccaucacaacaaaaugaugcgccaggcacuauaauuagcccauauuuagaguaaaauaaagacauaaagagguuaauaacauagccaaggucacaagcucgcaagaagaggggucaggguuugaacccaguccuccuggcuccagaauccuggcuuuuaaacacuuuguuauucuacuuuaaaaccaugaauaacccugcuaaccccauuauaauaggcccugcuaauuacuuucccucccuccucucccuccaaucccagcagagaaccacugcauuaucaccgaggucuuacaagagaagccugugcacaaagaugccauguguuuaagauagacauggaguuagaaacaaaaauaaauuccaauacugaggcggggauucaaggguaacacagggagaucggugugugacacaaacacggaguuuugguuuguuacauguccagcaugaugcuggggucccaaacuccccaugggguguuaggccucccuuuagccagagcuguaccacccugggaaacaaugauucuaagcagaugauuaagaggaagcaugggaaggauccuaagaagcuuuccaugagcccccaagcuggugggauuggguagaugucacccuugagaugaaagaauacccugggaugcccugggaugcccuggaauacccuggaauacccugggauacccugggauacccuggaaugcccugggauacccugggaugcccugggaugcccuggaauacccugggauacccugggaugcccugugguacccugggaugcccugggaugcccugggauacccugggauacccugggaugcccuucgacucuauauaauuuguuuccugcagaaucuacugucugccuggggauggugguagguaggaucccuaaacuguuaguuacuuuucuuacugcugucauuaaaaagaaauauaucucuguaaguuuggagagguagggaucacuuuggccaagagucaucauggcgguggggaguagcgaaauccugaggcaggauucccauccacugucuggaagcagagagaggaacaaagccuuggcucacuccuuccuuuuuauucagucaaggauuccagcccacagcaaugguguagcccaccguucuggugggucuucucccaucaucuggaaaucccucccucaucaaggugcucagggauuugucuccuagguccuucuagauccucucaaguugccaaucaacaggaaccaucacaacuacugcacuguggucacguucagugucaguguccuaaugauaacaagcaagaaacagagucauuccaaggguuuaugcaacaguuggaaagaguuacaaaugccuauaaauacaaccugcugaccaaaccugaccugcgauuaucaguaucuugagacuaaaagaccuuucaaucccucuguggccucuggcuagcagucuuaccucgaagcccaaaagaggagaaagaguugugcagaaagggguucauccuagcuguguuuaaaaagcaaagaacuggaagucccccaaaggcgcuaucuaugauaagggaaacauccggucagcuuuggaacagcuacacgguggagagcuuggcagucaauuacaaaacaaaagcuaaaacauaagccuuuuugcagagaguuuuuaauaauaugagaaaugcuuacugguguauacacugaguaaaaauccaagauaccaaauuaugucaccugaccuuugacccagaagucagacaggacuuugagaaucuauccuacagaauuaaaaacagcagcauauuaagacuaauggauaagaacgcggacuguugcggucuuucuaagcgcauaagcaacagcaauggcaacgugaaagcugaacagcagucccugauggagagugcuugacuugauuggggucacucuguaucauagaccacuauguaaccauuaaauaagaaccucaucuagauguguacuauauguauuuuuaaccaauaagagcaucuuuuacacacacacacccacacacacaugcaugcauacccugcauauuucuauggucacaaaaugucuaucauugacauuuggcaaaagggacuaaccuagcuuuccuucuuaggacgccgcuuuuguuagcugucuuucaugaacucaguaauaaacauaauaguguaaagaucuuaacacauuuuagaaacaagaugccccaugugauuccaaccguaacgaggugugugcgccugugaguggggaagguacgugggauguccuaugggcuccauggcuuacuauuuaguguuguaaauagaagugguggcuauuuuuuuucguaauuuuuauauauuuuuuuaauuauccaucauuugggagagagaggauaaagggagcagugagagacagacagagagagagacagagagagagagagagagagagagagagggagagagagagagagaggaaugagaguacauaaauuaaacaaauaaaugaaacugaugguuuccgguuuuguccccacaccuuccgugguucuggauucccguucaccccauguugccuacccuuugcuguucuccuugaucugagacuccacgcagaggccuaggaagacacauaguuaaccugcuugcagaggcagcagcaaccguaccucugugccgcguagggggaccacucuggaauuaauaucugaugaagaaauaacuguuaacagggcagauuuacaguauucagauuacuauugauccaugcgguauacaacuaauaaaagccuuccucgcauggcuuuuuugcaucguguucgccuaagcaaauuaucucuaauaaacaaguauuacaaggaucgaaggaaaaaugccaaucuauaaauuauugugcucaugcacucucucucucucucucacucucuugcucacucucucucucccucucucccuccccuucucacccccuccuccucucucccucuaucccuuucucccugucucccagaucucauucucuucucuauggauuaaaacuaggguuagccacucacaucacuuuuuguguguucuuugcccaaauguucagauuccccaaaucucuucgagcacagcagaagaccaucccaugucccaugagguacaauaucaagacugaaucucacuucauaguaaacgauacaacgaaauccaaacgauaacaaucauucucuaaggggcaaugagaaggaggccaccgaaccuccucuaagaucccccaagaugugaacgcugaaccugggccugcuucucugccugugugaccuugggcacauauguucuucugagccaaguccaaguacguuuaucagauagcaccauuugacgaugauggcaggacaacugaucauccuguccacacaccagaacagaacuccaagcgccugcaucaccagaauugguugcuucugguccuuugcccuucauaagucuuucugagucaccaaaccuggcuacucagaaugacaaaaaaggaccacuguagaccuagaaugguucgaccaugaaacagaagcucagcaggugccaccgcugaaggacccagagguguagguaugccagcacccugaauugagggugaccuuggggccaucuuccuucuagccaggcugaaugcaacagaaugaacauacaggaucacaugccugggcgucuccuugguccagauugugacuccugggucucauuucauaugcugcuaccucacagcccauccuuggcuaauauuacuguggagagguagagggggcugagaaggauacucaggaucaaaggcgauuggcugacaucagcugucauacuuggcuucagugaaaccacaaagauggagggaugcucucacggguuuggaugcuuaaccuucauccgaccuugggcugauccagguaagcaugcucccuuggccuuuagacaagcuauguacaucucuugaguuuaaccugugugcuuugggaauaugacacuguucccaugguacuuugugagacuguuaauuucuggggcuucccacguguguucucagcaguucauuaguucccuaggcccuagccacacucagggguccuggugauagagugguagguuuaaggugggagacccauuccucuuucaaggguggcacuacucaggaacacagauagccagauuuccuuagagaauucugcauaguaaaugggaaacaacaauauucacacuucuaaauagcucugugagguagcauaaaauaauguuuugagugagagaguucaagauguauuuuuuuuucaaaaaugaauucccaugauccaaaaagaagugagugaagaaggaagaugcagcugggaaugcagccaccugagguuguaucugccaauaauauccuaccuuccaaauggaacaauucuauacaggcccuugugucuuuagagaguuagaguuauuuaaaaucagacuagggguucuuggaagauaaauagaaauucuaagauuuaaaauuagugagcuaaauaagucccagaagccaaaacucaccggcuucuuauuuuaguaaacacaggcuuuuuugaguauuguuuuuguuuucuuguuuuugguuuuuguuguuguuguuguuguuuuuguuuguuuuuugguuuuugguuuuuuuagaaagaaaugcagucacucauuuuuauaucuccugugguucucugugcuaugcuggugcugugaucugaaugucagcaugucucuaaagcccauguacugaaaaguguuccccuugaacgugauaguauucaaagguaagguuggugagugacagaccaugaaugugggguccucuuccgugagacuagugucccugucaacaagagcuuccuuauccucuaccaccauaugaugccagagugaggugguaccauuugugaaccagggagugggcccuugucugugaaucugcucagcccuuaagcuuggauguuuaagguccagaacuuuggaauuucuauuguauauuagauacauagcuuauagcaugcuauaauagcaacucaaauggcccgaggcaauugaguaacguuuuaaagauuuauucuguuuuuaagucucucucucucucucucucucucucucucucucucucucucucucucucuguguguguguguguguguguguguguguguguguguguguguaggaauaugugcacaugaaaucaguacuugugucgaccagaagagggagagagggagucagauucccuggagaucaacuugggugcuggggaccaaacuguaguugcaagcaagagcacagaccacugugccaauccuccagcccaggaguugaauauuuuuugacauaggaccuauggacuaaaauauuuagcaccugcaacuuuaaagaaaaauaaaguuagccaaugcuucuucuauucagguugaguauguucaacaugaccucaucuuuaguaaugaggauguguuaacagccuaucccugauggagggagcuugguaccagagaaagagaauucugguaccuuuuuggcugauucuccccccucucccugcuccaucauugcccgcuuuugcauaauggguggcagucagaggcaacgggaugguuggaagguggagggagauggguuucaaggagcugaaaagauaccauaaaagcuuuuccacucugcuuuuaccugccugcaucugcugggaggagccuggcccccagaggucagcagaaguguguuaaaagccuugccuuugggauaaacgagcaucaaaaccugcccggggagagcgaacagagaaaaaauauggaaauaaaugacaaagagaguacucugaaagaauuucuuccuagaggaagcgagcaaugaggccaggcgaggaauaaauggcguagaaaugacaguggcucuuuuggcugggccacagcugcacucgagggcugauaagccccgccgugugugucagcccaccucuccguguucauacuucaaugugaacuuuacagggaaaggggggacgggaggcagcgaaggggaaaacuggggcugcgaaggacuugugcacagggugugaagccauuucaauuuuuauauucgaaaggacucuguaggugaucccgugaaugcaauuaugccuaccuaauaaaagcaacauaugcuaagacaauuaaaagauuuuauuauacgucucuucauuguaguccggguuaggcgggaggaacggaaacugaugagagagagaggauguauccggcaggaaggagagccaaagucgaggccugguccacgcuggcggggaaauggaugggagaugauacacuucuaacauaaagaugaauuacggaaugacucuucaccgggguguuuucaccuugcagaaugccaaggcgcugguuucaugaccgcacgacgagaaauaucgcugaagggauugcaccgccuucauaaaagcccuuggcgguuuuuuggugggcagucauaaaacgaaggucuucucacaaugccagggagggaaaaggucugucgcuugauuugaaguuuaaugacaaggugguuaaguggaaagcaagcuaacauuccgguguccaggcguuccacagacacauauggaggaccagauagggggauuuaaccuucuagggagcaaaaagcauuccgcgcccccacggagcccacuguggcacucucagucccucccuacuaaaagagaaguaaaaucuuuugcuuaucuuccugggcagaaaagccagauugaacucagcuugccuuguggagagagaaaaacaguucugaccagucaaaagugauuaggugggaccaggaagggaggauuggagagguggcucagggggcuaagcuauccauccaggaagcgagaucugauuuccagaagccccugaggcagcucacugccauuuguaacuccacucucuggugaucugagaagggagucacuuccugagcaaagccugguaguugaugucacuucaugggacacagcucccaccuucggggggcaccaacuuagacucuugguggguagggaaacagaaauacaccccuuggugguugaacuauaaggcuuuuuuuuugggggggggcugccugcuagagcagucucaccuauccugauucaguucugugcagaugagccaacaauuccagugagagugguuuuaagggcuagagagguggcucuguaagucacgagaacuuucugugcucuccugggaucugaguuugguuuccagaguccacccugggaagcuuacgaucaucaauaacuccaaauccaaaggauuugagauauagucuucuggcaugcaugggcacccacacauaggugaauaaacacacacacacacacacacacacacacacacacacacacacucacucccacacccugcuugaacauucauguacauaaauuaaaaauuaaauacauauuuuuaaagugucauucaaugcuaaaauuagaaucucuuauggagacagguuggaaacccaccacuguauuauggaacccuaggacaguuccaugaaaacggugguguuucucuuccauuucauaggcauuugcaaaaggaacucguguagaggucacgguaccacuggaggcccagacguguggaagaauguggguugggagcaggaucuguggggaggagcggugacucugaagagguucacuggaagccaccaugcagggacuaugaaagagcacuaggaggcagaaaaagagugccagcgucaagaucaauguauguccuccugagaugggagccacaacuggguuagacgugguccacagaaagccauggauccugagugcagggauuucuccuccauaaaccacuuuccccuggaacugaugaccaaaucaaaggcugcugagcugucuauggagcuaaccauagggucuguuugucaugaugaagaggcccgggcugcucagaaccacagcuuugugacugaccugguggccacugagaaaugcaggcaaaaaagcccaaccaaaguaaaaauaaaacccauacagggguuuuaaaucuuaggucuugugcaguaugggaaauguguucuuuagucuggagaggagcagcugggcuucauaaugcaguauuacaugaaggcagcgaugucuuuuucacucagcacauuagccuaccucuaacacguucaucucguuuuggcagaaggaggaaggcguaguaaaaaugaaagugauuaagucaaaguggauggaucaauccugauuagguuauaguuggacucucugggacuucccaauuucugaagugaauauggaggagaagguacugucagagggcagcagguggcaaagguuagggguuagaaagaagcauuguggagggagagacgaggucuucaugaugauaucacacagacccaggugaaagaguucucagacucccuggugauuaaugcuaacauuaaaugggauaaauuaugcaaacuagaagcacuuauacaaaauggcauguaguaaagacuccauagaagcuguuccgccaccuucuuuauauucuucuuaauuagcaugauguuuucugguaaaguuaucaaauguauuucuccuuagugcguaaaauguuguaaaauaauaccacauccgugguucauacugccugcguuccuugucugaaggaaucacucaacagacaucagucuggugugcguuaguuaauauuaguauauuuauugaugugugugugcuaguuaauauuaguauauuuauguaugucaauaauauuuauguaugugugcacacacgugacaugcauguucaagcaugcaugcuugcaugugcuccuguagaggccagagguacaugcuggauguuucccccagucaaucacucuccaccuugucuuucuagacaaggucuuucaccaaaccaggagcucacaguuugguuagacugacuggccagugagcccugagaaucccccugucucuauccgccuagugcugggauaauagguguagguuauccagcuuuuuuauguggguucuggggauugagcuccaauccucauacuugcacagaaagcaucucuccaccaagagcucuccacagucugcuuuuaaucuugaggaauguggcaugcuucucugggccaggcacuaacuguguuucugggugggacacucgguuucucaguuacugcuuggcggcugaggcaaaggagagacgcacacagucuugaccagccagaggcaucuggcaggaggcugaguugaagacauucgcuuugccuacgaaccacagccccagaugggcaucgcaucgaaugcaccccuccaugaccuuuccugcuacaaacccacaagaucuaccucuuuaggccaaguucaggaagacacucuggcuacacgcaaguauuacgaaccaucagguagccuagccuaaaaauaugguauccugccaguuuccauaagauuuuccuggugaggcauuuaaaaaucacaauuuuuaagauucuaaagccagugaaauccguuaaauuuuuugaaaaguaaaaaccaaacaaacaccccucagacauagacacagcccccucucuucucuuucuugucuccucugaucucuuucucuuuugaauuuuguuguuguuguuguuauuuuauuguuauuuuacuguuguuugugacccacacugcccuggaacucacuaaacacaucuaguuggccuuuucauuuauuucuaguuggaugauauauuuuauuuugaaucccauuuuugacauccaaccuuuuguuaugcauguuuuucucaaugggaguuuuuauuuucugcauaauauuccaguuggauagauacaccaacccgccauugaaccuucaagcugauuuuacauguuuguuaauuguuuguuuaaaaaaaaacaguuauagagaaggguucuauuuguaggagacaugauguuccccccugugguuuugacugugggugcucaugagcuauggccucuuccuaucaugaaaacugacaugaucucucucucucucuagagauccauggguugccacuaacauucaauucucugugcagaaguccucuuucucucucuuccuuaccccagccucacuccauuaaaucccuuuguuuccagugugaggauggaugagaaggcugguguggaccaucccaacagucagacaucucugagcuccuccacagugcccaaagcaucccaugcuucuaagguccuuagugaauggucuucgcaucuggaauggaccagauagcucccaggagggccaggaggggagcagaugguacaggguguaccgacaagguuuguucuacgcugacguggauguaaggacgggacccuggcgacaucaacaggcaugugugucaaaucugauuaacaugguauuuuaugccagggaagauuuuuccagagagaauccuggcugucuuuuugaaugcaaagggaugaaaucagcaaaccauuugcuacaauuuagaaauauagaauauacaauauauuucuauauucuaaacagagagagagagagaggguagagggggagguguagagggagggaggggaggagaaaaugagggggaggaagagaggaggaggcagagggagggggaggggaaggagaggggggaaacagcagagucucuaaagacacccacaugaguaggagagaugaagcaucagguaaaggugaugaaugagagccuaaugaccugagcucaauccccggacuauggugaaaggagucaacugacuccuaaaaguuguccucugaccgccacacguguauuagguagggcaugugugccacccccuccgauaacaauagauuuuaaaaaagaaguucgcagcaccuuccaaagcagauagccuagccuccgggcauacagucauuuggggggagcagaugggacagagguacucugacccagacacuucguuuuacugggcagacuaauuuugcaugggugaugucuccugucagugaucuugcaguccagagcagaucuacaaagugugugugugugugugugugugugugugugugugugacacugaguuucagugugaagccccaagcuggcuagagguaauucuccugccucagccccuagugcgcagggaucaucagcuuaugccacuaugccuggcuuuagaaauacgaagccuuagccgggcaugguggcgcauaccuuuaaucccagcacucgggaggcagaggcaggcggauuucugaguuugaggccagcuuggucuacaaagugaguuccaggacagccagggcuauacagagaaaccuugucucaacccccacccaccccacccccccaaaaagaaagaaauauggagccuuguagcacagagguuuucagauaugugugacuuccuucccaaucacaugucucugccuggcucugaagccuggaucucugcaccacagcaccugcagaaacuaggcacccccaaaugccaagagccaggcagagcucugagacacacucaguuccuucucucucgggguucaauguaggugagggaugaacaaaaggugacaccaucaaggcaaugagagaaauuaacaagguggcugcuuccaccugcuagcuggcaagaagcacagucacuugcuggcacagggggaggcuccugguuugcccugccuccgagggcuucugcaggagcuccagguuccuaagagccaggaugaccugccugauaaccuggcaggccaccagcugcauugaacccaagcccauguguguaucacaaugcaggaagcccucuuaaaagggcacaugaauuagcuuccugagacuuuagguuuuaaaagcuucugugauugaauuugcuucaguauauuauacauacauacauauauauauauauacauacauauauauauauauauauauauauauauauauauauauauaauuucgaagacugguucuguugucaggacauuagaagacaaaacaauagcagggggugggagagagagagagagagagagagagagagagagagagaacaaauuuacugguuucuacaguaaagugcuuuugauauggacggagauuggagauuggcuggcggaaagcaauauagcacuagaaggcugucgugcacaguuaaagaaucagcuucccuccagugacuugauugaugccaacugagcuuguguuagcacaguacucauggucagagcaucugcggucaggucaggggccacuuugauaaaaaccuuagggaaaacacaacacaaaacuaaauguguguuuccauguaauguagaacgacgaccuacgugguacuguguauguccccuguaagcugguugagagaugaaauuaaauuuaaauuaggaggaaaaagagcaacagaauguaaaaaaggaaaaaaaaucaaucaaccaaccaagccaaugaaaggaaagcaaaggaaaugauuuaaggauaggacacgaggcucagggguuaaagacacaugcugcucuugcagaggacucgagauuggcucccagcgccuacccugggcagcucuuaaccaguuguaccucuagauccugggguccaucgccucuagucucugaaagaaccugcucuccaaugcacacugcuaccccugccuccgccccacauaauuuaaaaaugaaaugaucauguuuuagaaagucaaaaaaauaaaauucuagguagaauagcaauaaccauugucuuuuauaggaaaugggcaagcgguaaguguggucauuacauuuguucagaaugagaauauaaauaacaguguuauacuauuuaauaaaggauguaugaucauauuauuagaugcguucuagaaauaaaagcccuuacuaaacucagacccucucccuggggucagcaucaucugcaggcacacaaaccgaggguugcugccacguguuggugucuccugucuuccacguuaaucugugcgcuccauagcugcucccuucuuacgcucuaggugcugggccuuuggucagcaaauaaaccauucuugaacuuaccauaaccuacuuccucuuccauuuggcuucuccuggcugacuaaucccuuugucuauucucagaaacauuucccaacaucucacuuuuuuuuuuuuaaauuagggagugcacauggggaaauauuuaaauaagucaauguauuuacaaucuguaggcagggccugaauaacccacagaaauucacaaaaccuuggcccaggucgaugaagaauuacagccaccgugccuuuccuacaacucgaaaggcuuuauuuccuucuuacauuaggaggagaugggggagaauggggaggagagggaagaggagaagaagagaggagggggaggugaggaggaggaggaaaaaaaggaugaccuugcaaauuacaguauuauaaauuguucuucuaaauuuggaaagaaacugaaagucaggaaaaaaaaaaaaaacccuccucgaauaagcuugcaaagacuuaaggagaccuuuucccguaaaggaagaagaagaaaugcuugagugugaaaacugacuucugguuuucuguuugauuuuucuaaaaaaaaaaaaaaaaauuaucuucuacaauggaaaucgugcaauccuuugagggagugauucauggucagauuacauuuucuuaaucugacauuuauuuagagaaugaauagggcucacugacuuaggaggcugguaucguuuucaucugcagauagaguuaaguggucaugucgguucgguuguacgauagauacaacaucccucccaaagaaauauuauugggaaggcggaggaagcgcggcucuccugccaucaguucuggcucuacuucuaucuuuaucaucuguuagcuggaugacuuuuggcaaauggcauggccucucuggucucugcucgcugugugucugguuuacgguggauaaaaacccggaaauaacagugccaggaugaacugagauaacaauggcugagaaaaaugcgugaaggaaacaugccacgcagcagagaauugcucccacugggaacccaugauuggauuggguuacugaagggcaaagggcuaucuaaaacuguuccagaauaaggcggagccugggguugggcauugggaggggcagggaucacaggagauuccaguuuucggaucuuauucccaugucuccuuucagaagagauaccgugucucugagagugcauggcccugggagugaguaccaagcaagcuauggaauagugcucaauagagcuauuuuggaccucucugugcaggagagaggaggaugucccucaucuguauaccuaguuccaaaugcccaccaggccaccucuaaggcacccccaggaagacagcaguggcaucuaggcccuucccacaguuuacagccagggagaggguccagaaggcaaggcaauuucugucaggcaccugugcucagagcaggcaccugugcucagaccagguaucuuucccaugagugaggucuuuacagcccccuguucagcagauccacacacguuugcaugcguucuuggauagaaugacgcuucauugucuagcuguacacgguuuuguacaacgcaggcaagacacacuccagauuuuucuccccacuuuuugcuucuggccuggcuccuugguuuccaaagacagccagggggguggugaaaggaaauaagaggaccuuucaagccuagcugggaugaaucccaagaacugauacccuuaaucugagcccuccuugggaggcaaagauggguggaucucaacaggcuugaggccagccugguucacaaagcaaguucuaggccagccaggaccauauaguaaguccauguuucaaaagcagaaggaaaacaaguaaaggaggaggaggaggagaaggaggaggaggaggaggaggaggaggaggaagaagaggaggaggaggaggaagaagaagaagaggaggaggagaagggaggggguaagggagagggggagggagggggagggggaagaggaagagcaacagcaacaaacagugguguuuggugaucuccugcagguccagguucaggaaccacuguagugugugugugugugugugugugugugugugaaagagagagguggggguggggauauagaggagcccaaaugccacaucaugcauggaaaggucagaaccuggaggggucaauccuugccuuccgguuugcuugacacaguaucuuugcugagcaccacugaggaagacccuacuucccauuguaauugggguuaccaacacaugcuaccacagcuggcuuuuacagggguuccuggggauuugaacuuggguccucacacuugcaugcugaacucuuuaaucaaugaugcagcuccgggacccaagcauuaaauuugucuguguuccuuaguuuuauaugaagcuggaaaaggcagccucucuucuguacaauccccacaccucccgcagucacaggccuuugaaggccuggccuuaugaucugaagucugcgcugccuggcaaguaucacaucugaugugcuggaggcagacuguaguccauaguguccagagagucugcagcuuacaggcuaucucacaugugcuauuugauaccucugcgucucagcuuccucuucugagccauggggcucugaacuuuggggacauacaagaugacaguuaaauggaauuauguuugcuacaugguaaguucaugccuuguccauaugcacacaugucacuucuggggucacuuacagucuccaaauucuggcaucaggaguacguguguguguguaugugugugcauguauguguguauggggguauauguguguggauucacauguguauguauguauguauguauguauguauguauguauguauguguagauguguuuggagaguguguguaugugugugcacuuuuuguguauguauguguagauauguauggaugugugcuuagauguguguguauauguguguugauuguguguguguuugugcauguguauguaugugugaguguguauauaggaaugugcacauggauguagaaguuaaguaucagucuuagguuuaauugcgucagcaacuuuggaccuuagaucugagacaacgucucauauuagcauugaaaucaccaagcagguuaggcugguuagccagcaagccuuaggcuccacuucaccuccccagcgcugugguuuuagggaucaaacccagguucugugaguuaagccugcuuuacgaagcaagucagcuccaugacccagaucacagccuuucugggcccucaccuuucaaagccugguaguuuauacaaugaaaauguuccuuuuguaaagggugguuucuggacauaguuuuguaaaauguuaagguguugacagugggccggggaggcugacccugggcucaaucugggagaugggagcaaauccuggaagagugaguaagaugaaggagugguagaaaucagcuuccucuuccacauagugggaggaacuuccugggccccagcgcugaggggaaagccucugggaaauccagccugcaccggguaggucucauuaucacucccucccuuccuuccucuuuucaaggccacacagccaccauuuccccaguccuguggaauuugaguggugcaggcagggacaggaagagccuggaguaacauggacuagaggugccugugguugucuggcuugcagggcugcaugcauggagagcaggucccugggguuugauuacagcuacugaagugacuccuuaaccugcagaaacgaccguaacaaguccagugccuacagaauacagagaaguagcuaaggauggaggcuucguguaaaacugauuagcccgucuggaaagcaguuuggcagcuucuuggaaagugaaguguagagcugacuuaagauucaaaaauucuacagcaggugaauuuccccagagaaaugaaaaugcagguccagaggcuuggagugugugcaguagugucauucaggguagcccaaaaccaggaggggaggggagggcaggggaggggagaggagaaggaagaaacaggcaaagaaacaacaacaacaacauguccaucauuggauacagacauaauuaaaugugguacauucaaucaaugguucguuaaauaccacuggauuguauacucuaaaacaacugugcugugugaauucugaaucaauuaaaauguauaggaaaaaaaaaagauaaauaaaacccaguaaguguuuuugcuugucuguuugcuacaagaggagguggggcaggguuuaguuauguagcccaggguggccucaaaagcaaaucuucuuguccuggacuccccaguacuaggccugcaucugugaauagccaugcucacaaacaccagggggaugaaaucauuguagucgaagucugaaucucaucccggccucacugggcuucaguaacucugggacgauggcacaggcagccagccuuccauugcaucuuaguuuaagaugucgagaaggagcccaagcagagccugugagaaguuugacaucagaagcaaggugguuagcucaggccugaugcacauguacgcagacugccaccucucucuccugccaccaccaugcccucccugucaaggucaaugcccuuaggagaagcuacugauggcagaagagagugucgggaaugguggggucgucagcagacacuuagaaguagaacugucagcaccuggucauauuugaggcauaacuuauuuuuuuuugaauaaacuaaaguauuucaaugaaguugaauuuaguguauauucuguacuuagcuaaagagcuuuuuagagaaagcaaaacaaaacaccaaguucauuaaagaaugaacacgguguuggagagaugauagcucagugguuuagagccccuguugcuccuucacaagacccaguuugguuuccagaacugccacaaggcagagcucacaaccgcuuacaauugccacuccagggaaucuguggagagccucuucugccuuccacagcuaccugcaacccggcacacaaacucacacacagacacucauagacacauaaauaaaaauaaaaucuguuuuuauaaagagaauggauauaugucaaaaguaauuuauucacugaacugacuaacuauaagcacaugaaucucaugguguuaaggaguuucacguugcccaagguggcuuucagacuuauccuguagcuaaggauggccuuaaaauucugauccuccugccuccaucucuugaguggugggauucuaggcaugugacaccacacucagguuuucucucugcucaauagcaugaaacaugcacuggaggugaaaggucagagaugccagaggucagcugaugccacgagccuugguaggucucugguuuuuaaaugggaacguuucuuuuaaugacagaauuucaguuaaugggcaugccaaucugacaucuucaaggcacugccaacccagcaguaugaauaagggaauucugaagacauggacuacugcucacccugggugauucugaacccucagugaaaaccagaacagacugugucaccuggcauuucuauaacaaagggaaggggacccagauggagauggggugggaaagaaacaaaccauacagaucaauaaauaaggacauaaaacacaaugggggcggcgugaaauucuguccucuugaucucaugaaguucaaggcuggaacagugcaagcugaaauguccggcuugcuacgauugagagugggguggaggaaggagauggggaggggacuuagcaccccacuuccaggagggacucaugucaaugucuuugcaauaauguauuuuccuaaaagcuaguugauuuauuugcaccauaaacaugguggaggguguuccauggaaauacccugugugugccuucacaguauccugagaagcaaagcucccccuucaugugucuggggaggccaucucuccaaaggagaucgcugucccugaaacguagauaguuauaaaaauggcauuaauuugcuuagacccagaaauuuucacaggagagcaacuagcagaaaacauuauggaaauguccaagagggcugguaauugaguugauuaguacgaccuugguuaugaagguaauggaagagggaccgguguuuagacugaguuauaacucuguugccgguucgucgaccgacugagagauguaauuuguucagccugccucggaguggccaagccugccugugacaaaguaauacucugacuagcggagcuuggcugcugcuuguacccugccggaguaaacagggcagggucaaguaagaaaugauagacugugcuccaacacagugcuucugugugggucggcggugggcacagccuuacagacagcggaccccaggagccacuaacucauuccuucugagcugcugaagaaggaagugaacucaacugcuccccagccagaaggaaacaaagcaaaccaccgacaucucaaagaauaaaccuauaggagggucugugcugaauucacucuggcucuguuuucauaguauuuauagacauuuaggaagcaacaugccucugguugcagugggaaauuuaguuguauuaaucauaagaaaagauccaacgucuuccucugaaaaccaugcuguuuacaggacaccuguuuaaauaggccacagucucuccauaauauuaacacaaguacccacauguaaacuugacccugguaugaccgcccaugaggcagggccgggguguggggggggggggcuagagugaaguguucaacuuuagaauuaguaugggagaauuucacauccagggaugcccuacccuucuugcauccuugccggccuugguuacccauuccaccuuagccgugaugcuuguggaaugucugagacuuaggggaaaucuaugcaucuggguaaccugauauaaauacaggugagaggugugugcucaacguuuucuuauucacuguucuuagagaauggguccuauacuugaacuacagagcugugccuggugaauaaaaacagucuaucugcaugcauacucuacguccuuuugggaugguaugugucuguuuguguguguauagguguaugcauguguaugucuacguggauauauguaccugccuguguguguguguaugaguauguauauguguguguauuuauguauguaugugucugucuguguguauauguguguguauauguguguuuguguguguaucuauguguguuuguguguguaucugugugugugucuaccuguguguauguguguauaugugugugucuauguguaucugugugugucugcaugugugucuguauguguauguaauguauauguauaucugugugucuguguuuuuauuuguauuuuguguguauauguguaucugugugugucuguauguauaucuauguguguacaugugugucuguguguguauauguguuuuuguguuuuuauguguauuuuguguguaucucucuguguaucuguguuucucuguguauguaugucuaugugugugaaaguauguaagugaggguuuguuuuuguuucuuugaguuuuuucuucuuccuuuugagccuccgguuuuaggacuggagcuacacaaaugacaaagggccagagucccuugucuccuugccucugucaccgugccugcugacccucuagugaaagggaccugaccaccgcaugcgaguggaauaaauuaucgcugacacuccaauauuuaauuaugcagcugucagagcggcccuuucgaaauucauuuuaauaaagugggaacuaucccuuucaagguugagagugagggggucaccuuuggugucagccagaggucucugccaugaguuccgcauucccacucuggacgccugucacuuggccugauagaaggacccgauaacagcucugaugccugguggcauccccccaucccugccugaaugaacacccuucauuuaaacccacaauaaugaggaccucaaagucacagaggcgggcacaagggcagucugucgggggcgaaaauggcuucuuguuauaaaauccacucaguguggaaguagaggucuuguccaucucccugguuuaaauaguuaguugaaaauauuucaccagaugaaggggggaaaaggagugggggaaaaacccgaaucagcuggguuuaaggaaggaggugucuagauccuggcuugucuccauagucaugguuccuaaucucauaaaagagacacaaauguauugauuuauauuuuucuauaaaauaaagaaugguauuauaguuuuuguagucuagucccugggccauaaaguugcucauagaagaggaaaaaaaaagcuuuuauguggcaaacugaaugugugaacgcucuccugccugccuauugugcguguggcuaaaguccauguuuagcugacacuucccacuguucguauguaagccauggcugcagacggcagggaaauacaggcagggcuggagaaggcagaaggggcagcagcugcuucuaagugggcuccuuccugucggcucuauagacucuccaccucccauguccuccuugccugccuugccuguccccucuuucccuucagugacacgguaaacucauauuaguuggugauugugugccaggcauuguccaaagucagccgguaugcaaauaugucuuagggggucagguggauucuauuaauuagguacuuuaauggcauuccccaacuuuuacaaaugaggaagccgggguucagaacugcugagguuccuucucaggacuggcuggauaccuaccaacuguccccccuaugcucucacugaccccucugccuccagugcauucagugcucacacuugcagucccucugccagccccgucucuugguuuuucuuccacaccggccucugugcugccuuuccccccuccucucugucucccgcucuagccuucucucuuucccaggcuucauaucccugugccucccuggaauauguacaucagcugcagugggaugcauggugaccaucgggcgagcaucugguguuaacuacugucacuaaacauugguugcggagagaagccucaugcuauguguuagaauaaauuccaaagacgggacuauccuguguguauggaaaggugcugcuucuaagccacaaauuauaacccaggauucccacaagaaagcuggugguucucaaccuguggguagugacuccuuggggaguugaauuccagauauccugcauagcagauauuuauauuaccauuugugacaguagaaaaauuauagugauuaauuagcaaugguugggggucaccagaacaugagagacuguaucaaagggucacagcauugugaagguuuuaccaaugccauaagcauuuauaaaauuuuuaguguuauuuuucaauguuguaugagcauaugguguguugacuauauacccgcaccauccuuccuacacugcucgccuccccacuccuccuagucccuuugucccccagacagcuucacuucuacggucaaaucccauauauguacauuauuuuacccaucuacauaaaucguaggaaucccaaguaagaaugaauacuauauucgucuuucuaaaauugacuuaauucccuuaguacgauugucugcaguuguauccguuuugcuaauguugauauaauuucuuguuuguggccgaaagaaggucccacucuguacacaugcuaugcuuucuuuacccauucuucuguuacuuggauuaguuccacaucaccuauugugaauagagaugcaguaaacacugauaugcaagugucucugauaccaacuuguaauccuugguccauaaacauguuugcuaaggggcaguauauauauauauauauauggcaagggccccagacagaaaaacaggcagcagaaaguaccaccucugcuucacuuugcuguuguucuaagagggcagaucuauagaucgaggcagaauggccagacccucccaggcuucuuauagcuccccuagcauacuccagagagcagcaaauuuucaagcugcccuuggucuuaguccuugagcuucacaauggggauuccugauagaugaggcuucagcuaggccuguagugggcacaggaaggaaaauggaagucgugguccuguggaggaccgguuacucuucccugagcuugaccuucauuguguccugccuauuccagggucucagugccaaggggauaauguaucucaagggcccaugauaauugagaccacccaugucuccccucgccuguugucuuccuauaaaucagugcuacugagauagcuaagggcuuaauguacuauuuaugggguaauaguuuggguuuucuuuucuuuuuuuuaagacaagguuucauauauuccauguagcuucaauuucgagaugcagccaagcacaaccuugaacugccuuuagaugcugugugagagcaugauaggaguguguucgccacgcccgguuuuacccugugcuggggaucaagcauggggacucucacaugcuaggcaaucaccuuacccacugagcuccauugccagugcugacucuaggagcugaaagaagcauucgaacucaaaucagacuacagggagagaagagcuggagccugggcaugucguucuaaucugcuugacacugaucucaaaccggcaaggcaggaaaccaccacucucucaagcagaagacuaacacaagggcuuccuggcccauggaagcaauuguaucaagccaagcacuucugugcacuggcaggcauguuuaacaagagcucggaggacagacgcguggucaaguagacaucaacuucuuaaccacuggugagucacagcaacccaagaaaagacaggcagaggagauggguguguuguuucugguuccugccacuguggacugccugugaugccuuucagagauccuuucagagaugagucuguaucucuaggcuucgcuagaaccuggauaaaggggguugggucuuaguaugugcuucugaaaaggauaauaaugggacaaucgagauaagaggucguagaagugucucagugaaaaaucuacaagugcuaucuaugucaaggggcauuuccgcuuccaucccuuucucgcucuuucucuuucuuuccugcugucuauauccucccuuuagccauuugcauucagugauuauuucaugggccaagcuugugccaugggcuuucuauucuaguucaucucuaccucaggugggaagugggugccuagagauaaggaaaccgaggccagccuaggcaaagaaggcaaagaaguucaaggccauuuagccaggugaagcagagggaagauuggaaggcagccaugcuuauccacagaggcagcacggaagcacaucuagaacugccuucagcuaacucauggcaagccugucuaacaaggcucacuguggugguuugaauagguauggcccagauagacucaugugcuugaaugcuuggcccauagugaguggcacuguuaggagguguggccuuuuuggaggaagugugucacuguggggacagaauuuuaggucuccuaugcucacgcuaggucuaaugggacaguuguuucuacugccugaggauccagauguagaacucucggcuccuucuucagcaccaugucugccugugugacaucacguuucccaccaugaugauaauggacuaaaccucagaacuguaagccagucccauuuaaauauugccccuuauaugaguuguuguggucgugauaugaggauuauaacucuaagacacccaugacuggcaauacaucaaaauucuuaaggggauaaauggucccuuuucacugcaacgguggaacagcagaaauaugaaauaguaacgacaucaauagucagcaggcuagaugcugugacugugaaaguguguguaugugugugagugaguguguguguaugugagagugugugugagagaguguguuugugugugugagugugugagagaguauguuugugugugugugugugagugugugugugugaguguguuugugugugugaguguguaugugugaguguguauggugagagugugaguguguguguaucuguauguauguguggcaggggguauacagguguuaugugcauuauauguaugugugugugugcauauacauguacauucucagggcuggagaaauggauggauguacaaagcgcuugcuacgcaugcaugaggacaagagugcgaaucuccaggauccacaggaaugcugagcagggacaauggccaguucucaggagaugacacaggauccugaaagcaagcuagcuggcuagagcagcugaaucagugaacucugaguucaagugagagucccuacuucauaucacauggagaccagccaaggaaguuacagugugaccccugccucaacaugcacacacacagacacacacacacacacacacacacacacacacacacacacacacacacacaaacauaucuagauccauacauaugugaacaagcacacacacagcauacccauacaugugcaccacagacgagugcaaaaaaguaaauucacauuugcauuuuauauguaagaguauacagauaaauuucuaaguacacagagaaaaaaaggcacacauacccuucuccucugauuuacaccauuaugauuuccaucccauauccaauaaaccaaagcuccauuaaaugcugugcuagggaccaagaagaagaaggugcugaguugaaugugaauacagaucaugucggcucaaagcuacugcuuuggaaacauaaaauacagaaaauguaucugccaccccucaacuucacuucugacgugagguguccuuccccagacacccuuucgcuuuugcugcagucuuacaaagagcugcuauagguguuagcgugcaaagccuaccuuauggauggugaaagcuagggcccagagcaacagagacuugucucuauguuuauaacaagcaucagguugaacucacauucagacucauuaccuucuaccucccucaguucagaacgucuugccuccacaaggugggcucugugaaggaggggcguucaucgcucaaaacucuccuucacggggacgaggugaugccucaggugggaaaguauuugccauagagacuugaggaccugaguucagauccccggcacccaagagcugcagcacaugaccguaaucuuagcacugggaaggcaggagguuccaugggccucuagcaaaugcuaagccccagguucagagagggacuuugucuugaaagaaagaaagaaagaaagagagagagagagagagagagagagagagagagagagagagagagagagagagagagagacuggaaggaaggaaggaaggaaagaaggaaggaaggaaggaaggaaggaaggaaggaaggaaggaagggcuggcuggcaagggggcuuagcaggcaagcaccuguacugcaaaccugacgaugugaguuagaucucugaacauacugagaugggacucccaaggguuguccucugaguaucacaugugugucaugguacaugcauguaugugggguggaagggcacauguacacacaaaauagcaaacauaguaaggugaaaaguaauugagggagacacuugauauagaacccagccccuccccacacauguacacacacauacacacacacacacacacacacacacauguaucuagguauguaugaauauacauauauacagaaacauggacacacauucacaaaacaaagguguacacacauacauacaugcacacacacaaagcuucuuucugcuacaguucucagaaccgacagcuuccuucucaaaaaaaaacagauucgugucugugggauauucacagccucacaaggcacccacugcgcgucgccuuccaagguagcugggacaucacgccugaugccaguguuucuguguaaacacugacagucaggaagcgugagcagcagccaccccacacaaguccuuacaguugggaauaauccugggucaaggucaaaucucaaaaauacuagaaaccuacacccuccucgugggguagggagaaggcugagagccacagcccucugccagaggacaccccccacacaugcacacugccuucaaaacccccgagcauggcaaaauaccccaagaugucaagcacaagcuagccggcuggcggagggaaauaaauccuggcucaacgaggauuaaaaagucaccuagcaugaggggaauucgcacuccacaaauuuuucucgacugaguaaauuuaaagauauaaaacuagauugagcaugcguuuaacacuggcugcuaucuuuugcucugguuugcucaguggcuuguuaaauaugaaaagauucgcccucaaaggagacucaggagaggcaaucacugggggggggggggggggggaucagcuacccuucugcccuucucuaaaacucaggugaggauggcagccuauuuuuauaucaauauccaagccuuguccuauggacaagucucagauaccauccugguauugugauggucucuuaauagaaggugugguauaaaaaacucauuggagaugccaggagcuucccucugacccuggcugccugcgaggcaaauugcauuagaaaaugacaugccauucaucucucgaguacuugcagggacauuuagcuaauuaaaugauuaauaaauuuaacacugcuuuguaauuucauuuagcuguguuggaaaucacacggugagcugcguaggcagcgaaugagauuaggugggagggaggguuucggaggcugcccugguaauugagauuagccuauuacuacagugaccuuuuuaacuuuuauauucucuuguuaaagcgaaauaaaauuuuauucacuuuuaaggaauauuuacuuagagaaauuuacaugaaauuaaagaaacacugagcccggaagccuacuggggcagaguccacgcaguauuucuuuaguaauucucagagucucuuuaggaaauuauucuugaguuagcuagagacagaguaaugaacaguguauuuucagacauucguucauucauucauuugcucauucaugaacgugcugaguucccacgccccgugacccgggucugauuuuagaccuaugaccaugauccagaucccuguuuuccuagacacagauuauuauagaaaaauacacaugagaagcaaaugaacacgcaacaagauaacacagagaaaugaacacacacagcacagaaagccagaauagcugacuugcuuuagacuggagaauguaaggaaaaccuuuauuucauauauguauauguuugagcacauguguuugggugcccaugggcaugggagcucaaaagccaacccaucuaugauuccucuggugccaugaaccuuguuuuuaagacaggaucucucaguggaccugcagccgacuaauucagcuaagccaacaagccccagagagccuccugucucuaccuccccagagcugggauuauaaacaccugucaccaugcaauauccaagaggaacagaacaaagaaacggagaggcugaugaccaagguccccagaaaaggaugaacgagugugacaagaaccagcaaggacuaggagauggcuugaccggguaggucaaggaaguuggcagugguggaauaauuacaggaggggucacccuaagcgagguccuguuggccagggugaagccagagucucuaaaggugcagugggagucaugguagcagcaccauaugucaggcgacuccaucuaagccccaaggaucuaccugucucuaccuccuuggcagugggguugcauccgccaccacauccaucuuuuuacaucgaaucuggggcuugaacuugcuccucuggcaagcauuuuaccaacucagccaucuccccagcccugcugggaguauucauacuccugaauccuuagugauacucugucgggccugcucuuugccacagaaaccacaguuucaccuucucccacuugcuuucucucagcaugggcuucuguguguccucccaacucuuggcaugucuccucuugagaugagcaggucaugugcuccuaagccucuagauacccagugucauuguuuacaagaccugagcauuuaugaagguucuacuauuugcugugugcuucccagacaugacggucuuugacgaacuuuagucccccccccccauacaagcaaagaggguaguagcuuauuacuacuguuguuuugcuaugcuuccagcuugacaaacccaagaucaaauugaugugauccugauucugaggugggagauaaaccuggacuagagacgauauagcucacgaggcuuucuuuccgaccgaaaaggugauugacaggagcgaucaugacgaguagagaggcaucaugacgaguguuuuucauauaauuuauguauuuuuauuucaugugcgcuggugucuugccuacauauaugucuauaugaggguauuaguuacagacaguuuugagcugccacgugggugcugagaauugaaccccaguccucuggaagcacauccaguucucuuaaucacugaaccaucccucuagacccaagacgaguauuuuaaacaacucucuccacaccauuguagacaugcagcaggacauugguggggggauguugccuguuuuccagauggccacaucuggcccacacaggugccauuggguuuuagccuuucccaauucuuagcccgcacccuuguuaagaaguguauucuuuguuaauaaacuaucuguucccucugcaacucauaugcuuauuacccagguccuuagucuagaacauaaccuggaaauucaagcagguguccucaagaccuccgaguccauacacacuauauuacagucaacguguuccaaaggccaugucuugacaggcucuugaguaagacuuuaauuuuuuauuuucacuucguuauucauuuuucacguuugguuuaucuugcuaaacuagcuugggauucuauugaucuauuuauuuccacgcacacacgcacgcacgcacgcacacgcacacgcacgcacgcacgcgcacgcacuugccuucuuccuucuuugucuucuaguuuguccagucuuguuuuauuuagagucccuguguuccuuaggcuugcuuuaccuuaauacaaauccugcugugguucgguuccacuucacacagccuagaaucaaccuaggaagagagucuggaugggcugucuaccugagagagggcuugucuuaaguaauucaugcgggaaguccacuguggggagcaccauggacuaaugagcuuggaaugaaaagguuucuccccaccccacccccacuuuccccagucuuauccauauuuugcaccgguuuuacuugcuucugcccaaucuaccaaugucauaaaacagaugugggggcugccuucuaccaagcccgauucccaugaacugcuuaagaguagagaaaucaagccaaggacaagcaagcaagagagugagcacgcauucaucugucuuggcugcagaugcaaugcaacuucucugacuccugacacugggcauuuccuacacacaugaaccguggugaccuggaauugugagcuaaaacugaucccuucuucccucaauuucuugcugucaagauauguugucacgguaacagaaaugagaacagaaugaauacuaucaacaugucugugagacugucugcugcccugugucauucuuccagguugggguccagucccucaggguacagccaugucaccuaaugacuucgguuuucugaugauaaugugccuucugcaaguuaucuuauuguuuuccccuucuuccgacagagagagagacacagagagacagagaaagaaaggaggaguuuaaauaacagaggcagagacagagaggaggaguuuaaauaacuagccuuucuuccacuaaguauuuaaacugcagaagccccuaugcuagguaauacguauacagcccauagauauucuucaaauugcauacgaugcucccacaccccugaaaucugaauccugugauaccugccauaacugcccaaauucaugaacaauuaucuucguaagcaggguuuccagaaaauaucauccguggauucacacuucuuuucauaucuuguuaauuguuggguugcuaacucugacuaugaaaaucuucugaugcuuaagaauuuguccuguuuccuuccaacaccuuccacuagauguguaaaaucuaaacccacuuguguaauuaaaacauuuccugcucuuggaaaaaaaaauuuaagacuuagagacaaucacauuaguaccuguuaggaguaauagauaaaguuuagcuacagaaaaaaauaugcaaauuccaguugcuaaagaaauagcaaccugaguuccuagaaauuauaaacuucguuuacuuauguacuuuaguauggagaugaucauggcagucaccuguauuugggaguuuuaagaaugcccaucaucuuuaauagacauccagccaugaucacagacuuuuaccuagacuacuuucaaagcaagaauucuucuccuuuaccuauuuuuucuaucugauuuuuguaugugcccaugguuaaccugauaauguaccaggugccaaugcuauaugauaagaaaaaaaagguuucuuuaaaauauauuucuagauauaauauuguccguuauaauucucuuuuuucaaauaauucacauuuguaucucucaggaacuagucaggaauauagaaaugaggucaccucccaaccaagcuguaucuagauccauacccauagaggcuccuucaagugguuuguagguauaguaucuuaguagguacagaucuaggucagucucuauaccauguugguaagaggacaucaauuccauccccagaaaacaucuaaaacacuagauacaguagcauacucuuguaauuacaacacuggugaguuugagacuggaggcucccuggggcuuacuggucaaccagucaagcucaaccaauaagugacagauccugucucaaaacuacaaaguagaugacuccugagacauggcaggaaauacucuggccuacacacacacacacacacacacacacaucccugcaccugaaugcauauauagacaagcacaugcacacauacuguguguaaaaagaugaaggccuccugugacccuuaggugaugauuaauaugauagcauugagacuuggauaaccagguguggugguuugaauaugcuuggcccaugagaagugacacuauuaagagguguggcauuguuggaauaggcguggccuuguuggaggaagugcaucacauuuuagguggguguugaggucucuugugcucaagcuccaccaaguguggaggagucuccuucuggcugcucucagaucaagauguagaacucuuagcuccuucaccugcauuauguccaucugccuggaugcugccaugcuucccaccaugaugauaauguacugaaccucugaaccuguaaaccagccccaauuaaaugcuuuccuuuauaagaguugccuuugucauuuugucucuucacagaaaugaaacccaaaacuaaaacacugggacuagaucuuaguauuguuaauucaaauguacagaaaugcauuguggucgacuacucccugacuaucuacauaaugguccaagaccuucugaguggaggauccucuaaugccaaugauaucuugaggacauuccugaaugccccugaguaaaaauuccauucaaaggaggguucucagcuuucuucucaucaauaaggcuucauggaauggcugauguaucucuagacacuucagaaaguuuggucagggcuuaggaagccccguauagaaagccagauggggcuaaguucacaucuuaggacuggcaggucucagauggccuuuugauacuucugugccucuuugcuuccucucacagugaguacuguagguccaccugccaggacuuugagaagaguaaauggaagacagccagaguucaugcccuguaaaauuuagguguucucuggugggcuucauacaaguuacauauuuauucauuguguuccuuucugggacacagacagauagcccacauaucuccuauucagugugucuuacucuaacaagcuccaggggacaguucaggccauaguaguccucucccucucucucccccucccccucuuccucccccucucccucuccuuuucccuuuuccuccccuucucccuccccuaccccucccucucccucuuccccucccucccucccaucucucuccuguguucuaagcccagaacccacuucucuccuagaucuuucuuauagggcucagaguccuaucucucuuggaguggacacucucagacuguuaagucuccacugagugcugacuccccugauauuuauggcacuauauguaagcugaucucuguauugguuuccugcacuccacauaucgugagcuggcuguccacagcucucuuucaucacagaccggugguuguuuuauaaaagcucgacucucugccucuuggcuccaccucagagccuucucuuacucuugauucaguagcgggaggaugcuuagccuacacuugcuuucgucccagcuggucugugcccugcuucaucccauccaucacccuuucugucagcaaaggucagcgaauccugcuccuucucgaggccuccggcuuuacacacuguggggauaaaacagaacuuccaagguggugcugagaaaaaugaaauugugaacuaucuuuuacuccauaggaagaaauggcagguaaagucaauaaugauguuggaggagaccaaagaagagguaauauaacauaugaccuccaguuaugauuaauauaguaacaacaaaaacuauuuucagccucauaacaaggguucuuugacagcuuuauaagacucagaaccuagacacccacagcuccguggauaagaaaguucaucacuaaaaugacaagaagggacaaaggugcccugccaaucacagagaagagagcaaugaucacauuagaguuaacccuucaguaucaaugagguaaccuuccaguuauaagaacuguaggaucaaaacuccucuuagguggcucuggcugucagagacucuaucaggguacugcaaaaccaauagacccucaccacugaguauaaugcccauuucuuuccugccugguaagccaguuuuuggcuaccagguucuguguuaguucaaagagaaaggacuuuagcuccugagcagagucagaacagucaggccuugugcuuugaaaucucaauacaauggcaguguucacuucaagcaagccuggugacacgacgaacaucaaccaaguggugucaaguucagccgcugaccacagaagggugauguugaccuguugucugcauacauaauccucccuucucccagugcaauggagggucucacugugaccaaagagaggguggguuuacucaccaugucagggacacaucaacauggugucagucaccauagagaaagcagcauguccuauauaaguuuucucaacuggaaguaaagaaagguuugguagauggcuaagcaucucuuuggcaguugcagagauuacucauaagggaagucugggaugggaacuuucagcuacagagugaccagagcuaaccuuggugaagaugugggucacauuuaugaauguucuuggucaaaguaaaaagagcggccugagcuggggacauagcucagccaguagaguccucccuacacaagcacaagucgcugaguucaauucuuagcauacaaacaagcaaaaccugggcagggugguuuguacacagaaccccugcauuagugagacagaaacacauagauuccuagacucauugaccuaaccaacaggccccaggccaaucaaugagagacucugucuugaaaacaaaagaaacagaaagcugaaaaaccaaaccaaaccaaacaagcaaacuaacuaacuaaccaaaaaacucaagcugaaaaaccaaguuacccaaggggcaauaccugaaguugucgucuggacuccauaugagcacacauauguguaauaugcucacaugcuuggucagaggaguccucaauuaaggguguacauccuuguuaguucucaaaacaaauuuaaaucccauguuuaaccccagauaauacuguuucuugccauugccaugcacauucccccuuuccaauaguguggaaaggugggugcauagaugggucuaaagccucauaucagagucccuguguaacccacaacacccaugcugcaagaugacugacugagugcagacagaauguccaugucaacagaacugagggaccacgcuaagcaaagcgagcacuggccucagagccggucuuccacucuaucccauuggccaugggccuaaaugcaacaaucugcggcugaaugccaguggagagagaagaagaacccaaaguguaggcaggcagaugaguuaugaggcaugagugaaggcucauuguauuuuauguagcucaagcugaguugcaugguggcucaugaggauucaguugagaccugggcaugggaaaggagggaugcucuccucuggcauccuuugaaccacagaacuagaagucucacguggaauauuuacaaaguaauaucuucuccuuggggauucucaugagaugacagauugugaaauaaacacuggugagcuauccaaaacacagaagcaaaggggguccaacaauauagaaguacacauacaccaugcuguucaugcaaauacuuauacacagauguuuaaaacaccuuucuucucaacagcuauccugaaauuucuuuuaaggaggguggauuuaaacaagcuaugggcccacaucaaacagaccagggaauacugcugaguaagaaaagcgucaucgucacaugcagagauuuggaugaauuuccagagaguccacuggauagaauaaaugugguuacaauagagaggccugagcuggggagauagcucggucaguagagcgcucccuacauaagcacucucaaaugaaagaauaaaagccaguuucaaacauaagcuauucucugauucuuucuguaucacauuuacaagaugauuacauuugagacaugggaaaucguuuaggaguuggcaaggguuagggguaaacagagacauaagaaggaggcagaugguugaaaagcaauccaagaugcggcaguauggauguaaacauggcccccacagacucacauguuuggguacuugguucccuguuauuagacgcguucucacgaccggccaggaaagacgcaacagaccagaaucuucugcggcaaagcuuuauugcuuacaucuucaggagccagagugcaagaagcaagagagagagaaaacgaaaccccgucccuauuuuaggagaguuaucccucgccuaggacgugucacucccugauuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacaucucccccuuuccuuuuaauaagagcaaauaggccacccauauuaaugagaguggagauagaggucaaauccccaguguguagguaaaggagccauguacaggauuagcucuuaggcucacaggcucuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaagcacacucacucuaucccgugcaaugagucuagccucgugagauguaagagcugaguggccagcgaccuauugccuaagcauagauaaccauauaucagggggagcuccauguucuaguccugcaagcgccugggcaauaaccaccuugucucuccuaguuugggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagcgacagguccaagcgcguggaguugaccugaagucucaauucccgaaggaucuguucaaauucagccauccaauucuguaacauauacugaaaaagacuuuuugacaauuuagcugcccuaguaaauuucucauacugaauggaaguaacacacaaucucggaaacuuuuguuuacaucccagcugagcuauuugccauaacaaaacuaauuguauuugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaaaaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaaaacaacagauugauuuugggcaaacuguaagauuggaugcuuuggauaaugguuaucuauuuuuccugaaaaggagguaacuaaaacugcccaaucauuagauguggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacauuuggauggauccauaacaauggcccauucugccacaaaacugcaguuggcaauugugcugucuuaaagacacacaaacugaaaggcugcgaauccucaauacguuguaauugugcauucuguaaggcuuuuuccacuuuuuguaaggccugguuagcagcuagaguaagaguccuaggggaggagauaugaggaucuccuucuaaaauacuaaacaaaggccuuaacucaguggaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuuguacauaaaguugacacauaguaggacuauuggacauucccugugguaagaccuuccauugauaccucuuaucagguuccaugugauuaauagaggggaugguaaaggcaaaucugggccuaucucuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagauggcucaauauggccuaguuuuaauuguuccucuaccaguugaaucacagcuucuaguuuuucagaggauaggugccauugaggaacccacacuggguccccuguuuuccaugguaugggucgugcugccccaauggccacuaaggaaaacccagacccugucugucuugguuuccauuaggugagaugggcucuauccuucccuguucuugauguccuaacccuuuuccuucuuuauaacccaucuuugccaugauauuuuuugcuuuaguugaauacccucccgauggggcguuuucauuggacaaaauaaggcccaaaugcugcauaauaucccuuccccagagguuaaccgggagugggagcacauaagguaugaauuucccuugcuguccuucagaggauucccacgucaaggcaauggagcuuauagugggacaugauugauauccuaggcccuguaaugaaugagaugacucuguggugggccaugcuuugggccaccaauguguagagauuauacuuuuaucugcuccgguaucaaggaugccuucaaacucuuuuccauuaaucuuaaggcggagcuuaggucuaucauuuaaagauacaaccaaauaggcagaaucauuuccugaggagcccauuuucuuuaucucagguccugcagauuuuucccugguauuaucagggaggagcagcagcugagcuauccuaucuccuuuacuaauagaaaaaacgccuuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaagaauucugcccuuuauaucccucacagagcgacacuggucagcucuaugauaaccuuugccacacuuagagcaaagagugagagucccucccuguuuaucuggagcucugcaaucuuucuuaaaaugcccaggcuuuccgcaguuaaaacauguccucugauuauuucugcccauggagcgguucugagauugaaggauggcggccgcuaagccugcauuggugagaggucccccaagcucuugacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggacaacuuuuguuaauugaccagugguuucaccugcucgggagagcgccuuccaggcccuaauagccguggaagaaaucugggcauaagcuccccaaugguaguuuguuugaucagcagaauaagcucccugacccguuaacaagucaaaaguccaaucucucugcucuggagucaaagcagcugcguuugcucgggccugcgcuugugcagcuucgugccaaagcgcucuccacuccauauauuugcccauacuagggagagcggcuuuuacaaccguuugccagucagcaggaguuagugccaugccggcgagccugucuaacugcaccaagguaaaauuagcauugguuccguauuuacggaccgacucggcgaguucuuuaauuuguaaguauucuaccggagcguggacacgcccacccucggcuccuucaaagacuggaaaugccuguuguauuuuccuuuguuccucucugggaaugaaugagucugcgcacugccucucugcgcacugccucucugcgcaucucucugcgcauugccucucugcgcauugcugacgcacuacgcagggcgggggcuccgcauagggcggaccuugaagccgacugcccugaggccaaucagcaaacuggccuucgccagccgcuuuuggcuuccuuaacugauuagcuagcacuuuaccuggcugguacccuuuuuucucauaaugagcugcuucuuccucccagucuguuucuucagaggagaauucuucaucugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucagguucaagacccguggaaaggccuguacgcuuauuuuguguaccauauuuucucuuugcuccuacucucucuccccgcuuuacuucugauagcuuguccugaauuuccucuagaauuuucagcccuaucuuaaucacuugauaacaugugaaaaggaacaaaagggcuccuaacaccagaaaaaauucaaggccaaacauauuccacuuuacuucugauagacugucuugaauuuccuuagaaaguucaagaucagacuuaccucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuucucgucccggaauucggcaccaauuguuauuagacgcguucucacgaccggccaggaaagacgcaacagaccagaaucuucugcggcaaagcuuuauugcuuacaucuucaggagccagagugcaagaagcaagagagagagaaaacgaaaccccgucccuauuuuaggagaguuaucccucgccuaggacgugucacucccugauuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacaguucccagcagguagcacuguuuggugagguggucaacuccuuagacauggcccauuugaaggaaguaggcuccuagggucaggugaggaguuauauuccaacuucucagcaucuucgucuaucaagauacaauccagcagccuucugcuccccucgccacaaccacaaauucuaccgugccuuucccacuaggagggacuucacucucucaaaccauaagccaaguaaauccuucagcuaggauugccaagguugagugccucaucccagcaaaggagaaaaauaaccaacacacaaggaucccugggcuucuacacuguugugguuagagaagggugcacacuugaugaguuguacugaacuaaagacagacagacagacagacagacacacacacacacacacacacacacaaucugccauauauuucucucccuuuccccaccgaauaccucaagaaccugucuugacuaaacuauaggccugcuucccauuuuccuugaaaauauguuaccaagaauacaucaugcaaaaacacagccuguuuuuauaucagcccacaaauuccaaguucaauaaguauuuauuuugaaaacaaaaaagauuagggacaggaaaauauucuucuaaguuuaacauuugcugaguaacccuuguugagggagauauccuauguuagaaauuacaccauuguauuagucaggguucucuagagucacagaacuuauggauagucucuagauaguaaaggaauuuauugaugacuuacagucggcagcccaauucccaacaauuguucagucgcagcugugaauggaaguccaaggaucuagcaguuacucagucucacgcagcaagcaggcgaaggagcaagagcaagagcuagacucccuucuuccaauguccuuauauugucuccagcagaagguguagcccauauuaaagguguguuccaccacaccuuuaaucccagaugaaaggcauagcccagauuaaagguguguuccuuaaacucggagauucaaucuucuggaauccauagccacuauggcucaagaucuucaaaccaagauacagauaaggaucuccaagccuccagauaagggucacuggugagccuuccaauuccggauuguaguucauuccaaauauugucaaguugacaaccaggaauagccacuacaaccauacuauuguagaugugcauuauauuauaaaucccuuuaaauaaacagaauuaacugucaucauucaguuauucaguuacaucuaugguauuauacuuaaauaauuuauggcuuuauucauaauuuggaauuuuuucuuguuccuaccuuucauuaucuacgacaagcaguauggaaaagucccuuaauuucuguguauuuacuuuuuauccagccaacucuccguguuaccuuauugcuagugacuuucacuagaauaucuuagcuucuuaucuagaauuguaaacacauaauuuuuaagugaagaucauuuuggguuucuagucacuugucauuuuuguuuuugcucuaaaauauguauguuuagaauuuguaaccuguguaaauacugaucaucacaguaaagagccuugucuaguuucugauucaaaugggaggcuuuuuaccauguugcuguuugggauaauauuggagcaggcccuuuuuaaacuaacguucuugauaaccuuggaagaagccagaggaugggauggugcaguggacagcgcacuggaugcugaugauauuggaagaucguccuacucuuuccacugcauugagggugguuucuuguguguauagugucugcuaaauugggguaaauguuuucuugguucauugauagagccauaaaguugucuuuaauuuguugcugucauaaauaacauugcuggagaauaaaaacaacaaguaaauaaagaaaugacaugaaaauuuaauucauucuaguaaauaauguauuaauaucccuucaacaaguuccaacccacaguggaugucaauuuccaacaaaaucuagaaacgucucauuuauaggcaaagacauauggagaacuuaauuauguaaauaaauucuuuauaagaaucuaggggagcuaggacugggcugggcugggcuggggguggggcugguguucaguugguagagugcuugccucacauguaugaaguccugguuuccccagugcugcauaaacagaguuugacggugcacaccuauaaucucaauacucaggaggcaaaggcagguagaucagggguagaggguuguccuuaacuacacaucaagccagaggcuagcuuaggcuauaagagacccuguccaaagaaaaauugaaaaaggaaaauggagagagagagagagagagagagagagagagagagagagagagagagagagaaaaugcauuagggagagaucucgaaaggagccagcagaggugacaauggagaacaaaauaggccagaaaaaaagcugugugguuauagcagagauaauggggcaaaagauuugggaaugacauacaauuacagacaaauaaaugagauuuuuuuucuuaaaaaaaaaaaaaaaaggaugacuagggcgaugguucagagcucaguagguaaaaguauuugccaaaaaucuaaugaugaguuugaucccugauaaucucgguguaauuggaaaacugacccuaucaaguauccuuuggccuccauaugagugucguagcauaugcccauagccccuacacucaugugccauauacguguguguguguguguguguguguguguguguguguguguauguguauguguguauuuugaaaggggaucuggggagauggcucagagaauggcugucuaagcauaaggaccugaguucaaauccccagaacccauguaaaaaggcuggcaugagggcauguacugguaaugccugggauauggaggcaggaggaucaugguggggucuugcuggcugccagccuagcuccagguucagugaaagacucuguuucaaggggaugagguggaaugauuggcuaggacacccaggauccuuaucugaccagugucugaacacacacauguaugugcauaccuccucgcacgcaagagucuaggaaaggcaugauggaccaacuuuacauaaugaaggaugcguucuuuucucuccaagaagcauucccugucugcuugcacgcucuggaaaacucagcagcgguuuugucaugccgcaaacaagaagcagagauacaggagaaaaagacugagcacccaugggcucccgguggccagcagaguuuggugugcacuuccugcccuuugcucccuagaguuuucagugucugucucuuguguagaugaccaacaccgggcagcuuaguaagggcagcuaacacaaugccuggguuccucaaaggaccuuuccaaguaggugcuauuaauacccccaccccaaguacccucuggaagaucugaacauuaaagacggccaacagucugcccuagccuacauggcugaucaauggcaaaaaccagggggaagauucuguccuuuuagaacaaaauaaguugauccuaucaugacggacauaggcugguauugcauggugggcuagcugcugggaccucauuccagcagauagggaccugaauacuagcuaggugguccuaggcacugaagucccucugcccccaguuucuccugaguacuaugaagacagccuuuguguagauacaauaacacugcugugaaggucaaagggcauuuuccccacgaagccugggugugcuacacagcaggaugcuccacccugauuggcuaauauucgcuuggucuacuauuaucauaauuuucauugucauugaaagaauuuuuuuucuaaugguucuguguaaauucucacugggaucaagaauaagacuucuaaaagaagcugcuugggugguucucgccagcuaauaaaacguauuaaacuggaagcgucccuauacagccaagccgcagagcaggccacuguucagguaagucguaaagucuucccugcagccguuucggugauugauccucaggcacgauuaaaauucaagagaugugcugacguuuuaauagaacaaauaauuuaaauacgugaaauguguuaggugguaauaguuuuuguaauauauaccagacagauuuuugggaauuuucccccucccacacacccccccccaaaaaacagaaaagcuuuaugggugagccugaggagaauggaaagggggagcuccuguucuggggagaagccauaaaaucugcagccacuugaaucagugcacuuaacguugaagagcaggccagauuuaaaaaaaaaaaaaucagccuucuccuuuguguuucuaaaaaugcuguggggaaaaaaaauagccauuugagagccaggaguggagcgaugccagcacucaggaggcugaggcaggaggauuggaaauuugagguggcuugggcugcacaguaagacacagaugcauggacacacauauacacccacaggagagagacagagacagagacagagggggagggagggagggagagagagggcaggaaagaaggaaggaagggagggagggagggagggagggagggagggagggagggagggaaggaaggagggagcaaggacuaagcauggcaugguagcacaugccuauaguuccagcacucagaagguggagcuaggaaccaguauuguagauuaaguucaaggauagccuggguuacaaaguaaguccauaccuagcuugggcugcuuagaggauaaauccugucucuaaaacaucaaaagcaauaacacccacacaaacaacagaaacaggauguaagauauggcuugccuuucuuaaaaacaaaaggaauaaucuagugggggcuggagugauggcucaguugggaggagcaguugccauuccuuugaaagacuugguuugguucccagcacccaugcuggguggcucacaaccaccugugacuucagcuccaaaggauccaacacccucugcugguuuccaagaccauccacacacagagcagcauacacauguaaacaugcacauacgugcaaaagcaugcacauguaagaauaacuaaaagaguaagcaaauacuaaaaaaaugaauaguaacuugagaaaugguucaugauaagccgauucaaagaagacacacacauacacacacacacaaacacacacaaacacacacacacacacacacacacacacacacacacacacacacacacacagagccucugauuuuauauugaaacucaaaaugaaaauucuuuccaguaaacaacuuucuuccugguuuucuguucaguguuaggucggcugcagcagggaggggccaguuucccugguaacaauacuagcccuguggcuaaacucaggcuaccacccaugaugucacugcccacaggacauggcacaaugggcuuuugcugguaccacuagcucugcaauaccacugaaaccguuuccacccaacuucuuuuuuuuuuuuuuaaaucucucuagccuguguuucaugcccagagacacaggaagguaucacuuucuagaagucauuuuauaacccugugauuuccuugccuuucuccugugccuccuccaaauggaagcagugagaggauccaggacgcagcugaucuguccucucagcuguggugagccugucuagauccuggccucucgaggacucuacgcauuuguggaaugagugguggcccauccuugccauucuucaggaagugggacagugccauguggccacuucuuccccgucacucaagacaacccaagugcccugagacccuuuugcccuucugucuagacaggcacagcagaaaacauuuaccauuaauugauuuuguuuggguaauuccauacaugucuauacaguguacucuggauauucauuccuccccccccccccccccucuuagcuguuucccaccucugccaauggccccucuuccuaacaaaacucuucugcacaauuccugagccaccgcugauuuuuaaccaaggccuucuccaaugaccacggguuuggaguuauccacuggagccuggcaggcucaacaaaggggugcacggcugaaaauaacaaccaucccucccagaauccaccaguucaggagcaaagguuaacuuucagguuucucucccaauguaacgagccaauucaagccacaucaagaguaugagggcggguuuauugagaggcagcucucagauggauucacugauucauggguagaggucaauggagucacaugcccaggcuaaagcaagggaguuuuauuggucuugggugugggguggguggugaccauggucacuuuuggguggcuuuucagaaacauggagacaaggagugauccgggcuuuucugcuugagagcagggggcgggguuugaggaagaagaacaaacgggguuuguuugugcagggguggggguugggggugggaugagcaggugggauguuuuaaauuuagagucuuuuagaguucaaacgaucagguaaaacuucuuucugaugaaaaugagaauuuugaaagugcuuguuuccuccaaccaaagauuuaugccagcaggucaaagaccuguguucgcuuuguaaaauucguuugguuuugauuuucucuuguagaaagugggagaucuaaccagcucuauuucaaacccaggacccaagcacccuuccuaguagggacauugaaagaaaaggccacagagaccuccuauguggaaaccauuugaguaacaagaaguguuucuggauaacuaugagucuguucauuuucagacugguguguugcaaccuguccccucggucaaaaguauugacauccaucuaaugacacaaguagaugucauguucuccauaucacucauccugaaagcuuaaguuuccuagauaagaggugcaggcaagaugagcaggcacacgguguucucugaagcaggcuggccucuacgccuauacaugaagacguguguggugugucuuaaucacgaauguggcaguuagcaggcugcaggcuacuugcugucuucauacaggcacagaggggagagaucugcgugaaguucaagaggaaucaagaauuggcaucguuuucugcugauuucccagagagcaagagucuggugaauuccagaaggugccaugcuggagggcacacaaaagacuagcuaagcacucaucacuaccaagagggcaaaaaauauaagggcugauggaugcuggucugggggauguugguuuaggggaugcugagcugggacugccauuaguacccccuguagaaaugaacucaguucuaagaacagcagcauccugugugucaccgaccaaagaacacagaaguuucaagauucuguuggccacccggcucaucugucagacugaauggacugcauuuuagggacauaucccuaaaccuacuuuuagguauaaugucugaguucuguauuccugggcaagacuggugcacuuugucaguuucuugggacuacagaugagaucuuuuuaaaagaaaaagaaagaaaacagguaagaagcuuaguacuuccaacagcgcugagaugcaaggcacuguaagaaaacacacaaauccaaaaccgcuuuaucaggccccauggugcgugaguuuugccaggcuuggcuggaacuguggucagccgccagguuuugaaucaaugcuggcacugaaugaaucagcagugcaaaagucccccuuggagacauuacaacuugcuuucaaacaguuuaugaagaggcuucuagguaugggccagaccaagugaaagacuuccccagcuuccguauauuguuaugguaaagagcaugacuaaaaccaacgagggagggaaaagaguauuuaagcaugcucuuccagaucccagcccaucaccgagggaaguccaggaaggaacucaaacaggaacugaaggauaaacugcagagaaauacggcuuauaggcuggccaguucucugucucccucagauuguuuuuguacacagccugggaacgccugccuagggauggcgccacccaauacgggcugggcccucugauaucaaucaagacagucuccuauagauauagccagaggacaaucugaucugggcaauuaucuaguugagguucccccuuccugggauacgucagauugacaauauaaacaaacuuguacagacaccauccuuagagccacagacauuuuucuaaggccaguucuaccuuuucuuaucuuacuguccucuccucacgggaacaccaacuuuuccuugggaaaauucaauucucaaaagcaaacaucaucuacugaccccagguacucagagaaauaaaaauaaauaaauaauucgaccagaucaucagaaugcuuccauccuccauuugcgauccuuuaacugaaaagaaaccaaacaaaauuaaagaaauuggcacauaauguccacagcuucuuuccaaagacacaacagagaacgcguucagacaccagaagaaaaugaccaacagaaguuuccaccaaagcuucaauguaacggggcucccuugaaaaauguaaagaguuuccucuggcacuaacugucacauuaacuacaggcaaagugugucgcggacauucacuuggcaguucacacgaacuaagugagcaacucuaagccagagucccacaugcaaacgaagcacgaagccccacuuccuugggauggcauuugacuguaaaucucuccugccuuugccugagcugcagugguaccaagaagauccguccuuugcuuugcuuuguccaaaaugguuuauuugcccucuugggaggcacgcugauacauaaaucccagauaugauuauuauuauuuugagcuauuauuaugaguuacuauuauuaccauucggagacagaagggauggggcacggaagcugguagaugagacagaacacaggugugacuacugagguuaggaccauccaucuuuguucagggcaguuucuguaauauuucaggagagcacagucaucaauacgagagggaguuaagaauguagguagagaaagacucugcuacgaauagauugccugggagcccgauccugcuugaauuaucuuuggcuuccagccuguuuugcucuuggcuccuguaagcuuaauguguuuacagcaccugggaagcauucgcuccccguugcauuuccugcauaccuacugugugccauggucucugcugggacugaagagcucaagacaaaugagaggugaugucgcagcuuugguaaaugacagccagcuagacaccucuagaccgaugugugagagcaaguugucuggacaggaggcugugaugauggccagacuuggaggguggggaggggacccuucaaagugucaggugacagguaguaccugucagauagauaaauggaguaaauugaucucaggcaugucugacuacuguggggagaaauccagacuuuauaaucugugcacagcaaacaggaccauagucagguggggaggcagccccugccacagaaagaugcuaaaagugucaggcaagaauucacaggaggucgaguagugcuuaaccugacccagggaaaccaagucauauggagaaaagaagggaaggcucuggacgcaguauggaagggucuuguugaaacacugcaagucccaccccaaggcugagaaauagaccgaccguuguaggccucuccaagggaaaugaucgugacuaauugcugguuuuccuaugagugcaauaccuugcucuuagaacauaaaaccuucccgaacuuuaaugguucccugaaacaauuucuggccuuuggaaaguagaacauccaagaaaaacaaucaggggccauuugaaggcccaggcaguuuucuaggggaauuauuucuggcuguggacccugcuguggaucacaggccuugggcuuucaaucacgggguugaaagguauucgcaagaauccacuggguccagggaaacgguuugcguaaaaccauuuuccuuucuuggaaugugaaccaguuaggccucaucuagaauuauuuacuaguuucauccacaaagcuucaaagguuucuuucuccucaucucccgauguugugcuuggguugcaucccccacgacaccccccuaucuuuggucuuguguuuguggaggcucaggcccagcauccucaggauggggucuugggagccugggccagcagagucacaccuggaagucauuaagaauuuaaggggugggaagggaggauaggaggaggugagcgggaggaagaggaagagaaggaagccagagggugaggaggggacagagaacggcuccaucuccuucccaacacacugaggcccuuacuccauuauaacaagucuguacuaaugacgacaauauucaaagucaacagccaacaaacugaacaccuagaaauucggugcugcuuccagauaauguaagggagcuaaugggucaagcugagugagggaaagaaggaagccuaaacccaaagagcaucuauccuaaaacuucugccauucuaaacauuguuuugaauucauuuuaauuaacauacgagauaacaggugucacuaccccguuuucacacuuaaaugaucuugugcucauacagggauuauauugguaaaugcuaaauuaguucauggucuccaagcuuucaaagaugacuguaccaaugauuacuccucuguugcuaugacaacacaucugaggagagacuacuuaaggaagcgaguguuuaaagauguucgcaguugaaggcacagauaggaucacauggcauccacagucaggaagcagagagaggugaaaaaaagauacucagcuucuucucuccuuuagccugggcccccaccccaagggaugauuccacccacuugcaggaaggguaucucugaucaguuaaaccucucuggaaucauucucacggacauagccaagggugugugugguuugcauaugcuuggcccggagaguggcacuauuagaaggaauagcccuauuguaguagcuguggccuuguuguaguagguguggccuugcuggaguaggugugucacugugggugugggcuuuaagacccucauccuagcugccuggaagucagucuucuacuagcagccuucaaaugaagauguagaacucucagcucugccugcaccaugccugccuggaugcugcccuguucccaccuugaugaggauggacuaaaccucugaaccuguaagccagccccaaugaaauguuguccuuuguaagacuugccuuggucaugguuucugcucacagcaguaaaacccuaacuaagacagugugccucacagaugcuccagugauguuacaaauuccaaggaagccgacagucgugauuggcucucucacuuacaaaacgaauuggggcaaacacuuuugaugaaagcuaacauugcuggauuuguucuugacaccuccggccaagaccaucggguuuguuaacaacgguucccucugaucuccucguuccuuucugaaaggaaguauggugacuuuuaugaggcccaucgaggaaauacuuacuggagguauuaaugggugggacacaguguaaacgugguguaucacaagaagggaagcauuagagucaaauguuccugccagggagacccauaaaauccaaggaauuuccuuccugaagccagaggauauucauauuaacggaauuggaauuagcugguagaugagaguugcaagugacccuuggcgguuuaugguaauaaaauaucauaauagucuccacucaguucccucgucucuauucuccucagggcucuauuucccuuccagauuucuuuaagaugggucagggggaggauuaauuuaauucaauugacuuguuagauauaucuugcaguuuggacaguuugcacacauaauuuugggaagugacaaacauaauugcauucuuucuagaaaggccaagaggucgcugucaucuacccguacaacuauucacuuugcaggacacuggggccuccgucauacuucuggaaacuggggggugggggaggcaugcugagucauagccucaaaucacacugggaaaggagaagucagccccucccugccugccccugaaauccaugccagcuggggacaaaaggccagcuuucuguagccagccccguggucuuacagcccaucuugccugugacaguuugucaggauauguaugagcaggggaucaagugugguccugcacucuugguuuuccugacuuccacguggacacccaggaagaaacauuccuguucaggcgagguugguagccccacauucguuugcuuuucaaaaauucaggcuuauaaugguguucucucaaacucaccacccguaguccaauuacacgugaacaugucaaauuuacauugcuaugugugagaaaaaaaauuccacaguggaaaacgaaugcugaacagaaaugcacauaauuaguguauggcaucgggcucauuuccuucauuuccacaaaggucuccaccauaaaugaaaagaaccuccuagaacauuuggccaagaauacaggaaggcagugcagagcagaaaaagaaguaggugaugaagaaauuaauaucuacccaacuccacacgcaaaaugaaauuuaagaauuguuagagauauuccaauucaaaaaaaauuuuuuuuagaauaccaguuaaaaaccguuuuaaagguaaauaaagagcaagccaauguuuuccaacuccugagacaucacuuuggcacucuacuuuuuguuuuguuuuguguuuguuuguuuguuuguuuguuuguuuguuuuagcaagaguggggauugaacccagggccuccuaccuauacguuaagcauauacucuaccaccuagcuauauguauaacuauuuucccagugcuggauauugaacucagggccucaagcaugcuaggcuugugcuccaccgucgagcuacuuacuaccuuaguugcauccuggaccucuguacaagcacugauugguccugcacgucacuguggcuacagcagguacaaucaggauagaacaggccccuccuucgguuuuguuuacacagauagcauaagcuccggccuuucacaucuguuccuucuauuucuuuuucuuuuucuuggaacacuugcaugaauugaucaaauuuuauacuaaccucuccuuuggaaaauaucaaaagaaaccaauucugauuuuggaaaaaaaaauggugugaagguuuuuggaaagaaacauuuguuggagagugaccaaggccauuacugcccguguuccacccuaauucuacaugccuaggucugacugacucccacuaggaaaacgucaccaacuacuggagcauguacugacuuuuaaaacuacagaaacaauauagagcucugcauugccaaccaugaacaaggacaacaggaacacacaguggugcuuacgucuuuuuauaagaucucaaaaagacugugccucacaugacauuaagauuaaaacaaacaaacaaacaauaaugcagggaaaguugguguacggagccuuaguuuaaauacaugaaaauggaaagcaccucuuucccuaccucagguuugaaacuguacucccccuucuuuucccagacuuuuugcuccucuuguagugugagccggggucaagguuugagagugaaugagaucuacguacccacacccacugaagaagcacauaaugggguaccccugugaaaucugugagccccuucacauuucacaaaguuccugagugguuaaaugcugagcacggagagguggcucagcagucaagggcauuugcugcucuuucgaaggauccaaacuugguucccagcaccuccagggcaucucacaauugcuuguaauucuggugccaggagaucuaacacucuuuuuuuuuuuuuuuuuuuacuucuacggucacuagacaugugcauggugcacacauacaaaugcagccaaaaaagucauacauaugaaaauaaauaaaugaaugaauuguguucuagguugacaagguaaaggucaaaguaggggaugacuggugguagaaacuacaauauguauuucauuggcuuaguacaaucuacggcuucacucacuggguuuuucacaaaguuguuaaaauaauaacaauaaauaauaauaauaauaaaaauaaugaugaugaugaugauaacaauaauuuggcugugcaucaugcuaacugggauggguggaggggaagaggggacuuuacccuagacucagcaagcuagaaagguuuccagcaugccugcgacuucuuuguauaaacgucaugcggaggcagaaggaaaagcucacggaggcuucugccugccaggauucugaaaucuaaggagaggaacaaaccccaggcaucccugaggaagcugaggcgaaggcgcagccagcaggcccacccaccacaaaccagguccuccuccaucugguucaaaucccagugugaaacacgcugaugugauaaagcguuagaccuguuucucuuggccacugggacaauccagauacucgcuuucagaggggccaggacgucagacaggacaagcugcacauucgcaacugaacucaaaguucaagaggcugagguaccucacucugguaaagcacuuguaaaaggcuccuugcaaagcacuuuacaaaugacaauauauaaggaggaacuucaaaggguuauacgcgauuuuuuugguuguuuuuuuuuuuuuaaggaacaauaaaaaggaauguuuaagggacaaagagaaacgacagagagaaaaaugucccaauguugaggacaaauguugaacccaaaguucagaugguuccugcaagaccgugggagauguggccaaugucuuuccugaauaaaugcuggucauuuugaaugacagggcacuguucacuuaacaccuccuguggcuguuuucgguugucuguccugaaggguucuagaaaaagagaaguauucuuaaucaagauucaucaccuacaaguuccaaagcugagagucaaccuaaucccgccugagagaaagcugacgucugcucuuucagguuuaccacgcugccuuguugacugcaaacaaaaauucaacugacggagugggaugauggcuugugccuuggaccucagcacucaggaggcagaggaaggagggucaccacaaaugacaaggucaaucuucugcauauaacacgcucugugccagccagggcuacacagcaagacccugucucaaaacugagagaaaaaacaaccuuauacagccaagugagguuuuguagucuuucaggggucccgagaauggcucuguuggcauuaguagguaaacugcugggcgagcauggagugaaauccccaagaaccauauauaagggugagagcacauaccugugaucucagugcugggaagguggaggcaggaggauuccugagacuugauggccagccaguauaaccuaaucggcaagcuucagacuuacugagagacccugucucaaaaauuaaggugcagagcaacuggagaagacaaaguguugaccuuugaccucuacucccuugcacacaggcaccugcauacauaaacauacauauagauaugauugcuugccgauacaggagauacaguguuagagcuguuuguuuugggguguguguguguguguguguguguguguguguguguguuucugcaugugcuggguagcagagcagaaggcuucacuguagcuuaaacaccuaugccugcugaaauuuaauauuugaagucaguuccuggacaaagagagcacggaaggagcaagacaucuaucccucaagcacgacucugaacaccacacggcuguagucaguacaacgagggucaagaguugguuuaugggcuccuggguggccaaccuuguacucaacucuagacauuccuguggccaugccauccaggaucauuucuucaaauuuccuaagcuguucaagcuuacucaaggaucuuauuucugaggggggagaaaucccacaagcagcaguccaguuuucucuccuaaguugggagaugaguuguaaaacaccucaaauccuccaggguuuggaggauauuuuuguuuugcccguuuacaagcaaaguuuccuuccuaggaacacaucucacucaggggcaaauggugcuuuugaggagaacuucuuccuuuugauuuuguuacucuguuucucccuuguauaaauggcccuccaggacucaaugggccaucaguaggcuacuagaagugccauccuuucaaggagauaacacccuacgugguaggaagaccuaggagguagggaaacagggaagaaaaugugcugcucccacauuuguuggaggccugucaucucaggacuuucucuggugacugaaaaugcuguggucucuggauggaacgcaauccucaccccuuccuacugcaagggccgcagauccuccuggucagcccuccggcaguaacucauugccuuagaacuugagaauccaucggagcagccagggaacaggccuucuuaaugauagccccgugagaacccaucuccacacucugagaauucccauuuggaugaggcucgaacuggcagcacuuuuuuaagucccaaugaauggacuguuguccuagguuacucugaguuuacuugugauuggagugccuaacugaccagccauugaagaacagaccaugugaccauagugucugcaucccccugagugggaacagaacaccacacaggacaggcaagugcucugcaaaccuaacucuuaguuuuuauaagucuucccaaaggaccucuaggaaucucuaaguaaccucaggcacaagagaguauuuucccacccucuucaagaccugggcuucauuccguaucuacauacauaugcacgguggcaagugucgaagcagcaaagaaggaacauggggaugccgcggaugugaagcccauaggagaacucacucuuuuccuuuuuaaaugauguuuguuuauuuuguaaguggguagagucagcccaguguggguggcgucauucccuaggcaggcaguccugaagugugugagaguggagcuucccacaagguagugacuuaagguaauuaauugcugcaagccuucugucacugucauuucccugaaauuacagacugcauccuagaacugugagcuacaguaaauccagucuucucuaagcuucucuuuuucaggguaucucaucuuggcaacagaaauuaaauuaaggcaugaggagaauaagagacaguaaugaggggugaauacaaucaaaguacauuauaaacgaaccugagaaugccaucaucaaaaccaucaccuacuuuaacuaauauaugcuaauaaaaacauauaaagggggcuggagagauggcucaacaggugagaacaacugacacucuuucagaggacccagguuugauuccuagcucccacguggccgcucacaacuaucuguaaccucaguuccaggggaucugacacccuagucugaccuccacuagcaccaggcaugcauaugguacacagacacacgaggaagggaaaauauucauaugcauaauuuuuaauuaaacacuuaaacuuuuucuuuaaggaacuuacuauuaaggaaaauuugaaguguuccugacaucuucuuggguguuaagccauuaaaauuucugaagcaucagacuuguuaccuacaaagcacuguauucuacagucuaaaauuaauguaugcagcuuuaaaguacaaccauccacuaauuuugcuauuauuuuuaacaaucagauagcuggagugagcacuccuucacauacaaccguuuaacaucuaggggugcccuaaaacuacaucuuaaccuuggaccaaaaaguugguaaacucaggaccaguuucuucuccccuacugucucuuaaacucaucuggaugcuugcaaaggcuggauagcaucaagguggaccgagccacaguguguggccccaucugcagagccauucugauaaagauuaaaccuuucugcagagacaggaagcuagacuucucuguuagcauauggaaaauuacaucuuuagcccagagaagggucaccuuugcugcauacuggcuuacaguugugccuuugugugggauaugggaugguaccgccagccuggguuuccugacugggcaauggaaacaaaaucuucacuggggccacuuuuuuuuuuuccuggucacauagugaacuaacuaaugggaagauaugcauucugcucucuugcugcugauuucaaccccaccccugcuagcuuacaaauauacuuuucaaaaucagauguacucaccuuaacacuugaggaacaauuuggauauaguggaagacuagaaucccaccaguuaaaugaaauccauuugggggaaauaaagccccugccacuucuuucccacccuagcuacugccguagccaacaagucagagagccuaggacggaagagaaacuggguccaaccuauuccaccgcacaacagcuaugugagccuggcagaacuacuuaaccucuauauugacccuuaauuuucuuaccuguggcagggacaauaaaggcuuuaugagguuccugggagcauuuggaaaauauacuuuuaacuauuuaaccuauuuuaaaaaaaaaaccaaaacucuugcuuuuuagagauuugggacucgcaaaaugagguguguggauaaccuucuaugggcuggcaugguaggaaagagcucugacucgggucaaggaaaaggggguuuccauaaugaacaguagguucuugcucaugauggcagcaucuucaugaagccaagaccagcaucuuccacaucucucugccuuucuuucuuauuggauaacagcccugaguagguccaaaauaaccgucagcauuccccugccucauaugccacucccaguuccuccucagcaacaagccucucuggugccuuuuucuucucuugcuucuacaucagcucacgucgcaacacccugcccaguggacaaaggcauauugcauagauguguggccuugggucuguuuuuuucuucagguccaucuucuguggcaucaaaguuucuccucuaggauauucgggagccaugaaccagcuuccuaccaacgcagucucccccuucuccaccugagggaggaggccaagaaguaccaccccccauccuacacugcacaaugggagggguaacuagagcagccucuggguggggcaaaugguucccaucucuaaaaaugaccaaugcaugcaucucuaggcuccauccugcaaaucugcucuggggcuugggaaauucugucugcaagagguuacugguggcagcacaauuugcaacagugggagauugggaacaacccaaaugucuaucaacagggaacgaguucaaugaauuaugaaauaucugugcagggacauagucaccgguuguuaaaaaaaaaaugaagacaucauuucuaugcugauuuggggccaucgcuaagauauauugucaagugggaggaaugaaguaugcaugggacaggaagaacauuaagagaauaacacaucaucgcaucguugcauaaaggugucugugagaaugcacaaagaaaugauuauagaguuucaggagaagaguaggugagaaggaaucuguaggcagagcauaugugcacguacaaggaugauguauagcuauaaacauagacauauccacacgcugucuuuuguccuuuccucuuugauauuuaaccacgagaagacauuucuguccaaaaguaaauauuuuaaccucgcaucuuuauuuuaauauauguuucuaucuugugagugugucugugggcgugcacaucucucucucucucucucucucucuguguguguguguguguguguguguguguguguguacucauaggaaaacccaauaaauacuugacaagucaaagagaaacuuagguaacaaagagaugaugauaccucucaugagguagggauuaugguagggauaacacaugaaaauaaauguacuuaaaauguguauuuguacuauuaucaguaacaauuauaacaugaauuuggcagauuuucucuuugcccuuagaacgaugggcaugauagucacucaaacccucucccuguuaaagcugugaaguacccccaugcaagggagauacaguggagucuugccagaaccugucucauugggagacacaaugacagacugaauuccagucaaagcuagucucucugcacuuggaugcaagcugaagucuacaucaucucaggcuuguuguuauucaucucauaagagaaugucacuugaaacauggccagauucccuagcuguuauaaggucgggauuuagguaacaugcucucuucuggaggcuucauuugcaugucccaaaucauucucgcaagccauuuaucucccgacacuauuggaugccauaagcauuuaggaagcauucuugggguguuugaaucaacaaggcaauuaggcagguuuuaaaggaaucaaaaauacaauugacagcacuuuggaaacaucgaugagauuuucagccuggcagaccacgcaggcaguggagcguuugugaggaaauuuuaacacgauuuuaaauaugcaccauuuggaauuucagaauugauuuucaaacugaaaaaugggcagagcagagagccccaaauacuugagagaaauauuccucuagaaaaaaaaaacuguauauuuggagccagaaagaaauagauuuuaaucccagaugugugacaagaaaaugagcaauuuugggaaagccaauuauucucugagaauuuguuuucucgcauuuagaaaugaggucagugccgccaucuuuaauuaucauccacaaguguccaacgugggccuuccuccuuauucuucuccacuuuagggagcugcacuggcuuugauuuuaagaaaacagccaagacugcaaacucuguaagugcuucaguccuccuuaccagagagcguuaagacaagcacugucaaggucugcuuugcgacacuaaauagcauaaaccgaucugccauuucccuucugcagcccacagucacaaggauggaagagggcugaggcccaugcucagagcuccgcaggaaagauauguaaagauggaccccaucuuaccuagggcgagucaaacaagguggucuuuggaugaccuguuucuugugauuaacauaccuggauaaggaaacucaucucauugcuauuguugagagcacaggggagcagagauguagcucuguuggaaaagcgcuugcugagcaugugggaagcucugaacuugguccccagcaccacauacacugggaauagaaaaucccagcacuugagaaaaggagucaggaggaccugaaguucaaggucauccuacuacccagugaguucaaggccaaacuuggcucuauagacucguuucaaaauaaaaccauaauaauuacuuauguuucacuaugguuuccaauaaacuagucucucucucucucucucucucucucucucucucucucucucucucuccuuuuuuuuacuucaagccuaugaauaaaacaaacccugucacuauuggagauagacuuccacuccagugcggaugcuuuuaagaccauuugccaaacacgcugcaccuuuugaccaguucuggggcagggggcaugcucuaauuacugauuguggaguucgguaucuauagcaacaggcagaauugacaacaggaagcuuugcccucuggggcaccauccgaaguuuauaaaaucaacuggaggccaaggcuauauaguuaaucaggcgggcuuucggaggcaggagcuccugguccacacuuaaacggcaaugagauuauuuaauaagacaaucgcaggguuggagacggcagcguuuauuuagcugugcuuugcugggccucuuguaguaauuccuccuaauggcaccgauuucgcuagugaauccaggcggcaggagagccgggguaucgguuuaaucagaccccgacacugccuacuucuaaagggcugcugccacgcaucaaucucuucuacuugauucauuaaucggauggcgaggggauaugaauuuccccaggaucaagaaugcugucugacagaauucuuuauagcaucucuguuuuuaaccagcauucauucagugcacucccuuuauuucacguucccacagcugacaggugaggaggcucuggcuucuagaaaacaguggcugagaggaggggagauccuagagaccuggggcucaggcuauuuugaucaccgucucugcuuccuaccaaacagggccaccaaagaguuguugguucccuacaggggucucaaugucaucagucauuaauuuuggggaauauauauauauauauauguauauauauauauauauugacauggaacuauggagaacugacacaagagugcgccuaccacggugccuggaaacaggacgaaagcacaugguacacuuacaggaggaccggcacccacugaaaagggauguguggacagagacggguagaucacggggcaucauuggucagccacccuggcugagucagguugcucuaggcucagagagggaccuuauuucaaaaacuaagguggagagugaucaagggagauauuugauaccuaucacuggcuuacacacacacauacacacacacacacgcaugcacacccaccaacccauaguuuuuaaaauaaauuuuaaagaagaaucuuaaccagugucucuuuaucugccagcuuugucuuccauggcaagaugguugcaucuaaaccauuuugcaggguaaaguguuaagguuuauagcaauucuauagcucugguuauaccugccuuuguaauccuaaaaaaggcauccaugcccagaucuguagcucuuauguccucuuccaaggccagaggaagcgaauccccaccagguuucauacauguccaacuccucuuacugauaggacacugcggcuuuccuggcccgcccucuucucucauauacagcgggacucugauugcaaccacuagacaggcacagacuugcagugacaggauuuggccuccucuuccuuugggaagagguccuuuuuggaaaguucagauuuuucuguguguuaacgaagacaaaggaagaucagaguggcccuugguuccugcauugaaagcaguggcuauguggauguugaggccacagaacacagucauugucccugcccccuggagccucagcugccauuucuguggcuggguuccaggagacuuacugcauggggcccgccauggaaaggaagcuagcccaggcuguaaagccaaucaguuucccaagguaaggauaaaaguggcugagguauuguggccccuuucuccaaaacagcugccagauccaggccuuccacaugucgacuuggccucuucuaauucuaucuuccuuagccuaggccuagauguuuccauacggacaggccugggugcugaggcagaagcaaagacggggaaauuuaagcaaggaauugguaaggagagugggaaagaaggggguguaggaaagagagagacugggaggaauaagagacagggagggaggggaagugggaaaagaagagaaagaauguagaaagggagaaagaaaagaaagagagaaaaagagguggaggggagggagaacuagaaggagagaggaagaagggagaaagaagaaagaaaaaaggaaggaagggagggagaaaggggggaaggcaagaaggaagaaaggggaaauggaagggaagaagggaaggaagcaggaaggaacaggaagaagacaggaaggcuccucucuaacaccuuuuccacaccccaacucuccucuccuaacacuggagaccaugaggcauuuggaagcuuuauugcuucaauaggcaggguaaggagguuaaugccagccuuaacaagggagucauuucuuucucccucccaccuucucccuuuccguuuuuuggcucagccuaaauuucuaacacuaccuggugaaauguguauauagcuuuuaauuguacccagagguagcacaacuucauagaggguuugcagcgaguggcggaggauuugagaaacagcuguguucccggcccgcgugcuccgagguggaacagcgccgucagcaccugcacccgcugagcguacacccucacgccccacacgcgugugcacagcugggacccauccggcuggugaggaauuaauacucuuaacuugguauuuuauuguaccugggggagccugaugcuguauuaaauccguaacauauugguuggauuuguucaguauuagaguuauugggggugggauacuggggcgggagugggggagauggguuggauauugacacaaacacacaugcaaacacacacaugcacauacacacacacacacuugcgcgcacacgagcgcgcacacacacaucacaacuucuuuuucaauugaggacaaauuguuuuaauaucucgauguucaguuuauuuauuauuagagacgaggggcugcuuuuggggaugaauguagaauucugagacuguuucuucucaguaacuuagcaaugccagcuucccuacacaagcaguuaaaacaacacacacacacacacacacacacacacacacacacaaacacaucccaaaggcagagaaaauuuucagacugaccaaagcagaagagaccaugagaccacaaaagagacucgaaccaugcuacuacaagucaaggaacggugagagcuaccagaagccaggauaggaaugaguuacccucuacuaaagccucugguaacagugucacguucaggcuucuuagcccgaaaacacgaguucacaaauaccuauuuuugacucccuagcuucuggucauuuauuacaguauccacaggaaaugaaugcagggucguuugcucuaagcgccaugugaaauugauguugcuguuaauaagagucccuggcaagaggucacugcacacccugggcacuguggaaggacagaaaggucguccguggaaugaagaaugucaugcugcucaugcguggccaccaggucucgccuucaaggacacaggaguuuagugucucagagaagccagucacuaugagccacaucuccaagggggauguggggaagggggcagugugcugaccucucucuucugaccacuucccauccuugcuggacuguuuucuacacguguaccuuuggccagucguuacagccccaucucauucccugaccagaucagcaguguguacugcaguuugaaugccagggccccugacaagugcugaugcuugcuugugcaccuagcuaccaggcaucuccagaaaacccgaggguugcaggcugagggcccccaguucugagagaggcaccaucuccagaagaugcuacugucaagucccccagaacaugaucucucuuacauguccgcuucucauccaggaauauauggaaaucucuuuagauggcaucugauccaaauggccagguuaaugucacacacaaauuaaauuuuugcucuuucuucagagucuccaauucucccucuuucaggcauuaaacaauaagccccccccccucaaaccaacaauaacuugccauuuguuuguuuauuguauuaggaaugauuuuuuuuuaagaauaugcacucaauauuggcucagagaaaccagacucuuaaaggcugauuuugcucauuuaaauugcgaccaaucuuuuggaaaagcaauuuggcaauaugacucaggaaccuuuaaaaaaaaaaugugcucaaccuuugaccuaguaauuccauuucugggaaucuauccuaagggcauaaugggaacucuauggaaacugcuuuaugcacaaagauguuuaucagaacacucuuucugacagcaaaaguauuuaaaaccauuuaaaugcuccgugguacggaagaggauaaacggaugcaucccguccaauaagaaccgcggugaagucuuuguaacaacgugauggaauguauaaugucaagaaaaaucugaagcagcgugccagaugugcggaggugggugaucgcagcaugaagacaggaaaaaaagaccgggaggcacacacauguuaaucgugguuacuuacaguagacagagugcuucuuucucucucuuucaaagauaaagcucuucucugcugaacuugcaugugcacucuuucguuggccacguaaacaauucagagccuacacagucuuuuuccucuguggcuucaacuuucucuaugccuguuggaauagucuuuacccugguccucuaaucccuggaguguucucuuaguucagggucuaagauaggaccagaggcuauccagggacaaucuccaggcacguagccuuggugucauuuguugauccucggcgagagccugagacuuuagcuuaguuucuggcuuguauugagucuccggauucugaccauggaguaauugauggccacugaugauuuguugugguugcuauguagcauggagacaagcuugugucuuacuggucacaaaaccagcugaaugguuuacuuccuggccccccucuggccuccagcugaaucccacacccugggugaccucccuugcuucauagaucacccuauaucaaauaaguccccgauggauaguuucaaggaacuauccugcccuccccccaauuucguaugugcaccucuaugaauugugcucauaccgguggagaaaaagaaaggccuggucaaagagaagaggagcacugcccaccaacagcccuuggggaucaaggaguauaaagaacaggagcuaucagguugccaagguagcugagugggggauggaaccccgcccuguggggacaaaucccuuuccugaugggaggcacauggggucauguaaguagggcagaaaccagcauauggcuuugcuggcaaggcaaaucucaucccuguugcuguaauccugugggugagcugaugguccaccuuccuucaagaugggccugccuccaagcuccucccucagugucaccagggaacaaagauaaagggaguuggugggcuaccucuggccucugucuauggccucucacugucugaucugccaugcuccugccugggguugcugguugauuuggcaggaggguacaucuucaggaacucuuggguauguugaggaaggcuacuguguucauuccucugggugggguagcacacagccaacugcucaagacagcagaaauggacucuuuggcaguucagagguccuugauaucagaauccaggugcucucagggcugugcucccucggagccucuaagggagaacuauuccucucucucucucucucucucucucucucucucucucucucucucucucucucucucucucccucucucucucucucucucucucucucucucucucucucucucaucauuccuuggcuuauggcaaaaucauucucuuccauauucacaaaccagugccuauaaguucauaagcaugugggcaucuccaaaucgccccccccccaaaaaaaaccaaacuccugcuguugaacuugugggucacccuaauucagugcacccuccucuuugauuauacggaaaagaaucaggaaaggcaggcuauauucacaggaacuaaugacugccccuggggcguucacuucuggguacucuggcuccagucuucaggcauucauuacaauauauuuauacuaagaaaaguauacauuccuucugaaaugucaauuugggguuucaacugaugggaguacaaauacaugauucacccccacaaaagauuuauuugcacguuaaacaccaguugguugaacuuuuuaaguuguguggguucaaauccuggcucugcugucucuagccuagggauauaggggauaucuaaugaggucauaugcuauucgagcucauugccgaacauguauaaaucacccaaaaguacauacgauggcucacccuaaaugcuaagagauccagguuugaguuaacagcacacaguguacucuuggcauaagauacuccauguaucuuucuuggacaccuuucuucugccucccccagaugugcuccuauccccacgggauaagcuaaccucuccccagccuccaaccuggcccuuauugacaucuauucccccccccaaaaaaucuucuugucaccauggugaaagugucuugguccaauaccugcucagcccuuccccuagcaagcagagguuggggucccucuggcuauguaguugcucuauguacucugaugcccccuagggcugccucaucaaauauaggacacccaguuaaacuugcguuucagaaaucaugaguauuuuucuucacauaagcauauuuaaaaucuuacccuccccucucccccgcccagaaugcacacacacacacacacacacacacacacacacacacagacaccgaguacgcagaaagagauguccuggcguaaguucucaggagacagcaggugggcagugagugagccagucccauggugacuucguuugaugguggguuuccccugugccaucucccucaguuuuccagguggauuuuucuaaaaucaugcguaccccaaagaaaccauuuacaaaagcacuugcaauggcuugcuucugcuuccccuuccuccuacuucaaagaaagcaaggcugggcuccucuguguucugaccucucaucucuguucuccagggcugagcuuguguguuugcccuggagccuucugcaugauugguacaauuccauaugcaugugcuuguguguucagucucucuacaccacagcuccauugugucuggaccguccaguucuccagaagccuguccugggcuggccugguacaggauuugacuccaggaugaaugggaaaaccuuacugauaaauacagugucugcggaugccaggaccgagacagguucucaucuguauacagcugcagcuacacaggccgcaacaucugcccgcggcuuuaggucuccauaguggcucucguucagacuugaccuuggggugucuccuggacacuucaccccaguucccucggcuguaaaaugaggugcugaaaggggaugauuucucuggugucuuacggcucuaaacuucuaugacgcuauauucuagguaauaaacuuuauggcuaugaauaaauuaauggaaaugaauauuuaaaugaugugcaaacauuucacgagagugcuuucuuagucuuuuauguggugggagaagaggagaaaggcugggaucuaaagggugggaaauagcuucaucgguacaaaccuggugucuuauuccucugccugggagaggaggguguguacaacgggauucucuagacagccuuagagagggggaaugucaaaagaaaugucaguuucuggagaagccagaagcccacaaaugaauggaugucccaagucuuaggaaacaguuuggggcaccaggacauuugcaugccauccaucucgcuagcuccugcaguccgucaagauuuccagcuggacaugaagggaugggaaccagacacauggaagcuuccauggguuuucaaggggaccugcuaccugccagucaauuucggaaggaagucuaaggcaggagccuugacugugguaacuauaagugcucaagaagaaagacacacugaguguuagagggaggacuaccuaaguccuccucuuaggaggagggagcugggaagagggagagugcagauucuccagaccaagccuaggcugugauccgaccuagguaggggucaggcaagcaugggaagaggcaaaguguggcugggaccugguugagauaccuagcaaaaaggaucaugcuuauggguggcacuuagugggaugcugugagugcaugugggagugcuccaccaagagagagccagagcagcugagcuucacccguuuacaauccauaggcagcaagcucuccaacccguaucuuagugccugaguggcuuauauguucugaguucuuguuguuuccagaagacauacuccaaccuccuaguacugggaagucuuucuaugacugacccauuauucccuacagccaccgagccuugggaugcucuugcugcagagccucugggaugcccaugugcacugaaguuccagcugggucuccuggcaaauccccaucuacagauaugugcuaacccgggacacguccugaugaaggaagaacgaggcagaaccaccauuucuguuugguuuguucauuugagaccaaaaaaaaaaaaaaaaaaaaaaaaaaaaaaaaaaagaaagaaagaaagaaaaagacaaaucucaccaugcagcucaggguggccuugaacucaugaucuuccugccccagccucccaaauacuguggcuacaaauguacacugcuaccgcuauccacagccagugcagaauuaccuuucuuucuuucuuucuuucuuucuuucucucucucucucucucucucucucucucucucucucucucucucucucucucucucuuucuuuucuugaacuauagguugagcccagggccuugcuugcucuaggcaagcacucucucauugagcuaugcccccagccauuguauagguuuauauugagacguggcaccuuugaaugucuuaugcuggccuuuaagucacucaguccgugagcuaguaaugaaucaggcaugacacaugugugcuaccaggcccgauucaccacuuccauuuucugaccaugaauagcaaguugggaaguaugcaguguuucccuaugucuucuuucucauaaaaagcacccucaaaccaaggacucgauucuuauugugcugauaagacagcccagagguuguaggucauauguccggcacucagcugauggagagcugagcagagauaucaaacaugauccaaagacucugggaccaacagcuauuucugcuccagcuuccuuccacaagcaaacacuucucugcggccaucgcacugggacggacccucacuguccugcugacuaguguacaaaagaugaaguucccagcauugcugaaaggcacggaaaagaggaccuuggaauguggugcggaggggcugguggggacuaaaucucccuucacaccagaacaagaaugacuugaggggcaaaguauucagucucuuucccaguuagaacugggucagauauucuagcagagagaauggcuuguucucugcuccagcuguuaucugagcuacacagcugggggcggggggugggggguagaacuccaaccugcuccuuggacccagagcugaaggauucuccaggcugcauuugauggccucuggcagcuggaaggaggaagagaguggggguuggcggggaggggagaacagaaugcagggagggacaggcacccucguuucuacuagugcaaccaauuacccaaugagucagaucuaccugccucacagcugacaaccgggcgaacauucauucucugccagauguucacgggugagaagcugaauuauuuaaaaggaccccccaagcagccauagggaacgacgcugaaaugggagaggaggucauggguaugacgugauugcuccauuaaagucuugaaaguccgacuguggggucagcccuagcucaacaucugccaggcuagugauaaacugggauugcucccaaaucccugaagacaaaaaaaaaaaaaaaaaguaucgggggagacccuuuccuuugcagcguuggcacuuucguuucccaggaagcugggauuuuaagcuaguguaccacgcaaaaguuccacuuccaaacaaucccaguacccuccgugauaaauccuagcccuuagcaccgcgcgugcgcgcuaggaaggcuggcuucacucugugccgaucacugagucugccauaaaugcaguagagagagagcuaccgauggcuucccagauagcccguucugcacuucaagaauucuggguucuucgagugggggggaaaaaaaggaaagcaaagaguuguuacaugaauuucauaauuuagagauaaauaaugaacaccaaacuuggaggaaaauacccuaguguucauuuuauuuaauauucuccauugguggaaauaaauuaaaaaugaacaaggcuuguuuaugccugccucacauugcccucuacuuuuugaauagcaaccgcauauuaauuugccagaucccauaaauuauaauuagcccggaggauuaacaacauaaauccuugaauuuaaaaccaaccugccugcuucucucuucccuauacccuaaaguaaaaaagggccauaaaaccuaucacugcuacuugauccauuaaacuccggagacauucuuauuucagcucagcuacuggaggcagucuuugucaaauccuuuuuuaaaguuacaguagcuugauaggcgcugggaaucagggagaugaggaucugugucaacauccagcagagcgcacaaugccuggcagccaggacacugggagauagggcccagguacuaaacagagaugaaaagugggcccggccccgcccccaccccacugagccccaggaugcaaaggagacacacaagaucauaggccguaucugacugacauuggaagacaagcauuugaagaaagacuacaccaaauuugaaaaugcuggccuugcugauggggagggugagcuuuuuuuuuuuaugagugggcuucagggagugcuuucuccaggggccggguggauggauugguugguaguguuugccauauaagcaagaggaccaggguuugauccuccagaauggauguuaagccaagcacuuaggaccccagugcuggggaggcagagauagacaggucccugaaacuugcuggccaggcuugcuggcccagcagauuccaggccggcaaaagacaccuugucucaaagaagaacgagaaaaucauuuuucacgguugcaaaugaaagcagacugcuguuauguagggaccauguguguccaugcccuucagagugggccuuuucuaaugcugucccuagagacuugaaagaagguaaugguccacugaggacccauagcaagucccuggccacgucccauguaaaucaccccaauagguguccccuucuccuauacugcucuuuccugguuuuaacaggaaacuacacacucaacugugagcuacaccugaugguucuccucccucacaagauguccuccugguugaggacacuagguuccuuuuaaguagucuccucauucccagagaccagacuugcucugaggagacagccugcuggguacagagaacccugggacaggcccccucuaaugcugugucuugaggucuggaaagcuuuggugacauuggguugcaagcacacgugaauauacaccacauacacacacacucacacacucagguuaugacaugcccuuuuaaauauaggauacauguacaaaaauuauaaauguucuuauaucacacacacaaaaaauguaggcaugcuguuacuucauccucaaauauguuaccauguuucaagauuugaaaggcacugcccuaacauagcuccuguugccugccuugagacuuccuuugaguucagcuuuagcaucucccaggagggaggcaagaugguuauuuaccaucuugggcaagguccuuagugagcuuuaccagagggcgcugcuaacaugagacaguucccuuaucuugugacagccauugcuugugacacccaaaucauccccucuccauucuucucucugaaauuuugaccaucauuguuauaaaugaacccuuuccuucaaagacagggccaccugccacuugcucuguccuacaaaguauaccuacaggaaggucuucagacauaggcauagcauccuugguuuaucugugcuuuuuacacggagccuugggcucaucgcccuccuguucaugcugaugauacagagaugggaugccuuugacagauccaauugguuaaguaacauacuuaguaucaauaaugauugaacagcuaguuggagcuggacuggacagguaauuuuaaaugugacuagaugugcuaagaucuuuaaaaugaacuguuagcaaaagccgaacuucccgucaaaccagagaacacagaaggaaccaggcugucaccugcccuucaucuacacaacgaaacaggcacucuccaaaggggaauucagagaccugggaggggacugggacauagggugaucgaugucaugagaucugaggaaggacagaguccuggugguauccacugagcugcugagcacugcccacuaaugcuuuugccucucaguugcugcauugcccugaagguauuuuaauaccugugcagggaggagaacgguugcuucauacagaaauuaaauacauaaauuaauagacgccucuccagaaagccuuccaaauggggaguccagcugcuucagggacucuauagucaauaggucaaagccuugcuuaauguauagggaaagacagggcagggauuaaagugaucugagagguucagcagagcccagcaauuacauccucagauuuaacugcuuaggggaccuggugccuguguauagagaugcugaagagcgauacggcgggucucaccaaagccaagagacaaaggaaaaggaaagccauucugaaccugccccccuugcguucucuuugacaagggcaaguagcuagagauggcagaagucacagggguagaauaugggugccugagacggugagucuucuuugcugucaacuugacuguacuuagagcaccucagagacacccccugaaugcgucugugaggauguuucugaagaggaugaacugagaagagaaccacuuugaaagugggugguaccaucccgcaggcuggggucuagaaccucccuuucugccuccugguuuacccaaacggaagccuccccauccgguaccggcuauagccaugccuuuuucagcaugauggacucgacccuaaagccauuagccaaaucaaaccguuccucugccaggccacagcaacgagaacagugaccaacaggcccagggaaacauucugcccuuuguccccaucaaagauuaagaaauggaauaccaccccuaaggaaugacucugacaggaaugaucuagaaagaucccuugggcuuugaggagaaacuaugaaauuuaaaauuauguccauucacuguagaaacucugugaucccugaauuucacccguggccugaucuauuugcugagcagguaccacguccagcugcugccuggacuggcauucuauacauacauguuacugaccaagauaguuuucuucaagguuuucagaaacucuuuuacuacucccuggggacugaauuucaggaggugacuuccuccaaacaaaggcaacaagagcucuugccaagccugcgagaccuggucguugcugauugcaauggagagcagcccuccucaaauccuucauaucugcucuccucuggcagaucagugaaaauccacagguccaagauucacaaagguaucaagggaaaggagaccccagaugagaguaagcauccaugugccuguuccuuucuuacagacaagucucuugucuaagguaucucuuguccucuagucuaaauaguugagcauagcaguagugagcauuuucauuuuucuacugacgucuuuugcagaaggaauuuaggggauacucaucugaacggcaccauuugauacaaagucuacaagcuauauaagcacccauggcauagcucuccuuggucaccuauuuauuuuuuaauuuauuguccccugugauagggaaaggggugaacugcuuccaugggcuaacuucuuuagaauaguacgguuuaaaccucuuacuccguaguguccugcaagagucuucuacuuccuccaaaguauguacaguucuuucauggugguauacauguucagguaugugugugcuuguguguagauguugugugacaaaacauuucuggggagacauucugugguacacaugucuacucuucccugauaggggaccuaggacagaccaaagcacagauaccaccaaucuguuuuauggggguuacuuacuggaauauggauuagggguuccuuacggggcaaagaaauggcugaagaccucugugucgccaaggcccaucccagaacaggaggcaucucacaagagcugggaaaccuggagcccacugcauaaccugcaggcagcucaacagguuggaaaaugcccuuucuaggugccuuacuuggucuaaaccuuauugaggcagauccacuaauuucugcuucuuucacauagcugcucuugucuccagcgucuucuucacagcucuacuuccuucuuucugagggagacucacaacauuuaguguuuauucuggcagggaguggccuggugaaucuugucaguuucagggacuuccugaagcuauuacucuggcagggaguggccuagugaaucuugucaguuucaggaacuucccugaagcuauuuugaauuguuuacccuccagcccaaggagcuuccaugaaguauggaauguguaagaacaggguuucucucgugaaaccuggagcucaccaauuuccagagacuuucuagucagguugcuccugggaucuucuaucucugauuucccagagccuggacuagagauccauacugcuggauucaaagggaauagguuguguuguuguuguuuguguguguguguguuacuaacugaaccauguucccagccccacuaaugcauuccuucuugaaaacaaaaccauaaaacacugcucuuaaguaguucaacugucuauaaugaaguaccuagaaaguagauauaaaggacacagaagcagaggguaaauacacacagccccuccugcuuucuaaaugcaagaaaaauagggggaagagugggggaaaggcaggcaguucuguucagaaaguuucuaucuuucacuuuuucuaggaagcacagaaaauucuguggaccuuggcuucagugcagcccuuccuccauuggccugcaugaaaagccuuccccuggacaguuguaguuccaggaauauccacugcacugacuuaaacucagucacucccucuagcuggggucuggaguucauauuuuuuuaauccccuugcaaacgaccuuugucauaaaauaauugggggaaauuuaccagauuuccaguucugaaaguccccuaccugccaaaagagucucucagucuugcgagugucaucaggagacuggguuaagggacacggauaaacagaaucuuguucauuucgcaauacugggccaccauucacgucaacagacugggcuugaauucacacacagacacacauguacaaaugugcacacacaugcgugugcgcacacacacacacacacacacacacacacaaucucuucaaagaccucucuacauaaagagcugauuaaagugagaccaacuuucaggaacucuacuucauuucucuuuccagaacaagacugagaauaacaagcagaucucccggguagucggguagucguuuggagauguggucuauaaaaaggguccucgccaaacucacccuagguacuuucccuuuccuccccuccaguccugagcaaccuucccgcuggugcuaaguuuauugaagacauuauuucagaccccugcagaggaagaccccauugggucuaagauacaaucaguauucuugccaguggccaacucaucaguaaaucucacugucuucuacucuaaaagggagaacuugucugcucuaugggggaccggaaaaaugcacagugcuccaaagggaauggagacuauuucugcaagcccagccuugguuccuguguuauuuuaauugcagcccaguggugccaaggugcugaagcaccggcuuaggcugagugcuuagcuuggagguacugaauuaaagugucagaacaugcagaaaaauugcaacgcggccugucaagagcauuuguuaagagacacggguaaggcuggugacuuguguagaaaaagagccgccuucagaaagccaucaaagcacagccuggaacuaaugggguauucagaggucuuguucuacuucauuggucaaagccaacacaagccuguaagauuugggcccguuugcuguuuauuacugugguaauaaaggcuacuuaaagauacaagcccaucuuguauuggcucagacccaagggugccuuuguaaaucggaucgcugagggcucacaucucagguuauuugaaacaaccuuuuuauuuuauuuuauuuuauuuugaaaagaaaaugaagaaaaacuaagacucccaggaaggaugauacaguccucuuguccucuugauuuuauuucucucucucugacauuuuucccccaauuuuagcaccugcccagaguugguuagauccacagccaucugggcuaggccacagcuuccgauugccccaucaaauaugaaucaaggucuucuugggaagguacauggcaaagaugacccaaguccacagucaguggccuuucagaaagggccaucacccuugacaaucucaggggaccugaaucuagaggagagacucuauccaggcaucagcugcagcgcaaagcaugaugggaguccuggcuuuucugcagaggaacaauuucugaccugccuaggcacucacacaggcagagaagggaacucuuugcaguuaauacccuaauaggcaucuaucucccucuugcucucguucuguagcaggugcuggcugacucauagcccucacauaaucucuucucucacccuucagucgccuaacuuuuaguugaagaucucaaguuggaagccuuggaacuacagauggcucgcaucccuguuggcccaugcccauguguuuauaaaacacauuaaaaauaaaagcaagaugaauuaguuggcaacauugaaaacucugaaagucacacacacacacacacacacacacacacacacacacacacacaauuuccauuucuuagaaacaaauaaaaaaaaucagaauacuuagauaguccuagaucugugucagcuaaaaugacaaaucuucauccccuuucccagaacacagggccuauacuccaucuccaucuccaucuccaccacucccuagugucucccaaguacaagggcuaauuguuguguaccacucuauauuguuucucuuucuacagagacaaauacauuuuuaucaaagguagauaauucaaaagauagauugggaggguuuuguguuucaugugaaaaguggaagauagauguuuauuuccagaagaaaaaaaaaaagacuauuacucugcauaaaguuuuucagcaguaugugucuggaauagccuuaucgauccacaucaugguuugggcuuuacugaugggcaaauauuauugguaaauacuucuuaaaucuuucacaguuuaggggagaagucacgagggagcaaucucuguuuguuguuguuguuuagcagaggaggacauggaugugaucagggggggggaauguuugcucaauuaauggcacauuacacauuuuggagaaacugacugagauguaacugggggugggggugggcuaaggaaaggaucccaaggccccucuugcuaagcaauccuugaauguauucuucugccccuggugaccuugcuggguuagcuaaugagguuucuucgcuaagaugcaacaaugugauccaggagaaaaaaaauucacaauguaagggcaaggcuuuggguuccaucuccauucuccaucugggagaaggcugugacucaguuuccuuuuuuucugaaagaagagauauccccagauguacauccacuuggaacaguuaaggcuuaauccuucaguaagcacauaaguaugucuagaagguaaggcccaggagucugauuuuuuuuuucuuucaagcucgcacaugauucugaugggcagcuagguuuagaaucggcugagcgauaaacugucucuagguuuugcucuuuuucccagaucaaaaaaucccauguaccgagcaucagauucugcaggagucucuccagacgguggacaggcaauguuccaaacauauuaaugacuucggggaugcugggauaugauuauaaaagacuugaagcaucucuaccacguugccucagucaccuggcaggaccccacuuaccgucugacuuguaauuucugugccuugguggcauggaaaucccccucgaaguacagauccgagacaagaugcagagguccaaaucaauugguccagaugugaucuuagaaugaagggccugaaauuugcccacuucucucauccugagacucugcacucauggccagugcccacugcuuaaaugcuaggaccuuuaaaaugugagacaugaccaucuguuuuaaaugcaggacaaaagggaccuuuacucccccaaagaucuuccagaaacagaaucaaauuguucaauguguaccccuagaguaccuaccuaacccccuucggagagcaguuuugaauguuauccuucugagaacucagagagcccuuucugguguucagagggagagaguuauguggguuuuuuuucuaaugcaaacaaaagacauuaggaagcacuuggagcuuaugauagcucuguggugcccgagauuuugcuuuuguaaugugugacuauuagaucacaauguugguugcaauaaauuaucacuuuugguuccugcuaauugcuagaaucuucugccaugggcuauaauaaugugagccaaaaaagaaaaaaaauuuuuuuuggacccuaauacaaauaugcauccugcuggacugugaauggcacuuuggaauuugaauaaaugccuaaggaaacagcuggagaugggagccagagcaucaaagacgucauuaugcaauuauugagaaaagcaggaacuuuggggaagagaauucugacuucucugcauccacugacccagugugacacccccucccaauaucccgggagauaauccuugccucuaggacaagaccucgccagggaggugaacaugcacucaaguuuuuauaucuuaagaaaaagaacccaucagugaaaacauuccuucuauuccacagaaagcaaaacgccccccaaggggcagccagcagcucuucugugcuuuucccuggcccccuucccaccuccauccagaucuucucuugucccugaauuguagagacaucaguugaagcaucugggcagagaucucugcuuccaaacuagagguggcuugguagcuuggagggcuugcuguucuuaggggauuggaacuugauuggaaguacugaggcagcucacaaccgcuuguaccuccagccccaagaaauguggcauccuuuucugucuucugggggugcccacacacuuguaugagcacauaugcacacacacacacacacacacacacacacacacacacacacacacacagagagagagagagagagagagaaaugaugaugaugaugaugaugaugacgaugacaacgacaauaacaagucuuuugcuugguaagugauaaccauauuggccucccuuuguguuaguauguauguagcucaucuaucuguuuaucugucugucuaucuaucuaucuaucuaucuaucuaucuaucuaucuaucuaucuaauuucuuucuuucuuuuuuccuuccuuccuuccuuucuuccuuccuuccuuccuuucuuuucuuucuuucuuucucccuccucucuucccccccccuccuuuucuguuccuuuccucuaaagaagacagucucaccaucauccaagacagauggcuggaguccuagccacuuuggccuugucuguugcuugaugacuuaccugccauuacuuuuuucugugccucaguuucuccaugaggaaguaaaccugauacagacuauggagaagcagacauggauucauaggggugaaaaaaaaaagccugaaagcagcuugcuuuccuuggagaaacaucuaugacacaggacguaggcucuuuuguccccaucucuuguggccucucccacugaagagaaacugcuagaaaaagaaaaccccacuagagguuugcaaaggauuguacaaagcagaccaaggcaggggccuucuggaagcauguugccuugaguagauugaguauccgagacauaggagaccauuuagcaauaggaagguaggcacagcauugcugagaaaggaaggaagagaauuagccuugcuguggguaucaaaagucacuuuaaagggaaucuagaauaaaccagaagcaaguagacccccccucccccaaucucaaagaaugcagaugucaacacugcuacugauugaaggcaggucccuccucagggaggugagaagacauucuccuaacagcagauccagcuuggacugauuguuaugaaauauaauaaggcaagggggaguaccuggccggcccaugccaaggugucucucugagaaauuacaccaugcaauagaucugguauaaaaggguuuauuugagaaagggaguggggagugaggaccuggagaagggacagaggaguagacauguagacagacagacagacagacaggagcaaagccaugaggggggagaagggaggggacagaggaggacauaaaaggggagagaaagacuagccugcgaacauuuggaaacagagagagacaacugcgguggcuagcuguccuuuuauacaccacccacaccggguggaggguggcagguaguggcagcagaugaugacauaagccguugccaggucccuaggagaagccuacuggaaugccuguaagcuaauacugaugacccugugggccaaggcagcgucagguguccagucgcuaaauaucagcuccuuuaaugaaggaaacaguauuacucacaggacuccucuccuuucauugcugcagugucuauuuaugauuucuuuaaagaggaaagagucggucuuuccuucugccacauggguccuggggaucaaauuugggccaucaggcuuaucggcaaauacuuuucuuuacucguggggacaauuugucagcccugacuuuuuuucuuuuuaaagaauuaauuucagauggauuuuugaaaaugauacuggaaugaagcuauguuauuacuuguuuuuguuuuuguuuguuguuugcuguucuuuaggauacagggaaugugcaucccccugccacccccaaguaaaaacaguaacaaaacugugaguccaucauggcauucuggaagcaaauccaccaggcaauccuuuacaaacgagaacguguauuccuagguucacggcgucaaggaguacauuacuuuacuccgugcugcuacaaaacacuggaaagaggcuacuuaagagagcagagguuucuuugagcucauggcgcagagggaacugugcaucguuguaaggaagccacugcaacugguccaugguugugagagcuuacagugaccucauacuuuaagcacuaaagccagaguugggcaggguugcaauccuucaagugugcucuugguaagccaagccauugaagccacugcuccugccucagacaucgggcaacauccccccaaacggugcucccagccuugcaggaauaugugugcuggaggggauacauuuuagaugcacacagagcaagggauggggaaauaagaaguguuagagguaaguaauuuaucuguguacauuaugcagcgacuuuugaaggaucccuugagucgacauacauucuccguuaacucgcucacucauccgacagcccucucuggcauuauucucuauaacaaaaugcucuagcuuuccuguccuuugucccugcgaagaaaggaaugaggcgaguggccaggaggcucucuggugagacuaagucuuggcugagucacugaguuuccuauuuaccacuucugcuucaaacagaucacccugggggaugaggagaacagcuggagagaaacuaucaucggucugggaaagaggagcaggauuaauuaauaucugauuauccuuuugauguucacaggaguuaccaagagcccacccuuggcuucugcugggaaauccgugguaaaacuaaugucuugauauuaguugugggugucugucuuugagcaagcaggguccuggggccuggagagccaagagcucauaagacaagcuggguccuugcucuguguguguugcucuguguguguguguguguguguguguguguguguguauguguguguguguguuuguguguguguguguaggggauggggccggcugaaccacugcaauuguaaaaugacucuuccauuaaaagaaacagccauccggugcagcauaagaacaauuuuuaugcaaauaaaaauuucauuuaaaugaaacaagaaaaaaaauauugggucagaagaagccacugaacacgucuuuuugaucucauaauugaagguauuugguuuuguuuuuaaugagaaaaugcaaaggaaagcacgccagagccccauccuuaaagcaaaacuauuaccaauacauuucucacucucauauccguucucaccauagugcacgugccugcacgcacauacaaacacacacacacacacacacacacacacacacacacacacacgcaacauaauucuuguccagaugucuuucuuuagaauugauacucuuuucauuaauggagacugguuauaucacaguaauuaaccaauccuuuaucuuuuuuauagcugacgcuuggcuaaauaaaaagcgaaagauaguguuuuguuuuauagauuuauaaaggcugaggagagcguucagucuguagacugccugcuaggcaagcaagaggaccugaguucaaucucuaggcccacuucagaagucagcugugauggugcaagugcaacccuaacacuggaaagggagaagcacaaagacggcugugggucaccggcuaaccggcuaaccuacuuaguaaucauugggcuagugagaagcccugucucaaaaaaacaaggaugacagcugaggaauaaugucuaagguuaaccuguggcugucacaugcuccaacaaagauaugaauacguagcaaugcaaauaggaaagccacgugaucagcgguaagagcaagagcucauguauuuccauguuuagugucagggaguaaauuuacugggggcuucacuuuugagagggagguggagaaaccccuuucagugagcgccugaaaugucucacaugggagugaccucugaagacugugucaugagaaacaacacauggagagagcucucuaggcauccucaucucuauucccaguccugggcagacucugucccaaaaccugucccagccugaaucauaauucauuacuugccaacccuaucuucugcuagacaaagagcaucauaggauuuaguuagaucuggcugaagaaaaauuaccuaauguacuaacgagacaugagccucuucccuggaucggccugagacccacgacccauuucaggguagugagagcuuagcuccugggagaugcaugggguuucauggugcagagauggggacaaagggagcuuggggucccaagcagagaaugaacugauccuuuagggucaacugagugauacagcuuauggcucuguuaccauaguggugaaagaggaaaacaggccaacgggcugccauuuuauugcuaauuucaagaaagccaguacaauggauuacuggcucccaaaggcuucuucacucucuguaucuauuuagauuuuaauauuguuagagccuuaauaaugggcgagcuaaacauguguguaaugaauccuaucagucacaaacugauccuugcacccaaggaaacuaagaagaaaucccuucuuaaaacacacacacacacacacacacacacacacacagagagagagagagagagagagagagagagagagagagacagagacagagagagacagagagagacagagagagagagagagagagagagagagagaaccugaaaaggaaguuauuugaauuaugcacuccuuuaaggagaaaaugcuaucccacaaguggagacguccacacugaaaaacagacguuguucuauccgagauuuucagugagcugcucuaucaaaugaguaagagcauucuuaggugggcaccacugagucaggcacuagaagguaccuuucagguacuccuuugcaaaggucaaacauuuccagauugugcuaugaccuuuugccgggucaucucagguuccagaagccaagauccuagauucccacaacuccugaugucuucccucaugaagauagaccuacaguggggaacaaagaacugugcuccugaaccuauggaagagcacaaaugugauuccagacagaagccuacuacugaggccacagugagcguacaaaucagugugugccugaaagcaggagaugagggguugaaugggauucgacgaguucugccauuguuuuguuauagugggagaaaauucaaguucgagggcagcauauuacagaaaugauaagcugacauuuggcacaaccaaauaagaccuuagggagcucuuaguguauaacugggaacaauccacagcccguucaagacuuucagagcaagcaguggccaggacuccugaauccugagguccacugaugcacacgccccagaacuuugguacuugguggcucccugcuccacuauacucugccucugccucuguuugcagcaacuucccacagaaaagguuccuucgcacagccucuagagugagcuucuaguuuuuagcacagacuucugaaugguugagagcacuucucauucccagacaugauuuuuuuauuuguuuucuccuuucccaacuaaaagaaagugcauuccccaaaccuccacccugccucaaggguuuugucuagcuguuccuuacugaauaugaucuugaauaaacacauauuaaugaucgaagggauggguggguggauggauggaugauagauggauggauggauggauggauggauggauggaugauggauggauggauggaugguugggcuagaugaccaugaacugugguguaugccucuagacaccuguguacuauuuuauagcagagagagagagagagagagagagagagagagagagagagagggaggaauguguaaggacagccucccaugaggcuagacucauacccugacccuggcccacucagacccaccaaguuaagaaauagcucuugaugugccuuccaguaacauuaauuguuggucauaaaacuucaaagcaacagauauuuauagcuugauuagagcccucuuuuuccacagacccucaccacagcacuuuccagcucaguucccaugaguguacugaaaacagccuccugcccacuuccugucgaagccaguuccuuaaccgcccagguccugaggcuggcugcccccucccuuuuguuccagcgugcagucuuucgguuucucuuggguuuucucgguugguuucuuacuuuuuuuaaaaauuucuucacuccuuuucucaggcacccagauccccugcugaaccacccccagagucggcaugucaacaggggccauccagugagugcacgauggugcccuucucaaaacagccuuccaggggaaaacaugcuuuuucugugaaguuucucaggguccuccagacuaaaauggauaauggguucacucuuccuggaagcuugagagaccggaaaaauacugagcuagugcgacaauucaaagauccuagccagaggcaaccccuaguuugaguauagaaagguggaguccuaccaucgagugagugugcuugugugcccuaccuugcgugugugugaacuuccaaugucauucuuuaggcacucauauauucaugcuguuugggaguuuauuuuguugggggugggagugggggcuuuguuuugaggcugggucucucacugaguccuggggcucuucaauucuucuaugcuaacccacaagcuccaaggauccauuggccuccaccuccucaacuugggaccauaagcaucugucaccaucccuggcauuuuuuuuaaaagcauggguccugagaucaaaugcaggucuccaugcuuacaaggcauacucuacagauagggaaagggucagaagcuagagagauggcuggcucagaaguuaaaagugcacacugcucuugcagaggaccugaguucggcucccagcagccacugcaggcagcucacaaccaccuguaacuccagcuccgggaguuccauugucucuggccucugagaacaccugugcacacgugccuaucucccauaggcauacauguuguuagaaauaaaacaauuuaagguuaauaagucugcuaggcagcuagaacaugacagagacaucuccugucuucaccuuccagaugacuuccugaaaacgcgauuuuugugugcaccuuguacauugaauuuuagaaggguaugggggugccaagcuaauuggacuugauccccuggcugauagugguuauguucaggauauguugaguucaucaugcucgcuccccaaguuuagcauuaggaagaaaaguaaacugaaaagcuacacaacacagggucuccuuugaagggggaagguaaacugugugcccauucagcuuuaaaagggagccucaugggccuucauugcugucacuguucauuggggggauuguggugaauucucuuugaauguugggaguucagcagaggguaaucucagcagcccacaagagauacuaauuguggugauuaauaaguauugugugguucuaaacaugggccacauguuagagaagugauauacccacaauuggaggacccucucuguagauauuaucaucugagaaaaauggaaacuagaguggucuccacgagacugggcuagaaaaacaaaaacccuuuuacuuucgaaaagaaacccccagagacaacacugcaucccuuggucugauucuguagcaucuacauaggcucagaggauguugguggccuugaggucagccucuucuucagucucugauggaaaguguugcugcucaucaaccaggcuugcucugagaccacaccccagugcuuggcuuacccugccuuuguuucauguggaccuaagacucuaggggauaaggguaucaacucaaauacaagucuacugugcaugguguguuacaggaaacagccauggauggucauacccugcuacucucuacaccuuaaaaugugccacccaaaaacuuugaaaaguaagcccaggagcuaacaguguuaggggacagauagagugaucccauaaaaaguuuucuucuuuccacaucaucugaggaagucagugguagcuucuagugggggggugggggggucaaaggguacaaucucagccuguggaaucagauuaacagggaagcugaagagaugguggauaagcagaaagggcuugccuggaugagagaaaaacucagcuguugcacauugugguagagccuuggguucaguauucaagugcagaacauucuaguucauucuagagcauuccucuagucugaaacauucuucaacuuccuccuccucuuucauauuuguuuuuugagaacugggucuuauauaacccaagaugaccuugaaauuucuguagagacaaggaugauuugaaaccagaucuuccuaccacuacuuuccaaugcugggauugcaaggguaugcacuaccacaccuggucaccuauuuuuauagagugcuagcaaucaaacccaauuuguuugguuuugcuuuguuuugcuuuuuccauguugagcagacucuaccaauggagcaauauuuucagcugucuugcucuccuuucuccaugcuucacacacgucuaaagaaaaacagaagccgguggcacuauuuaucuauuaauuuauuuauuuacuccauuuagacugagggccucuuuauguagcucaggauuuccuguaaauuauuuuuaaaggucagaacucaugaccuuccuaucuuaacuuccauugugcuauaucucggguaugugucuuuuccauaccugcuuccaagccauucuugaagacucaagugauaguauuagaauuauagaauuugcaccagaaaguucuggaaagcuugugaauuugguugguccuuaccauacuaccuuuccccuccccucuaagcauuaaucaucccuggggccucauggaggucccaagguaucaguccagagacuaggugugcagucagcaaggcagccucagcucuucuuucuugccucucuugucauacccacucacagccaugggcuuucugggcucugaagggucucaguagggcacaagacuguuguuaguuauguaugcuuauacucuacacucaucauccuagaaucuacucuugggcacaggagagaaggauucaccuguuuacaaugacaacauaucuugcuucugccacgagucucuauaagucacuucuccuccaacagguaacauaggggagauuguacuccagaucuucagagcacgucacauagucauaauaauaauuuguaauaagaaacuaaaacucacagguuugcgaucugccuuugaaauucugugaguaucaaaagucggagagcagaaagguaccucagcuucccaagggaggguucugacaguuuuuugaacuucugcucugugacaggaauuuucauguucacacucaaaagugacaaugugaucacuuuaaaagaaaaaucuugaaaacagucaaaacaugaaaugugaguuugguuucuuucuuacugaccauauuucugcugcuaccucugaauuccuuugacugugguagaacugugguuaauacguaauauauucguagacuaugacauauuguucagguagaucauuauaacaaugauuuaauuuugaaauuaaaaaugggagacuugguucuagagcugaggcuucaacucacugguagaccaguugccuagaauguaugaggcaugaguucaauuccugaguacucuagauacaaggaagaaaacauucugcauuuggauuacauuuaccuacuggucuuugcauggaugcaacuuguugaaaaaaaaacugcuuuuccaaugugaugaggcagcagagaggggagaaacacaagacucaaggcugugcuuacaucugcccagugaacugugagauggagaugcccuuucucauagcucagcacaacagagacccugaggggaccuccuaggccagcagagagcaucauuugucuauuaagcacuaugucugguccagccacccaucguguuuuugauggucagcuuuguaacaggccagaggauaguuucguaguuuuggccgcugggauccaagaguccuuuagagugugacuuuggaagaaagcuaaaacagucaacagagcugccaagagugccaacgaagaaggguggcauugcugaguuugugccuuagccuucgaauccugacagaucaucaucagccccugcugugugugagagagguagccauguguagcccaggcuggguuugaacuuacuauguaagugaggaugacccugaauuccugaucaaccugcuuccacuugggguuucaggguugcaguauaggggugcaguaccaugcccaauuuuacgcauagcaggguguccauuccagagcuucauacaugcuaagcaaauacucugccaaccacugaacuacacaaccagccccgcuucagcuuuauauuacuaaaagccuaacuuucuccuuuccuuccuuccuuccuuccuuccuuccuuccuuccuuccuuccuuccuuccuucuuuuuucaugcuaguuaguaacugaacccaaagauacacugggcgagggcucagcuguuaagcuauagccucaacccuacuucuuuauucuuuguauuaaaugugaccaacccuaacucauggaauuaaugugaacguuggaaagcggguacuuauaaacugcuugauauaagccuauuaacucuaggauucauuuauucauuuauuuuaugguacugagaauugaacucaaaauuuugcuagccuuagguaaaugcucuaucacugacuacaccccaacccuuuuaauuuauuucuuuguaauaugagauagggucccaguacugcccaggcagaccuugaacuuuaauucuccuaccuuuagccuccugaauagcuaggauagcagguauccuaugcaugugucuuggaaugguuucguucacuuucacuauuuauuuuagguaguuuugucauucauuuugaucaggacacauuacuuacauuguaccuucuuucucucuguucaacacuccacaaagucagugucccuccuaagcccuucacuaggaauaauaagcccaucugcggacagaagagucuuucuucaucuggccuucugcaugccaagcgcaccaccagagcuguggccuagcucuuacuugggcuucccgaaccugcuucuuccuguuucucuguggcaucucaaacccucgccaccagaguguaaaucaagaaguuugcagugaucuggcuuugcuggcggugccuuaaaccccaggcgagugguuaaccaagcagcccccacagaaacugcaagggugggcuccccaauggggaggcaaaaauucuuucuaugaaaaaugcaaagcacgaccucauaaaaagaaacccaccgcaggaagauggagacaugucagcucgcauuaaaacgaaacgggaagaugaacauugcgaccaucuggcaaaagacccucccuaggaaaacauaaaaguugccaaggaguuaagacaagaccucagugagaaucgcugaacuccacauggcucucuuugcacuugagucaaaacuuggagugaauucgggggccggguguuagggacgagcugauuguaacgguguauucccucggugcugugcaguugucucuguuuggcuuggaacuuaauugccucaucaugcauuagaguuuguaacacauuuggaaggagguuggagucauaaucacacauaagcagacgaauaaaacaaugcaguguaaaguuuuauggcaagagaggcuggguccuauugcaggagcaaaugccucugaaaucucagcaacuggcaacaaaggcucauuucccccacagucaguaggaaggcuggcagggaaacucaggugaccauggucaacacagggacucggaagggaaagggcaagacucacguggacagcacauuucuggauucuggggccacaaaaggagggugagguagggcucacagugacucucaaauucuuuccuccuggacaugaaauaugugacuguuggucggauucuauugggugaaccaaaucacacaauuccccguuauuaagcggaguuaggagguaucucuacccuguguucugaaauaggaacgcuguaguguuugaugguagccagagugaccaggaagauucgauuauggaggcccuaauauguuggagcucuuccuucacuuuauaucgucuaagcuuauaaccgaggugagaagagccaaauggcgaaggccagaauuccaacgcccugucuuaacuaaaagugacaggggaggucacucgcagcucucccauacagaguucagaauuagacaagcuucaucuugucccccugaacuccuuaaaggagacccucccugaacucggugugcaccucugcuaucauuuauguguacggugggcaacacuuagcgacauccuaaagaccaagcugcccgucugaaauggccuaugcagggggggcuaaauguguuaagauccaaagcccuggcuggcuggucauaguucaugcaggagguaucugcucuauaccuacgaauccuaugaagauuggccaggggccaggcacacugcuucuuuggucuauuuucaacccuuccacaggucuagaaaaugcccccaagaagucuccauugcuaagcaccugcuugccccaguccugugccagggucucacccuuccccguuuagcucucagaucaaauccaugcacuugguauugucucuacgcuacagcggggaugcuaccccuugucagcagcagacacggggcugaagcaaacugacuuucauguugcuuucaauugugcucaauuuuuuucccuuuuucagaugccugucagggaagcagaugugucauaagcuccccgguguuuaacccaccagccaacacugaguuaagagguucugaggccugaggcuacaguugacaaugcuagcauuccaccuggccccggcggcuucauuucaacagaccgauugugacauaaaccacaccguugugcuuauggaauuucucacgaguggucucccggcgcucgguuuugaaucuuguaucgacucucccuuugcuguucagccaacaucuugagucuuuuuuuuuuuuuuuuuuuugcuaauguuucauucugagugaaguugccagucagagugaaacugagguagggaaaggggucuuaacccgcaggagugggaggaagcaaucugcuuugucacucauguagagcaaagugucagccuuagaccagaggcagauagaugacaugagaaccuacugggcaaggcagcucugugucuuauauggccugcauuggcggggcgggaggggaggcgggcuuagcuuccugguaauuguuaucugccuguccgucuaaacugccugccuuccuuccuuccuuuguucuuucuuuccucauucucauucucuccuccauuucuuguguuccucuuuuucuuucucguuuuaagcaagggccuuaaguaaccuaagccggccuuauacguccugugaaaccaaagaugcccuugaacucccgaucuuucugcuuccaccucccaagugcuaggauuaaggggcaagcauagucuugccuagcucaugcagugcucgagaugagcccagggcaugucaggcaaguacucuaccaacuaagacauucccagcuccuuggguuucugagcuaucuauccauuaauaugccccccccccauuuacauggacugcagugugagaagccuggcccauugaagaaaccaagggacagggugauuacaauuuuugucuagcuucauaucgcugacgggaaaguugggaaugauuccagaauauaagauccaccucccuaggccacaccacuguagaaaugaccacaagaagcagcuuuucaauaaucaccuuagagagagcaggaaguuucugcccaguacuccucugggucuucuuccucccagagcacuugggaaccacggccccuggaauguguaccaagagcuccugcgauaaaguuguugcaaaucuagaaggcugaaaaaaugugaguggugugugugugugugugugugugugugugugugugugugugugugugguguaugucugugggugugucuauguaugucagugucuaugugucugugccuguguccuuguauaccuacauaugauaguauucacgccucugugugaguuucuguguuugugcgucugucugugguguaugucugaguguuucuguauaugucuguguccauguguuuguucuguguguuuguagguguguguuaggauccacaucucugugucaguuuaugugugugugucuguguguauguauauuuguaaacacaacaaccuuuuucacuacuguauaaugacuauauaagaagagcucauuugaaaaggaaauuauuaauuuuauuguuuguuuucuuuugguuuuaacauaggguaugauuaucuagucuagggauccacuuacuucagccucugcauugcuggugcuguaggcaugugucauucauuagaucaggcucaaauaaauuaccuuaauuaaaaggaauuaaugaugccaccuaauuuuaggaaaucuguucucuuucucuuaaaauaaaaacuagaaucaucuaagaaaauucugucuucugacacagaaaacuugaucaagguauacaugggggacucuacucauccuuucugagccucucauaagaauuuggaguuuggaguccaugauacucuguaugcuguuaugaauggcaaaaucauaaauagcagcaugcaaagucaguauccuaugcuaagagugaccagggggacgagccacuuuguuauggacugcaugggaccucccaucaccaaacacugauuuagcauaauaucccagucuucucugucuccacaggcuguuuuaguuggguucacuugaaaaguuucuagcgguugcagacacuaaagcccacaagggcaauggcuuucauauuucaauccuuguuguaaucucagggcuuggcauggucaagaauaaauacucaaccuauaucugugggagaaaucaaaucagguaucuuaacucaaucaauaucccaggugguagaagggacagcuugaggaucaauuugcuuauuuuucgucugccaaauuuucuacauccacucaaagggguaaagcugugcccagagaggcauauguuucaauaacauuggugguuaagcgcugcucccucauuccaaagacagguguuugaagaauuugcagugucuguaaaauaaugguauaguucccaguugcaaagacuggguuagacauaaaugugcccuaauaacugugacugucgucagauguauaaagugucacaggguaagaaagugaguuaggugguggacagggaaaggaugagugaaugaaaagucaaggccaaguguuuaaagaucucugaggguuacagaguauggcaccagcuuauaaggggaaaccgggauaaugagaaccaguccaaaagaauagcuggggaaggggcaaccaacucgaagggaagacuggcuccaaaugucacaggggagaguauucugugguggauggguggguggauggauggauggauggauagaugggauagaugaauagguggaugguuggauagauggaugaguggauggauggauggauggauggauggauccauggauggauccauggauggaugggauagaugaguauaugaaugcaugaguggauagauggaugaguggauggauggauggauggauggauggauggauccauguauggaugggauagaugaguagaugaaugcaugaguggauggauggaugguccccugaaagagcagcaagugcugaguuauuucucaagaucuuggggguuuauuauuauuauuauuauuauuauuuguuuguuuguuugauuggucuuguuuucugucugguugguugguugguugguugauuugucuguuuagguuguuguuguuguuguugagguuguugaggcagggucuugcuaugucgcucuggcuaaccugacguguacuacauagcccaaguuguucuuaagcucacaacagucucccucagcuuuccaggugcugggcuuccauauaugagcaaccacacucagguaaaauuugcuucucagggaugcaauucccuucuuccagggaauucauccuccaugauauuggauaggauaagggaauacauguuucuaugugguuaagguuaaaacuggagcuuugggcacuguucagaggaugucauucaugggacguccaaguucauccacacuggcaucaccaccccuauaaaacauggccauagucuccaucccgaguagugagacccaacaggcaauuuagaagccacacauacccugagcagaucugugcugacagguuuaccagggacaaaaguucaaccuaacucacaggacuuugucaaccuguggaauucaagggacaauggagacagcaaauauggagaaagucagaccaggggccaggaguuuaagggucucuucacauuguggggagccccaagguuaacagcucacaaguguuacaccccaaaacuuucacaguagaugaagacugaaaaacgaaaaauugucuagacgcaaagcuccagaaggaacuugcguuuucaucccgagcccuggguagguauugaaaaggaccugucuaucaggugagagcaucucccagaagggccacaaagaaaucauaagaacaggcauguccagaagcugggaaggaggcucgcaugauagcacacuggguugcaagcuggagggccugaguuccaucagcagaaccuaccuaagacaucugggcaugguaggagaagcuggaaauccaagaucuggagaggcagagacaggcggauuccuggggacagcuggccagaaagccuaacccacuuaccaaggccccggagagugagacucugccucagaaagcaaaugguggaugacacgugaggaguacgaccugagaugguucuccacauccacaugcucaugcuuauggugcacacaccucugcacucacauaugugcgcccauccucaggcaaccauguccucacccauaacacaaaaggaucacaggucuaggagaaaggaucaggagacaggcacuggagaagagcagagguuaacuacagcacccccugagaauauuguacgugaacagucuuugcccagagucccugcaggaguuugggagaccaaccuccauaucugauuugauuuuuuucccccuuaaaggauccuagaagcaagcaacguuaaaaguaaagaaucuggaaaaucauuauaugugaccucugguaugcaauauucaucaauaaauugugagggacgcggaacucguggcucaaaggggaagaaaaacccgggaccauuuaaggacacugggcaaggcccucccugcgauaauggaacuuuaagcauuugacaauuuguaugcugucgguaugugcgcguugagccucccaaaccccacagcugcguguuuacagaggagacgucguugugaauugcauccuuaugugcuguauuuuaaaagcccauuuucagccccuacuuagcuuccucucagaaauaccauucaagucgggucucugagcaugccugcacgcuuuuugugugcuccccccacccccacccagccacacauugucagcccuggccacgguaguuuuuccccacuguguuugcucuggguucccuguuccacgaugaaacucagaauucugauauuugucagcacagaaagaggcugagacuuggguccauugaggaggugggcaaagguggccaaaaaaaaacagguuuuaagucucucaucugggcccagcagggugcccaaguauuacuggguucgguuuaauauugaaaagccuggguuuagauguuagagagcagacacugaaaaacagauuuuuuuuuuuuuuggcugugaggcugagauuauuaugcuacagcugauggcagccuacaguuuucgcccgccaacuggcaacugcauacaguucagcauuauaucgcaccucuagaaaccgcaccuauaaaaugagcgagaauaccaauaaagccacuguuucaggcuggggcgcucuguuuguaaagugcuugcugugcaagugugagaaaauaagugaguuugauccucggaacuaaaaugauaggaaaggcaugguggcugcaauccaggugcugagaaggcuggggcagcaggaucccuggggauuucuagccagcccaccuagacuaauuggcaaguuccugaccaaugagaaaccuugucucaaaaaagaagugaaguaaauggcuccugggcaaggauacccaaggcuguccuuugguuuucacauacacuuggauaaacacauacgcauuaugcucacacaaaagcauacacacgcccgcauaaaugcuauuuccuaggaucauaaggaggaaagaauaguaugauauuguuauguuuagugcauaagucucugcugaauuuaagccacugguaucaucuccgaacauaaaauaaucuaaaucucauaacagucaggcacugugccgggcaggaagcugaggcaggcuaggacugcagauaguuugaaagagaagucacacugcauguagguggagaagcuaaggauuuggucugaucuguuugacucuaaagcuugcggcucuuuccguaucaccugacuagucauaguuucagauagcgucaacuggcuaaggucaaggaaaaggcagcgguaaaagccaggugugcuggcucgcuugcaucucuaauuccagugcuggagagguagagauacgggaacccugagucuuguuggccugccagccuaaccugcccaacgagcuguaagccaggugagagacagucuacaaaaggaaaacaaaagagaaagguagauggcaccuaugaaaugcccuuaggccuucacauacacuguuaugcacgugcagaagaggagacaggagagggagcaggggcaggcuuggggccaguacccacagugauuaggugagcuagcuuacgcagcuuuggcaccacggaugcuggcccacaagguggacuggacagccagaggcagccagacaccauguuuugaagucucugaaagacacaguagcucaagucuucuauaggcucaugggagucgcaugggacucugaugcagaagggugagaaagaacacuaugaauucaggugaagaggcgaccuuuuaggguuuccgagagggccagcucaauggcaagaaaccaagucaucuuguuaguaggaaaaagugauucucuuuacucagauuucuauacaggaucaauuaugacaccauguguggccaugcggaacccacggcuuucacuaaaaugagaugguucgcucccuaaugcgaagucgggacaugcucacaauaucacuuugagaaaaccauacuuaguccugguugauguaacuuguacaagucucagcaaagcggcacuggcucagauccuaugacuaaugaugcgauguccaagaugcaucuuuaaaaaaauagaugacauguagaaagaagaaauaaaacgcucgaaaggcauuuguuugcgcuguugaaaacugggaacucguagauaucuaaugcuagacuuagaguuaacugaagucugacauuuauuguuuuauacaacaagaaccaaaacaugaccauuagggacuggagagauggcucagcauuuaagagcacacacugcucuugcacaggaccaggguucgguuuucaguacucaucuuuggcagcuugcaacuccccguaacuucugcuccaggggauacaauaccuuuuuccaaccuccacacaaacuuccacucacauguaccccuccacauacauauauauacauaauuuuuaaaaacuuaaacauaaucauuaaaagcaacuucauauguauuugaauaugguuacaauagaagaaagcucauugccaagauauguguguguguguguguguguguguguguguguguguguguguguguacuucuugccuguuuucuuucuugcaggaacaguauagugguaacuaccauuaagacuguuauauacauguagucauuuaguaaauacauuuaaagaacaaagaccauggccaaaacuaugucacacaaaacauauaaggaaaaggaagacuggaaaagaaacuguucggaguacuaaaaauauuuucauuacccugguggauuuuacucuugcuggcuguguagcucagugguagaacacuagucuagcaugccugggguccuagguucgacccuccagugucauaguaccaacaagcccuugcuaggggcucaaugcuagccugacaaucuaucguauugucagauacgcugcacuagagucaguccacaggccagcacaaacacacaucuugcuuuuauagaucccugauggccaacugaccaaggcauggauacuuaacgaugugcccucaugaauccucauggcaucugaggauguuccuauuacuccuguucuaugaauggagucccuggggcccagcuuaggucaccagcaaaugauacgguggaugcuuagcuuuguucacuuuuguauaucccaaaccccagacuuuuccaggugccccacguuggccguucauugguaaacucuccaaagagaaaauaaaagggaaguaaagagucacauucuuccucccauagaccagguggaggucccguagcccaaggcuucccucuagauacauauuuaauuuuaacuuauacauguauguauguauguauguaugcauguauguacaugcuuguauaagugcauaugugagucugcauguguaaaggcucucuacuuuauuuaguuugagucaggaucccucacugcauccgaaguucaucuauuggauuagacagguuggccaauagcuuaggggcccucguuuuucacuuccuccccaacacugguguuacagacauucaacacuggcccagauuuuuuuacauggguucuagggaucggccaugccugcacagcaguuguuuuacuaacugagcuagucugccagucucacaaacacgugcucuucaaucuguccacagugaaagccuuuccuucucaaaccauugcccccagcccacuaaaacagaaauagaaccuuauauuuguagcuaaugggcaaguuaaagggggacacaucaaacauggauuugcuucuguuuguuuuggagacagaaucuccucaauagcccagaacgguuucuuacgugagauccuccugccucugcccugaguauugggaucauggacuguaucuccaugucuuccuuccuggcuuaagcgcuuuuuuuuuuaaccaacuaugucuuuauuuaaaacuuuuaaauuaaaaugguaaauuuaacaggugugaacuuaauagcuucaaaauacacagauccuaugauccacaucgacaaaagcacauaucuagaugggagugccugguucaacucuuaaacagaugcacauuugauuagaaacagugacgucacuccuuauuagcagaaggucaagaagacauacccagaccugcucacucgcagagaaauuccaucaccuugcagggcuguuuuugccuuugccucucacuaagaaacucaagguaaguggacaugaaagauuguagugguugaguuagcuuacuucuacuuuucuaaugcuaggccagagggaccacugucccuaugugugcacugguuuagggcuagcuaaaagugucauacacaguuucugcaucucagcccaaaucccagcccgaaaccagcuacccaugugcuaguuguaaacuugcacaucugaaaacaaccaaucaaagauuugcuccgaaugugcuaagcacuaagaguguguugugugauggguauacagacaggcucugagaaccaagagaagauaaagaaguugccauugccccaaagaugguguuaaauaaggauguaaggcauuacuaauuugugucauaauaaugauauuugcaauaacaaaucuauccaauaccuauggaacacgaaugaagaagagaaaggucaucuucagaaaaagcauguuaagaucucaucacagguuagagaccguauaaccuugcuugguccagaaaggacucacaccauaguucccacucugucccacacagaggccaugagucuaccagagauggaacaagucugcaggcaaugggacccugggccucugcaggguagagaauauccauacgaguuuacaaguuuaaaagggaaugaaugaggaggcugguaaugcuagcaguugagagacagaagcugguggaucaugguauuccagccagccuuggcuacauggcagguuaaggccagucugagauacauccugaaaguguaucccaacgaugaaacuacgaacaguagaagaguggaucugggaaaggucaaguaaccauuccaaacaaaacauggcuuugcuuguauauccaggauauggaucugguuguagcacuguuuucccagaaaacagaacaauuccccagccccagccccagccccagccccagccccagccccagccccagccccagccccagccccagccccagccccagccccagccccagccccagccccagccccagccccaccccccaccagccucagccuggaaucugauuuaacucacaccucugauaucaugguggcuugaaugagaaguacuuugcacuggcuugggugguguugagccuuuggucuccuacuggugugguuuguuagugugcuuuagaaggagcagccuuggugcagggauggaugucacugguggaaguccuugaaaagauaagcacacacacacacacacacacacacacacacacacacacacacacgcgcgcgcgcacgggccaccuccauuucacucucucuacuucacauuugcgguuaaagacgugaucucucagccuccagcuccagcagccaugccuccccgccaaggugaaaacuuuagcccccuggagucauaaaccgaaacaaagucuccauaaguugcucucagucacuuggguauuuuuuuucccagcaacagaaagguaacaaacacagaaauggaaccacaaauuguuucuuucuuucuuuuuucuacugacaggaugaaugacuuggagcaaucaaggaaccaacuuaagaacuaugauuagaacacgaaugauaauuuagggcuggaggccaagaaggacaagaagcuugguuugaggaaacaggcauagagagcuacugauuccaagucugggcuggcagugagccagggaagccuucucaggacuuaagggaccaaacacggccaaugcagaagaaauggggguggaggggugaagccauaaagccaguuagacuugaaaaggaaacaaaguaaaaucugguuuggguauggagcauguacucuugggcaacaacagggauagaaacgcaucccuuccucccuccaccccucccacucuccccccaccccauucuauacccucacgugggugaaaugauucuccggcauccuucaacauggacagucugaugacuagucaugauucucaacugacugaauugagagaugucagggaagaaugaagcgcaucuccaccucuccagagagaauugacuugucgauaguaacugaggggagagaccuacccuaaaagugaguggcguuaucuaaacggcggcgaguagcugggaugggaaaaacuggcaaggauaggaauuccgugcccagacuuugcauuagauacacuugcaagaccguguauuguucugccugagggaguguguaacgucauugcucgcagcgcccacagacuugagacuucagccuugcacuguguaucugacaccaauccauggggauucuggccuucagcaucacaccgggagguggaagcuucccgcuuccugacccaagcagcugccagguucucugcucuccaacguguagaugaccgccauugaauuacucaaacuccuaugcaauaaauaccuuuuuaaaauuuucuaugugugugugauuugauguauggugugugugugugugugugugugugugugugugugugugugugugguccuguuugggguuauguggcugaaugugaggauucucacuuucaagcuuaggguagcugaccuagacuuuacuucauagccuaggcuagacucaaacucacaacaguucuccugccucagccuccccaugcuaagauaacaggcuagagccacuuauccucagcuuagaauaauaacuguucagcagaaacaauauacauuagaaauauacuguauuuauugauggauaagaaccagauuuuuuucaauagauguuuuaagauaauuccagauguuuuaauaucaauagauugcuuugacuauaaaauacaaagguuuggguaacuccugguuauguaagauagggguggggggauauugaaucaagaggguuuggggugacuccaucugguaauuugagucaacacugauuuauaaaucacugucacuuaggacuaacuaguaccacuuaccaaaacacagguuaaucccagauaaaucuuuguccuacucaaugucuaacagcagaaacugccaucuucacuagauacacauuguuuaauuuaauucauggcaguuuuccuuuuuuuuuaaagacaggguuucucuguguaguccuggcuguccuggaacucacucuguagaccaggcuggccucaaacucagaaauccaccugccucugccucccgagugcugggauuaaaggcgagagccaccacugccuggccauggcuguuucccaauguguacacugaaauguaaaagguuucuuuaaacucagacgaccguuuacuucauaaugguuggugguaguaucauuuccauuuauacuauuuaauagcuuuuucaaauaaaaguucacguaaugguucucuuccugcgaaucuucuccuacccacaggcugugaugaacaggccacacugcauuccaaagguuuacauaaauaugaaugaccacagcaaugugugaacgagacagagauguaaaagguuuuuaaagccgaguuccaaaaaaaaaaaaaaaaaaaaagguccugucugucaaugaaauaaagcuguuuugaauuuguucccacucaucuggcucuuuugcugggagccuguguuugcucguggugauuaaugcgaagcgcgugcggccuucgcugagcguggacaagaacuggcaauuccaaaugguauucaucauaacccugaucgggcaggugcggcaggcucaagugaucuuuauucucccccgcuccaggucacgagguuacguggccgucuucaccuuuguccagggcaguaccaagagccuaccucccucacccggcggcaugucaggacauugguucuggacucuguuuucaggugccuucucugcucagagucucacuggugaaacagcuuggaaaucuaacaaauggaggugugacauuuaugaauaacugccuuuccaaugugcuucaagauaaauggccaggcaugaagcuuggcugcuaggaugcuugucuagcacacaccaagcuagcuuuggucuccagcaucacaucuccagcaucacacaaaugguguguugacacgucuguuuacccagcgcuugggggauggggaugcagguacugaaaauucaaagcccauuuagcuacguagggagucugaggccuggacuacagaagacccugucaccaccaugaccaccacaaccacuaccaccaucaccacucuccacacacacacaaaagauaaaucuuaagccugggcuuaaaagaacugggaaauguuugggcaagauuuuaccaugugugggcuucugccccaagaaacaaugucucacccuacccaccucucaggcugucauggaacucacagaggagguggaguggggaguuaugacugugggcugccacgccuggcucacuuuuuaacaucuuuucuuagcucuucucuggggcugucuaggcacgagugguuuccaaagcaagccugguacuuucuucagugcaauaacaaaguacuugacagaagcaacuaaacagaaggauuuauuccggcuccuggucuagaaagguuuaggccgugcuggcacggaaggcuuggugaaguucauggccaggggauuuauacaggugacgaguucucacuucucagucuguccggaagcugagaacagagaacguucaugcccuuuccugcuuuuauucaaccugcggccucugccuguaagacagugcucuucaaccuaaccgcuguagaaggaccaucacuauacaucucuagugguguuuagcacuauugcccuuggcauuuccuaauccaguguaauagaugaucaaaguuaccuaccauagggacgacaauggggaaugagcaacgugaccgggacacuugggucucaggugggguggguaggcagagacagugaagagguacccugcaggagcacagggacuugcugcugaccccugaaggacuccagcaaacccugccucacuuucccccacguacuuccaugaggggacauaacugcgcuauccccuaagauugugacaggcuucgaaagacuaaaauuuugggagguacuugggauagucuagugccuuagacagcucauaaauaucaccaguggcuguugccauuuuuacaaaggucacaaaguucauacaccaucgcucucuccucaggcaccuguaucucauuccacuaacgcuaaagguaugucugcaauccucuuucaccucccuugacccaugcaugcccuggguagugcuugcuuacacagcugacaggcccaggcagccugcaaccauggccaacuguaagaugcauuuggaugugcaagaagugugcuuuuguguagauuucugccugaaggcaaauucuuuauuggcacacuggggaucuuuugccuggaucauaggcaaucccaggagaugccaucuggugagacuggcuuugucacaagaugccaagcaaagauuugcuauuugagcauagcuugcgacgucaaguaagcagcacuuccuucccuucagccaaacagguguugaccgggcacuucugugcauuugccaggaucugaugcauggaugaagaagaugguguggaggguuuaccugcuaguagaggaggagaucacccccuaaauaccaaaaaaaaaaaaaaaaaaaaaagaagaaguaacaugugcaguaauggaaacauuaggaagaacaaagcaagcaggucagaggucagaacuuggagauaagaaaaaggacuguuaaacacguugauuucugggaagaucucuuuaguaaaguggguaucuaagagagacuccauaaaaaggguggcaucacuggcuggaacccaggagaguucccagacaggaaaguacggucacccaucaucucugucacccagccagaccaucugccagacauuaccgugguagaugacaauggguaccagugggugcugcaacuaccaucaaaauuaggaugcaaacuuccagaagugaggguagaaagugcugacaagccacaaguauauggucccucgucugacucucaggauggagaugguuguccacaaagcaaagucuuucugguggaggggaagaggcccccagaggaaggcagauugaaauuccccuauugaaaugggugggcacucaaacaauugcaugucuggcccuaauguugcccucugagggcuuugacagcuguagggaggugagccuucagggcaaggacauuuaaggagacuuccuggaaaucaugcaccccucucaguucauuugcugccucaaccagaagacucuggguggagcucggcagugccuaagcguacaagcguacgauggaaaugcuguucacuauacugagggcaagacuccuuuccccgacccugauggagaccguaauguuccaguguaagacacagauguuaagcaagugacaauugggacaauuacugccugagacaacugugacaggagaagagggugcagugauugagaaacaaccagcaggaaccagcccuguguggcuguggggguggggcucaggguagugccaguucaaagguuacaagccgaaagaaagagaccuugguagguuggugggaaggggaggcaggagacaggcccggagaugaagcugggguggcuuagcaaagcuccagcagucacgaugaaaauguuggucuuggguuagauguuuaguucaggaggggggaaggcacaggacggggaagacaagagcuguggaagcauucuaaagcacugacgagccauaccuaggaacacuggucaugggaacuacauaagaaaauucuggaagcuuaauuuauuaauuaaucauagcguaucguuaacuaacuaauucaucgaaauuccaccagguuuuuauacuuacugucuuucugaauugucccauaguaaggaaaagcaaaagcuuuaaaaauucuuugcuuucauuacauuuaaauugugugcuugucugcguguggguauguacgcagguauccaugggauccagaagagggcgucggauucugaguuacaggccguugugagccaccugacuggggugcuggggacuaacucuagucuucugaauggacagugccugcuccuaacagcugagcacaaaacucucaccaaaagcaaaguggggcucaguggguagaacacuugccuugcuagcaggaggagcugcuaucccagaaccccuguaaaaacagcugggcacagcugggcaccugugugaucucaggugguucccuguggcugguugggcuccaaaccagugggagacccuaucuuuaaaaaagaaaaaauauaaauaaauggauaacaugagagaugacacccagggcuaucugcuggccucuguagguaaguguggacaagugcuuacacaccuauacaaaugcaaacacacacaaacacgccuacaaauacucacaagagcaagugccaacugggugccgaaauugagucccaaguaugcaugcacuugggaacuuguccaagcaucccaucaaacccugcggcuuugcaaaugucccuucacguuuaugcagguguauacuggugugcugguacacgcagcuccuuugccuauuaaccacccacccuggugcauuguugccuggugcauuauugccuggugcauuguugccaucaaaaccuccugguuccuuucuuccucuacucaguaucuucucuccucacguucuugucccucucugcccacacacuggcgugacauuccugggcagacaauuuacaggcugaguucuuuucugucacucuucuuacuuccugacgacucaccuagacuaauggucccccucuugagucugugagaccugcccucuccccuugaguccgugaguccuguccucgugcucaggauugagucucugcugucacccucucucguuucagcccucaaaggaaugccaccagacaguggacaccccaacaauugcuuccccccaacucuucccaagaaaacucugugccaccuuugacgacucacaggaggaccgggagcaacaguuccuauggauacuccaggugcuccuaaccaccugucuccaggcacacgucugaucuaugacacauguggucuguaacgcaagugcuaacacaggugguauuauuaccaugggugcuguccuucaugugaucaagugaucuucacgugcuaucucauuuaaucuucaaaacugccuuugggaugaugucuguuuuuacagggagauaaacuaugaguuuaucccugugaggggagcucgcaggguccucugaucuagcaguuugaacuguuauggugaucuuguuccucuguucagcuguacacgcuuucuaaaggacggaagccagggccaugguagugugcucugcaccaacacccuucucuuggacucugacuucguauaaaguauaucuuacaauaugccuuugccucugacgaaagcaagcuccuuagagccagaucguuugcuaagaucauuuacauaaaccccagacaagagguugauuguagugccugcuggagaacuagaaaguucugcccacuucuaagacuucuaaaaucuacaaauauuuggcaacuucuccuccaacagccaggcuagagaaaccuccaggaaaaugagggucuggguucaugcgauauuugaguuaagugagaguggccagcuguuugcuucggaggaaucuuguugccuuugacaaaucccacuucaaaacugauuuuggcccuccuggggcacgcacccuauuggcuaauuggguuguuaaguccuuggauuucacagaaaagcagccuugcuccgcugaggaacuauuuuuacuccuggaggcuguggaugguccacugagguuuccugaggugcuggcauggcaggcaugggagaaaagcaaaaacaacagugccauggguauguuggacuucucuaaccaugccuacaaggccaaaacggacuggcacgugcuucuaaauugguguuuggaauugccccuuuccacucccaacaucccuggguauuccauacccuuggggcuaccauuugcuuucuauuucuugcuuuaauguucuccauacuguucucauagaccuggcucaaguugcauaacuugccacucgaauucuaucuccagguuggcaaccuuaggauggaaaugggucugucagaaaugucagggggccccgaaccaacccaacaggaaauacuugcguuuggaaacauagcuaagaacacgcuggaauguugcuuucaaaugcaacaggauagcuuagguuggauaaccagaucugaaggugaaugcugucccuuggaccaagcagccugagguguacuccucacaacgggagugaugggaacaucuccaacucuccuuccuuugccaacccaaauccuucuucaucagaaguagggaaucagaucuggugagggcugcgguacccaccccuaguuuuaaauaacaugauggcauaucaaaacccucgcuuccacgcugcauucaacaagcgagguaccugccaacaugcagcuaaaaauacccugggcaucugcacaccaccauccaucucugccuggugugggugggugacugaccccugagcagguggagagccaggaauuuuuuuuuccuggauugagugucagaguugacuuaaaacagauguucucccaaagcugcccgggcauguauaacagggcuacuuauggacaacaguuuggagaccuguuccuacccaagccgaacaaaggagagcguccuugagaagagagcccaggcacugaaaggguuaagccaccuuucucccagggcugaaaaaaaaaaaaaaagaaaaagaaaaaagaaaaaagcgggugaggguuaccagaauagacagaaauaggagagagagcugucauuuuguauuuucaggauuguagaaaagccaaccccccccuuuaaauguaaacauucauuaaacuaauuugaaguugucauuacuuuccaccccgcuguuuuauaucagauuauuccuaagugcuuggugaagaaucccauaaagacacacucgauuccucugcaggggauaaucgcgugguuugcacagugauuuacgcugugugguaccgggaaguguccucaacuuugaaagaggccucucucuccacuccucuggcaaacaaugucugccuuccccccauggaaauaaaauuccaaucguucccuccacggcgauuaugagguccccauuaccuuuucuccauccaacuggagauaauuaaaagcaguucaaagcacacgccagaagguacugggcauuuuauuaauaaacgcagaaccaagaauacggcagcgggggcggggaccaggggugggguggggugggaugucauugcggauucacacugugggaugugcuggugccccuugccugcuugacuucuuucuccccacccuccccuccuugaguuagggggagccagccacuccaggcucugaaaccgaauggacugaggaaaggacaguccacugucacacuuccaagcccaagccuauuacgcacacagguuuccucaaccauccuuugcucagagaacgugauucccgcauccucggcugcuggaacuaggaggcagucacugagaccauauccaauggccuggucuauaguuacuaugcauccuauuaaaauaaagggaauaugaguguccgccauauaagucugcucuggucuuuacagggcaugaggacauaauauguaaagaccccagaacagugccagccugagauggacauuagcucagcucuauguuacuaugcaugcagauguucaaauccacccaaaggggagcagcuccaagcaaggguuggggacagggcagcagcacaaguccagucuucacuuucuccaucucuccuguuuagugugccugguucccagaagccgcugucaccaucaaucagccgccauugcggccucagaccuuaaauguccaaugacccagcucugagucuuggucaauggacccgguccagugauagagucaacagcugcagcagcuguggucacugaguguaucgugccuccgucccuucaccccacccucaccccuacgauuagcguuuugucagagaucuggaugcuuucaagcagagaagauagggcuggggauggugccugccucgcaugugugcaguccuggcuucuguccccagcaccccauagacgggggcaucgugguguaaucacagcacuugggaggcugaagcaagaugauaggaaguucaaggucacccucauggauucaaagccagucugggcuacaugaaucccuucucaagaagacagggaggcaggcacuuaguccacuuagucaguacaucuccacacucuugagugguguaccaaacugaccagagccggagccuuuugaacggugcucggcuuuccaugggccuucuuaacaguucagacaagaaaggcagguuugggaauagcacccaguagaaaauacaguuaucauuucuuccuuaaucucaagcagcgacagguccuuaguuccaacgugggucucuuuagcauccaugggaugugccccuaggauggccucagaugcagugugagucugcaaaucuggauucugcccaaagggccugccaucacagguccagcauguccuuuaacaucucugugcuuacgcucucucuguuacaagaauuacaacaucuauuccaugguuuuuggggguggaaggggguccucacaagagccuuuggcacguaauaagcauugaucaagcaccauuaguugugacagucacaggccaucauccacuccaggcacagcgcacacauagcugucugaagauacccacagagacacugcaaaucuuaaagauaaaaagaaugcacuaaagcucuuguucuucuuaaagcaagaucucacauagcccaggcuaccuuuggacucuccaugcugggauacccuugagacucugaucuucuugaucuucaccucaguugugcugagauuaaagacaugagccaucacaucugauaucuucuugcaugcuaagccaaguucugggccaaccugagcugcauccacaucccuugaagggcuucuccguauacugccaaugaccucuugguuacauuaaauaaaaaugagacugaaacuccauuuguaauugacuuuguaaaaugagaccaagagauaccccacaaguguccaguaacuucugaguaggugaaagguauuucucgacuuucuuccuggugugccuggccccgacauagaagggugugagcuugcugguuauucucaguaagcgcuggucaggcauaaugagacucuacuaagcgcacacugaaaagguuccagggcacaggccacagucuaagacuccucugcguuuggcaggggcaucagaaagcuugggcauccacauuucauacuucaccuagaauucaucuggaauuucauuccagauucucaccaagccacagccuguggccaguguuccaucagagagaggaaugugcuguaaaacccaggccagccuguccucacaagguggcuggcagagccaguguuucagcgucuguauuaucccaaaaacuguuguuuuagcagggggcagagggggaugaucguggaucaggucuccaaguucaaggaaaugaagcagcggaaagagagggccuguaagccucccucuaaaugcaagugaggacaaggaauacugauagauuaacuacacaucuggcucacauccagaaauauaaucaacuacagccuaaauuggucucuuauuuaucagcuuuguugguuuuuguuguuguuguuguuuuuaagggauaaaauggagcccucugaugaagaauuaccaaggacaaacucuaaauuacugaacuuaagggaccaaaaguaacacuucagagaagaggaaaaaaaggaagagagggaaggaggacagagaggaggaggaaggcaugguauaggaaucagaacagagugucucuuaaguagcacaaaugcaacacugucaucaacaaacauggauggcaggaguguaagaaaagaaccaaucagaacuuuccugguugacuccacagacaaagucucugcaucuucuuuccucucuucucuugauacaaaaacugaccccaccagcaaauucucaagccagguugagcaucuuuugucuuuuuuguuuuuuuguguuuuauuuuguugcuuuuugguuauuuuguuuuuuguuuuuguuuuuguuuugcaugcugcagaagucacaccucuuccugguaguccuucuguuucagagaagguaguugacaauguaguuaaugucuucccuuaagcaauuacacacuagauuaaggacuucaguaugagagugccguuacccuguguuuuauggcaaaacaauacguuucaagaugacaacaaacuauaguggcauauucauguaauccuagcaugaaauaaauuccuugcaaacaccauuauuguuaccuaagucuuccaccuguuugggacuuccugugaacuaaguuaaaacauaacuuuacaauaauuuuaaacaucauuuuuccggaggaggaauuucccaugaagcauagaguugauaauccucuccggaaguggguguuguugacguggaugcaugcuaucagcaugguguuaucgacaagcaacuauaaucuguccaacagucauuguuuuuaacuuuacuuuagcuuugaggugcucagcacccccuuuguugaucuguguuuccagguuucccuggguuuaaagugcauauagaaaugaggucuuuucuagcugauccaguaacgggaauugucagccaauauaaagugacgugcgugcgugcgugcgugcgugcgugcgugcgugcgugcgugcgugcgugcgugcgugcgugcgugcgugcgugcgugcgugcgugcgugcgugugugugugugagagagagagagagagagagagagagagagagagagagagagagagagagagagauccuggcuccuaccucugcacagccccaaacaaaauaguggcaacaagaccuugacagaucacaguacaauuugaacuucagacacagaugcauucaauuuugaaagaaauugggugugucuuuagugaaacuacuuuccaugcacugccugaguacaggcagagacuagggagugagccagacauaaggguuaaagugagaaucauuacauuuugccuucuggacaucaggugaaauuuaggauaguaaaguuauuuuuaaauucaacauagagaggggaccaugccaugccguugucacagaaagaauucacauuaacacagagcugagagggugggggaaguaccaugaaagguccacaaaauggcagagcuggaauucauaauccguccuugguggcuuuucuuaaaauuuauuuauuuuuuaaaauaauguacauauguaugugucuuuauguaggcuugggcaugugaacgcagguguuguagaggcccgagggguccccugaagguggaguuauagguggagcuaaacuacaacacuuggguguuggaaccuaagcgugcguguucugggacagcaacgggccacuauuaguugcugaccuauacuuccaaugccuggauucaccuucuugugguugagaucgucuacggacuggacucugggcuccccggaaaaacaccacaacuaggcaguuacauagaccagugucucugcuuucugcuuagcagggacuugguaggagauggggucaauucaaguuguccaucaaggguaaaagguuugucuguagugcccccccuccaccccaggagucaccaaguauccuauggcaaugcaggaguuaagguagaucaaccccccccccccgguucuguucagcaacagggaaacauggccacaguaauaaugguauuuacgcaagaacucuggugagacugggccugaggacugaacaaaucacaccaaaccaaugcuuagccaaaaaacagucgauaaaaaugccgugacuggugaauuacaguggucuucuccucucuucgauaauuuggggcaauugcaucggaacgcuagcccauugauuuccacuccaauucgugcccccaugcuggggcaagccggcuggcauacccgagucugcuggaagacuugacgauggaucugaaagaggugcaggcaauuguugccuccaccguuaacagaacuauaacuccgcuccacacucugaaaugcucucagugccucugagaaacagcugagcacucccugagugcccauccuggauuaguggguuaagcgcuuccauucugccccaaggcugccaaaucacuucuggcacuuucuagaacucuuucauauguuuuuuucuccuccauacuucuaauggggaacaauauugacaauggcauuuuagaaagcaauagauaaucaaugucuggcaguuaggggcacauagauguauucuuaauuuuagcaccauauucuacaggcuccaagugcuggcauacaugaaaacuguuuuagcuuuguuuuuguuguuguuguuguuuuguuuuguuuuuuggaauaaugguuuggaaaaagcagauugucuuucuguaaagagaaugaaguucaaauuuccacaugucuuagagguaauauaaacuuagaaagaaagacaggaugagucagaggcaugaggagagaaucagucucaauagagcaagggaggggacauugucauguuuagagaugcugcuugucuggucuaaggcaaauagaugcuccuggcagguacagagcaaaggucagaggugcugccagacaccuaaugauguacagaacaguccuaagugcaaaguguaucccaucucauuuuaggauugccaagguugagaguaaugucacucaagugacgugaguaaguaaauaauacauuugucccacgucacccuuugccacaaaugacgcuuaccuacauugaaacuaaggggcaucgucgcuugugccguuacggcucuuugccgagguacagauuuucuucuaugaaagcgcuaauauuccaagguucuagagaauuccccguuccuucaggguucccuaggucccauucccaagcuuaagacaucuugacgucaagugggaaaaagaaagcugacucuuuggaucuaaaguaagugucaugaucgaagucccccagaacagagaaugggcuuggagcuccaguuuagaaugaagaguguuugccuaaagugcacaaagccacggaccugacccuggugccaaaugaaacaaggcaugguagagcacaccaguaaucucagcacuugggugguggaggagggagggucagaaagucgggguuacuugucuuuggcugcacaaaagaguucaagggccagccugagcuacaccagaguuugucucaaaaagaaaauauaaauaaauaaacaaaagacuagagaagagagguguggcuugguggugcaagccagucaucccagaacucaaagccugaggcaggaagauuucugaguaggccucacagagagagggagucccuguuucaugaaacaaaaacaaacaaacaaacaaaacugcaaacaaagaaaaaggaaaacgcccauuaaaaaggggcuggugagggcugacggcuuuacaagcugaggguuuaauagagggacugaguuuuuuacaagcugaguugugcuaaacucuguuauuaaaguuagugguucugccaauaaagccuccacuccauggaaaauacuugcuaaacagauuagucacgagagcagagaaaggaagacgacgcaguacuuaggagacgcacacauccgaggagcugcucuuucugaucccccacccccaccccacccugcuuccaaccacacaaaccaauaaaaagaaggaaagagcccagccccuaagcucagcauccucagagcaaugagguuguguccauuuacccuggcuuucaggaagagcaaaucuguggccgaacacuucuauagggcacauaugaaaauuaugcuugcucgccaggaucucuuacauuggagggugugugcucuggcuguuuauucuucuucaaaaaacaaccuaacagggaggggcucuggggaguagaggagccuuuguuagcuauuggugagcugggggggcgggggugaggcaaucaaaaauuuacaggcaggcucaugcaugcacauaucacacaaaauauacacacguaugcaacauacauaccauacacacagaacacaccacacacauauauauacaacaaacacaccacacacacacauacauacacacacacacacacacacacacacacacacacacacacacacacacacacaaacauacacacacagagaugccacaauguaauuccaaagauuuauuuacuuuuauuuuauuuauaugugcuuuuccuacaugcaggggaaaaaaaagaagguugaaagaagguguuggauucccuggaacuagcauuacucaaagcuacgagccaccacgcggguauggagaaccuaaucuggguccuccggaagaaccccaagugcucugaacugcugcgccaucucucagccucaaauaaagguaauuuuuaaaagauuaauauaggaaaggagccaguugucagagaaagagugaaaacacuucccuacccgagccacaugcagcacacagaaaaugucuguuacauacacacaggagaaggcaaaugcuaugcaaaugcccucgaaagagucagaacucaccugcugcacaaauguuucucagcauuuuguuuguuuguuuguuuuguuuuacuuucucagaucacuagucccccugcuuccuccuccuccucucuucuuucuucuccuucuucuucuuccccuucucccuccucccuguccucuucuuccuccuccucccucucccccuccuucuccucccucucccccuccuccucccucucccucuccuccuccuccuucuuuuucuucuacauugucucucuucgugaguccuugaacccaauuuauuucuucagaacacaagaaccuaaaagccucagcgggugcucccugaacucagccgggaaccuguagagugagugaguaggaacauguuugcauucauuuucuaaguuuaccaugguagcaaauguacaauguuaaccaaacgcaaugcaacacaagguagccaguggccuggcgaccucuccuauugguugcucugucccacuagacuguccaugccugaggaguuucuguaucccuucuguuuuguccuugaaugauuucucaguuucagagucacuggcacuggaugccauuuuaggucuaagcuuaccccaccccagaggagguccaucaaagugauucauuagucuacaggccaguggggcaacugucugcguaauggauacguaaugugcucuccgauuaugggauggagggacguaaugugcucuccgauuaugggauggagggggaacucaauugcuaugcauuggaauuguuccuaauuuucaaacuuaugguucauuuuauaacacaaccuuggcuucuuuuccaccgccuucuaguuuaugaaaauacauaauuaguuccagacaggaacgaugaauucugcuuaucacgucugagaggccagggagcaccauucggaagggcuucuccacauugucguccugaagauucgccccugcaggaagcaagggagcagccuguuuagaagccuuguccagaacaccaaguaggagccaagagacuggagagcucugggguguucuugccgacuuaacuaaaacaagcuugaagccagggcgcaauccgugcacgcuugaugaguccuuuccccaucucuggagcauucccuggugcagcaugcuuuaggggagguaaagaucuuauauacuggucuauucagcugauaauuaugucaaccucaccacggccaacucuugacagccuaaaacauuaaagauuuuacaccgcuagugccgaauacggcuccuuuuauuggcucagagagcagauaucaauuauaaugaggugauaaaauuugcaagcacuguuuguguccugcucggauucuuucucuuuucuuccccucccacucucuuugagauaauaacggcagcaaaagagaagagagagaaaucuuccaaguucucugaaagcucuggcuuuggguggcugcggugccauugagcuauuugcuccuguugguggcuuccuucuaacuaaagcuuagaggcugggggggauuucucaggcacaccuuguaagugccaggcuccccagggauuaauggcucgcauuugcauaacuauaaacuuaagagaguucucccaaagcccagcucccuuccacuacacuuacugaugagaugcagggcccucucagagguuccccaaccuaaaccaauuuguaaaguuguucuguuguuuaaaacauuaaagaaauuaaagugaucggacuauaauuagauuaacauucauaucuuccgaguugcuuuaauucuaauauuaaaaagauuaagcauccacuccgaggauuaagcaaaaacccaagugcuagcaacacauuuacaucgccuuacugugcaaauuauaaaccuaauuaaucuaaaguuuuuuccagaaauugaauuggauaugcacucgcagccuggugaaacuuuagcuacuuaaaaugcgcuccagccucauucccuccuguguguggggaggcaaugcugugguggaggaacccauuacaaugacuucacuugccuucuaauugguggaaauuaaaucucaacauaaacuuauguaaaaagaaaggcugaaagaaugcaugcacucaauaagaaaacacacccuggccuccccauccaucuagcugcucuucuagguauagaaaggcauggccucccauugagcuguuccacauagacgcaaaaggugaugcauaacuuucucuaagaacuuagcuucaggguuguuccuccugucgacuggcuucaacuggccacuugacccuagguagaauagccugggaagagaucuuaauugaggaauggucuguagacacgucuauugggggggggcugucuugacuguuaauggaugggggaagccauauagacauauccuauguguggguggagcucuuucauaagcuggaccaagcucuguguaagacaaggaacaaagccagcagaauguaagaagcggcaagcauacaguaugggugccugcucuccguucuugccugugguauuggugggacucgcugccucaagcuccugcccuaaccuuuucauagucacagacuguugucaccucugagcugugauccaaaggaacccuuacuccccugaguuacuuucuggcgggguauuuaucacggcaacagaagccagguucacacacccccuuggacugggaaaauaaagaagaugacaaggcucccuuuccuucuuuuccucagcuuagcugcuuuauucugcuccugcgucccugccugguccugccauucccucccccugcuguucugcaccccacaccccaugauccggaggacacagucauucuuccugggucucacuggaccuacugaguagcuuugguuuggaagaccauagcaaacuuagacagucuugauggucauggugaagccacagaaaagacacauccuguugauacaaaauaagucauaugucuaagcuccuugauagagggagaggccacugcacaaggauagacacucuuguaggccuuuuucuuuguacuuggauuggauaugaaguaguggggacuuaaaaaaaaauguagugguuugcauuguaauuacuguagaaauauuaaucuuccaaaaucugugggcuagcauagguucaggggaagaggaaagagaagagguggguagaugggcugggccugugaaggcccaaagccuuguucuaugccuuuaggaaauacaagcuggguuguuaaaauucuucuaccaggcuuucccagccaagcugacaguuaucgucugcauucaucaauauaaccaccauaaaaagugaagccauugaggagaaaugagaaauuacggccgagauuagcagccaugaguaucugucaccaucugagggccuucgcucaaaucgagcaccacagcccuccauccacuuaggccuaaccacagggcuauuacccaggaagcacuagccauuccaucuguuaucaucccaaugaaauaaauaggugugaauuccaccccuguccauuggguguucccuaaaauuaguuaauggacgugugguuugagauuugauccuguugggaggaaauauccauagagaaaguacuggccaguggugagaaaagagucgucuuggaaaaagagauucacuggcuauuuuuauaucaugaauggaaagcccaaucgcaugauguuuaaaauaaaauagcaguuuguuucucacugacauauaagauaaaauaggugaucuggugaguuauuuacucgcucccuuccaaacacuguuccugagacaugggcucuacucugugacuugcaaugacuaaagaagcuucucaagguugccucagccugggauucuugcuuggucacaugaccauucgaaaccacaaggaaugcugggaaauguaguuuucugcaugggacuggaacagacuuagugaacagcuguucaagguuucuaacaggaacuccugucaguucugagccuagaccccaagaaggcucauguguguccacuugcugacuucagcuucugccaggagaaaugguugggcuuugcugaucucaggaggaugagagacauguggagaaccaccacuccagguaaaguauuacauacacauugaaccuacacuggaauccccaugucaugcagagauaaaaaagcaaauuaacugagcuaggcauaauaucuguaauaacagagccuuguuuaagaccagcacagccuagcauaccucuauagagauccccauggaggugagaaauuaguacagaaacuccccuuguuacaccaugguagaaccacaauuggccuaucauccuuucaaaccuuacugacauaaacagccucuucuuauuccaaagccccacucauacucuccucuuucagguaauguuaaauaugucccagaguacucccauccauguguauucccccuguggccacaaagacuuaucauccugaccucuaccgcauggcuaccugcugcuuacugcucaguacuggaguuuugacuccacuguaaacccaaagacaccuuuuaacuagccacugaagcugggccucccaggucacacucuauggacugucccagguaugccacacauggguuacauacucucugggccagucaacacccucguuuuuagauucucucgguugcaucccugugugcacucauccaugaaaucaguguggacucauuuuaggaaugcacccuggugugaugcgcccugguguucugcagugggauaguguuguuuacaucaugcccuugucuucuuccucccacuaacugcaguguucguuuuugcugcgaccccagaguuugacaccuucuccccuggagauaagauaggcacaaaagacuuggggagcuaaggaaacauacaaggcucaggaaguuuaagaaaaucguuaagacuuacaggccccuuucaagguuaccuacacacauaguaacaauugcuagggagaggagacugacaagaucugccuggaaauaggacaggaggcuggggugggggguggggguggguucuccagggggcuccaaggguacaacuuuggugaaucgggguaggauuuuuagugaugcuauuugugacuuacgaugcucuuguaagaaaggccaguaggcucggcuucucacuaacuggauuuacauucagucauuucuuugcuuaaucauuggagcccuccucugggaggaauagcugucggcucaugucucccugagaaaagucacguagcacagucuaagcguaucauuaucaacaaagcuaaaccauggcggcuggagagauggcuccgugguuaaggauacuuacugcccucaaagaacgccuggguuugguuucccgcccucgugugguggcucacaacagucuguaacucuaguuccaggggauuugacacccccuucuggucucuuagggcacugcauguguauggagcacauacacuuacgcaggcaaaacacucaugcacguaaaaauacaacuaauucauuuacaaagaaaacuucauuacuuuggguauauucccugccuggacacugggucaaacacuggcaaauguggcccaauuuucaucguggauaaaaguuugccugucacacaggcuugcugcugcugaguugcagccgcugaauugaaugcugagauggaguauacagcccgcagagcuuaaaacacuuauucaacaaccccuuugagaaaaauaaauugcagauuccucacgggagauuauaaguugucagaggaccagaaaccugucacuuucagucuuuuuguaugcccauguccaguaugugugccugucaccuaagauuugcuguuuguccaaggaggggaaccuauggguacagcgacaccuguggcaaguuuugaucaucaccccaaggcuugggugcugcuccgcuuggaauagcauugacaauauccccaacaguggcucagcuuggagcaucagggcaaggcugauggcagugacuacuguguggcacuugccuuucucagcaagaaaacugccccgcuaccugggaaggcagcugaaggagugcugggucggcaucugcugccagcgagacuauuugaaaguuugaagaaaugagaaaaacuccaaguugaauuugcccgaauaagcaauugaugcuuuggaguauaauuaucagggagaaggaaaaaaaagggggggggauguggggagggaaucaacacauuguuuagcauauguuauguuaauggcagguuaggauggcccacugugcauaauuuagccaaacaauugauaccaaauuuuaauauauauauaugauuacugcuacagaaacgaagcgccaagacaaaacacaggagagcucguaauagacacccgugaacucugaagcccuaauuacaucacgggggaggguaaacaguugcugcugaaccaagcagaaaacagggguaauuuguaaacagguagaaagccguccaggugcacagcauguguguggggcggcggggccgggaggcucugagcuuccaucuggguuuaucagggauggcaagguucaugaccacuucccucagcugcaaacacagcccccaagcucucccacaggucagcuccugacuggccugcccuccaguucaaaaauagaaagcuaaagacaagcauuugucaaggaggcuucugugugcccuauggaauaaaacacagucuuccucugggaucugaaacucguuacuuagugucuuuaccaaguaccuuugaagaguucuaucuuuuuagagaguggaaggagaugggucuuaggcuacucugaccacaggacugagacuugcaggagacucuggaguucagauuuuaagcaauaggaaauauguuggguuaucuuaucuaugaguccuuggaaguguugaggcugugggauuguaugacuguuugagaucaauccagucauagaacaguguguggcuuugagucaaugaguuaccagguugccauuuucacccugguaggcagcauugcagggccagugacaucacggccaucuguuaggcgguccuuggaguacaaauaaacuugagugaguaccuacagugcagcugcccugggaugugacuuuccaucuauggucacaaaacagagucaaggggaaaggcugagaaaaagucaccaagccucaucucuccuuucuaacauacuuccuucucuaccuucugaacacagacccucaugggagucccaagauuucuguccaucucaggacuucagaagaggaccuggauugguaguagggucuucacacauguaaagaauucaacaggacuacuauccucaugagagccaggaguaguggcgcacaccuauaauugaagcucuuuggaggcugagacggaagaauugcaaguuuaaggcuagcucaaacgaauaccaugaaacccuuacccccaagcaaagcaauaacaaaauaauaaguaaugauaauagacagaaacacaggggcaucagccugcaugauaaaagagguucagcuugagaugaugguuccacaagccaagagguccccaggacuuccagucaccaccagaaccuagggcguggcgagggaaagguacccaaguguucacagguuacggccauuccaccaucuugauuuuggacuucuagucuccaugucuguguguguggggggggggacuuccuguucaucuacccuaugaaacuuugacaaaucagucauuggaagcuaucuaagacauuuagaugcuccgaggggaccuugcaccucaucuaccucuugauuugacaguugcagaagcugagaugcacacagagguuagaugcuguagggagauaaggucagaggugagggccaagccacaccucacauucccagcucuccaacgguggacaccuucaacagcaucaaagucccuuuugcagggaacauucacacuugugagcuaugccaucaccaaauauaagaaugacaggggagaagcauguccucuuucugggacaucacaucuuugucuugggaaccaguggagaugacauuacuugacagagccagguggauacugcagcucugguuaagggucuugagaaagggggaaugggcuggguuaucugaguagacugaacacagggucuuuauaaagggauggaagagagcugggaagacaccuuauuggguaaagugcuuugcuuugcaagcaugagcaccugaguccaaugcacagaacaaaggucaaacaaagcugggcacagaggaguuugcuugaaugucugcucucggaaggcagguguagggagacuccugggguaugugagagaguuagccuaaacuaucccaugaguuccaggcugguaaaagacccuuacucaaaaaagaaccuacuugguaaauagugcuggaggaaagauagccaagauuguucucuaaccucugcauguaugugcaugcaugugcacauguacacacacagauacacacacacacacacacacacacuuacucacgcacaaacacacaaauaggacagaaggcaggucaaaguuagagcuugcaugaugacaggcuagagaagagaaagaggaagaggacaaggacgaggauauaugagcccaugaagaggcugggaugauguguuuggcuccuacaagaaggggucacauacaaaggaaugucacaaccgucuagaaucuguaaaagguaaggaauggacuuugcuauagauguuaagauuggaugacacguugauuuuaggacuugugugccagggugaugaaauacaucuagaauuucggaaguggaggcaggaagauggaaaguuugaagccagcauaggcuaugggugagacccuaccucagcaaaacaagguaccaaaacccuccuucaaacaaaacaaaaccacagguagagauacacaacaaaacuguauucuugacuguaaagacauacauuugaauuauuaauucaugccacuaaauuugugguggcuuauugccacagugauggaaaguagaugcagaugauacccccaagacagaaccaaagauaagauggagaggugagaauggcccaacacauuacugagugcauugaaagguaggaggcugguugaaaagagaagucauuauaucugggucacuggaacaucugagggacagaggccacacaggaugugugucuaugauggaggagccaagccauauuucaagcugcaagcugcacaccuggcaaugaagcucuggccaguuucccauuaggccaaacauccagugaguaucacugaaucucaggcuugcauuucauucugcucccucagaagugaagucuguguguuauccaagcgcuuaaucccagugcguguuucggaaagacgcgcucucccuggcuauuaaauucaaaacggagaagucaucuugucagaaccagaaaugcucuuuucaaggagcuuugcaucuuccagagcucauggcaaaaauuugaaaaucucuccacaaagcagucacuaacgaugcaaugacucacaacuguuaucugaucggucgucuuaccaaaaacucuaauacaacagggcauuuuaacacuucagaacauggaggccuuaaugaggguccgucaauugaucaggccuaccuaggcuagacagaggguucggugaguagaguguuugaagcacaagggagagaaccaccacuucagguccccaggucccaggaggcagaggcagaggauugucagagcaagcagaguagccagacuggcaggauugccaaucucuggauuuaaugauagaaauugccucagcauguaaggucuaugucuuaugucuaugaagauauuugauggcaaccucuggccacuccacucaugcacacacacacacagagaucccacacgcguuagcccauacacacauacacaugcuuacacauauaacacauacauagacacgugcaaaagagcaguuaccagaauuacaguuauuaagugucauucccagucuccugaacccaagcccuucaacagagcccuguucugcucccaacaucagucaccuuugggguccucugucuacacagucaccccccuaggccuuuccguaagucuucauccucuuuaaacacuaaaagaugaguccagggcaugccuaaacagaguggaccuuugcagcuuccauucuugguacccgguccccuucuuuuguuuauaauaucccaaagccccuugggggucccccuccccagcugccacccgcugugacuuucucaaggcaugguuguuuagaagcuaacguuacuuccuggugcuaggaagggucacagggcagaggccucccugaugagaguuucgcagccucuggcucaugauguugguccagagugaaaagcagccagaguggccuaagaagaagccaugguggugguccuacccuuugguaguacuaggagggguguuugaugaaaacugagaaagagauaauuaaauccuuugguaccauuuaugaaccuggaucccaacaggccuaaagucaggcgcacuugaauacuaguaggauccugauccaaagugguuuuuuguuguuguuguuuuuugcuuuuuuuugugguguuuguuuauuuguuuauuaggggugguggugguaggggcuuucuuuaaauccauuuaaaucucaucuuugguuuggaucuugugucagacuguauugcaaaaaaaaaaaaaaaaagccauccucucuagaagaaaucuuuauauacaccgaacaccuguaaaaauguccgauuccuggcacggugccauuauuucuauuuaucucauaguuuucaucugugaaguuccuugugagguuuccugacacccucacaggaaacagguuacacgcagaguauuguuuucauuuucuucuaaacugacgcugccacucaaagcuacaccucucucauauccagacaccagccguugcagucagagccucccaccugcccacguguccaggaagccugugccacagaggaaauggccccggccaagguacgaugggaacucaucgugacuauagaaccugucccgugaugucacugaguaggaagcuucagggagagaaacuguugucagacagucagacagacagacagacaagaaaggagggguucugugggaguucucucaaaggagaauuuugaugcaucauuauucaaaaaucuaaugacacgggaauagaaccauuaaaauacguuauuuauuuuuaguuauacuucuacuuuuuccuuuuucuauuuuguuuuucuucuucuuuuugguaacucuugugguuccauuguauguuagguaaaaguuccuuugagaaauucagauuaagaagaaaaagguguaugggugugacccuuccuacucugaaauggcucuugcaaacccuucugcccgguggaacggugugcauacgauuagcugcacacagggggcccacggcuugcaugagcaguuaauuugcuccacauuuccaggcugcauuauaacccuaaugaucacuaauaauagacagacccacauuuuauugaguaaguaauuugagacauuaugauuuuuaucaugcgaauaggauugaccaauuuacauugggcccagggagauaaauaacugggaucaaucucugcaguggcgggcucugucucuuggcaaacugauaagcauugaucaggaagguggacgucgugaggcaguaaagccaacgagcugcugcugcgcuccagccagaaggucggccagagagccuguguccaccugugacaugaugccaaaggcaaugggggggaccucauuuugggagagaaggugggcuuugugcucauggggcacagacucucaagccaguccugucucuccucuucuaccugcauaugaccuuucauccaggaacacaccaggaggcaggcaaggggcuggcaagaugguucagggguuuaaaggcgcuugucgaacaugccuggugaccugaguuuuauccccagagcucacagaaaggaggaaggaaagaauugauuccagaaagcuguucuuuggacuccguacaugcaguauguuacaugcaugucccgacauaauucacacacguguugggcuuuuuuuuuaagugcuuuuuuaaaaggagaguuagguagaaaaagucugggugugguuuauucaagaggauggagaauagguuccucccccaaagucuguaaacauaaaagcagggauggaagggcuucaugagaugcaucuacucugcagaaagaaccgagcagaaaggggauucccuuuauugccauagaggaagccacugagauccuuguggcuggggugacaaugauggggccuccagguucucugaacucacacaccagagaguggaggagaggcggagcucgggagcacuuugcugaacacuucuagaaagaucugccucaguugcaccuagacaccagagcaagaauguuuucaaagcucaagcgcuuugaagguggaaauaggagaaucaggaacucaaggaggggcuuggagagaugggucaugggggagagcacacgcugcucucuuguaggaacugccuuccauucccaacacugugucaggugacucaggacugccugugggcuacagcucuggaggacugaugcucuucuggccugugcaggggccucauguagcaaacgcucacacagacacauacaugcacguacaugaaaauaaaucuuuguauuaagagagagacggggcguaaagucauucuaagcucaaauacggaguuugaggccacccuggugcacugagaucuugugucaaaaaaacaaaacaaaaaacaaaaacaaaaacaaaaaacaaaaacaacacagcaagccaaauaaacaaaggaauggaaauccuagcaaacuuuuuucccuguuugaaggaguuauuuguuggaagcaaaagucauauuugggguaggggauaaugguuguuauucugggccucacagacuaaccugccugucaguaacaucuggcuuuuuucccuaugcaugucuaggccauguaaguccauacuuuagccauuuguuuauaauuagaaucauaaaggucuucuuucuuacuguuuuuauuuaaccuaauacuaccucaggaauauuuuuuucuccuuucucauaucaucuguuuucccacuuccagauguuuuauugugacucuuaacuuaaggagaugccuuacugaggggaauuuuuaaaaauguacuuuaaaaugguuucuuuuauuaucuuaauucuuuauuuguugcucaguuggcauuucagaccagaucucauguaacccggcagcuugcugacuagcugaacuuccaguguuccugccucgaccucccaaacgcugggacuacauguaugucccacugugccuaguuuaugucauacugaggagggaaccuggggcucccuuccugcuugacaagcaagcgcucuccuuggcgaucugcaucccuagccccugggcuugguuuuugauguggcuuugcugucuaggcugaccucaaccuugucacagucugccuagggccuccaaagcucuaggguuacaggugugggcccuggugucugaccuagggaagagaacuauuaacagaaugcaaacaaggugcuaagugacauuggaaaagcaguaacaacaacaacaacaacagaauacaaggcaccauuggcacuaagggcauguguccccccaccugcccagguucacgggggggggggggggggggggggggcaagcagagccccccugggaguuagaagcuacacacugccagucacucauuugaguguauuguugaagagagaagcuaggagcaugcuggagagggcucuucaaaagggaacuggcaggcagucacagcagucuguuugccaucaggaguuaauuagccuuuggccacugaggaggggaggagcuuuccuuggauggaggcuccaaccuuuagcugcagcugcuauugcuguuggcacaauccacagucauccccccccaccccccacccccuguccccugcaaggagagcaaccggccuugggaaugaaaaaaaaaauuuuuuuuagaugaccuugaaggagagaggacagcucagccugacuagaaaugucaacagaauccaucuuuuccaaaccaauguuugccucuccugggacuggagagccuacguuucagcagaaaacguaagguauccagggacccggaggauucuacagcgugucucuuuugcuucggcuacugggagguagcagaaggcuacggaccuuggaaacaucuagauuuauauucagccucgguuacuuauuagcagugggaccuuuggccggugacacuuguaguguuccagucucuuccaccaacaugccuucgaccagauuggccauccuauaaggaaacccuuauccaaguucagcacagauauauacaucugugaacccagccuuugguagaccgagacaggaaggccugugugugucuauuaguauguagcccacacuaggcuugaggugugcaccuaaggcaggaccuacgacaguuaagacacuuaaucucauguucuguuuguacagcugaggagacaugacagcaaaaccacuuaucccucacagggaagggaccuuuggcaccuccacugaaucugauccucauuccugugucuaaagaucaccugacguaacuuuacugcacauuucaagguuauuucuucuuacacagaauaauuccagagucuuaacagcaaauauuuagcaaugaucuucuaucuuccuaauccuucgucuacuacagacauugcuaaucaacuccaccauucuuuaaucaggugcaggcacugugucaagggucuucccaaagcagagcucuagggcgucaccugggauacucucaaagagggaaugaccaaggcacaccauuguauccugucccuauaauaccaaagguuccaguaauucaugccuauaggcaccgcucagagaaagccggaccaaagaaaggcuugucaagagccuagcacaucauuaaaaaugcaaaaaaaaaaaaaaaaaaaaaaaaaaaccaccccagacguuuauaaggagcucaacuggcaauaacucuauggggcaaggcuggggauuaaacuggagagcugaaugugagggacacagaauaaugauccaugcauucuucugcaagcagaggugcugugugaugagugugggcuggggcaguaugguggggaggccaggggauguggugguugggggaaaccacacagagaggccaaugagaggcacauggaacuguugugaucucuaucuggggagacaaacaagugucuuuucauuccggauaggguaucaacaacagaccaaagaaauuuccccaagucuagcauggucgaucaaagccuuucagugggguuauuuauaggagcagggugaggguuacuuagaguaccauguacacaacucacaaguggcuacacaacuacagaaaaugucucgguccuucccaguaacucuucacugccuacauguucucagagagggaaguggccuugugagccccuucuucauaacaaaggcugucuacagauuacaaccgauagccuggaguucaugggucacucucugcuuccaugaugaaauauuaauggcauugaucuuacguuggucucuuaggacaaccauaccuggaagucaagggugcaauggccaucccgugcccagagggauagcagucuacaacaacagccccaaggauguggcagaggagaaguaaagaggaugagaagaugagaagaaccugcaccauacucagggcuagagagcaggggccucccagcacuggcugggccaggaggucagcagggaggauauagggucuuaaugcaagcaucaagccaaaggaugcugguggagauguaugcuuaguuuucaaggccacugggacggagcagagagguuucugggaagcugugacuucccauauuccucgauucuaaucacaaggcauuaaaagaacagccaacacauauccguuacuuaugccuaaggcacagacuagaagcuuuguuuccaggcucuacuacagcuugccugucuuguccagcuucgauggcaucaagcuguuucugcuacgucacugaucuagaaaguuucauuguggccucuaggugguacagccugggagcuuccucauacacacgugggaguugagaugggaacaggauggugggugggcuuaccugugugcuucuuuuaaauauuuauucucuuuuauaaaguuuuuuuuauaaaguuauuuuuuuauauaaaguuauuuuuauugggcuggagagauggagagauggcucaguaguuaaagagcuucuguuguaaaagaccuccaugaacuucaucagaaaccauggugggccgguuacagcugccuguaacaccagcuccaggggagcugacaucucugucagaggucucugagggcaccucacucauuugcacauggacacacaaacauaucauuuuuuaacaaaauaacucacucgaguaugugcgugcgugcgugugugugugugugugugugugugugugugugagagagagagagagagagagagagagagagagagagagagagcauauguguacauacaaguccauagagcauauguggaggucagaggucaacguauggaguugguucuguccuuuuaucaugaauguccuggggacugaaucugggggcucuuuggaaagcaccuguacccacccaaucauuuugcuggccuugacguuuuaaucuuugcuucauuucccugaauauuagaguaaaauauuucaggcagagaauguaaguucaaauagcccacaguggaguggcucgcuggugaauuacaagaggacaaaucaugccccucgugauuguggauuugccuuucuuuaucuuucaacaaucuuacuagaagaucauucgagcucuguuauguucuauuuuaaaauaauacuuuaaaaggccacccugaguccaauagacugcuaagaagaauggauggugacauuuaggguuacagugaauaauccucuccugucauauguaacauuguggucagcaggugucaugagcugcagggcgguucuuaguggagaaguguuuucauuuuuaaauaauugucuuuccuaaaccaaagcaggcaugccuaagagagacggcuuugugagaaauaugcuuguuugugaauggaagggcuaugguuggguucccuacaauucacaugaaaaccaagcaagaauggcaagcccagcacuugagaggcaaagaccggggaauuccagggcaaggugguuagcuaggacuagcugguaacauccacguucauucagagacuuugccucaaaaaauauaacagagaacucugagagaagaucccuaccauuaacuuuggaccucuauacaaacacucauguguacccacauauauguguauucaugaacaugagaacacaggcccacaccacauacauaugcagaaauaggaggaaggggaauaagaggaggaggaggagcagcagcagcagcaggaggaggaagaggggggggaggaagaggaagaggaggaggaggaagaggaggaggaggaggaaaagaaaacagggggcauugucacagaagcaucuaagauauuugcuuuugaagaucaacaccaccuuuggguuugugaccacaggcuuuucuauccuguucccaaaauaauggcucugacacuuaauauauauaaguagacaccuaggccaauaccuuugaccuguuuccacuugcucauaacucaguuaccccguuuaaacuacccuaagucaugccacguggcuaguuaccucuccuucaguaucaugcgaccaucuucuucagaguucaaggcaaacccaucugcacuugacuaucccagaaauccugucccugugcaggaacucccaccucccuauauccugccgaagcuaacaggucagcgguauuuuauugaaggugaugcuuccauacauugcacaagagauucucucuauagggucaaucugggaaagagccaccaggccauguaaugacaauuuuaaacauuugguuucuuuuucaaaacacacgguacuauuaugagacuaagguuucauuucauccccaggugugagguaugggcugcuucugauuguccacagcagcugauuuucuuccuguucuagcaggggcgugauuuuggcagauacuuucugcgauuguauauaauguuuggaauuuuuggaauugcucaggucccgccagaggcaggguagauuguugguugcugguugguugcuguuggucacauuuuguuaaguagucaugcaugaagaaagaagaagaagaaggaggaggaggaggaggaggaggaggaggaggaggaggaggagaaggagaaggagaaggagaaggagaaggagaaggagaaggagaaggagaaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagaaagaagaaauaaucagauauccugagggcaaagaacaaacuugcuccaaggaacuugacagcucuauucagcaggaaguagucuaaugguaauauggcaccuuuuccuuucuaucccuuuuuuuuuucucucugcuaucuaguguuaggacguagaaaggguggaagacagaagaaccuacaaaguagcaaguggcuacaaggugggaagagcuuugauguuauguucucauaggaacuugauuuuguaaaccuggcugguuuccagccccucuggaggucaacgguagccuaggaaacugaagaugcuagucuuggacuuacuaggugaaaucagggggcaggacccuacaguuggcaguacaucucaauagagccuaaagaaggcauagcuacuuaaagcugagggcaucacacacagccaggaggugccuacccaucuacauucugaugguuuguuugcaauuccauuauuuggguuaucuuguaaagacauacugaaugcacagauagaugucaggacaauuaucgucauuccuaauaacagggcuuuccauuuccugagagugccucucugggaccgauguuuuacauuggguaugaggcuuuuuaggacaauuaauguuuaaaauagcauccuccuacagcaugggaaaacauuguagguagagaaucagaaaacauuaauauaaaaaaaugucaggagcacaucauaaaaggcuuggcuugcaggucccuggacccaccacuagucagguaaaaguguguggccucaguugugagucuauccauucugcuauguuuagcuucuccaagacggaacugaaggucccugugggguucacuggcacagucauucaccugccugagaacuggacccugccaugucuggaccagagugggauggacagcccaaaucugggagauuuuuaugugcaacgaagagcugugaggcggauugaccccaaaugcccaugcaugggaaaagugucacugggguuaggacucacaucucuaauguggcugucacaaagcugccuacuuccccuuggcuccuggugauugguuuaucucacucuuaagaagguuauuagcauagauuccccaggacuaaagaguccccaucuccaguccaaaggaagauacacaucucucucaaugcaagaagaguggaaguggauaaagggccugguguccuaacugcagagucagauggagaagcuccaucagugucagguuggagagggacaaagaauauccagccagugccacacagcaucugcaaagggacauccacacaccuaccacacaguacccagggcaaggaggcacacucaagcugccagugcacccaaggacacugcucaggcuucugcugaacucuauagaaguucuuggccuuugaaagacacccuacuguguguaauuucccugcagacuacugccuguaaaucugauuggcaggauguuugaaugugacaaugaacaccucgauggugaagaggcacuggcaugggucugaagagacagcucauucaagaaagcacuugccuugcaagccugaggaacucccauaucugucuucugucugucugucuguccgucuaugugccuuccuaucuaucuaucuaucuaucuaucuaucuaucuaucuaucuaucuaucuaucuauagauacagauauuguuaucuauauaaaagcaggcauguuguuauauacuuguaaucccagcacuaaagaaauggagauaaccauaucccuggagcuuguuggaccagucagucuuuuuuuuuuuuuuuuaguucaaaaccaguaagaguccuugucucaaaaguggauagcaacugaggaaugacaacugaaguugaccucuggccucuauaggcauguguauacaaacgaaagugcaacucuccuaaaaaaaugugugugugagcacacucacaaacagacagauuacacuauacacauuaugucauacacauauacuauaacacagagagagaaaaagagagaaaggcagagggagggagacggaggggaaggagagagggagagggaaggaggggaaggggaagagggggagggagagagggggaggggagggagaugucuaucuagacucugaauaagccaaaccuacaaggagaagguguggcaaugauuuaauggcugccugcagcacacugccacucuuggcccagccacagcuccuuugggaaugcagugauggcaucugucugacugcccuccccgagaucuaaucuagacucugauagaggaaaaacuccacugaagaagucacaaaguaauuauuaaaaauaaggacagaaucauaggauuuuccuaaguaauacagacucauuaccaugcccuggcagacaugcauuuuuaaacaaugguuauaauaacagaaaauuagaccucauuacuuauucauaaaguucugguuacacucugcuccauuuguaagcguuuacuuuuauaaauagcaucuuuggggcagacgcugcucucuggccacuggaugucagaaaccauuuucugauuauucuggcccacugccauugcugacccucuaucaggaccacggggaagucuuaagauguaggggcuuggcccuucucagucacgaagacaggugccuguauggaguuauacugcuuuuuggauuuucgauuugauuuaaagcacuguugaaauuugaagacagcaaacaauguuugauggaucuacaaccuuuacacuaaagagagagccacaagaccaauaaaucugcaguagaauuaauaauugagauaccuagaagcucugaaagugaguauuaaauauguaaaaucuuguugaaaagcauaauuaaguguaucagugccugaagcuuaaagaaaaagcaaguuuccauuaaaguuauaaaugucuuuucuuucuuccuuucuguuuuucucuuuuuccuuccuucuuucuuucucuccucuccccuccccuccccuccccuccccuccccuccucuccucuccucuccucuccucuccucugucugucugucucugucugucucucucucccucucucccucucucccucucccucucccccucucccucucucucugucucucaaaacagggugucacagagcccaggcuggccuugaacuugcuaaguagucaagggugacccuguaccucugauccccuuuccucuaucuuccaaaugcugggauuacaggcaugcacuaccacgccagguuuuacagacgacagaacccgggacuuuguguaugccagacaggcauuuuaccaaccgagcuacauuuccaacccagaaauacuaguuuuaugaauacaugagugaugcuggaaauauauauauauauauauauauauauauauauauauauauauauauauauuucagcauauuguuuuuuaaaauauuaaguugauuaaaacauaaaauguuuggugagcugaagagggaagggaagagagagaugggggaaacgggccugcagcuugcagccuguauuuucccaugagucuucaguaguccccaaacacuguggacaaguguuuaacauucuacucuguguaacuguggccuggauaugguuacuacaguuugacaugucuaaagagaccgccaguaagucuguucacucaccgggacauguucuauuaccacucacugugccaguacugaggacccaaggaaaauagggcaaagucauguucaaccuacggagaugcuaucucugcacagcccuaagaugucccgcuuuugcugcucuguuuucgagggucuucagaagacucgagacaaccacagaaaccauucugagaaaaaccgcgucuccccaugagucaucgcuccuuccugggaagcagcgcugagcuaagugucuucaagguacuguugcuccuaaaagcccaccuugagcccagcaccaaguccauguggcucaaaaaggaaaagauuuguggaacuccauaauucagaucaaagguccacauaagaagcugaggugagaauuggauagcccccaagaccugggguaggcagggacccccagaggaccauggacagagguuaucccuugcuaugcacuaauacaguaauauuacugauagacagugugugcaaggcuggaggcuggcaggccuagggcagaggacugaaaaaauaacuucauugccugccacuuagcauaaauaacaaaguuaaauacuauggaagguuuccauuuggagugaaugucauggugucauccagauacuguucccacuaucucuacuacaaaacacuuuucuuauucacuugguguccaugagugcuuaccgaguggcugcccuggccuaucuccuggcagguuuaacuuugguccaauugcaaugacuuguugagacuagacgggagauauucaccaagguccugcaaacaguaaugaagaacggcaggcugaaguaaguggcagaaaguggggauugugguucggagagaccuuggaacaaaggcaacaauucuggccagcagaggcuggggccuaggguggguggaauuucugagauugggaugcugagcugagaucugaaggauagcagggugaaaggugggaaggaaggggaggccgaggugacaaagggcagaguaaccgaaagacagagaagggaugucaggguagguuagaggcugggauugcuaaauuaagcagaaaggagugaagaauguaaaggaagguguggguuguuaacgcuaacgguuuggcaugcggaaaaaggcagcagguuggaugugggucauggggucaucgaaaagacuauugugucuauauccaucacauuagcuuccugguaucuguguuggcuugaaguuguugucccagcacccuugagaacaagaggcuaaaggcauucucucaguaaagugggguuccuuugguagucucuaagggauggauggccaucccuaguaccguuggacucgaguugagucuccaagcucugcuucguuuucaccuaggcuuugcccucaucucucuaccucugccuuugccucuuacaaaagcauguguccuggugcccuaggagaagcucggcugguagcauacuuuccuugaugacauaaggaacuugaguuggauucuuagggcucaauugaaaaugccaggugugguaguaugcaccuguagugccaguguaggaagggggauggggaguaacgggggugcuccaggcagcccuggucugauugauaaguuucaggccaaugacagaccccacgucaaaggagguagaugauauucauggcugucgucugaccugcacaugaacacgugugugcacacacuaaaacaaauagacacaugccauuagcuuugggaucugccugugcagcccacuguuaaggccucucucuuacauucuagguucuaagagagcaucucuuuuucaggaugcacacaguccagcgcugaaagcccuggucuuaauucugcacuucucagaggacaaagcccaccgaaccgcaacagagucuggagagugaaucucccugucucagagcagggggcauuguguucugaaguccagcccaggaagugucacucccaacucuccacggugccuguagcuauuguccugcuuuaaugccuuccuaugaagucauguggccagcucgguccccucagccucaccucaucgaucuuugcuccuguggccuuggccucagucuucccucaaugauuucucacgccaauucucauuuguguuccuaucaaggaaugaccuaaauaagccuuuaagguuuauucacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaaucgacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggagugcaggcuuguacaaccacucuggaaaucagucuggcgguuccucagaaaacuggacauaguacuaccagaagauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugguaaguggauauuagccccaacccuaggauacccaagauauaagauauaauuugcuaaacacaugaaacucaaggagaaugaagacugaaguguggacacuaugccccuccuuagauuugggaacaaaacacccauggaaggaguuacagagacggaguuuggagcugagaugaaaggauggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaagggaauuccagggccaaaaagggggagugggugggcaggggaguggggguggguggauaugggggacuuuugguauagcauuggaaauguaaaugaguuaaauaccuaauaaaaaauggaaaaaaaaaaaaaaaaaagguuuauuccuucgugaggacucaaggcuggaagagaguaaguuacaaauucccuuggagauauagguaggaagugcaaugguugggaccgcagaauaugccaugacccccgcccccacccccacccaucacccacccuucgugcacuugagcacugugggaugcuuuuuguccugccccccucccucugucugcuucacaccaaggcuccauugaguagacaacuccaggaaaccaugccuauccugcaucugucccaugacaaggaagcuagaugcugaucugcgcucuauaaaacauucagaguucaaggaagagaugcgaugcauaaaugcaaagagaggucgguaauucuugcauuacacugcuccagagacuugaggaagauggacuguguugccauccguugcuuucaagcuuucuauuaggucaagugcgcacauagaucuaaugacaaagccccagagccacauccccccaugcuuuaaguggaauaauuguuguacgggacggugccagugaaagugauuauagguucucuugguuuuauuauuaguuuucaauaaggcggcagcacuguguccuugcuguguagccagucuugugcuagaugcuuuccagaugcucccaucucauccucuuuccaaagccagucaucagcucugacaucagaugugcucgcucagggaggaaacugaugcccgaagaagggacauugcauguagaguuggcaaacacggaagcuggucccacgguggccuguccaagcagccgcugacauguguugucccagauccaggcugguugggagcugccgccucuuguggccucccccuccuucuugggcuccagcccccuacauuagggcuuauuauuuggcaucaaucacccccccaauuacaugaaugccaccgccacgaacacuuguaauuaaaacugggacggauauccugcgugucugccccuuuccccgcuccucuuuguccugcugcgguauuauuggagagagaaugaacacucauggaaacagaugcuugcagaauauaauggggcucugcuccucgggagagcaggcugcgagagggcgcagagagcagacuuaaaggaggcagcuuuauuuacucacaacuggggcaccggcaggaagggcacacagggaagccaaagggcucagucacaacagggucuccacuugcauguuguaucggguuaaggucccucucugccccacguuuguccccacagacacagcuuucccaccugccacauucuuagcacaccugccaccaaaugcaccuggacuugaucuuggcugacagcucugucuguccccagcccugagaaucccaccucucuauucuccagcaaaagcuugguacucccuugucucugcuuugggcuucccucugcugggagaaagccugccgcucuagccuucuuugucccuugccuaucacuguccuagacaugcucaaaguaggguggucauaauggcugucauuuguccaacauuuacuggggaaugcagagggaucugccugggccaucacccucgggguaugagagauacaggugcuagggcugcaucucucauacccugaggguggaccaaggugaucugguaucagaaaaccaucagccacuuuaugaggucaacacaacuuagcgcaagacccucaucuaagcaucugugggugagacucugggugaacucggacagccaagaugcuagaugcuucuucucuacugccccucugaauuaaaauuugcuuucucccuuguuuaggacacaagcugacaaaauaucacaggcaucugagacuauucucauuuccugccuguugcuguuauaacacucugaccaaaagcaacugaaggggggaaaggauugauuuggcuuacacuaccaggucacaguccaucaucgagggagucagagcaggggcugaagaaggaacuugguacaugaacuauggaggaaugcuauuugcuaccucaauuucuggcucacuuagacucauacccagcuaauuccuuaauaggggccagaaucaucugccuagggaauggugccacucagugugggcugguuccuacuguaucaguuaacaaccauacagucuuucaucggcaugccuauaaucaaucugauuaaaacaauuacuugauugagacuauuuuuuccuucaguuguuucuaugcuaugucaaguuaaugauaagugacuuugucacugucaaaugacaguuagcuuccuguaaucucaaaauaccacuuuuaccuauuuuuugguuaauaauaggucuaucacuaaccaucccucucuguguuucucugucucuguaccuaugcauaugcauguauguggugugugcgcgugcgcacgcgcacgcgcacgagugcaggucauggcacguguagauaucagacaacuugcuggaguugguucuguggaugccgggacuaaaacuuguauguugaugagugaauuaugacaaaacuagcauccuuugugaacuugcauguuuuauuuuauguaguuagaacacaauucuggagagcagaaggagguacaaaaaugauggagagccccagaauauagagaguuucucaagagcagagcugaggccccguaccugucauccguuggagcucgguuauuucaagacaaggcaggcaaaacaccagaaaaguucagauugcauagagacaugaagauggcucugcuuuguuuuuaagggucuaucaaccauucauucauucaaucauucacucauucaacagguacauaaucagggccuuguauuugcaaaacacugggccagcacuccagauauggcucugaaugaacggagcaaguacccaccugcugcccucccagcaaaaggccuucugcagauccccccccacacacacacaccuccaccuucuauuaaagcuuuguaauuuggggugaccuauuuaguuauccacaauuuguugucaagaauccccugagagcccugccaaccuaaacucacuaacauagcccuucacuuuuauauacagugagcaucauacuuuguauacuuuugcggcaaaacuaaacacuguaaucucacagcggcugcucaggcucagggagauuccaucauggaggacacacaaggaggucgcccuuugugugugaagauagcuugaagcagcacccuccccucguaccugcuuagagcucugugcugugcacgggauucaaucuguuccucuugcugguucagucuccuuuuaugcauauuugccugggaugucucuuuucugucucccucuuucuacccagcaaacuugaacaaugguacaugaccaaaguagugagaaucucaacuaaugcuuaccagccacuucuguguugucuuuuaaauuggugaguguauuuauuaauacugcgauuaaucacuuuaacuaccacaggaugguucuuaccaucacccugauuuuaauggcaaggaaacugaggcacuaugaggugaagagaugacuuacaaaaagaacacacgugguaugcacucacugauaaguggauauuagcccaaaaucuccaaaaaaccaagauacaauucgcagaccacaugaagcucaagaagaaggaagaccaaagugugggugcuucgguucuucuuagaaggagaacaaaauacucacaggagcaaauauggagauaaaguguagagcagagacugaaggaaaggccauccggagacugucccacuuggggauucaugucauauacagucaccaaacccagacauuauuguggaugccaaaaagugcaugcugacaggagccugauauggcugucuccugagaagcccugccagagccuuacaaauacagagguggaugcucacagccaaccaauggacugagcgaaggguccccaauagaagaguuagauaaaggaccgaaggaguugagggaauugcaaucccacaggaagaacaacaauaucaaccaaccagucccccaagagcuccuagggacuaagccauccacaaaggaguacacaugguuccagcugcauauguugcagaagauguccuugucaugugucagugggaggagagguccuugguccuaugaaggcuuuauagauaccucaguauaggggaacugaggacugggagaugggaaugggugggugggugggugggugggggaacacccucauauaagcagggguagggaggaugggguaggggauuucuggcggagggcgggggggagaccuggaaaugggauaacauuugaaauguaaauaaagaaaauauccaguaaaaauaaauagaaaaaaaaagucacuccagagaagcgaggggauggggcuuucagagauauagccagccagugacagagcuuggauucacacucaaugguuaacacaggacacugcacacuuaucugcaaggacacaucaaaagccacaucucaaggugucccccggacugcucuugcagacuucucaguccucucuccccagcccugggcuaggggcugcucucacccaaucccuggcuagugcugcucugauuacaaucuuucuuucugcccgucauuucuuccuuuaccauuguacuccuguaaaacacuguucccggacacaaagcuagcagcugguggaugcucaugaccuguccaggucaacaagggaaggaagggguagggggguagugacacacugagaaagcauguuugugauaguggaacaguccaaacuagacaacuaccgaguccugugugcugugugccugaguacuagcuauuacucacacagccaugagauagagacggaagagguugggagaagcagcuuagcuggccuaaaauccuaagugaggucucaucauagcccuggauuuugagucugauacaggaauuaaacauggaucuuccggcauggcauuuuccucuuccauuccaucacuauccggggcuggagaacuguccuccacggagugucaaaagagccagcagucugagaugccuucuuuauucaagacacauaagaagcagguuuaccaauaaauaauggagaacaccaccaacucuucugguuuuguuucuguuuuauuuuauuuccuuuccuccuaaaaucaacuacugucuugugcuagucucagcuuuuuuuauuuuauuuuuauuuauuuacuuuuaacuauguguguaucugaguguggauuugugcaugugagugcagugcccauggaggccagaagagggcguaggguccccuggagcuggaguuauagacagcuggguguggaugcagggaacuagauuuagguccucuacauggauaacaagggaucuuaaccauggagccauugccauagagcuguaguccagccuuggauauuuccaauccucauacuuucauuaaugacccuugcaucuguggggaaccaaaaucugaagcauuauauuuagcacauaaucauauacugagagagaggggagaccuugguuuaagccacuuaaggugcccaggacucaggugguuuugcuugguuucaugaggaagagauggcuuacuuugauugggugagcauuauacguuugaaacaaucucucuggcuuugauagacgugaccucgauucugacaauuaucuauuuaauuggaucaauacagacagccuacucccccaaaccacugauucaauuaaucagaccauugucaaaucucuucuccucuuggggucugcauagacauggaccaaguggcaauuucuuccaagauaggcaaggaagucaauaguccccuuuuggaugaaguaucugauugcucacaaauuacacaaaucacaucgauugcugacagaucccaauguucguggagcacuauuuggcuuuggcuucagaggauagcuaguauuuaauuaaugacugucagauauaauauacacuauuauaaugaccagaaagcaguugccugcugauuuuauacaauagaacaaauauuuuggaacuagcauuaaggaggaagagucaguagggacaccaugagagaccauaaaugaaaaugucacugccauauuuaaccuggaauauucuuggaagccaugaugguucugacucguacggaacucguuccccuuuucguuucugcuucgacuacaaagaagcucaggcaauuuuuuaguguaaaaauauuaacuuauuccaugcggaggcuugcaaaauauguacuuuauuccgccuguuuuuaauuuuggcauguaguauuacugauucguugcauagugacucuacaggcuagagaccagccagcuagagccuacagaccaaaucgugcccuccagucugucuuuggauagcucacgggcuuaguauaacuguccacgguugacuacacaaaaaugcaaagauggauuuacucacccugaaacuugcaauggcaaaaauuuaaugguuuuaaugguuuuuguuuuauaaaaacaaugguuuuauacacacacgcacacagagcaaacuaaagaauauauuuuuaugacauauagaaaucaaauguugguguccauaaauaaaguuuuacuagaacacagcuaugaccauugguggguguguugcccauggcuauuacaaaggcagagauagauaguugugauaacuacaaucgaagaccaaaaagucugaaguauuuacuaugugacucuaccagagaaacagguagccaacaugucucaggcuuucuccagcauuuuguguccucugguaugggacaguuggauaacucacaugcuagauaauacagagaauauguaucuccccagccugugguuaaugccacuguauacaucauucuuccugauauagaucuagugguaauauuauccagaggauccgaacuccauguuugucuguuuguuugguuuugaggaaaacaagugacacuuuuaggagaaacacacagccuacuauguucauuuucaggagacuaagggugguugcuuuggcucccccuaaauuucccagggaaaggguugugucuauuacucuagaaggguguggcccgggccuugguuacagaagcagugaggcaggaacaucauggugauaaagaaacaggugauaaagaaacaacagaacuguaggaaacggagcaucuacugagcucagaagaucgggcgugguagacacaucaagggcaaggauggagagccagcuuugggacaaauaaaauagugcaagacaaagcuuaggaacauuccugaagcuugugcucuugaccuuuaaaaagcaggugguaacaccaccaucuaaaaaguaacguaggugggguagucuggagacuggagaaaggggugaaaugaccgacccaaguccaugcucucuaauggacacaaggcagcuagagagcagccagcaacagagaacaucugguuguaucagcaccucuauccguccccugugggaggagaacugaauaguacuuuccagugauacgguaggagggauuucagaaaccuuccaaacuugccagauuuuuuuuuuucccaaacaugcagggcuuuggggaaacaaaucacagcuucaucagaggauggaaaagacaguguagaauugagaaaugcaugggagcggguaggaaacagaggugcuacagguguggauagccaaacugaugaauggcugugagcagggccagcccuccuccuaaaaguggcaugucauuggcuaaaagcaaucgcucauuggaaaagaagugggcaucuccuacgugguacuuccuuggguucucacuuuugugugacagcugugauggagaauaguuaccaaucugcaaaggaagacauggggucaggguaaggcagaugaguagagggaaggaaugugacugggaaaaacaccuagcaggucauucagucccucugacuucagagucuuagcaagaccagagggccuugugaaacuggagucuccuaugcucugugugcuguucgcucaccggcaccuaugacuguaccuagaacaugguaggaauucaagggaagcuaagugcaaacaaucagaucguaaggcaugaccugauggauagacguuccguggaccuccacauuuaaauugagggagaaugcagccccuugugagucacaauugagcauccguuuucugcuuguccucuguccauuggauucaucuuucucuggcaucuuggggagggagcauuccuaucugagugcaaacauacucgauauggugacuuauuuccuggggacacaugaacaaguguuauaggacacugacacuagauagucaagguccaaccaaaggccaacuuguugaacugaucauauugugcuucgaggagcaugagugacacccauauaguugugucacccuaaagucuuacgccauuauggauaaugacuuccuagaaugcaucaugggguccuacuuucaacugaccuuuggcugccaagauccucuagcaucuuccaugaucgcuugcagugggcaagggccgggggcggggagggggcaguggcuacaauuccaacagggguccuaugaccuucgccucccuccuccuauuguaaugucaaaacuccauuacaguuaccauagccuuaacugucucuguacuguuuaagucaauuuguugcuauggcuaccaggccaagguaaucucagcuccaaaauggcaauggauuguuauguuagagugggagaaauaaagccaaacuccaacauggguagucacuaagugaauacucacggaagcagaggaugcccacuaaaugcuagggcaagagaaguagaugauuagacacugaacguaaguaggcaagagacggggguaagggagagucuacauuugcccugggagguaauagagcaaagaaaucuuuaaucccagcacccaagaggcagaggcaggcagaucaccaugaguucgaguccagccuggucaacagagacaguuccaggacagccagggcuaaacauggaaaacuugucccccaaaacagaaaagucaacaaauaaaaaaaagagagagucuguauuugacaaaacuggacuagaagcacucaccagcccuguccucuggagaaagggcuuuauauuucacccagguuuguccaucuaugaaacuggggcgugggggguucaauaacuaucugccuuaaaagaaugagucuauaaaucacuauuggggaacacaugcagagaagggggaaucugauggauguucagaaggcagcaauagagauuagguuagcuuguuuuugucaggucuagugaagccccagguuaaagagagagagagagagagagagagagagagagagagagagagagagagagagagagagagauauucuccaaaacucaaaaaucuuagaaaccuucacagacacugccggaguugcuugaaccaaaugcagccacguuuacauuuuucauaccauggaaaauugaggggauggcacaggacaacacagacaucuugagaaaauuuaaaggcucuaaagucuuuuuccauucagggacaauagaaaacaggaaaccaucaauaauguguccgugcccggcugcuggcugaacacuccccaggaaaguauauuuugauauaaaucagaagcugggcacagcacgcucuaggcugauguguuguaaccaccccuccugcgaucccaucccggcaaagauguugaaaagcuuucaaacuugacaaaacccaggcccuuccuuaaauagcaguaacccuucccagagagggaucucgcucccugccagcucacagacccaagucaggcucgagcgaggaaaggaggaaacgcagaagauggcucagcuccccagcggcucucaggaauugacagauucuaaauuacugcccgggaaguaugucgaaugccagcugacaaaaggacaagaggaagaaaaaaaucgggaagccaauagagccuccucugguccucucuggggaggggaugccucuugugaucuuguuaguuacuaaaccaggaaaccaaaugaaaaccugugauuacaaacaccugacagggagguacugagcaagugaaaagacugaguuggguggggggcugccucccugggguggaggcaauuugacugaaaagaaagaagaggaggagggggcagaggaagaagaggaagaaggaagaagaagaggagaagagaaggaggagggagaaggaagaaggaggagggagaaggaggaggaauggggaaggaggaagaggaggagaggaagaaggggaaaaggaaaaagagaagaggagaagagaaggaagaggagaaaggaggaggaagaaaaagaggaggaggaagaaggaagaagaaaacgaggaggaggaagaagggagaagaaaaaggaggaggaggaagagggggaagaagaggaggaagaggagggaaggaggaagaggaagaggaggggaggcuucuguaagcuuccagcggacuucagauugggucccccaaguugcuggguacauuaauacaucccugaggugcuugcccagcuccagggagaucucaagugcuggacaagauuuaacccuuggugagugggauggaagggccaaguccuaacagaacaguaagugcuguacuuuguaggcacacuggcacacaagacccuugucacagauguuugaaccuugaguuuguacuucagaagaguucacagaaaagaagacagaaacugcaaggaaaacuccagaggagaugaaagcguuaucagaagugagcagagaccaguugccuuguggggaugcuguucucaggucgggcacacugaugcaggaugcucugcuucccaggaaugugugacuguagaucagagccuacaaggauggacaucuggcuuuuauuugaagugaggaguucccacccccaugcaaagauaccaguaaaaguucucccccugagccugagcugaggugucaguccgcucugucccucccaggcgcacaguccacacucaauuggaaccuagggauucaagacaggagagggucugaaggaagagacugcgaagaguaucuuauggagggcugccguauguuaugaugucggccuucagucaggcuuacagaauggcugagucuggcacugacuagggaagagacgugcuguggggcaggacuaauaggaucugagguugaaccccuguguuccuuggugcuggcuugccucccagaaagggaaaaggcuggugggacaaacuugaagaccuucaagcccugugcagauuccauuccuucuguugcaaaguacagcuuugucuugucucccuugccccagacccacccucacaucccuucuccauccuguugagcuaugcacccuuucccacugcaccccgcuucuuucaaauacucugacaaaggcaacuuaggagagaaagguuuaguugucaauuucaguuuacaccacaccaagguggcagggaggucaacacagcaggaguuugaaguggcuggucacagucagaagagaacaauuaaugcauguauccgcucugucccccugucuagacaacaguccccacgauuccuguuuggagaauggagacaccuacagugggcaggucuuccccucucaaaguaagauaaucccccaacuaugggcccauuccuuacuucugguccuaucaccuugacaacuaauacuaacucucacgaccuaggacggagccugaugcuuaacagcaacugcccacugaauggagacgagaccucuguccccugcuccucgaaugcccucaggguauuccgugugcaccgguuugccgugauuuguuuuccucuuggucugagcugugcucuaacuaugugcugagaacucaugugugacauaggcuggauagaguucugugaaaguggcuaugccuacacagaacuucagaaugugaccucauuuggaaauggagccuuugagauguaaucaauggagaugagguaagguuauugggucaaaucacuauggcucccaauucugguaacucuucuacuuuuuguuuguuuugucuuguuuuuaaaggauauccuauagaaacauggggguuacagaacaagaagauggaagcaugcagaaagaggcacaaguuggaauguugcugcaggucugaaucacaagaauggucaggaaaugccaacggguccuuguguaaacaggggugaaauccgguccagaucuugccaagagaauacggccaggcugcugcucugaacuguauagccucugagacugagagaauacggccuucuguucugaguugccuagcccauccccuaucucguggcagccauaggacacugaguaacugccguccuccuuggucaccagcucccgguuguucgcaugaccuguccuguaguguaggcaguaagugagucugaggaaggguguguuccagcucuacccaggaacagcagggaucuguaggacuuuggucugggaaagacucuugggaacuuuauauggaugcagcuugggaaggcagagagcaaggugaugcaggguauucaaugccagcgugagcaugggggcugcagggcaggcaggcacucauccuggcugagcuuucuggcugcucccagggucagauggaaagaaggccagcuugugcuuccucccuccuuuucccucuucacuguuaugaaaugcaggugauuggaagacagcuauuacuuucugaaauccaaggugugugucuggggguggugguggggcggcuaccaucacaaaaggcagaauuaagcuacgaaauuaaacccucuaaauauaaauaauaaauucucucauuggugcccaaccccggggccaacguaaggaaaaccugagucccugcugagccuuuuuauuacuugagguauauggagucucuaauuuagggcuaaauauaaaacuaaagcacacacagcuggacuuucaaguaguuucaaagcacauuuaauaccuucccgcgaaacuuccaaaauccaagccguccccgcuuugcugccguauaaacagaagucgggcagaccuaacauaauguaugggauucaaaaggauauuuaagagggguggggaacacacaggcugagggcccacagccaucagaaugcugacccauguucaccggcccaugcuguccuuugcuggguggguuauaauagaaaccaguaaagcuaaguagaggugggggggggggugggggagggcagagugccgaggagggcugccuuuaaccgcaguuuugucugccccugaguacuuuucagcaccauuccuacaccccugggccaauggaaaaugagaaagagucaaagccggacuggcagacaugaauggauucucuguuaaccccgggaauucuucuugaaggagaauccaggauucugguuuaugauuuuuguguugccagacacuuuaauugauuuguuaaugagccccaaagucucaagacuucugugagcgaaaggcaguuuggagugaacgcuauguuacaguugagguaguagguacuguucaaacagcucuugcuuugaaggcguggucccaaaauaauacucagagguggagcuucggaaaauaauuggaucauuaacggcucuggcuggcuuaaucaucaggcuaauucacugaucgauucauacuuugacaacuuuauggggaagcaaaagagacuagaagauuagaccuacuugggcuaggcagauacuagggagcauggcuuugaaggucacacccugacucugaccccugucccagcgccaucccccgucuugcugcuuccugaccuccaugaagugagcagcccugacccugagguggcagcuagaagcuagcugagucacccuggguuagcacugggacccggucaaacaaaaucaggguccuuaucucuuagaaggaucugcuauggggacaaagaggaugcagaccacagacacccagauggcuuacaaaaugcagcuacaaguucuucaauagucuucccaccaggaaguagagccuuaugucccccugcauugaaucccagugugccagggaugguaaacucacuauaaggucuccucauauggugagaggaaguggcuuccugugauguccaaggucagucggagaagaccuugccauggcagcuaugagguguacgcccuacaagauccaaccucucuaagaccaccacgcuaaagaagccagaggcggagccccccacuuagccacucaugcaguaagaaagguaauuaugggcuagcccacccaccaaucaccccgugaccuuugccccauagccaacagauugagagacaaagcaaucccuacccccccccccaaaaaauugagccagaaaaugaugggauuuaauaaaaacaaaaacaaaaaaaugcauugguuguugucuacuaguagcacguggggcgcuuuguaacucgggaacagauaaaugacaggggccagacuccagggaugucgagauaaaaugaaaccauauacacuacauucccaguacacagcgggcucucggcagcggcggaugucagaucacgucccauuccuggugacaauagacuugauugccuuucaguuucacugccuauuuuuauacugugcgacgcuaaaucguaaauuacaagcagcuuagcagccucugauuccuacccagcacucuggguuuuauugggcucucaaaguuagagaaaggcgcacauggaaauuggagcggcuccucugcucuccucuaggggcucuggaaggagguucuucagccggaaacuccuagcuucugaccgugcuucgugcccccccacccccaccccucaacuuccacuccccgguggcaggcacaccacggugaacagggggcuuucugccgggaaguuugcaagcguuuuuucugagcaguauugguuuucuuuuuucuagccggcguagauuugugagcugcaauguguuccugcaggaaggaggcaagcagccucccuuggcaagucucaccaugaaguuauuucucggauccgcaucuagaauugguuguauaacuuggugauugccagaaagcauuugggagccagaugggucuuggcaugaacccuggcucuuuuccuuccagauggagagaacuugggggcagauuuuuguuaaaaaaaaaaaaacaaaacaaaacaaaaggaaaaaaaccucaguuuacacuuuugagaaaugggacuaaucauagugcccucugguagugcauuugggaagccucaacuagguaaauacucgaggcccugcucgaagucggagcucacagucauuuuucugcuaacaggaauccucaucgcuggaggcuaccccggcgaaaguuguuggacuuggcucagaaaagcauaagacgccugugagauuagaaauucggauacagaacgaacagcaugcugguguauacuagacacuccggaagcccgguggccugcuaccgaacgcauuugcugcuacuucucguaaagcacgcccccccccguuuuccugagacccccccucugcgggauagaugauggccauugguauuuacaaugaagagcaaucauucagcgucuggauggagggcucacccaagagcugcuaaacagaaagcucucaucucuguuuucucaucuuuaauacaaacucccauccuccaucucccuuccuccagccuccagccuaauucugaacacccccacccccacccccacccccgguaaugaacauuagcugggaggaugcucuggaaaagccgagcuggaaaaaguuucucuggagccccacugccgcagucauuacauaaccagcucccuccagcagcagccugagguucgcuguggagaugcuuccauuuguagccucuccaaguuccucuggugcagcggcccccuccuuccaagucccuuccccuccucucucuucaugccugaggucuggcuccacuggaagccaccccccccacacacacacacacgccacucgcucauuuuuuuccacauaauauacugcaguuuauuacauaagugauuuauugcaugcgucuuaauguauaaggggcaaaaaguuguuuaaaauaaauccaacugagaggauaaucucugugggcaaaauguacuuggacuuaauuucucuacuggguauuauacacuauauaauugccuuaaacagaagcugcacacacaaauuuagcuuggcaccgauaucuggcuacacggaacacucaaguuacacgcuggguuuuucuacaaauccuuugcucccccggaagaaaacucaacagcaucccuuaaagaaauauucagccugacucucccgcugagauugggagggggaggguagaagagcagcccauuguauccuggauggaaggggugggaggccuuugucuugagagagagggcaaggcugccagcuugucacugggcagaucugguuccuggaauucuguagcccccucacuggcccuggacaugggauaugcacuuaauuaaaguugaugguggcuugcccuucuuucuccuacagauuaauuaauuaauguauucauugacucccucaugcauuuauucauucuacaaauacucucugagcugcucuugagcccuugggcggugguggguccugggaauaggagagugagccacacacuguuccugcccacaccuaaugaggagacaggccguacguaauuaagcuguccuaccacacaccuuaagugugacaggacaggcuguugcgagaagaauggguacguggugcucugagggccuguagaagacagagaaaaguuucaagggaauggcuugagcggguguuaguuagccuuugcugccguaaggaauacacccaaauuuagaugcucaaggcaacucugcucuuuaugaucgaaguggucaggaguccaaauguauccuuaaauccauguaucugggaaucaggcuccugauagaaggcauaggagagaaucugguucacggccucuuuuggcuucuagaaguuacuggccuuucuuagcacaugccccucccuccaucugcagagcugaugagguccagucuaauccuuugccugugcaauucccugugauucaacagcaucucucuuccccacuguaggaaacuggugagaaaaucuggcccaccaggccauugagaaucaucucccacgcugaaggucggcaggugagcgaccuucguuucuucugucacuucaguucccuguuugcaaucuuaagauacucaacaggaucugggcauuaugacauggacauuguugguagcccuuauucgaccuaccacaaagaggacauaaagaguaagaaggaagauggggaauaucacaggcaaaggugggguguggcauugaugaggaauugcugagauacauccaggaacccagcuaacgggauggaagaagcaggcagggagcaaacucuggagagucaggucccaggugaaaggcccgcuccacgccccaaacgcccggagaaaggaaccauuuaaauacucuaguugagggcuaagccugucaguuuuccuaagucugucagauuacagauguuguugcuuucuuacucucuaaaggaagggagaguguuguauguuaaaauauggccuaugggguaugguggaagaacacucgucaucucaguacucaggaggcagaggcaagaggauggcaagucaggggcuagccugggcuacauaaugacauucucucuuacaaacuaauggccagcucauugcuuuccucaauugcugugagcaaauacccaacaagaagcaacuugaggagaaaggguuuauucucacucacagcgcaagggugcuguccaccauggcagagaagcaugccagcccaaguguggagugguuggucaccuggcauugacagucuggaagcagggagagaugaauccugguacucugcuugcuuucuugguuuugggcauccaggggcccaagcccaugaaagugauccuacccauacuuaagggcugacucuccacacuucaguuuaccugguccagauacucccuucaugggcaugcucagaaguuugccuccuaggugauucgagauccugauagguugguugaugcucuaucaaccauauagcuggggauguagcucagugguggcaugcuugcccaguccacacaaggcucugggauuuauucccuguguagaaaggggggggggggggggaagggcaagacccuuuuguaucacuuagaauuuguguaauuauacuuauuucaagaucucuuucagaccgagaacguagguuuugcuauagauaguucuuauguauacaauaaaaauguaagugaaaauacuguagaaaaaaguuauuauggcauuccuaaaaugucuccgccuucaaaguccucuauccccagaauaacuguaacucugaaucaucgaagaucaagcgucugccagcaugacucuuuucuuuuuuacuauugggagucaugggggugugguccuucuuagaagaagaauuucgcaauuaugugaagcaagcuaaucuugauuaucacuuccagaacugagcguucuagcccauggaacuguaccagacaaggucuaaguggccacaccuaccugugccggucuuucagugaccacuuagcuccuagaaggcugaggccccugccaugaucuuugagacuuucuuggaagcggccaacacuuauccuucgagauuccuggugggcucuuuguauguuugcauaaugcacagauaagaacaaagcuugguaucaccccuacuuggcuaaggacaacuuccaaaagugcucgcauuucagagaugcugacagggaaggauuucgaagaugcguccgaagguuaaaggucagacagauguguuccaacagucagucauuccauccgggcaagauucauucacacaccggacggcugcaaauaacagcugauuuacuuauuccuucuucugaggacugugauggccacauucaucugagucagcuaauucuugccaaaauucuagguggagguauuauuauuguuguuguuguuaucaauaucauaccuauuacacauacugagacacugaagcuucacuagaucuaugaaccugucuaauauuaggugggagaacccagcugugaacccagaaugaguacugauauguuuaagcauuccucuugucugucugucugaauuccuaaauggagaaguccuuaaaacucuuaagaguccaaagucccuucugcaaacacguacagcaccagcuguguagacaccaugcuccgcuuugggccccaggacagaaaggugaaaaacuaaacauucaaacaaaccaccaccaccacaacaacagcaaaaaaaaaaaaaaaaagauaguuucacugaagucgccgagucuaaaggaggacgcagaggcuagcccacaggaccaaagaggguaagcauguuuagggguacaagcggaggaagaaaaaaaaaaaccauuuuauuccuguugugcaauuuuucuucaagaauuuuggaggcuccacaucagcuugugaaacauucagacauucccaggaaggaagggugaaauuugcauagaaaaucuauuccgguccccagcccguuuuuuuggguuggcugcaaauaacagcugauuuacuuauuccuucuucugaggacugugauggccacauucaucugagucagcuaauucuugccaaaauucuagguggagguauuauuauuguugcuguuguuguuguuguuaucaauaucauaccuauuacacauacugagacuuuuauaguugcugcccucccucaagucugccugagcaucaucaucuucuaaggggacgaagaaaaggcgaugagacaaauacacagccagcacacacuuggcuucuuggagugauuaacaacguguguuuauuaauaagcaccacuguauacagacacaauucuuuaggcuaaaguuaggaaggacaaaauaaauaaauaaauaaagugaaacauuucaaagacuaugggggcgugcauguugggggcggacuugccuaccaugcaccagaucuuggacuuacuucauccccagcaucaacauagauaaaaugaaaauuaaaauguagaguugaaaucucaggguagcugggcccagaaggcucaauggagauacugauuuaaaaaaaaaaaaaaaaucuguaggcugucaccaggaagaggauaaaaaaauccgguucuguagaucucucugauuaucuacauacacauagcagguacguagucauguugcugauccuggaguggguuucuaagagauuauuuuaucuguggaaguucuuccuaggaacauuuucuuuagaaucauuuaaaauuuuauuucaguugguuucagcggccugcugcagagguauccucccccuccaccgccuccucugccuccucccugauagugggagccccuugcggcacgcucgcaagccacuugaacauaugucuacauggaagagcauuagauuguuaaagcagaugguggcaugcuucggaaucugacagccugcucugacggcacuaucagcaggcagggcuugccagcgacgcacauuucagcgaggggcugccagggagaacagaucuuggcuucacccuccaaggugcagagaggagcuuguguuugaaaacaagcaaaaugugcucucucucucucucucucucucucucucucucucucucucucuccaacagcaaaugaggaugcggcucagcagcguuuauggcacauguguugugggauggggaaauaguuugcaagccacgguucuauaaaugguaccgacuugggguguuuuccaucagaggcaggugggaaguagagggggaggcaguuguuggaagaacggcagagucgcccguuuccgugggcugugggucuuucuuucacuguacccuguuuguuucccaagauguccccaugcauuugagggucaccaucucauacugucccuggcccuguaaaagugcauugagagaagaaccagagacucucaggcugcuugcccacaggucuggcuccaggcuaaacacuucacugauacaccugcccauugcaacucauucaaaccguuuuugcacauagugacauuggggucaaguguaaggaaaaauuugagccaaacuaggugaaccuggguggggacagaacugugccccauaguugaugguuuaugccccgcuucuuuaugacacaguuagaaacaacauccacaaaguaaaauccaccucucucagagcacacagcugcaaaggaaccuggcucagugcugcuauuuucaaggugacuuugucuuccauauuucuaaauagagaguucuaugcaaggaacaugcaucucggcuuaaaggagggacggggggaagcaaaaacuaugucugagcugacuuccauagaaagauuugcauuuugccaaaauaacuuucgagaucuggcuuuugagucaccuccuuccuccggagaagugaaaaauaccaccccuuuuccagccaagguuuaacuccacucuggucuccaucucccuuccagucacagaaauaucguuaauaaauuaccagagcugucacgagcgcacacacacacacacacacacacacacacacacacacacacacagaugugaaaaucguuuugaaauggucccacuugaggucauaccaucuacgaaaauugacggcuguuauuuucuaauuccuucagaggccaccacgggugggucuucuuuacacuugcagugguugccccccuuucaauuugcauuuaaaagacaguaaauugcaggguccauaaacauuuuuauagugauuuauugaagacuagaaugucaucgguguucuucacacuuaaccaggccugagaaucaaaggcuggcuggguaugccaucucacuguuccugucagcccugugaggacaagccagucuuugggggcaucuucccuucucucauuuccucuucucccuuucuuuccuccuuucuccccugcaccuucuuuucuuggcauuaggucacggaagcacacuuuuagcuaccaagucccaaggcucagcucuagccuuuucaaaagaacucaguuuuuacuaaacagcacagcauucuuuaucagagagagagagagcaaauacaaauugaaaaucuuucuugccgggcgugguggcgcacgccuuuaaucccagcacucgggaggcagaggcaggcggauuucugaguucgaggccagccuggucuacagagugaguuccaggacagccagggcuauacagagaaacccugucucgaaaaaccaaaaaaaaaaaaaaaaaaagaaagaaagaaaaucuuucuuuuccucuucccaguuugugcgcugcccacuagaaagcauccucacacaucuaccacaggcaguaggugacaggcaggcaucuggguagacacagcagggacuuccaucuucccagcuaaacccuuagagcaagcauuggcugugcaccugcguuagaaccugcuauucggaaacaaugcuagagacauggaucuggggucagaaggcguuugugcuacuucccagccagcuaagucaugaaaggaggugugcagccaagacacacaguuuaucuaagggcacaguuacucuuggcauccuucgcccguuauggggggguggggaggacaggaaccuuucugugcggauuuuguagagaggaaaaggagagggggccgaggagaagaaaagcggcucugcgccucaucugcccuuccaguguccaaaagggaggauuucuuuccaucuuuuccacauuauaauaauggcuuuucggcuucugaaaggagccccaguauaagcgcaaauguugcaugaccgcgaagaaaaccccagucuuugucgcaccagugaaaguccuucucugccugcgucucccugccauuaacugagaugaaaugaguuucucccccuuuugauuccggcccccaccccacccccacccacccccacugccuaugacagugugacgugauugggcuucccggcccauuauuucagggaagguucuauucugguuugggaguuccugccugcaagguuaucugcacacaauguagcaaggcacucugcauucuuuuuuuuucuucuucuucccccuucugaaaucugaucucggugaugcgagcaagagaacuggcuuugcguuugucagauaaguagcuaggugcugggagucguaauuuuugugacuucagucagggcucccuguuaaaauaugucaacugauaaaaauguaagccuuaaaaaaauaaccuuugaaucaaaagugcuguuuuaucucaaacacacacacacacacacacacacacacacacacacacacacuauaugcaccccuuccuuggaccucccuuuauucguuugccuguuuccugguguguauuuccaaacaguucuuuuugaaugggguugccacuccagggccaccauucagcucacugggaggggaaaaucaagggacuugugcgaccagauugguguagcacaguuugucugaaaagaugcagaggcgcccuccccuguuuuacucuacguuguuaggaaauauuuccugaucacaauaagcaaauaaaucaaauccagaguggggcucuguuuugagcagagucaaagaauuuuagggcaagugucuagaaggacuaccauaaugucgucccuauguucccggggccagggccuagcugccagucugcucagggaacaacgcuuccuugucccccacgugagaagaaccaaaggcaacugcaguaaugucugugucccucagccaugagaggagcacaagaggccagcugggcccacaauggucuucaggcugcucacagguucuuucgccgucaaagccauccccacccugggcaaagccgccuugcaccacgcuggcgaacguguuauauaaauauuaacaggaggcagauugcuggagccccuguguguugcuuuccccacugguggcagccacacaaagccacuggugacaaaacuaagaggcacggggcgcgcuccaggcauggggcucgcucaggagcccagugccaaggcgagcaggaagcaagguccuguccccaucccuguucgaaggcccguacacccaggccugcagcugauaacacuguaauaguccuccuuugagaaccgcgguucccgccugcugauuagucauuuaucacaccuggcagcauggccgaacuauaauuacucuucucuuauccuaacggcacugucauguccgagaggagaggugcggcagaguccccaguuaaugacacauuacccucuugacaagcucuuaaagguuuuauuguaaauauucaagauauaaaacauccgagauucccuuuuuaauuauaaaaaagcaauuucauggccucccuuccccaaccugcuccucccccuccccaaccccacgccuccccaaauaguaaaguuuccgcucccuuauccucugcuuacugcaaacaaacugaugucccuuugucacguaaacucauugcuacaaguuaacucgguaucucuacgcaauuaucagacauauugccuaugaaauugguaauuuaaacacacaucacauuuccacaaaaguuaaauuuccgccccgaaagaaggguaaaaugugcauuuauaugaaaaauuauauaugaaaaaaaaaagccuaaaacgcagcauaaauagucugguuuuccucaucggaacgugaaggagagggggagucaugacgucguuuuuauuuuauuuuuuauuuuuuugaagaugagccucuaaaugaaguaaaaauuauaugcauauauuuuuuuaaacuaaaaaauuggaaaugugugggucguuaaacccugauugccuacuuacaagguuuagggagaaagccaauguagcauccagccaugcccugggcuauuucuguagcucuagaagggugcggcagacacuucccucagggagcgagggcccuggcaggcuguuccaucuuaccaccuuccugcuaguguuuaugaggccaucuuucugcugagccaacccucaguuuagcuuucaggcuaccuuggaccaacuuuccaucuagggauuaggacagaaggaugggagggguggggaagcaagugguaauuauaucuuuccucugacagaggacacauacacacacauucuuacaauacagacagucagacagacacacacauacagagacacacacacagaugagcucaccagagccaaaccuguucuaacucccccuacacacacacacacacacacacacacacacacacacucucgcgugcaucaugcaggucccagcuguacauugcauuaggccgugaguguggguggacagggaugcaaggauggaggugcaagugugcuggguucuauguguuuaagacucugaugcuuugacuggugaacuguacagaaaacagcagaaaacucccagcaguccuucaguuuaaauccagggagcuguagugaagccagagagcauggaguuuauucucucucucucucucucucucucucucucucucucucucucuccaucccuccguguaccccuuauguuccauaaaucauuagggucagucccucugcucgagccaccuacuugugcaccucuugcuuccuacacccuucaucugauggucuuccagauggcuuaagguuccagagcaucgcccucccagauagaggaaaaucuuuggucaaagguucaugggcuaggaaucagaacuccuagcagcaucaggaauagcagaauagcaagccucauaaaggcaaauagcggccagcacaaggguacacuauggagucagccccuacugagcacuagcuuauggggaggaggaggagggagaucacccuucauuuuuagggaggaggucuuuugagaaguagggaaauggaacagcagggaggugauaaaggugccagcaagaugcacccugaaacugaaaaccauggggggccguagugggcugcugucaccucaaagaacacugcacaaagaacgagggagcuacaagaguaccagcaccugccaaguucaaggccagcauccacacagucuuugcucauggggaaggucucaaggaaacaugguccuuuuuacugcagaaucuuccaugucuaaaacauuucggcaugccugcauucaagaggaaggcuccgggaaaccagcagggagagaaaaccuuuuaagguaaguaugauguuaauauuaucaaccuaggucuagaaucaccuagaagcaguggguagcaucauuccacagacugggaguccuugcucagaacuaaaaggagaaagccagcuaagaaccagccuuggucacucuguuuucugacuguuucugccacuguggcuuccucaucuuucauggacuguaccccuaaccugugaaacaaaagagacugucccucccguaagcugcuuucgucagguauugugccacuacagugagauaagggauggguuuuacuacacucaaacacacacacacacacaaaaccacacauacaacacaugcacauacacacacauacacuugcacacacauacaaccacacacacacacacacacacacauacgaacuauggauaaggccauguguccagcccuuuggaggcccaagcucuccaucuugcugggcuuucuuaucaccgaucagggauguugccccccccacccccccacccccacacacauacacacagcuuacauuuuacagagaagggagccgaggcucugagaucuggaagaacaggguaggacccucgcuuugauccagacccgaucauccauaaccagugccuuguaucgaggaugggaggaugggaaagcaacccaagacguuguuagaccacggcuaggauucuucuuucucuuugacuuugacuucagccaucaccauggccucagccgacauggagaggcugccaugcuucgguuuucuccagccuccccucccccauuuucaaagucaccauguaaaucugaugaaauaaccaagauguaaauaagguggccuucccucacgguuccggucuagggacaagcgcccucuggagauuuuauuccuuuuacccagagugacaccucccuucucuuaagggaaaaccacuggcauucugcucaccaccugcuuucuuguuuguuaauagguagaugccaagugaggauggagagaaagacucagaaagacuugggcagaggugcaucgggacaguguagcaguccugguggugugauccuucuuuuucucucccccgccccucucucgcuucuuuccuuucucuucccucggcaucucucucucuuucucucucucucuccccuaccccuucucucuuucuucuuuguauguucuccuuuuauuucauucugcaccguucuggcccacucacuaaacugucuuucaacuuggguggugacagaauucccccgggggcuuaugggggcuccccgguauuaacaaagagcuguugucagugugaugugcaagcuuugcgcugauaaaaugcaacccaccgagucugcaauaacacagcuguggcccuuuagugucucaggauucuggaaauccaccgaagcuaaaccuugacugugugcccagaaccgggucggccagaggcacauggaggggugccacgagacccauggcugagaaccaaagugcagugagguuucaugggaagaagagacaggaggauggaggcacuuggucugacucucugcaaaccugcugacuuauacucccuucuggacaacuuccugauugguuucuaccauuucccagauaaauguccagaccucaacucuguaagacuucugcgaguaaccauggagggaggguccauccuguaucaacggaagcucaagcguacugauaacucugcuaacuuggguucucuagagaucauugcuaguucuaccgguuggguggggacugacagcacggaacucccugcgauuaccuccuauuucuaucuuucugugaagauucaagucuucuuaacaccagggaguccuaggggcuuguuucugaugcaaaaugaaaauccuuuugccacagcugguaagaaacaggugcgcugcuuggccugaucccuuggagaccauguuaaauugacaccucuguaucugcacucuguuucugugauggguaucuagguggagcugaggggaugacggggaggucacagaccaccaaucccuaugcuaacagucuaacagacuaacccaaucccuaugcuacagucuaacaucucccuaaccauuuacccuuuacucuuggguacccugcuuuuuaugccuucagaaagcugaccaaugggaacaacauggacaggguuguagugaguguugcuauuccuccuggaaucaaggggggggugaacugaaccccucaaccaaaaguuacagccccuugguggccuucucuggcuagaagcccucaaccuccuauagacccagacacagauacuucaugcucaggcucaggccagugacgcucuccuggaaaauucacuuucucuuaugguuucucuagacccuaacuugacccucauaagcauccucuucauuccuaaaguguccucaaauccccaaguacaggucucuggccugcuggaucuaccacagaggggaaugagggaaggcaggauguagcuccugggcccagagucaccuuucuccaagccucagacccuaccggugcugcacucccugccuaaacacgggaaaauccagcuggaaacuuugggaaaguacaauuguaaagagcuggauggucccagcagagccugggccagcggcgcacagccucucacucacacauaaugaaucaauccucuuuccuuugccucugauacuacaaauucgguccugcacagacuuacucagcaucaaaagaagcaaaaaagauaaagaaaagaagaaaauaaaauaaaaucgugaaacaugagggacaaugcaaaguccuugaagaagucuuuccccaguuguccccaggccccauguuuaauaggacagucuaaacuuucaguuaaaaaaaaaaaaaggauguaaaaagugaggcacccuugaucuuuauagcccauuuaucucaucccuuucaagauuugcuugagaaagaggaccaagcaagcagcaaagguuucagaguaaccauacuggaaaaccacgacuuugcuuuaaaagguaugugcuaugaaugugugugugugcguguguguguguguguguguguguguguguguguguguguguguguuagauccugggugucuuccucaacuaauuuccaaaauaguuugugagccuaagucucucacugaaccugaagcucacugaucggguaggcuggcugccuagugagcccaggggauaccucugccccugucucugccugagcagcagcacugggcuuauggcugccugccacugagcccagauuuuuccaaggguucuggggggaacguggcuuuguaaccgaugucaagaaacuagguaugaccacacaugccaucggggcuggaagguagagacaggagacggggcuugcuaagucacuggccuagcaccagauucugcgaaccucggucucaagagguagggugaaaagcuaccgaggaaggcacccaacacugaccuccaaccuucaugagcauacauguuuaucuacgugcacccacccacacgggaacacguaagcacacaugauagaauuaguacuuuaaauuuucuuguaaugacagaaagggacaguuuguaacuucagcaugcaccccaacuauauuagugacuggaaucacaaccaugccugaaaaggaaggugagugagcgcuugauggcugacugauguuggguggcuguggcacuccacaaugacaaguuucugguguaugugacauuuuacuucuuauuaucccuaccugggugucacuuccacaaaaccauagcaagaacaccccccaugguaaaguaagcagagccccaacguauuuagggaaucaaucgccccgaauuugaaaagagcaaccagccgaugucaagaacuaauuguucuuguggugcauagacaauauaucagagauaugucucucuaggccgggaagucagguagggguccuccagguaacuuucaaaacaacaggccuccaagccccuccaccuguggcuucuuguaagaaugaugaacuaguuucaguaaguuucucauucaucucggguugaaaacugccggcgucucgcauguguaaaaauaucaacauuugacucaucucucguagggaaaugcugacagagccagguggaggagggagguagugcuccugucccugagugguuccuagaugaucuugacauuccccccacccccgccccauguucccaggcgauguagaacaagccugcaucacagaucccuugugacccugggaugucuugcaaauccacucagcaaggagaauuggaggucagcuugaugcauugugggcucugagccaugaccccuugacacaacaucacauuccugcuucagucaaggucuuugucuccucuaagagauccuggcugauugaacaggaggaagcagucaguuggaacacuggcaugggccguaacuucugcauuccagcuggggagaguggucagcacucugaggggaggaggguccugagaaaucagacccuccucuucugauuucacucuccuccugauggggggagaccuggauccgcccugaugucaagugauuaguggcucaggagccccugacauggcgauuagcucugugguuguugacaagccgcaucugagacaaugcuacaaggugcccugugugccugugacacagacuuacaggcucaacugcuuccucucuccugacauaauggguugugacagagugacagaacagaguguuugcauuugugcccauaaaacccuugaggaaauggagaucucuucagaaucgaguccugggagggaaucucaugcagaugucaggcagccucggcugcgacuaaaguugcugcccaaaaaaacggucacaaagucuaaaaccuggaccccagggcauggcuccugagacauagggauggaguggggcgggagggcagagacucagugaccccugaaccuuagcugggguugcuuguguucacucaaaugucagccagugucaucuuaccaugccaaacaaauuucaguauuggaacccuaaugggccaagaguaaaagguaaaagaagccguccucuuccccuguggccccuuuuccuuaucuuucuccuuucuagucauucaccgaguccacucccaacuccagauaccaggggcugauccucagacaugacugcagaaaucacugaagcuaaucuggcaacaucugaccacuuccgaguggacggaggaugagaugaaagagagacgaagaaucugcauaucaucuuuguuucaaggcacccuugggggcggggagggaggggggcuuccgugguguuaaguaaagcaguagaaauaagauagauaauuguguaccuguguaccuguguuccccagggaucauagggcaaaugacaggaagaucaacccaaaccgaaggauguccuggugugccuugagagguccaggccaaccaaagcuaaacagucuugucucaaaacaaaacgacaagacgggccagcaccgggagagagagagacacugacuugccugaguggaaauaggcaaugucacucugauucucugccugggauuaccacacggggcagaugcuaacaaauaauuccuggaguccucagucugcugucuguuucuguaaaguucaucaauacacagcacaucuguucauuggcauaccgucuguagcagccucuguguuacgagagcaaugucgaguaauugcaacggaggugacguaauaaaacugggcccauauuagcuaccuggagcuuuaccuuucucgauggucacagauucccgguauagaggguaccuggugugagcugaugugauagacagagagacuuuuaaaugcuggugaaguccaugccauacagugggcaaguguggaugggggggggggggagguggucaugggaccacaguggacucaaaaacgaaaggucagcagacggggucucuuaugcgugugauccaggaacggcgauaucccuccaaucccagaacuaagaaaggcuggggcuggagaacggugagugcggggucaaccucgaagagaugaaaccccaaccccaucugaaaacaagaaagaggaggaggagcggggcaggaggagagggaagaggaagagaagggaaagguucugugucaacccaucacaagggaagguaagucugcaucaacaucacaugccggcaaaagacgcucacaacaaauauuucacagggcaaaacaaaagaauaccucaugcugccuccaaaagaaagcccacagucccaauuacuguucuccaauuacgaacggucuuacacguaaucuucucgggcuaauuuuauuaguuugggcaguguucacaauaucagccacagaggacuaaaaaucugauuaaacuaauuuagccaacacaggaaggagaaagagaggcucaggagacaguauucauuugauggcuacaauauauaucagaagagacuauucuguaagccacuacuuacaaaugcaaacuucuuuaggguuuggaauucaaaagcacuugcuccugugacuaaauaaacagacauagcugaauagcuuggucuaaaauauuaacagucuugcugcaccagagauguuaguccuugccucccucuuugccuugcuucugucuagaagccguggagcauacauccacagugccuagcuaaccauguaauugagaacucccugcucuccucgcugugggaaucugucaguuaaagucuaaggauacauacacgccgcuaugaaaaugaacuuacacaaaucugucuguggacgaggaggggcugggaugcaagccgacauuuugccacuuaauuggcugaggccggcuuaccagugcacauguguuauugggcgcuggugggcuguauuauaugacucuucuugacagaccuauuuagugagaaggagguguuuucuuccccccagauaauugcucaaaaucacgcuuucaaagucagggugauucaaacuugccugucuguauuuugcaaacacacucggaagggaaugcaaauacauccuauuucucauucaaugcacaaguuugggugugcuuuuuuuugcugucuuucuuucuuucuccccuuccuugagcaaugaaggagaagaaauucaaaucccccggaguucagaccaucccgagcgugauuuacaugguccaaaucuuucugagaaugcuuuaacccugaugcaagcccggcagccucgcuaagagcuguugaaacagacccuggcagucaaacaaaacacggggacccgagauggccuuuugcuagguggccuguuagacauuaguagcucaagguuauuaaggauggagucaucucaugcgucuaugucccuggcaacacacacuauuaauauauagaauauuaaggcgucccaaccuauccgucuacuccuuuugugugucugagccuucucaucccaaucuccugagucgaauugcccguugaaaucucaacugaucuuuguggcuugauccugugcagguaaccacacgugcuuuggaguuccugaguaccacagccaggcuaugcuccaaaggcagcauuucacaccaguccuucugucacguggcucuuacaguccacccuuucuuucgguagcauagacucauguuuuugaacaagucuaugagggccaaggaguggaaugugaugguuuguauauucuuggacaagggaguggcaccauuuggagguguggccuuguuggaauaggugugaccugguuggaguaggugugucacugggugugagcuuaagacucucaccccaguugccuggaagucaaucuuccacuaacagccuuuggaugaagauguagaacucucagcucugcaugcaccaugaagucuuuguugcugggaguaauuugaacuguguugaccuggcccaagagauuucaaaggagaagaauuucaguauguggcauaaagaugaaauguuguuuuuuauaacuguaaucuuucggcuuaaauaaagaaauggucauccuugcccuuuguccuugguaacacuuuggggggacagucccccuagcagaacaaacccuauaguacccaaauccccagaagguuuaaaggauuuuuuuucuuuuccuuuggauggugccuggaugagaggauagaaaaaggacuuugaggucagcccaccuucauguuuucccuaaaaaaaaaaaaaaaaaaaaagaccgacccccaaccccaguaagguaggagccaauucuuauauaugaaaaggaugguguuacagauugacauguagaaaucaucuggaccauggcagaugcugcguggccagcagcuugcuuugucccugguuccuugacugucuucucaagaccucuguuagcaucuuauuuucccuuugcauuuuuuaauguccacguggagauccuaggaugguggacacgggcagucgcaagcacggacacauccuaauaagagaguuuagagauaagaaagaagccacgugaaggucacugacacaaccaggcugccacaacgacccgcauauacgucggcugucagcaaaguucuauagugcagagaccucacagugaggaugucucgauaccaagacacgggaagagguucaauaaggguuccaaggccuagaaaagacuauggucuaacacuaaaaauuagucccgucacaaagaacugcuuagcacagaucuguacacacaaaaugcaaaaugcaggaccagucccggggccuuauaggagucugcuguauuauccugaaggaaaugcaacaucuggauaugggguggcccuugcauauuguucacuggggccagucguagagaguuaaaggauuguacaaucucuuacagacucuagggggauuucaagacugucccgaaucugcuccucuguuucaagcggggaaagugaacucugcgaaaauuccucuucaaacagcugcaauuuuaaaacuuaaaccaagucuacccauuucaucuuuugaaagaugaaaauauguagaucuagccucuuuuugggggucaagauuuugguccugguaugaaaugcuaacugugguuccuacagugggacaccugacuaugucauccgugucaccaacaggaggcugagauagaaaaagcuguuuuccuucuuacuuuuuuaaguacauuguaaugacuaaauaaaguacagguauuguaauugugguuagauagccagacagucaugcagcacaauuuguugugaaaacugagguuugucuagguaagugguauuuuuacaaaccuucuuagagccaagagaacugaaaccauuccaggagcauuguugggaauaaaacucgguagaggaagaguuuaccaggaauaaaggacuaacagcugugguggagaugaaucacauguggcagguggccuccgucuuuccaucuaacguagagcuaauaugaccuagcacgcaguaaaguuuucaaacuggaggcuugucaguacaagggaucccgugguccuguguagacuuaggaugaauaucagggaauaagguggccaugagcugaaucaccccacaguaccuccugcaguuaccaacuguguugggauacagaugcaauucuauauuccaguuggaacacuuagugcaacuucccaagauaagaaagagaauccucggccaccaggaaucccuguuuguucuuggguaucugcuguuucaggugugagggcaugcagucuuagggauacuguccaaugccuuugaaacguguuugcaugcacucuuagagaaggguuuuguccaaugccuuuggaggggguuuugucgagaaggcccuaucaguuucucccugcaggcuagaaagauucugucuacaaacaccacaggaacuucagucaacuucaacuauuucaggagaaaaggacuucucugcccugucccuaacacaguccuguacaaaaacaagguggcagaguagaaacccuugucuaauauauggucucagaguccaagcaacugagaagagaaggucccagccaccugcccugaacagauauauguccuucucuugucacugaugaugguaugcuaguaauggcaguuuuugcuuagaagcaaaucaaugcccaacuaauaggucgggaaaacaaaagacuggaaguaaauagacaaaugaacgacgcacagaggguguggcugggaaugugaauaguuuguuucacgucuaucuguucucucuuuuguuuuaugaauacuccacaaugacaugaauucuuuugggauuuuuguuuguuuguuuguuuuuguuuuuuaaaugcaaagagucucccccaugcuuagagaggaucugugccuacuuuucacaguguccuauaagaagagggcugaaagcuucucuaagaaaggaacacagcaaggcuuuagugagagcaaucuggaggaccagagcaagggccaggcuuccuuaagccagucucugcccacauucguucugccuuuggcuuugcuugggagcuggaucagaaagaagggagccacaagaaguucugaggucauaacuaaccaggcgaaucaaugucuucuguuggaaccuggggucuucgggagacacugcaaggaagucuccuucuccaagggaggucacagagauuucugagccuuccggacaaguaccauccccucacucccgacaaacacacgccacacacaccccugcugccauuucccccagaucucuaguucuuacacacacacacacacauauaguuggaagcggcguguucaaacaaauacuagacacaaagggaacagagucaacacuuuagggaccaaaguagacagaucagcuucccagagccgcauggagaagcagcacggauaguggccuuguugacuugagacuuaggugacucuugacugucccuagucagaugacauuucucuagugagcugacaugcuagacgcaaagcaauaaggcaaacagaaaaggacggcagcugucagccaagcgcuuagguguugguuguacagagguccuaggcagggguggaggugaccguacaucuuagauggcucagccagcuugcugcccuuuaguuccacuggaaccaagcauggaggggacccaacaagacuggucccaagaggagggaaaaaaaaaaaccaaacaaacauuuuaaauagaauuucuaauagagagaucuaauguaggcaagaccaaauguuaccuguucauuauuauuguuuuguuguuuguuguuauuguuauuauuauuauuauuugguuuugguaugacauuaauccagaaacucaucuucucuucuccaguacagauguuaaagcuuagaaaugagcagccaggcuucuuccaggcugagguuccauaaaggagacccagauggagcuacaaauggccaaguugcaacuuccuguuccacaucgugccucuccugcccugccugcuggguuucuucagaaauuacuugcucaagucguccuuucggguuucaccaccguaugccggguggcucccuuagucacagacccccacacaagccacacacacuccggaucugagauccuuaccacacaggccccgagugucgggagugggugagguccugggguaccaagagcaaaacguugccgcuuugguucucauuucaaaacugcuugagaaugaagaucagaaagagguagguguguuucacagaugcugcugagaugaaagggcgcgcggagucuugcaaggacaaaagcccaugcucgcucauccguucaguuguuugcucaugggucuguucccucaccugagaaauaacaucugagugucuacacuaugccaagaauucuguggggcuugcaagggugaauaaugaagagaauguugaaguccacacagguagaagcauaaagaguuuucaguguuccaggaccagaggaggggcacuagccaaaugcaccagggggauguuggggcaucuucacaaagaggcuucacaaaauuuucaagcacugugggauaaugggcaggaggguaccagucauuggggaugggguugggguacucgggcagagggucagagcacggggagacauauggcagcuggcaaagauagaagggaagauuaugcccuuagacuaaggguccuucugggcuugaaggaccaugagucuuggcuauucuccccccaaccccugacugccagauagcucuaugguagaagccuggcacucuugcuuacaagcucaguuggcuccaugcugccugcugacaaugcccuugucugggcuaggccauccacauguagaacuaccaacacugggcuucgagaagugugaacaaaugacucuauucuuuggggucugaccgugugcuagcugcacaauguauuauggacccacagaacacugugcccuucuccuuggccuggaccacugucgucuuaccagagacccuaagccccggcaauauuucaaguuugcucuaaauaaaaaccaaaggaaacgcuguuaacaaucuccuguuaacaaaucacaccuuuauuuauacacgcauagagaagggcugguuaucucggcugaugauuuuauacccacuauggggucccuacaucaaccucaaucuagcuuuggaaaaggaggcuacaccuccuaguggagccagcuuccgaggaacccuggccucuccuaagacucugcagaagccagugucugugagaaauggaagagagacaaacgcuugcuguucaauuaaguaagauguuuauuggugugaugugugacacgcggagcccuccuagguuauuaucuggaagaugguucauuuaucugcagugugcccugcuacaacaucaucuaaaacacugcuucuucaacauaaaccccaaagaacugccuuuuccuuccuuuccuuuauaaaguauuaacgagauugggcuucccuggacucaguugcuuugugagaacauagugcaucucucccuugcuuuuugucuuuguuuucugggguuuugggguuuuuuuuuugguugcuuuuggguuuuguuuuguuuuguuuuguuugagucaaaguccugcuuuauagcccuaguuggucuggcauuuacuagguagcucagacagaccucgaacccacagcauuucuccugucucugccucaucuuuaguggcacuggagauguguggcaccguguacguuauuuacuguguuuauccagacaauggaugaggagguaacuuuauauuuucucagcgagggacagaauguaaaaggcuuagaauccgaccuaaaggugacacaggcucugucuugccaaaggaaagaaagccuggcaaugucccuugaaauagucccaggauuggucgugcggacugagauaaagaagucggaggaaauaaagacaaagcuacaugcaauuuuucccggcuggagauagaaauuguuccaguucuguugaugagggaaggggggacucucagcucagaagcccaacccucugaccccguaucuguacaggaacuuguguccuucaagacacccagaaaugcucccccuuugcccuuucaucuugaaacuucgguugccaagagaggacucuggagagcaaacagauagacacaaggcaggcaaggaaaagaacaagaaaucuaagcaggccagcauauaacucaggaggcuuagaccaggggaaaagaaagaaagcucagagggaaaaaaagaggagagggaugaagggagggggaagaaagagggugugagaguagaggguuaggaagaggaagagggaagagaaagagaggcgaggaugaggaggaauaggaggggaagggaagggacacaaaggaccagagacuucgcucaguuggcagagugaccacuguguauaguacaaaguccugacguugcucauuccuguaagcccagccuucaugagguggagauagauacauugggaguucaaggacagccuagaggauggauucugucacagaaaggggagagagacugagaaagaaugaagacaaaugccguggugguguacgccuuuaauuccagcacuugggaggcagaggcaggcagauuucugaguucgagaccagccuggucuacagagugaauuccagaacagccagggcuauccugucucgaaaaaccaaaaaaaaaaaaaaaaaaaaaaaaaaaauagugaagaugagaggggagaugggaagacaggugaugggaagacuggaggugagaaaagcgagggggagaguggaagagcgagaaaaugcuucuuaguuucccauccaucaauauacuguugccguuguuugaagaaaauggcagccacugcaaagacauuuuagaguuccuuugacuguguuuauuauuuccuggcucuguuuguuuguuuguuuguuuuuguuuuccuucaaaagucaggcuacuucuaaaggaauucuguuguugcuucuuuuauccccccuuccuuuuaucgacuuccuggucuacccagcugcuucccccagggaaagccggcaccaaaugccaccgugacagucagacuuuuugcacggcagcuuaauuacucauuaugggaucccaucaacaggagcucuggucugugguuuuauaauaagggcuguuaucuuuccuaagacuuucaacuccuucauuggggguugggggggagaaggcuguggcggagaugucugccaccccacuuuccagggaagggagcagaaugauuuuaaugcgugaaucccaugccauuaacaaugcuggcagcuguuuaaucccaguagaaauaacagcugagucccaacugcaggaaaaaaauaauaauuaacucuucaguggguuuagaggaagggaucuuacgaaucaauuauggggcucuauccuuaccugcgguuuuugucaauuauucagccauugcggcaggggcagggcaggaugggguggagggcucuccuuggcgaauaaaaugacacgaggcccuugaaggcaaagagacuuguuaaguccagagaacagauuuauuaaaugggccuguuugagauguucaccauuaauuaaacuaaagaaccauuuauuuuucccuccauguuuccccagaaucgcagggcauaaugaacuggaaggaaauaggaaaugaagaagugagagauacuggugaccugcuggcagggaggagagcugagcugcuagggaaagaacauaucagauucugucgcuaaaaacggaagcacgugguggugggacucgaggcagcgcgcuugcgcuuuaggacgcgugcuguuuaauuuagacgaaccacguggacacccggcgacugcaguaagcauuuuacuuggcuguugagcagacuggcucucauugagauccaaguucucuugccugccccgccccgccccugccuccgcccccaguuugcuaauuaauacccuuccuguuacuaucucuguugcuuuuaauuuguaaaauauuauagauauaaauaugccugauuaagauccagccuugaaauauguggcgcucacuuugcagcuccuggauaauaaaaaagcacccccucuccucuccguucauuuauaacgugagacucgcagcggaugucuuaagcauccaaagguacaaauggcaacauuacgugcauuuaaauuuggcucuuugucuggaugccccucucccuagugcagcggcugauggccucuggagagcugcgguucaucuggaaaugacacggcuuugccaccugcccaaggcuuccucucacugggacauggagaacaucaaccuguucuccacagagggcucugaggcugcuggggguagggguggggggcugggggggaaggagagacuguuaucuucugaguuaagcuuacagguggcuggagaagguucccuggcaacagcaggcagggccauggugcagcuuuuggaagcauccccaguuccugugcucuuguccccauuguacugaugggaaaaaccgagguucugagaggaggaaaugggcuggcugugucuuguuagcguucaguuuaaugcgauugggcagauaugccuguaaaaucccuuggucagcuuuucaauccaaacucacaagggaaggcuaauacacuggggcagaaacacucuagggugaggcuuggcucacucaguacccaugucagcaucuucuguccagcauucauccuucccuuacugggacaugugacacaaagucacccuaggccucaugcuucucucauccccgguuuucacugcagugaaggacagcaucccagccgaacugugagaccccgggaaacccuucuucuauuaagcguuuucaguuaauuaguuugccaugacgauagcaacucauaaaguagcucacacgggucuggauggucuucccugcucacacucacaggcacagcaccugaccucaucucuaagcagccuuccucguggcugcauccguuuggcuucuggauaaaguaugggacuccuucagagcuaggcgccaaccuugacuuuggcccaugauguaucuaaggaacauucuagaacucgcuguuugaacuaauacccaaacuacuaggacccaugcugcaggguggcuguggaauuucugccucccccggcuccccuccaauggugauaaaccagguuucucagcaacacuguuaaacaaaggcuccacgucagggaggaaagacagguggaucccacaguugagccccucacugggcucccaggacuccaucugaucugagaauguucuuucuugcuacacaccuaagaguacagaagaccgaguuggaaagauggcucugugaugcuugcugccaagccugagggccugccuuggucuuaggaguccccaugguggaaggagaggaccaaccccccuuagguaucuucucaccuuucuacauaguugcuguggcacacagcacgcacacacacacacacaccauaaauaaauuuaacuaaaaacuuaaaacaggggagaggacuaaguagcucaauuucuuucuuuuggucuucauuccuuucuucccuucuuuccuuugaauuuuaaggaacugccuucacccacagagggauugguuaugugacaaacauuuggagucccuucuuauggcaauaauacugcacucugcaaauggcucggcccugauccaaucgaacauaauaaaaugaaacaaucugggagcuagcuccaauggcuuucgucuucaccauacuaaugauuucaaaaccaaugagcagagcaggaaagggcagaugaaaggaaggacagcauggcgggcucugcccggccggcccucggcauccgcagcugggguggugccugcugucggugcccugaaucuccacggggcuuaaugaaaaggagacucccuuggcuucaggacuagacuuuacauagggaauuaagacaguuugaaggugcccauaugcauguuaacuaugacagacugaaacuugucuagggucaaucgcuggggaguuguauggucacuucuaggaccuggucucccugaguauuagcuacaaggacuagguccaucugcucuuuguggacugaacucagagcauguggguucugucugggguuugugcaucaucugguguugggcuagucuagaacucacuuagauguacauucauuuguucauucauucauucauucacucauucauuccuguacauuaauccuguaaugcaugcacuugggcuaagaguuaaagagacgaguaagucccacccugugcucucagagaucucagaagagcagaagggucuacagucgcacacaugucuuucaugucuuaggcugcuugcuaaguaaaggaugaagucggagaaucgaagccagcuagggggagaagguucuagaagguucuagaagcuccuuccuucucucaagccagcuuuaugucccagggcacuacagcacagcuucaugccugccacccugccccugccugcccucuuuuacaaaccucacagauuggggucuccuaaaccagcuccugacugacccuuccuuagguggaaaccugacccuaccugauccucagagucugaacuucagugugacuacagcccuggcuuuuuguucuuccuuugaaagccuggauggaugucuguccggugggguggggagggggugggggagggguguggaggguggaggguuugggggaugggagaggauggacauuaccugcucagagcugcaaauguguucauuuggagcagaaguggggacaaggauuuaaugccugccuaccaaauaccucuagguguuagugggccucuuggaagaugcaggugaacaugagggcugguggaucacuauggggaacauucuagaaaggaaagaggguaaugguggauuuguuugggaugucuggugcauugcaaacaccuucugaugaagauacuaaugacaguuaauuacacacacacacacacacauacacacacacacacacacacacauucuaauauucuaauuauggaguccuccaucacaccaggccccuguguugaucugacaccugaggauucauccaguccuugcaacagcuccaggaagcagagggaacccucauuuucuucuacuuaacaggcuuggaaguugucgaggcacagaguggucaauguucacaaaguccaguaagcaguucaccgacucaggccccagaccaccauuuuucacaaaagcaaacuugcaacacaguuaaggcccuuuacaaaguccauccucuuuuaccugguguuccuacuuuuuggaagacaugacuuaggaaauaauuaaaguauauauguauccgucugugauugucauggucauuuuagccuuguuuuaguaaaagaaauagaagcauguuaaauuuucaauaaaaauggaguaguuaagagagaaaaauaaaaccacccuagacauagaggaggcuguagagaugguucaggagguaagagcacuggcugcuguuuccgagggcccagguucaauucccagcauauacacggcagcucacaaccaucuguaacucuaguuccaaagaauaugacucccucuucuggcuucuuugggaacugcaggcaugcaugugcugcauacacauacagaguaaaaaucaaucaaacuaaaacaaaaaaaaaaagacaaacaaacaaaccaacaccaccaccacccccaaaaaaacaaacaaacaaacaaacaacaaaaaccuaggcguaguacagguuauugaaguuauaacccguagccucagcuauuucagagucugaggcagaaugauucaagguuccaggccaaccugaucuccauacuuagacucugaauaaagagaaaugggucagagacguagcucagugguagagcucucguggauaauauguaauguccccggcucuauccaguacugcaagacauaaacaauagcaguaauacaacuaaaagaaaagaauaaagaauagccuucacacaaaagaaagaaagaaaggacgaaaggacgaaaggacgaaaggacgaaaggaaggaaggaaggaaggaagggagggagagagagagagagagagagagagagagagagagagagagagagagagagagagaaagaaagaaagaaagaaagaaagaaagaaagaaagaaagaaagaaagagagaaagaaaggaaagaaccucgugccaggugugguagcacauaccugcaaucccagcccacaggaagacugaggcaggaagacugguguuagcuggaggacagccugggcuauauggggaguuucagcccaguuuaaauugcugaguaggacucugccuuaaaaacaagcaaggguuagcaagauaagacuugcuuccaagcuggagggccucagacugacaucacaagaaaaaaaaaaaaaaaaaacacaugccaugccccccccacacacacaauaaauaaauaaauaaacaagaaaaacaaaacaaagcauaagguguuaauaauauaaugcaacuauauaauuguguaaaggugagaaacaaaauagaaauuucuacagaguaaaauuuaguauguuuagaugccauuuccagggugcauuaagaaaaaaauuuuuuuucgauucaguugagugauuuacuuuaggguauagcuguaaucuuuucuuagcccgcagucucuuaaugcagugccuugagaaaacucaacugguucuguuuuuuuuuuuuuuucuucugauucuucugagauauuacacguggaaaaauauguucucuuuguggguuuuuaauaugucagaugagcagacaaugcuggguauuuuggcucguggaaaggaagagauugcaaguggaaaggcguucuguucuccagccuaaucgcacaguguguccguccagaguugaugaagcaggcagaucccccugcagauaaccggucuguaccuguccucacagcuccucccuccuccagcucuacuuuauagcagucugaguccaaaucccaucaccugcuucgucugguugucugaaccaugacaacucugcuugggaaaaucuaauacuguuaaaucuagggacugcuccuguacccacaauaggaucaaacaaaugacccauaagcuuccagauauaacgucggugaccaaggagacagagaggaacagggucccuguuuucagagugagcugauuagcugggaucauaucacaaagugaccgggaugaggccucaacagagaacacagaaauucaacagcaguggagugagcgguguggcuuguucuguagacaucaacagagugagcgucucucacuggcaagcaagggacuguaaaucugaauaggcagguauuuuauaaggcaucuuaaaauacacucaguggucaagagugauuuaaauguuauuuaauuauuauuacucuguguguguguguguguguguguguguguguguguguguguguguguguguguguguucaaacaacaacuuucaguagucuguuuucuccuuacaucuuggaaccuaggaaucaaacuuguguucucugguuugcucagcaaacuaucuuagccaaugaaccaucuugagggcccauuuuuguuguugguuuuguuuuguuuuguuuuguuuuguuuuguuuuuguaagacauugcuaugguugucucuguguuacugguggauaauuuugaggucccuaaaggcuccaaugaggaagaggcaaagaugaaacuggaaagcaggauucacaugaaacccaguuugggcaaaucccgugaggguggcuggcuuuggaaaaaaucccucacccagggcugaugcaaguccccuaugaacuaagcuuccgcaucauaaaacacggugacaagacaugcucauguguuugguacuuagugcaauauuugauacaacauccagacucaauaaaacguuggcucuuaauagauuuaacauuacaucacugcgacuacucagggaaagagcgcaucccaacacaacagccauaagcaaauaucugacucugggucaauagugcaaucaugaucugcccucuugaguguuuagaagugaagugacugcucucugcaauggacuuugaaaggaagguggauugauggguggauggagggaugagugcgcagggaugcagguagagagcaagguuauuuacaggugguagguggugcgugcaugaguaauagauagugcuuucaaguuguguguaggagugagauauuucgccauagcagacugcugggagacuggcauacuauguggcaauaaaggaugaaauaccgugggacagucccacaacagaguggcaauaaaaagaaaagaaaaaaagcaguaagugacuaaauaaguugcuccagaggaccccauuuaucugacacucaaggugcgcauuugaccaucuauggagcuggggaggagcuggggaggagcuggggaggagcuggggaggagcuggggaggagcuggggaggaguucagugauuaagagcucuugccauucuuggggaggaccaaagguuuguuuccagcacucaugcugggcaacucgacacaaaccacaaaccguaacucuagguuacuguggcggaucugacacucucuucuggacucuguagguacccgcacucacacugcaugcacacagacagacaaacgaacaaacaaacaaaaacccuaaucuuuagaauaagaguauaaaaagauggccuggaagucagaacagucucuaguuggucauggugacaggcauugccacugagaaagggauuugagggggcuuucuggggagcuggcagugcuccaggccuugaacuagggguguauuuacauggguacauuagcaagucaacaccucgcugagcugugcuucuagcgcgugaguagcucacaguggguaaaacucaucucagugcagauucugacuccaacggucacaccguuccugaauguccuuuucuuucugcaccaggcauucuuucuaggcacuuucugaugcauucauuuggaaaaucauuucagagaauugucuggcagaauacauuauuuaagccuuuaaaugcaaugagcagcgaacuaucuuauucuugggaaauggcugucaucuuuugagaguaagcuuggccuggaaggaaaucaugagugugugacaccgguggcucagccuccuggccuugucccuuguuggucuccgaguuuucucauccuuuccuuacaaacagguugcuuccuuaaccaaugaauaaaaaucucucucugaucccaaaucuccacccucuggcgugagacguuguaaggauguagagagaggccaacucuagcacaccccacccagagaaucaccugugggacagauauccuuaucaaagguuuggcgcucucucucccuguuccaggagauagcucagaggagagggcaaaucuuucuucuuccccuuuccaaaguucauccuuggccggaucaaugguucacagauuaaaaaaaacauaugaggaacaugcuggaaggaaguccuauugguagauguaacaauuguuucuggcgacaaagaccucgcugcugggucuaguccuaaucccugcuggcuugcuuugguacauguuugaaaauaaccuaaagucgggguaauucaaagauggcauccgcuacauuaucaggggaaggagcuguagccacaaggucagaguagagaugacaggcugugguuugccugcacuaggaggacuugggggacuugcucaaaccgcaaccccuccucguuucucuccauacucacugaauccacggaucucggggcacgcuccagaacaugccuacuuuaagaacaauguuuugggcaaugucuuguaugacaaaagcugcaagaucagagcuauaggagugacacaacaguuaagagaacuggugcucuuuacagggccagaacuugguucccagcaccuaugacagguggcucaccacuaccugcaacucuagcaccaggggacccaacaccuucugcagacaccuacauacacauguacaugacacguauacacauucacacuaauaaagcuaagauguugcuuguuuguuucaggaucgaggaccuuuggggaagaguucguuuaagaaaauacaucauacauuuauuucuuuauccauccuuucugucaaucuacugcuucauucauccacuuaucuaauuauguagccauguucccaccucccauacauccagucaugacuuacucauccaugcaucauucugcacaucaauacaccuacccaugcacucaucuacgcaccuagcaggcauucaucugucuggcuguaaauauauacaacuaucuguauauccauucaccugcauacccauauccauccauccauccauccauccauccauccauuuguucaucgauacaucaucuaucugcccaucugcacagcuaucccuccauacaccuguacaaacauauaucugcccacauaucuuuccaucuauccauauauccaucaaccuauccacccaucugugcauccaucaaucacauaguuacuuaauauuaucauuaugcaacaccagugauuggauuuucuuugcugcuuaaaauagauagauacauagauagauagauagauuccucuauauugaguagcuuuucagcaauucaccuauguaauugucaauucaguuauuuuacuaucauaaaaacucagaacacuuauaauggucauuuccuccauuggucucaguaacuuaugcaagccuucuacugccugugaucaguaccccuccaugaaggaucacaugggcuuuaggagagcaugacuccaugauacuacagugugugugacuugagacucuuuccagggaccguguaccuuuaacagggaacaccugagucccgggagucugcaggucagucagcacagaucuauggagcugauuaccuucugagacggccaauuacaagugaguaauuucuucccccccaagguacucuccggagaauacacuauagauucuucuguuuccaggaagcuaagaggauuuggguaccaaagcaaaccccauucauugugaaguucuuugaacauaaagcuuucgggggagcucugcuuguauagaacaacaauaaccacagaggcaaagguucaauaaacgacagugguggauuaacaagaagaaauaaaagacaugaggcagccugauagaagaggacccaagacuaaaugcauucuucucagacucacuuaacccaggagcuggugacccagggaauuuuuguaguuauuguguccuguagaacuucccuguuucauucucugucuuuccagaccauagacucuggagcaaaacugucaucucuuucuucgguacaucuggaugugauccagauggcaaucgagccaaaucugccaaacccauggcuuuauuucuuccguggugauaaacgcaaagaacuggagaguuguugcacucaccaguggccuuaaccuaaagcuagugacggccucuuuucauuucuauauuacagcuguuuaagaacaacgcuauucuagcgaaagaaugggcaagauggccagucauucagcaacaacaagcuugaaauuaguuucauacaaauuguaggccaaaugcuugugagagauagucccuguccuucuguuuguccuagcugaagucaaaggaaacucugaucuaugacccaaaagauagccaguuuggggucccauaucacaacucaagcccaagagauuuuucuacauugggacaugggugucaugaaguucacugcgucaauugaggccuugcuccauaaucccaaacuucauaccuuaccacucauccuguaaccucuauccuaacuuguuagccuuuaaggcagucuagggcuagggaaguagcucagcugaucaaguucaugcugcaagcuugagcuccuaaguucaauucccgugaccuacauuaaaaaucaacacccuggugagccaccaaaguugaguagcucuacaccgaugcccacuggggagccacugguuaaaacaagcagaccacaaagacaacaaacaaaaagacacauaaaagggguuggggacuuggugggaaggguuggugagaaugggaggggcauaagagauggugggagaacgaggacgaccagaauguauuauauucauguauguuauugucaaaaauuaauucuuaaaagacugggcauaaugaucaauucuuguaauccuagcacuggggauguagagacaagaggaucccuggaguuugagugcagccagccuagccuaacuggguaaguuucaguucaacaagagacucugccuucaagaauaaggugcacugacugacaccuguggucauccucuggcuuucauugcaugugcacacauguguaccugcacacauacacccccccaaauauauaaugucugaccaaccacgcagcacacacccacauacugauagcucuuacacuuuuccacuuggacucauuauuccauguuaucugaccuuuuuauauguugcuuuauagggucucauuaguuucaugacaucuaugguauuacucugcaaauauuaaucagcauuuugaucuucaucccagaaauaugccucuauaucacuuagagaauuaucaacacuaguucugucaugcuggaaguagauagauggauauguggauagauggauagauagauggauggaaggguaaauggacaguuggauggauggauggauggauggauggauggauggauggauggauaguugaaagacagaugaauagauggaucaauggauagaugaguagauaaauagauggauagaugaauagauagugcguggaugaaaaguauauauguauguauguaugcauguauacauacauguaugaguguaugcacacauggcucacucuuucacaauuucuaucauaacaccugaagugcuucaauauucacaucuugucaaaugguugugaaccuuaguagacucuacguuccaucugaccgagauccuucccuugucuaccuuggcuucuuagggccuuacccagcaguuggcagaaccagaucguaaguacagcaacaggcuaaaaaacaugcuuugcgaaaacaaaugaauuuauuucgauauucgcuuuuguaagucugcccaacaucauuacaggaacagggauuucccaguaacgaggacacugggagccuugcaguagagaugcucuguugcuauguuaccuuccuccuguacaaagaaguagucagugccaaguucugauaaaacuucugauuggaagaugucuuuccugauggcaaggaaaagugggcagauggguauuuuuaauggcuugauuaucuuggaacucucucuuuccacagaugagaaaaucaagaaguaauagacaccauaagguucuaaacccaccauuccuacuacucagauuggaguucuuuccacuguggugcguggaacccggaaaacagaauacaacaaauacauucuucucuuguuguugcuguugcuggguuuuguuugcuugguugguuuuuuguuuguuuguuuguuuguuuuuguuuuguuuuuugcuuuuugagacaagguuucucuuuguggcccuggcuauacuggaacuuacucuguagagcaggcuguucuugaacucagagauggccuaucucugcuucccucccaagugcuggaaauaaaggcuugugccaccaccuggagacacucuuuccuuuugaaucaagacauuuuuuuaaaaaugauuuuuuuguguguucacaugugugaugugggugugguauaugugcaugugacugaacacgggcaugugagccugcguacaugcucacaagcacauguagaagucaucuuggguguccugcucugucaccuucagccuuauucauucaucggggacucacugaaucuagaacuaggcuagugaccagcaaaccccagcuacccacuuaucucuaacacacacacacaaacacacaccacaacuaccacuaccaucaccaccaccaccccagaccagaaggagaucuucguaauuacauagcccuuucuagcuuguaaacccuacccuaaccaugaccacaauggucuaaucaagcuuucccaagggccauugaugaguugguauuuuuuaucuaaauaacuggauccugaugacaccagcugacaucgcgagcuuuauauuuggguuuggggggaggugccaaaggaaaacugagaaauccuuggugugggaauggaccgccaccaccacgcuuaaugaaagacaagagcauuacuagguuaacacaggccacuguuccaguuacucagggaacuacaagaugccaugacuuccagaguggggggggggggggaacccuaccugcuaugaauuguaguaaaguguguuuuaaaauuauuucagaaccauaaaaccucuccauagagagugcuuugagacugcaaauuaaauauagaaugucuaugagcuguagccauuuuuacaguuagucuauauuuccauggggguuuguaccaucuuuuuuuuucccuuuuuuuuuuuuuuuuuuuuuuuuuuuggucuaguuauacuaguuaauaacgcagggaauuugcaguaauggaguaaauguuauuuugaugacacuaucugauuaaauuaaagaugacauuaaaaggaccauuucaauaaggaagcagauucucuagaagugacugggacugaguguuuucugucagccaguccggcagucugaaaagggaccaaauggaauuucuuucaccuugugagggaugagguaagcuaaggaacaauggagcuaaauaauccaugguagaagauggagggcuaagagccaggcaaccucgguuagcugagcgagguguguugcuuggggugcaaauagcuucuguggccugggaaaaauguagagaggcaucagggggaccgaaagcgagaggagaggguaccgagacuggcaguggaaugugcugaugaggugacaguaagcaaagcagaagcaccaaccaaaaaaagagagaggauuagucacgucccccgcagcccacccacccacccacugccagcagccaugccaaggccaccaccuuuccugcagauucucaagcaauggaacacacugccagccccguguagggagaaguuuuugagauacaaguucuuuuuuuuuuuuuuuuuuuucauuuuuuuuuuuuugagacaaagcuuuucuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagguacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccgagauacaaguucuaaugguuguccucccagugccuuuguucaugggcacuugccaaauuuaaaaaauuaaaaauaaaaauaaaaauaaauaaaaugcuuuuucugagagaggagaucagccaaauaaaucgaguggcgguuugaaaauccccuugacuuaagcucuuagagaugggaucuaucugaagggcugugcugggggcgaugugacugaguuaugaaucaugggcauuuuagccacgagagaauucaagaugagaggugugggguacaaggagaccuugguucccacggaaacacuugcucuggugucucugcccccacacaggugacaucucuacugcuguggcaaggccaccggcuguugaccugguugaaccccaugcacucauacuuggggaaaggaaguagagagaaggaaagagagaguaagagagcgagggagcggcccaugacaaugaagucauccugugaucucaaagggacacugcccggccggcgcuaguugccucagacagcucaccuggcuguugugcggauuaugagccccacguaacuauuuccucaccgaagggacagugguauguggcuuggagggaagucccauucuccauauucucucucucucucucucucucucucucucucucucucucucucucucacgcacacacacacacacacacacacacacacacacacacacacacacacacacguaaauagcgcaucuuggagcgugcauccuucacaguccaccaucgggguauguuugacucugagcaugcgcacacgguacuuauuaccuucuggcacagugaaccacauagagacaacaugugacauaaaaggccaccagcagguaagucuauuaaagaaucguguggaggauagauuuguggcccugggauccucaagccugcgcagacccuuccagccacaaggaaagucacuguggcuccaaaugugcaggggcuugaagcucaaggcuagucagcuagaacggcgaaguguuuacaggagaugccucgguucccagaauuuugaguggcuugaaccuauagacuuggacucuucuucuagcucccuaaaccaucacaacucagugagcaacuucgcgcucucugcuucaccuuuuucuccuuacaaggcagaggcaguaauugacagacacccgauuucuuauggugguaacacuuuggaaaugcaaaaacuugagaggaacuuugggugccuaugcugagaaaugaacagcugugagcuggggguguaggcccuucugguagcgugcuugccuagcaagcagggaacacugaguucaacuccugcaggacaugcaccaggcauuggaagguggaggcaggaagaucggaaacucgaaaucauccucagcuacaugagggauuuaacuccuucucauaggaaaacacaacaaaaugaagccucguuuauacuagguaaauguucuauuguuuagcugugucugcagccugagaaccagguuuuuuuagaauaguuauuuuaucugacgauauaggaugugauuggugacaucauacaacacggaagagacuugugguugcaugugugucaugcccauaggguacauagcacucaggaucaccuagauguaaacagcaggcuuuuuggauggucaggaugcauugguacaggggccuagguggccacaaaggcuccacucugaaucaggagaucaaagagcagaagaugggaaggcaagccaguuauauuuggguacgcugaacuuaacaacuacucuuaaaaaaaauagaaaauaaccuugcucugauuuaauuuuuuuaaauaaauauaugugcaugccaggugugugcaggugacuucagaagcccaaggagaaugucugaucccacggagcuagaguuacaagcaguuugaaccacccaaacuccuccgguugaucacaacuguaacgucucccuuuauauucgggaaaacccaauacaaccuuugccucucaauucucaguuguuuuucgacuguggaaacacaaugauuauugggacguuaugcagcucugugugcauuguguccuggcaccaccacaacccuucucucggugcauuguguaccuuugcuuuuagaaacggaauuuagugagcucaggucuguauguugucugccccuauuuccaacugcugggguuugguaguugacuggugccuccuaaggacauaugggacuguggacauuugggcgacuaugucauuuuuuggcaagcuguuagaauaugacuguagaaagucaaauauaaaauuucaacauuuaucuuuccuaugcaucauuuauccaggcaggcagccacucaucaaaccuugaacccaucuggccacccauccauucaacuagcccacuauccaucaaucuaaucuauucaucuaucuauguauuucuucaucugaucauccauccauuaaaaucuccaacuauucauccauucauccaccuacccauccauucaucuauccauccacccacccacccaucauccaccuaaccaucuauccacccauccauccaccuauccauucaccuauccauccauccauccauccauccauccauccaccaaccacccauccaccuacccauccaucauccauccacacacccauccauccaugcauccauccauccacacauauauccacucgucugaccaacuauccauuuaacuauacaauuacccaucuguuaugcuauccgucauuucacauauucacucaccuaaucaucuacuuacccaccuauccauccacguaucaauucaucugggcagucauccauucaacaauuuauccacccauucaccaauuuauccauccauguauucaaucaucuaaccaucccuccauccaugcagacauucaaaaauugagcaaucccaucuacucuggcaggccuuuuaugggauuuucaaaggaaaagaaaagggaagggaagggaagggaagggaaggggaggggaggggaggggaggggaggggaggggaggggaggggaggggaggggaggggaggggagggaagggaagggaagggaagggaagggaagggaagggaaggaaagggaagggaagggaagggggagggaaaagaaggguagggaaaggaaggaauagaagacuagaaaaugaguaagacauggucuugccuuauguugcugcuuaauaggauaaauaauguaugaaagcaaggaccauauguuguccaucuuuuuguccccugcagcaucuuacacagggauucacauucagaaguagucaguaaaaugacugcugaauuaaugccuaagaacaaauauuauacaaggcaguaagaggagagugucaaauaaguacaacagauagaagguuacagaagaguggagguuggauugaucacgcccagcuggauaggacagggcaggugaaauccgagcugagacggaaggagcuagcuggcucacguggagaaacaagaugauagcaggcucccccagaaagcaugcaugcauccaugcaugcagucccugcuuauggagaugcuagccacagagcagggaggcccucucuaaguguuuguuuugaagugugguacccgcugggcugagcuaggcauuauggcaacagagaauggaacagagucucuggcuucauugagucucccggggcaacuucucuggaggaagcugauggcaaagugaggggugagaaagaugauguguuccugcgaguugccauaaaacagcaauuuacacugcagagaaagaagcagagguccuaaagggaccauugaugaauagcuuucuaauuugacuagguuugaauguguguuugcaauuagcagcacccauuugcauacaauuagugugcagagcccuuaaaaagaguuuguucucuaaaguagguuaaggguacccccaccuccuccacugccauuggaucuguauuauucauuugguucauccaucuccugugaugugggcccaagauagucuucaggcagacggagggcagaaugacacuuaucuggcuuuugcccugcauaggcagaaccaaggccgaacuuuccagaggcucuagagauaggggagucuagcaucagcucacugcauauaggccagauucacaacuacuacuggcaacccuuguugugggguaggguaaauccaaugacacaaagcaauuucaggggaagagaugaugucuaccagcgucacuuugauuuugugaugugcuggguaaucuagggaagucccaugaucccggucaccuugcuuccugcuucucucuguagauuucaggagcccaagccagagccuuggaagccuggccuugaucucucauuuacuagucuuuuuuuucuucuucuuuuauuuauuuuuuuucuccaauuuuuauuagguauugacuucauuuccauuucaaaugcuauccugaaaguccccuauacccuccccccuccccgugcuccucuacccacucacucccacuucuuggcccugguguuucuccuguacuggggcauauaaaguuugcaagaccaaggggccucucuucccaaugauggccaacuaggccaucuucugcuacauaugcagcuagagacaugagcucuggggguacugguuaguucauauuguuccaccuauaggguugcagaucucuuuagcuccuuggguacuuucucuagcuccuccauugggggcccuguguuccauccaauagaugacugugagcauccacuucuguauuugccaggcacuggcauagccucacaagagacagcuauaucaggguccuuucagcaaaaucuugcuggcguaugcaauagucugcauuugauggcugauuaugggauggaccccuguguggggagucucuggaugguccauccuuucaucuaagcuccaaacuuugucucuguaacuccuuucauagguguuuuguucccaauucuaagaaggggugaauugucuacacuuugcucuuccuucuucuugaagagaggugagccaagggggggggggugcugcguggucacagucccuguggcaagaggugagaagaaaggugcaaacgcugaaagcgagugggugugggggcaggcggggagcgaaagugagaggccauuguaaaugagacugaggaggcaggugggguagcucacuagguagagaggugaucggccacgcuccugagucugauuuucuuaagagcaguagaggagcgucaguaugguucaacugaggguggggacuugagauuaguguaaaaaaaaaaaaaaaagcaccgaggccacagcuuccaaaugggauggcagcuggcucacugagccaugccaugugcguagacuugaagagacgaugggacaugucacaguggaccguuugagauuucucaugcucaacacaaaaacacucgccacgcuuucgcugccccgcaggagagcuucgaacgugccuucuugacgcuuggggugaccuggggugggguggcauuacaugggcgagagacccccccaccuacaccucagugcucuguacagagagagucagaguggggcuuggaaugggacagucagagaauagaauguguucaucugugaaauuaaacguggcucuucacgaugcguagcgcuggcucugggcuuagucaaaagcaacgauuaggcugaggcgggcugggaacacggucaugaucaaauaagcaauuucagcaagugagcagggcuguucauuuuggggaggagugggggaauggggaaccaaggguaugauauauggggagacaggcuagggaggcugaaggcuggcugggcucaccccacagagagagcuaacucaguuuaugucucaguaugcuuaguuguuacuaucagacuugccuuccacuuagaacaacuauccuguuaugacuguauacucacaguggggccgaaguguaggcaccauggugaggcugggaaagguucucuuucauuuuugcuuuguuuauugugguguuggagacccaacucgaggccuucugcaugcuagccaagugauccaaccacugagcuacauccucagcacuuaccaauaaauaaauaaauaaauaauuaaaaauaaaaaaaauucuacuuuuucuuuugagauacucucucacugaguuucaaaggcugggcuugaauuugaaauccuccugccucauccucuuggguagcugagaugacaggcugugcuaucaugccuggcucucaguuggguuuucuguugagggacuugaaaagcccaagauagcuuuuuuuuuuuuccuucgugguugcaguaccaagaccuucuucacaucugaucuucuacacaucuguaagaugaaggugcuugcuucucucucuggcuguccaccagagcuaggacucaguuuccagccaugcuugcauuucuuggcccaaguuccccuccaaaccuucaccagugugacagauccacacguggaauuucucucucucucucucucucucucucucucucucucucucucucucucucucucucucucucucucucucucccucucuccccuugccccagcucugguguggagcucacuucgucuuaggcuuuuaaggucuucggacuuuucucugaaaaccuacuacaggcuguaaugcauccugggagaaacgucaagaaagaauaccuuuugggcaaggcugucccgggcauuuauguagcagguacagaaauuucaguguggacuggagccuuucaggaacccacauauuucaaaagccaaaugccgccgucgucagaguuuuaauugugcuucacucaggagagaauucacuuuuucugucuggccauccacccagcaaagaccuugggaaccgugaggugugaaugcuacgcgcacgcgaaguaggaacaagccuucaugccuccguuccacugcaggccgggcaaacagacauuguucugggaaauuuuugggaaccaaagcccagagagagugaggaaguagggugacugggcugccagaguggccccgaccucuacugaaaagacaaagcccagcccugcacuagaccaacccccccccaccuucccccccccccacccccaccccccgcuucugccugugacucuucacaaagcguccuuggaccaacaaccucagaaauaaugauuuaauuaucgguguuuucucaaugacauaauuaaauauccacagugagguaaauuaaccugaacuugcucauaggaugcuuaugcacuacugcagaagcuuaaccaaaaaaaaaaaaaaaaaaaaaaaaaaaaaucagcuuuuggcuguuauggaucuaaaauuagguuuccaauuuaggucccagaggcaagagguacaaauggcuauaaauagcacggagguggcacagugucuuuggggugcuucucagaguuaagaggacgcagcacaaucacuacauuggacaaggcaagcacucuccuuugguuuaugauuggccggguuugucagauugugugcucugugaggugagugggagccacuggggggggcugaaccgcaaccaccauaggcaacugcaguucuggggaaggccaguccaagucaugcuauucacccucuguucccugguuuuguugccgugcccaugcaaacaggaagaggaaaccccgccuccacccgcuucaucgccuuuaacuuccagagggggagagagagguaccuacuccauaacacguagcuaggggcauaaauaaaaagaaauagaaagauagauagacagacaggcaaauaaauaagguuuugaagcuaaugccagggucucugccuugacugcuucaggcaguaacacaaaauaaaagaacuaaguggcuuaagcaaguauaauauucaacuggguggugguggcaaacgccuuuaaucccagcacucaggaggcagaggcagaggcaggcagaucucugugauuucaaggccagccugggcuccagagugaguuucaggaagccagagcuacaaagaaagacugucucaaaaaaaaaaaaaaaaaaaaaaaaaaaaaaaaaaaaaaaaacccuuuacccugaggucccccugccacagugacuuuugggccacagucuggcuuuggaucccguuacuaaggucucauuaacauggucuauuaaaccuuuuacacauguggccccucuguuaaaugcaccuaacagcuuucucuguuggccuccugauugaaugcauagaguauuauacuaauuauuguccugcccucuugcaugucgggagaaggagauaaguagggugggagaggaaaggaaggagggaaggagagagacaggggaacaugagaccuacauuuguauggaaggccauucuccuuuugaaauaaauauguguuaagaauuuucuaggggacaggcaagauggcucagugguaaagggcacuugccacuaagccugagggccugaguuugauucccaggagccacaugcuggauugagagaacagacuuccaauugucccugaccuccaugugugcacaugagugcacacacaugcacagguaaaugugaucucaaaggaaggauguguuuccgauuuaaaaucaggagggaaaauggccucagcugucucuccguucuuagaggaggaaaugaaaagugcagcuauuugaagaauuucuugaaucauugucuuacauaaauaacucaauuaucucacugugcauuccuagugugcagauucaucuagagcacuauacaguucugcugcccaagaagcuugugagaaaggugagagauauuaaguagcccagaggaacagaugagaaaauuaauaccaaaugauacauucaaggucaugggagauauuaaauuaaaagccaggauugacuccggauccaguagcuuggaacugagucuuuguccagcccacgucugccaaggccagcuucugaaaacggacaacacaacauggacaaccuaacguacacucagcacgagcccugaagaacuguaacacuccagauauugaaaaagcaauaaauaaaauaaaucagagagguuuuaggaaaauagaggggagaaagagaaaggccuacaggaagggccaaaaaauucuaacuuuaaaagaauccuuaaaaacaaaaucaacccucaggcccugcagggacuguaaccuaggaggcaggauucccucgcucugcuguggaucuaggucaaugauuggggucaagauugcaccuuccauccuugggggggguguccauggucauuuauugauaaggguuacgucaagggccuguuuuauaagcaucagagucguccuggggucccugggaugucaucagaugaccuucccugaauaaggcgagauggaaacccucaucucauacuuucucaaucgggccacuggaucaggggccugccauaauuucuaaauugggaagaaaaaaaaagucacugaauucagguuacaucuucugugagcuguucuugaccugggaccucaaccgcgagauuuaaaauuaaucccuucugggcaaauggacaggagugcacgaauagaucucuugaguucuggcucagguuuacuuccaccgagacgcuucaacaaaucucaacagaaggaaguuccccccucugugucuuagggugagaaccauccaguucagcccaucgacuucgagguuauauagguaguuaccaaacuugcuuuggcugcaacaaaauuaaucagagacaaacgguaaugugaacccccccccccgacccggccacaaguggcugaccuucccuagcaauuuugaggaguugcccucacugucuucaucuuaccaaauuggagacagaauuaaaaggacuaagggaacgacgggcaggcuccacauugaagcugcucugacgugaacccaaaagaguaugcuaauauaugcuugcaaauggacaucuccuaugccuggguaagaggaguggguagauaggcaggggggaaaaaaagacaacaaagaccaucuucuaagggcuguucuugaccugggaccucagccacaggcuuuggaauucaucccuuccaggcaaguggcgagaacugaagugugugaauagaccucucacuuucuagagcuucucugccugcacagggacaccuccacaaaucucaaugaggggguuuuccauuaaaauggaaacccuuaaagugaccacugaguucaggucauggaaucugaggucgaguaagcauucucuucgccauuuucucagguuacuuaugcaaggggagaaauaaaagaugcuuccaacugccugagauggaacugcuuuuaaaauuuaacuuuuuagcuugacacggugcucacgccugcaaucccagagcuauaaagcggaggcagagggauagcucucuuuguggcuggauuggaguauagagugagucccugucucaaaauaaauaaauaguaacauuuuuuuccucaagugucuaaugggauauauuuugguaugcggauuacuaauucauucuuaauucaaagacagauugguaagagaaggggguggagaaaagauaccaauuuuucuucuuuauugcugucgugacuuggggaaagugaccauuggcuuccagcugcucuccagaacaugaaaggagcacagagaagggaacguuaucuuaaucaggcaggauugaggcccuucauucauuucuaccaaagggcaguuuuucauccugggcuggcggugcagggaacaagugggguagcaugugaggaacugggugcucuauggagaccaacuaccauuggcuacacuuauggcguccuggguacacgagaaagaauccuaugugccucucccugucagucagaucuggcuacuggaaaggaaggaggcccccauguuacagaugcaaucaugcacaaugugaccaaccacggguacauuccaggacaggucuccaggggccacuuggugacagaggaaaggcgagcucagccagcacccggccgcucguuuuucagccccuccuugcuuauccacuucauccuaauacaacacaaagauuauggugaaaacucgccaaaaaaaaaaauaaguaauuaaguucgugccauaauuaauucaggccuaaauaaacaaaaagaaaaccaagaagcaaaaacaaaaacccucuccuuggcugcuauggaguacucuucuguuugguuaucauuuuuccuucuucggcaauuucacuguaacgggauuaauugccuuuucaaaccuagggaaggcaaaccccagccagucuccuccucugcaaggcccggggguggggguggugaggggggaguugcaaagacaugcuaccgcaggaauaacaaaugcuggguuucugagcacucgcccaugauuuaugaaagguguaccucacugugggaagauaaugccauuugaaaugguccauuucauaaaucuauuccaccaguccccagcuacacccaggacuccugugaacuccugaauccaauaauguuuucaucugguguugaugagagagugacagagagagagagagagagagagagagagagagagagagagagagagggagggagggagggagggagggagggaggaggaggaggaggaggaggaggaggaggaggagggacuguguuuggagaaguuacaaugcccuuacauggaacagccguuaaugcucuaucuccagagcuuuauguggcaauggucacagaguuuccaaagcagggaaacuugaacaaacaaaaugaagacauaaucaacacucccaacaucuuugagguccuuuugcuacagguagcauuaauuacagcauggccccaauccuccagcaacagcacaacaaaacauuuugccccggagucgcucucuagcacaugagagauuuguccuugggaaccgguauauuuccuauucauucgugcaacgguucaggauaucuguuuguucguguaacugcaagaagaggauucucugccaaaugugauggcagaagcagucagggaccaaucauaaacuucagugaaauucaugguugugagucuuccuggucauaagaagacgacggugauauauaugcccccaugucacggagacuccgugagacucugaugaaauacgagcaggggacagaaagugguuucucugggauccagugaaauggacaguaccaacaugaagacagacuacaaaugccuguaccaugugacuuacuagaggagagccgcuccucaccaaagacucugagggaugagacaaaaggcagaguacaaugacgcacagacccuagcuggcgugcacagugaaaaggaaagaacuuaaggccaccgggcaagaaauauuuuaugaucauuaaaaaguacuuuuuuuuuuuuaaagaaucacccuagaugccgucaccugauggauggacacuggcuaugggauacuuuaacacaacagaacuuuacucagaggcaaagaaaaauaaaguuauggauuugcaggaaaacagauggaaguggaguacauuauacugagcgaggugguccagggccagaaugaugagcaaccauguucucccagcccccaccgaaucauuuuagcuuccucuguugaacuuggaauguguguacaaacuuagaagaaagaaagggaacguaggguggggagaagaggcucugagugcaagacagaggaagaacgucugugaucugaaaacagggagggaggggauaugcgggcaugaacggggaugagcgugggaacugaggcaggggggagagugcauggggugggggugauccaaaauuaaggaugaaugaagaagccacauugaacccuaugauuuuacauacuaauuagaaaaccgugacuugagaaaaaagaguuugaauggggguacccugcacuagggaauacuguugauucuagaagucguggguuauuuagcaaaggaaaaaaaaucucacugagaggauuggcacacuggaagaacccccacauuccucccagucagguggagauggauuucgagcaggugaaagacagccuaugagauaaaaaugaugcaaaaaaaugugaauuugaaaaacucucaacacaggauucucauccagauauucuggaauuugcauauuuugacuuguguuugaaaagcagcuucaaggucagcuuccguagagaaacacugagcuaagacaggaaggcaccccauuaaaaguccagcaguguuuuugcauauuuauuuucuuucuucuauagugagcagugacgacucauaaaucaaaaaaaaaaaaaaucaggguaaacaaauaccacagagguuauuuuauacagaauguauacuccuuauucuaccuauuuauagacacaaccauuucuauuacucggauuuauaaaguguguaauacaugcaugaaugcuuuaagaucugcauauauuugcauaagauagaaaggaguauauuauugucccaagucuccaaagaccauggcccaaauaaaaugacgaccaccucaaaaauauuuuuguauagugggauggaaaauguuauuuuuaaaagcuucaagcugugguacacacucauauucauaacugggaauauauauauauauauauauacauauauauauauauauauauauguauauauauacauacauacacacacgcaugcacacacacacacacacauacacgcacacacacacagaguugaauuggauggccuuggaccuuucuaaaaagacaaggaacuuuaagcaaaaguguguacagaucucaaaaucaauaacuacaccucaguguuaaauaggucaccuuaauaggcaaauaggaaguaagacagguugccauuaauucgaacugggauggaaugaaauuuggagaauuaaaggucauccucaaaggggcuguaucaugaagaaaucagagggguuguuguuuuguuuuccccagucgucgugggugcucccuaugaaugaauggaaggugaggcccaacaaugacuuucaauauuugcaauauuucagaguccugguauuggccaaccugaacacucagacuuggaguaucaggugguucagguccacccagacagcugucaaggacaggacacaggaugaagacuuugaggguccuuacuuccucacacagugccugugucugguacuuaagcucucagcagcucagugaauccugccaaugguaccaguugaucugauuugaggucaggugcagaaggaguucccgaacacuaauggggcaaaucagagugcggucagcgcggacucacuucuuccugucuugcacgaacacuccagggaacgggaaacaucucauauuccuguuuucacaaucccccucaaaucagccacccucauucuuacuaauaaucuaggacgcuucugacauacuauguaagaugaugacaucgcaggacccaaaaucugaagucccagggucuaaaugggaagugggaaucccagcuccaccgcugacuacccagccuaaauaaggcuacuugcuucugccacagcgaccaugagaccuuagggacucaggaaagaacuuuuuaaaagugugugugugugugugugugugugugugugugugugugugugucugcugaaaguaugcauuucuucaugucugugugacugugucuuugggugugugcaucuaugugucuguguguguguguguauguguguaucugugccuguguguguauuugugugacuaaaggugcaugggugccacaggauguauaaagacaaucucugcccuccccuucuaucuuguuggaagcaggcucaacuugaugucugcuacugcauaugccagagcagcugucccaugaacuuccaggcagucuccugucucugccucccaucucaccacaggaacaguggaauuaucgucaugcacucccguggcugggcuuuuuaacgucuaacuuuagauauuauuauuguguauguguguauguaauguguguguguguguguguguguguguguguguguguguguguaugaugugugugcgagugcgugcauguagauguguguguguguucuacacugugcuuguggaggucauagaacuuucuggaaucacuucucucucuaaugggagcucuggagauggaagugaggcuauuuauuaggcuuucagacacgcacuuuuacccucugcgccaucucacuccaccuguuuccagauuuuguguggaucccuggggauuugaacccagguccucaugcguguaggcacuuuacccacugaaccaucgcaaagaccagaagacaccucugggacuuaaaucauagauaacagagugcgggguauauuauaaagccuaaaauaaaaauguauguuuagaaccuuccauuuaauuugcauaauggcagaaaccauacacucaaauaucuuacugauaauaugucuucuuaugugcaucaaaucaguauaauugaaaacacgggcacaucaguaaaucagaguauuauucugguaacuguguacuaaauuugaaauguuguuaaaugaaaaguucucucuccugccugcgccucccucucugcccucagagacaccacggaccuucucuacugaucuuuucuuuaauuuuccauguuaacacaggaucuucaaagaagcccagaccagccugaaacucaugccuacccugcauccaccuccugagugcugggauuacuggugugugccauaccugacucacagauucccucuugauagauacuugauauagcaauuacuauuuuuuuaacaaaaauaguaguagaggagauuucaacaagccugcuguggaguuccuaggguuuaaacuugugauuccauaucauuuuccaggaccggguugaguacauauuguaccaaauauauaugaccauuauuuuuaaaucaaaauggauuacuaauggauuaauaugcuuuugaaagaauccuuacaagauugagcugcaagcagaaugccuuuccucucggccuccauuuagcaugcggcacccugcaauacuuugagaguuacagagaucugggauugcacgugauccugacacugauggaugggaagcagaccccagccguaccugacucaaagaguagcccugacuuguucuuaacuugugguuaaucugcugcagucauuugcugcaaacaauaaccgcuggacuguugucagaauucucucccugccuagggugaguggacuucuaaacugggaggaaaaaaaagaacaacccaggcucuaccuaaaauugauguggucuguggacuucgcccagagcacaccagccaggaaaucacaagguccuacugaauagcagacuaacauccaagccuggucguuuuacaggcuucugcugcugcugcugcugcuagcuccuguugaugagcgcucggcguguuguguggugaagcccaaggauaguauuucucaauauuaagaacucuaaucuguacugaggagaugcccuuaaaagguuuguggucauucaggggagacugagaaaacucacuugggcuggaucgccauauggagauauuuggaggaccaugcaaggacccagguuaaagguaugaacgaugcaugcaugcaucagaaaucauccgugaagcucacugccuuccccugcugugguuuguaucuuaccuuucccaauucuauggaccacuaauuaauucucuacuucccagaccaaaaaucaucacagccuacuucucugucaucagcaccuaaaccuaaauuguccaucucuccucuccaaacccacugcaucaacuaaauuuagaccuguaguaucccuucacugaaauggcaccagggaguucaaguuugucucuggaccacuuucccuuauuccuugaaauaugcccugaguacaccugcauuaaaucuuguuacugucucauucaaucugcuguagucucaccaccaaagaaugcguaggaacucucggugaugacauucaaguggccguggaagagcuuccauuuguaaggucugagugguggcuaguggggugagaaugcacagaaacaggguccucuccucccccaucacaucuuccaugggcuugaauagucugaccaguuaguuuccaaagugcagguuggacugccuucccuaacuuguccuugacugcccuucuccagucacuuuggucuuuugagccaucaugccaucauguuaucuuuuaaaaagcuauuucuuaagacugaugugugugugugugugugugugugugugugugugcgcgcgcguguguguguguguguguguguguguguguguguguguguguguguguacaggucugugcuuguuuuaaaacaagauaucaaucccaggcuugccuccaacucgccaugaagcagacagugaccugaacuuccucuugccucuacuucuugagcccugacaauacagaucuuuaccaccacgcccuguucaugugaugcuuggggucaguagggcauccugcaugcuaggaaaacacucucucaacugaacuguguccucggucccuaaaccugcuuccuauguaaguaacugcucccauggaagaacuaccuuuggcuccugagccuugauucuccaaccccauuuucuauauuguagaaacucuuagcagagucugucacgcagagggacaaugagcaggggucagcucccauuauguucucuugcuggaggacuuuagguagcuaacaucuguccuccagacaagagggaaggaccaggugaccuccaaaugccucuuugcauccucaccuuguaugcuugagcucugggaggggccugggggccaaacugagucacuuccuuucugggaaggucccucuuggaaaccaguacuuccugggcugugaaugacagguggggugggcucucugugauguggacagcguguguuuaauugcccugggucuuccugcggagggacuucacccugcugaccacagccccgacuucuuuuucagggaagucagcgauuccagccuccaugguuggcaccuagugagaaccacaccaggagcauuuugagggcggcguuuucuuuggcaggugugccugccagcaaggcccacuucaaggaugucgagagcagggaaacggcaucugggaucuaucugugguuguuguugguuugcacauuuggagggugaggugcagaagaacucccuuacacagcgugaucuuacccaggcauagucccagucuauaugaaaaaaaaaaaaaaauaccagacuggaaaaauuacccacacgggcaccugggcugggucaucgaguggucaguuaagaaacaucuggguguguacacccagacaccuucggacaaguuuccaugcuguuacuuucuaugcagcuuagaggaaggucuccccugacccccugaaugucuaaaaggcugugguccagaccuacgagcaaugccagcuggaaguaccuucaaccuucaucucagagcuugcucuucuauaaauucuuuucuguauguuguccaacugguuaaacccaaaccccugucucucuguauuccagccaagauccaccaguaaggccacgucugcagauucuacauccgggucuaucuaguuaccucaacaccucugucuucaugacuguaggucucccgagcuugaagauccugagaagauggccuuuggcgucucccuuuugcccuuaaaacacaaggccagucaaucaugcgcagcuacugaacuggaggcuuucagaucagcauagcauucugugucuagcuccgugucuauuucuggcucaaaguucuagguacgguuucaucucugauccaugaacagagaguauucaauaaagauguguagggugguuaccucagugguagcacagaauuuuccagaguuccucggugaguguuucuccuucacucuucucucucauuguuuuccccauacuguuguuugucccaaugguuuaauauccuaaguuguuuucugccgugugauaaaauucugacccaaaccaucgcaauggggaaagaguuuauuuggcuacaugcccugaucacagcuuaucauugaggggacucaauguaggaauucaaggaggugcagagucagaagccacaaaggaaggcugcuucuugguaccaaccagaugcucuucaggccguuugcuuacgguucugcuagaguuguacacagaagucucaccucuuuggaucucaccucccaggguagaggagacaggcagaggaagaugagggagaagaggcuccaucuccaguguuggucacuugggaucacccacacuccugguggcaggcccucacccaggaucuguuguaaacaagcccacuaaaccuauugauucccucgaggugaaagcugguuuaucuuugggacuuaggggggucagggggaaggaugcuucccaaaugacaguccuucuuggcuuuuaucauuuaaaguugggguuccaucaacuucagccagaccccugguugucuccugcuauuuuucucccauagaaauuuuugucugucugucugucugucugucuuucuuuuuuccuuuucauguauuuauuuugguuuucauucccuucugcaguagcggggucugagccgaggaucucccaucauaggcaagcagccaguuacugagucuuagccuuuguuuuccucuuuauguuuaguugggggucuugggcagcagccagagcuggccuugaaaucacucaguaaggccaggcugcccuugaacuugugcacuugggcucugcauccucacaccucccagccuucggggauuauaggccugcaccaccaggccugacuuuugaacucucuuuccucugggguggcucuuccagaaacccccaccagcaguccgugcuggcccuuuccgcacccucuaaccuccucccacccccuggaaauggaaauggcaucuggcacccuuauccugcccuccuccgcuaggcucaauaaauauuuuuggaagauagugacucaggaauggcggccucggaaacuggaucgugcucugauauggugccagaguucccccccaaaccccacccccagauggcuccuuagcauuggaaauagauuuuuuuaagcaguguuauauagcaguuccucuucgaaauccuccuuuccuuuucuuuaguaauguccauauaaaucaacguuauaaaaauaaggcaagcagaaggaaaaauaugcaguaccuagaaacugaaaauucaaguguuugcuuuuuaugggacacuugaggcucuuaaaaaagagaagugcuggaaaacuuaaauacaaaaaaaucacuguaugauagcauaaaagcccaacagaacugaauaguuuaugaaaauaauuugaauauuuacacuucaauuuauggucugaaaaucauccuuggaccuuguucuuauuuuuaaauggauuuuucgagagaguguuaaauacguuuugauuauuuugacacggugccuacuccgauauucugugcaaugauuugaaagccaaaaggaaauuccuuaaaaaucuaaugucacucuaugagaauguacgguucauauauacaaccaggcgugcauuuauaagcauaugggguuuauaacaagcaucuugacuuaaaggaggacuuugcacuguuguuauuauuguuagggaaaauaauaguaaauuuaacucaagcgaagcagugggcugaaauacaccguaauucucuugacaggaaaacucggguucaaauucauaucuuuucauuuucuaagucugaguuuugcaugauggcuuaaaguguguuuuauccccgacauuauggcaacacagaagcguugcccauaaaacuggcgaugaaacggacccggguuuaccaagcgcuucuauuuugccuguuccgucauuuauuucucccaggaagucaaaaccucuuccucucaggcuuucuuucaagccacccaucuaggaaguguauuaauaacuguugcaacaguccucuuucuaaagcauccaauaucuaaaaagaucagucuucaggucaagaaaaagaauagggagagcaaagccccaaacacuuugcuuuuacauucgagggguuaaugaaacucaaauaugaaaaaugcauaaauacacagggacaaagaaagggcuuuuggaggccgggagaacauaguauccagaucugggacugcaguuucuucuguuuguuuuucuuuaugaauuuuagcaagaucgaaaugcacacaagaccuuugguuuaauuugaaacgcacauccuagcaacuuaaucuuagcacuggggggcagcugaggaugugugagggacaggagcagaagauuccauucauuacaacaucagagcaagaaagaaaaacaaguagugagagaaacccccacuuaaucugccuacuaaagaaagaugccuauucgaagagacaccguccugguaccacaggagaggcagugagacaagacagggacaaaagauacaagccuggcaccaaggaaguguggcaaagagugcucauuugggucugauaagcgugcuuuaaugaccacccuucccucugacuuggauuuaaaggaaaacacggugaauaggagaucaaccaaugugguccauggugcugggauuuacuagaccccagggauccaaaucuaucuacuuuuucuauuugauacacagguauugaacaccuacaggccaggcugaggccucucugugcuugggcaguguggagauaagacugaaucucucacccagagaaucgacaaagagcccuggagacagacacaugcuguaacaacugaauaauauuuacugacagucuguuauguggccaauacaacugcugggcccuggcauguucuaucacggauaaugcugggaguuacccguguguccuugggguaauuacuccuuauucacaugcaauagaagaaaaauacuaugguaaauuaaugacuuggccaaggccacacagacacaugggacccagagcugcucuccuggaggcuggugucagagcucaaacccuagucauugaucucuacaucaucauaacuaucucuagagcacugaaaauccugcucaaaguuaaacaacaccagacuccuucgcugaaacaaggcucauuucauggaggagggaaagacgggcuuugguguggaucaaugugacaucuucaugcucccucaacuagcuggagacaauguaagaauuggcacuccgguggacagagccugucucuuuccagcaacccggggcugccucugucaagucuugcaauagccaaaacuaguugcgcaacaaccugugacaggcaccugccaugcagacacauagugcuggguaucuuagccuuagccccuguggagaaaagguaccugcccuucaggccccccuuuuaccuucugaacaguugagggguuguuuucccaauccugguugcugccaccuaguggcaacagggauaagccuugaugguggggccuaaaauggccuugguggacagggcacaucuuacagagguugaacgcuguucuuacuuuuauacaacgaacacugagagcccaggggaugucauggccaccagagaugcuuuguauauauauuaagaccuguguccacaugacagcugcaaaauccugugauacagcggucuuaaaagagaugcucugaccugacaagcugcaccagugggaagccuaagagugaggaccucagguuggaucuuaaacugggggugaaagcuggaugcgguggggcgcgucucuaauccuggcucuguugcugugagcugggugacagagcugggaggaucccaauaugccaugaaaaacaagccacucuuucccaaaguaaagagugaugacugauacccaaggucaucugaucucuaugugcaggcucuggcaugcaugugcugucccgacacacacacacacacacacacacacacacacacacacacacaaacacacacacaugggagaaggagagacagaggcagagauuuaaauguauauauuuaaauauauauguccuauuaaaggugcacauaaacugaugauaacauuuaggaaacccuaaggaaugaccugguuuuaagcuuucuuggugauggugguggugguggugguggugguggugguagcaauucaucccuaaggucuuagggugagacaggccauugcagaaauaccaaaaaauuagguuuaggguaagaacguuuuaucaugugguaucaccuguccuggaggcucagguuaacccuggaucaacuagccaaucauucgucagccaagcaaccaugccucagugaugaggauucaggugacgaggacgcuggaccuuggguuuuggugaccuuucacgaguggccacacuccagagugcagccacauaccaauacaaggaagacaguuuguccacgcuucguggaaagggaugguggaaacugaccaucugcuacucuuggauuccgccuuccgugucucuuucucuuggucacugugaucugugcccuucuugcccugcaguaaacuaggaucaaucauuuugcaguuuccaguuaaccuuauuagucuuucuagcaaauuauuaggcaugagguuaguuggagggucaccucccaaugugccuuuggugucagaaaugaggacacugucaggcuugcauccacucacgagguuggucccucacuccuaacaggauccuaccgcaagucgagacccauccuccacuaacuaaaacacauucaaugggaagccgugucuggcgguuauuuucuaauaucugccuugauggauuaagaaacaccuggagauguggcccaggacuuguagaaugcucaucuagcaugcaggggacccuggacuugauccucaaggugacaucagcuagcugugguggcauguaccugugauccaagcacuugggaaguagaaacaggaggaugaggaguuugaggccagccugggaaaggaaggaugagacagagggagggagagagaauagaagggaagggaagggaagggaagggaagggaagggaagggaagggaagggaagggaagggaagggaagggaagggaagggaagggaauggaagggaaggagagagaaagaaagggauggagaaggguagggcggaagaagaagaagggagguacccauggaguuaaugaggcacaucuuuggcuuuuccaggggucuaaugaggaaggaggacccacuacgaaugugaggggcaucacgccauaggcugggguccuggacugaauagaaaaaguaaaacucccagcugagccguggcauuccccuuucucugcuuccugaucaaaaccacccuagcccagugguucucagcccguggaucuucucucccuuugaaccacccuuucacaggggucaccuaaggccaucgguaaacacagauacuuacauuauaauucauaacgguagcaaaauuacaguugugaaauagcaaugaaaauuaugguuggggggagggcgggucacuacagcaugaggaacuguauuaaagggaugcagccucagggagguugagaaccacuuccauagagcaagcugaacgaaccacccuaccuuacccagcuauagcucauagcucuuugaacugcgggcccaaauaaagcuuucucccugaagucacuucuugucagguauugggucccagcaacaagaaagguaaccaacauaccuuccuccuuguaacugcccuugacugaccccacauccacagucuguacgcccucccacacuccuucuccucaucagaaaaaaaaaaaaaaaucaagcaaggaugggagccacucaguccacgugacaaaguuauuaugggacucaauuaagauaaugaccgugaaaacucuuuggaaccggucacuucaguuccaauuguaagauacuacagcuauuguuacuauuacuucagacuuuaagugccuucagacuuacacguccuggucguuuucccuuccuuccaugggcugagggaacccgaucuugacuccaucggcaggugcugggcuuguggcagugagaacuuucauuaguggaugauuuuagugaggggaaaggaacuguaaggcaagccgaggccuuugacggggcuggagcuguucuggcacagcgcaauuuccaggcuaaugucuuuucaaacagcucuguuuuugccugcagacuugaauacccucauuacaguguuugaaaaaaaaaaaaaagaaaaaguucccuuauguuuuuuuaaagagcgccauucuucaaaaagaugucaaggaguucucuuucuccccucugcuacaagguguaauguagagauaagcacaaaaucugguuggaaaugucaccuauauugggacuggggaaagcuucagauccugugagcagcucaguggaaagaugguuuuuguccuccuuggaugcugguauuuggaggaauguacccucacguauuauucacggccagugagaacggccugaaagucaauuauggugguuuagggaaaaaaaaaaauuggagucauuuguucacagaguucaugggaguucugaacaaguccccggccguccucacgacagccgaagccaggucuuuuggaaaacauuuuauuuuucaugcucagcguaauaagaagaggaaagucguguuuugcagaugaaauggggcugauaaugaaaaguaggucaugcuuucucucugucuccaucucucuuuaacuuucccuaaaagacaaaagagacuuuggaagacuugaagcaagcagggccaggcccccaacuggguaauccaugcacucuuaaaacuaggagcauuuacaccacucagggcugacauuucguggaggggaaguaccuggaaacagagaguguugucuaagaggcucuaagccaaggagggcugagaaagacaguacagcuuccagcaucuggagucaaccgaaggcaguuagaagccauaaccuuuaggagcugggacagcaaggccagaaagaggcagcuggcugccuaaugugggagggaacacuguggcacauugcugcuuaccuuguuacucuauggaggacucuacaccucugauuaaagguggcuuaggguggugguuugaaugacaugugucccucauagacuacaguuuuugaaugcuuuguccccaguuggcagcacuguuuggggagguucagugaguguggucuuguuggaggaaggguaggagugggaucugagaguuuaaagacuuguuuccuauuccuaccaccaugccucucuguuucacaaucauggacuccuauuccuuuggcacuguaaacccaaauaaacccuucuuucuuuauguugcuuugguuguggcuuugucacagcaauagaaaaaugaucaaaacaccuauucacuuccuugggccaauaaaagaaagcugaaauggcaagggucacuucuaggaagauagaugaagaacuuaguuuugugaguucucccuccuuuccucucucucucuauuccuccuucucucuuucucuguucucccauccuccccucuucuuccugccuucugcuuuccagucccaucacuugcugcuguaccuccccacaaucccaucucaaagaacuauaggaugaggucuuagaaacugugagccaaaaggaaucugguuaagguggugcaugccuuuagucuuggcacuggggaggcagaagcaggugagccuuuauggguuugagggcagccugguuggcauagugaguuccaggucaacuacagcuacacaguaagaucaugugucaaaacauuacaaagaaagaaaggaaggaagaaagaaagaaagaaagaaagaaagaaagaaagaaagaaagagagagagagagaaagggaggggaggggaggggaggggaggggaggggaggggaggggaggggaggggaggggaggggaggggaggggaggagaggagaggagaggagaggagaggagaggagaggagaggagaggagaggagaggagaggaaaggaaaggaaaggaaaggaaaggaaaggaaaggaaaggaaaggaaaggaaaggaaaggaaaggaauccuuccuccuauaagcuguuugucucagguauuuuaucauagccacagaaagcugacaaacaugccaagucacacugaaucccaggaaaagacaauggucuucuuucaugaacuugaacuuggaaauguaguauagacuucacugcuauaacuccaugucaaugcagaggaagcacacccugggugcuggucauucacccccccccccgaacugguccuuacuacaacugucaugcacacacacacacacacacacacacguguguguguguauguauguauauguauguguauacauauaauauaugcauaauauauguauauagccauauauaaagucauauauacauauauaauauauuaugucauauaucauauacauuuuccuauguuccaguuaauuguuuggaugaucuuuucuuccauuugcacucacaaagcucacgaguguguauaugguggaaaaugggaaacaaguuucacgacccugggcuauuaaauucagguaacacaucccaggacugcucagagauuuagcuuagagccuagaacaaccaugacugcuuugauucauuuucauaucuaaggagagcaugguggcuggcccugucuuccuucuaacgggcagaguaacccuugauuccagccagucugggacaguugguuccuaucuguugucccagcacacacguuggugucuuuccacucucaagauuacccagaguggaauaggauaagaaaacggagggaggcucuccugcccuguccgcuuuacaaagauuguuacucuccuugagagcaaaacauucugaauuccucucagagauaaccauggcuaauuauauaccccaugcaugauaucuucuuuccagucuucccauguuugacguuuugugggauuaaucauugcuuuugguugaacuggguucucgaaagccggguauuauuguuuuaucugaaggaaaccccuaugaaacggggccuccauccaucauagcucccuggguagaaggaacugauuaacacuuccuggcuuacaaacuuguuuguuaacacgggguuuccucucagcugucaccgugaugcguucagugugcagcguguuugggauugggcugacaguacuguuuuaucaagaugggacagucaucuuuguggggugugcagagcacggggaauccaaccaccucuguaaacacaaugauaacaucgugucugcacacucccagaagacaaugggcccacauccccccuuuccuaauugggauuggaaacaauaggugggaaauaggagacccugcuaucauuaucuauuggccuucauuucugggcauugacugagcugagcagugugugugugugugugugugugugugugugugugugugugugugaagaaacagcaaauuaaaauucagccuucuuccauuuuucuuccuugaguguuaaucuuguuauaaagcucuggugacagagauucaagacaggaaguagagguugggagaguuauaaacaguuguggacaggagccgcuuugcuuucagaauuacuuaauaggcaaaggcccgaacaggggagauaguuagaggagaauuggcaaaggaacguuaaagggugaggcuggucaggaagagaaaaagggacuguggguguggcaggggaggggcucuugcacagcauguaugggacaccugcuuucacccccaauaucauaaacaacuauaauuauacugcagaaggaagagacauagacccuucucccaaaagguaagugaaauaacuuaucuugaucccaugaacuaacaccaucggaugucuucuuuuuccuaggaaccaucgacaucaaguacaauuuucuaguacuuaaaaaauccaaagugcucaguacuuugguagcauuugaacacugggugucaugaucuacaggauggagcaucuguaaaguucagaguaggcucguuggugggcaugcucagaggaagagagcugcuaugagccacaaccuacagaacuucaauuuccacuuccuauuacccucuuuggauggaggaauggucucuauggaaccucaccuagugcacaacucuucgcugucaugggauucaagugggcaaguuagucaccaugugacugaguucugugcgaaugacuacagaggucccgugugugcugggaaucucuguaucuguauaacccaagccacaugaguggauggcaguggaaggaaagguggagggagacaggacacacuauuucaucagcaauguaagucugaacugauauuggagcucgcugacccaacugaguggccauccauuuuccccagagcccaucucuaaacuucacaggagacuggguuaggaugcuuaaucuuugucugucugguuugggccgcaguccucucacccgaccccuucccuugacucuacugguuucccucucauacaaggugccuagcacagcucccggaacacuggguguucaguguaucucaguuaaaccacagaugacucuaauucaguuacucacuucagaaaucuccuccacugaaaaggaagcaaaauuacacaaaacuguaacuauuggaaaaaguaaagugggggcugcagagauggcucagcaggugagaacauuuguuacucuuccagaggucccagcuucagcucccagcaucuacauggaugcucaugauugucuguaacuccaacuucaggagggucugaugcccucuuguggccucugugggcacuacacucacauggugugcauaaacucacacauuaaauacucauacauguaaaguaaaaacaaaccuuuagggaaaaaaauaaaaguaaaauguaugagcccaaacuccucauucauaaauucauucacacauucauucauucauucauccauuuauucauucauauauuuaaucacucaucaaccaauaaauuuaggaagcuccauucuaacuggugaagacuaaaagaguagacagauggggcagaugagguuguugcucuccugcagauuauggucauuggauuacuaaaacaacaaguaagcaauaaacgaaccaccggauggauggguggauggauggauggauggauggauggauggauggaugggagcaggcagugacaaguguugggcagaggaguaaaacagccauuggguugagaaaguaugaguugcuacuuuggacaaagggcuaggguaaaugccagcaaaaggacaagacccacacaguagaaaaaugggaucauucugcauucacucuuagcagggaugaaucuucauucugaucaguaauguaguugaaugcacugcuauaaguaucugcccaaaauaacaguaucagcgggauaucacaggcaucagcuaggacgaugauagcaguuacugagaugugguucaagaccuuuauguacucuacaacuaauauuuauuucuucucuuucuuuugcuucaguguguguguguguguguguguguguguauacaaguacaucuguguguacacagauacaucuguguaugugugcaugcauauagaagccagaggucagccucaggugucuuauucaauugcuuuccacccugcuuuuaaauuuuuguuuauuacuauuguuacuguugcuguuaguguguguguguguguguguguguguguguguguguguguguguguaugugcuugccauguauacaaauaaaugucaggaaagagcuuucugggauccauuuucucucuccacauucauguagauagaacucagguuaguggacuuguauagcaauagcuuuuaccugaugacccaucucacuggcucccacuugcuuuggagucuuuugcugaaucugaagcucaccaaguacuccaucauaacuagcuuuacuuuuaaccuaaguucucaggaagacccuugggucuucaugcuuacagaguaagcauucuauauaccaacugagucauguccccaggcccagaacugguacaucugaugagugaguuggcuuugcuccacaguggcucuguggcugucucauuuugucuuggagcucuguggucuuuaaccuuaggcuuccaagucacuauauucauuagcaucuggccugcaggagaagaagagggagagcuguacagggcugauguucauaacucaguuucacccaacaauccauuaaccugaacauggucaugugccaaugccuaccccggggagaagucgagaaagguaaaacaggaaggggcaggaaugggcaugggaugucuccaggucuguccaugcgaacagcagcaagugaacuugugagcggaggcgaugagaagcguucucucuucaaguucagaguuucuguccuuacauggagucaguugcagaaaccagggcaucuaaucuaucuauuugucucagugggaggcagaauguuggaugugggaugcaaaagcuagggcugaagcccaauggguuaauucaccaagggauaagccucggaugcauugcaguuucagauagcccccaggauggaaggcuaauuguccuucugggaugcugaguucuuugaagagcccucagaauggaccucgugaccuucugagguuucucacugcucugaucucuucuuaauggauaguguuuuccaagcugaugguguuuuaaagauacagaaucugaccaaugauaauacaucugaccucuugagggagaacuuuguaugucuuacucucuuuggccucucuuauuggccaauuacauaacucgacuagaaguugauuugagagaaccaauuucacuauugccuaaucauaaggaaagacuguaaaguuuuaugagagcugaagggacugccuuuuacagaggaggacuugaaugauauuaaaggggacauaaaaugguaagaaauggaauuccacaagguguuucccuuggaccgccaugcuagauuauagugcugagauaugaucuuacugguuauaucuuccaagggcacucauagaagaggagagaagacagccaacuguaucacacaaccucucacgauacagugaacagacuccucauauggagcucagcauacgauagagaagaaaagucuucugucacguccuggucacgugacccuaggcagauucacuaaccuacagaucacggcagugaccucucugagagccacuguauaggugaaaauaaaauaauaaacugugagggggaaucuugguuguccacuugacugguucuagagucaacuaaaggagaugggcauuccugugagggauucccuugaucugauuauuuggggggggaagacccaccuaaacgggcaaugaccuccaggggaagucgagauaaaagggaggugagaaaggaaucuuugcuuuuagucugugugccuucguuauggcuggcaaguccaccuaucuauuguugcugcaucccuucaccgguauucgagccuacuucuuccagauuccagcauaaacuaaagaccagcggcucuucgggaaaacuucaggacucgaguaucagauugagacugauggguuauccagcucauagauugagcaacucaggacgagcggcucuuuuuggaccaccuagacuguaugaugucagccaauauaauaaacucuuuccuucuuuccugcuaucgaaccccgacacacacacacaccaaaagugcucucucgcacagugcauggcuuacagcagaacugcaguucaugggaucauuacggcucauguuaaucgcuuuuuaaaagcuucagggggaaaaaaguaccaucucgguuucauagacgaggaaacugaaguucaaagacagugggaaacuggucugaaguaacacagugcaugacggccaucaccggauuuggaaucuggcugucaaggcucugaaggcuagcaagccucaccaccauugccagggcuuuucagcauuuggggcauugaccagucagccauaaguugccaucaucugggugccugguucuguugacugccuccgaauuccccagagguggggaugaccagcaucaucugugagucucaaacacugagccaagggaugaccaggguuggaguuuguucuaccccacagugcagagcacacuccugagucuuaucgccucugugggccugccgucuucccucucucguuucucauccaacuucucuggucuuucaacuaccgugguuucuggcaccuuuugugucucuacagaaggcagagguuggcuaaugcuggccagcaagagaaagaaaagauuauuucuccauuccuaguaaaacaugaagauacaggagcuggcaagauugcucaaugauuaaagguauaguacuuuaugaguccaguucccagcaccuacaucagguggcucacaacugccuguaacuccagccccaggggcagcugauucgucuggccuccuagggcacuuacacucgcaugcaaauauguguagacaaauuuuacuuuuuuuuuuuuuuacuuaaaaaaaugaggauauauuuuacaaaugcugugauuuguuauaaaggcgaauggaaugagagcauguucccaugcuauuuaucuugagaaugccuauguugggcuagacauaagaggccuauguaugucccagcacagaaugccauaucuuaucccuggaaggaugggcaacauuuugcugcagagaagaauagucccucuggugguuaauguugauuaucuacuugacaggaucuagaggaaucaccaaaguagcaagauucuggacacaccugugacucgucauauagauuaggauaccugaggcaggaagaccugccauaaugucugaucaggcaguaccuuaggcggugguacugacuaaauaggaaaagaugaggugaggacuggcauccaucacucucuguucucugauuaugguggaccgugagaggcuggcucaagcuccugccaccauaacauucccaucucgaccugugagucaaagcaaauccucccucccuuugguggcuuuagucaacggggugggugguaggcggugggagggcggaggugggaggaucauccaaugugaucaccacaccuccuucagggacuugacacaguaaaagcuuaauggucgguuacacuguagcuguaaacaggugggcauuagggccccccaagaugauggaggaacagcucgcagggagagcucacagccacacaauuacagauaucagugauucuuuguuauagacaagagugaaucgccacacuuugucuuuuaaauaucuuccuuaaggugauacuuucauucacaccuugauacaaggagaugcgccugugcuugacuucaaaagggccagagacuuguuauccccagacagagaagggagaaauauuugcagaaacaccaggggugaccacuuugauaaacaacagcaauaaaauggcguaaauucuugauaugaggauuucuuggacuauuagaucgaaugcaucuguaucugagaauguugacauuacuauaaaguugaaaugacacuguaucucuggauguauaaagaagaugaaaguuagaaauaucauugcaacaagcacagaaucuuauuuauuaagugaaugucuuggcucuuccuaugcaagguaaauagcaguugguauuucuucucaacagccacugacuuggguauggguggcauggcaugccuauuugccugacucuauaucuggaguaaauggacccauagaauaaccuuauucucacucgaaauaagagacaaguguuugaaaacugaccuaucagauccuggcaagaggcaugcuaguggagucagcagagccaggugucacaugauccuggguccagauuccugaaagugagcuugcauuuaagaggaaugucuuucccugaaagccuucaugugccacugaguucuucccagggccaacggagaagcuagaugagugcucuaaggcaggcaguacaggccugguugggacacucauguaauaacauggcuguucccucgccuugugucuguggggcuuaugguccauaaaguuuaauaacaggcucaacagccgaacgguuaaugcaggaugcccgaaggccacucuuuuuuacaaagaggaucggguucuuuuauuucuccccucuugacauuucaucaaacacaaaugccugucugucacuguggaccauauaaaguagcuacauggcaugaagggauaagaaaauauucuacuggcucuuuaaagaguggaaucagcucauaauuagccuuagcuuggcuuaaagcuuugaagaagagaaaguuaugaagcuuagcugcccugcaaauugggugccauaaauacccauagguugauauaccagguacugaugggaauagcugacaacaacccccaaauuccuuccuaugguuuucaaagcuguaagcaucucccaguccccuugccuucuaucuccuuacuguggccaggaccuucagugccuuguuggugaacguaccaacucuaguccggccuagggcuugguaucucugguacaucuuuuggguucuucugucucccucggaauggguuccauuuuaucuucuucugcuuaaggauccauuuaggaaagcucuuaagcccuagcugaaguuacaccccuccugauaugcuuugaugacagggacaauguguuuguguacuuguuccuuauuuaaacacacacacacacacacaugcacaagcacaaaguagauucucaauguaugaccauacaaugaauauuugucaaauucuagacucucucacugggauuggaccauucacaaauuuauggaugaucuauccagaugaacagccucaaaagccucaugcccacuagcaagugguagcacacagaccuuagaacugaauuccuggcucugggaaggcucucuugugacuuugcucagcacuacaaccaggcagaaauaguucaguccuuucuggauuuucccucaaacuuggaagggaaaguaaaauuagaagggagugguaggugagaaucacaccaauggagagacuguuguaggaagcaggagggcacuucagauggguuuccuuccuagaggaugguggacauccacuaaggaaggagcugucuuuucuugcuuggcaggagcuagggagcuuacagugauacuuuugucccagucugugggcuguagcuugagagagcagaagugacuauuugcaaccugguuuagauuuuucuguucccagggaagcucuggcaugggccucugcaagacucauaggucugagcacugcugucugguauuuugaaaugcucacccuggcuccccauugcccucucaugcuuugcugaucuccccagccccacguggagcugugggauacaaaacaauucaguggggagagaaaaagucaccaggcacuguccuugagguaauuaaucagcggugacucuuugccagggggaauaauaugacucagaacacauucugccccuguaacaucaacugugcagcagagaggcugcuuugaaaaagaugcgaaggggguugguggauggggugguguuggggcuuugugacagagugagagcucucggcuggugacaccauugcaugcaagaugcaagauggcugcaaacagcaccuggucugcugccaagcugcucaguucucugggaaagugaacuuggugcuuuccaaguucacugagauccgucuccuggcuccaagucugccgcagugagcucuacagcagaagguggccugagcauacuccaugugacuggcacuggcuccugcuacaucuccccuucccguuggcuaaaacggaugcugcaguacagaaagcccugaaucuuggccaaggguuggggggggggucuguuacccccacagcagguuagccacaguucacuugguguguccucagauacgugggucacacaagugagaauucgucuuucuuucucugcaccagacaucaacggaguugucaugugccuggauguuaagaauaccaacuaucagacagauaggagugggaggugacagagaagaagggaagagugggaagaagaaauggguaaggaagaaggaaaggaggaagaggggaagggagaggagaaaagagagaaaccaauaaaaggauggggaaagggaaagagaggaaaaagaaagaauucacaucaaaacucuuucugcagaacacacauucugcagccaguuugacuccaugaaguugcuuacgauugcccuugcauauucaaacucucugacccucugccucuguacaaacuuuuguuuucuugccaagcuguuucuuccagucuguuuccucacauccugaggcucuuucuguccugucuggggaaacggggcauggcgauuuugaagauggagccugagugccagccugaaggggaaagguguccgugcacaggagcuaugggaugugagcacacuccagagagaagggaugucucaggaccuagaggagcaggucacccugcagaaggcauuccucagaaccuggugcucacugaaaccgggguacccuucuagaaagaucagcagcacugggcuccuugcuaaaggaacagaguggagcugcaccauugcaauugcgcaucccccucccccccaagccccagguacaggccauucuuuuucgagacaggguuucucuguguagcccuggcuguccuggaacucacucuguagaccaggcuggccucgaacucagaaauccgccugccucugccucccgagugcugggauuagaggcaugagccacccccgcccggcaaggccauuguuuacaaacagaaaugcuucugguuaaaagccuaacuuugagcgucccacagaugagugaagcuggaaaggaaguaucuggggauccaaugcucauagauucccuuaccacaaaaggaagaccagcgcucaucaaccaucucaccugaagaggagcccauccauaaagccacugaagagaagagacaggugggagaaccaucuguuggauuccauaguguugcuguggaucagcuagucacagauaaccaaccugcaggccacagguugucccccucuaucccuuggauaggaaauucuauugggaacauaccauaagaagcagagaauuuauuuuuuuucuuuugagagcuaggggugaucuucgaauauuguuuugcuaaaacauguguguuugugcauauguauguccuugugugugccaguguagaucugugugcgugugcauguucacauuugugccaauguauauaugugcuacucuguggauaugugauguucauguaugugucaguauagauguaugugugugugcauguuuaugugugagacaaauauagauacauguauuucucucucucucucucucucucucguguguguguguguguguguguguguguguguguguuuguguguauucacaugggugccaguguagaugcaugucauguucacauguguucugguguauaugaauguaggggcggucauaaaaaacacuaguuguugucucucaaacaccagcucuccaucuuccuuugauacagaguccacauuguucuggaucucuccauauaggccaagcuugccagccagugagguccaaagauugaccaucuugucaguacugggauaacaugcauauugacacaacauuuuuuuuucuuaacaugaguucuagggcucaaacucagguucucaugcuuguaagccacgagccaucucccuacccaagaugauuucacuauaaggaaaaauaaacauaaacacaaauuuucuugagucccagcauauugccugccuggauuuagaucaucucagagcucacuccugaaggauagcuucuuugguuuacaacauagacuugauuguguuuggcauccagagaaagccagccagccacuucucauucucaagucucggcugaugcagaauggaacugaagcuuuuaaucuugccauaaacggaugugugcaucugagucauguccuacacuggcaaaaugguaaaggguugacacugacucuuucuuaauuaaaagagagaaagaaagaaagaaagaaagaaagaaagaaagaaagaaagaaagaaaaggaaagaaugaaggaaggaagaaagagagaaagagaaaggaagagagagagaaagaaagaaagaaagaaagaaagaaagaaagagagaaagaaagagagaaagaaagaaaggaagaaagaaaggaagaaaggaaggaaggaaggaaggaaggaagagagaaagagagaguaaaagagagagagaaagagaaagagagagagagagaaagggagagagagagagagaaagaaagaaagaaagaaagaaagaaagaaagaaagaaagaaaacuaaaauggagagaaaacagcaaugccuucguuagaagagaagaaagacuggagaaaaugauggagggagggggagggagggagagacgggaguggacagaaaaaauaaaccaggggguggaggcagaaaacugcgcagcuccauuuuggcaacccaaagagggaauauaagcuuaaaguccugaauuuaacaaaccuaauuaucaaggcuuaauuaguaccaaggguccagcucuguggaacaccugcagacuuaauuuauguccugacagagaggaacaaguguuaacgggcuguauuuauguuaauaccugaaccuuaggagcccguggaacaaaacagaccgugugcugggcuugccgagcuucagaacaaauagaaaagauuuucaucuuaauguagucugcauguaauucuuuuggggaucccgcggaucuacuuaaacuuuuagaaguagcacacggaaagaaaaaaaaaaaaggagagcuguuaagggucuuuguuaaagucucacgagaucaagccacagaugagaaguuacaucuugucuuuaauacacagaguggagaauuaggcuaauauugauaguguuucuggcgguuauauauaauguguguguguguuguuugugugugugugugugugugugugugugugugugugugcacgcaugugugcuuguguaugcaugugcagguacccucagaggccagaagagggccucagggucugugaggcuggaaucacaagcaguucugagcuaccuaacaucagugcugggaacugagcucagggccucuacaagagcagcacacacucuuaacugaggagucaucucuccagccccaaaggguggauuguguguguguguguguguguguguguguguguguguguguucaugaagucuccaagauaaacaguauugugccuaugaacacuagaguauuaaaaugauagcuugcuuggacagagagcuugucacauguccaccaacaggcugaggucucuguagacaccuucuaguuuacagaucaagaaaccaagagggagagaacagaaggauguuccccaggccaggcauccacgcagacuaaagagcaucacuaucccaaacuuuaugaccaaugcguccaacucccucaaauacacacaauacugauaaaauauuaaaaauacuugugcugggcagugguggcucacgccuuuaaucccagcacuugggagguggagguagguggauuucugaguucgaggcuagccuggucuacauacagagugaauuccaggaaaaccagggcuacacagagaaacccuaucucaaacaaacaaacaaaaacaaaaaaccaaaccaaaccaaacaaaacaaggccaaaaauaaacauuugacaauagauauaaucaaaaaauguauauaaaacauuauugagguauuuauaaguaugaaaagauauauguucuuggaaaugggugugugugugugugugugugugugugugcaugaugggcugagacacucaauauuguuagguugucaacauccucaaguugaucaauagauucaauucuauaccuaguaaaaucugagcagauauuuuuuuaauauaaauggagaaguugauccuaaaauuuaugucgagaaacaaaguaugaaggagaguuccaacagucuuacaaggaagaguaugcuaugguuagggucuuuauguuuggccagcuucaaaagugacucgaaagccacagaaauugaugcgguagucacaggcauuggaagagaaaagggagaacaauuggaucaauggaguacaauggagaggcuagaaauaggcccacgccuacauagucaaucgauguuugacaggggugcaaagggaacucaauaaagggaggaugagacuucgaacagaugucacugcuuccacaugggaaggaacaugaacccccacccuuaccccccaccacauccaaagagcgagcuaaggugaaaaacaggaacaaaugcagaaucuaaagucuugaagguccuggaaggacacugagaagacaucuuucuuaccuuggcauuagcaaagaguucauagcaaaauuaaacaaaaucccugacaauagaaagagaagaggaauuuggugcuaucaagauuuaagauaaaagacuacgucagagacuacaaaaggcagguaaggagaaaguucccagaaugcgcaagagccuuguaucucugguguguagaaucucuacagcccaguguuaaaaaagaaaacccaacuuggaaaaaacuguucaaaugugugaguaaguacuccacaucgacacaaucugaguggaauggccaaggagauuggggagguguggggaagcaugagucaucaggaaaaugcaaaaccgagcaagcaaaagagagcaucucacaccuacugccaaagguauaauugaaagaccgauauuugcaaguaucaaugaggauaugaagcaaugggaccucucacacaguucuagauguaaaaacgguucaaccacguuacacuacuguuaggcggcaucuuaacuggacaccccaagagccaacaauccucugccuaaguauaaaucccaaagaaguguuguaccaaagagacauugaugucccuuguuuacugcagcaccaucugcugcaccucaguauggaauccaacagagguauccacaguuaaauggugggcaaaagaaaaugugguaccuacacacagcagcuuaucagaggcugagagauggcucagagucucuaaaaacauaauggagucugucaaucuggcaaaaugggcaugauggagguggggcauugcgcuaaaugaaauaagucagacacagaaaggcaaguguucguauuuauaugcggaaaucaaacccagcagaguugauagauggaaacaguacaacagugguggaaaguaggaaggccaacaaggaggagguauaugggggauguuuuuaguagaagauaaugaauacaaaaguauuucauagagaaauaaaaguauuucauagagaaauaggcucugacacauauagagagcugagaggggggcuguaguacacaccaauuaaucaucuauuugaggagaaacuagaugacaggaguuugagauaauaauugagccaggaaugguggcuuacaccuuuaaucccagcacucaggaggcaaagacagguggaucucugugacuuugagacuugccuggucugcaucauaauucuagguuaggggugcacagugagaccaggucugagaaagaaaagaaagaaaaacaggaaggaaggaaggaaggaaggaaggaaggaaggaaggaaggaaggaaggaaagaaggaaagaaggaaagaagggagggagggaggaaggaggguauagaaagaaauaaagagugagaggaaagagagagagagaaagaaauaaagaggaagaggaaagagagagagagagaaagaaagaaagaaagaaagaaagaaagaaagaaagaaagaaagaaagaagaaaaaggaaggacaaaaggaagaaaggaaggaaggaagaaagagagagagaaagaaagaaagaaagaaagaaagaaagaaagaaagaaagaaagaaagaaagaaagaaagaaagaaagaggccuggugagauggcucagcggguaagagcacugacugcucuuccaaaggucaugaguucaaaucccagcaacuacaugguggcucacaaccacccauaaugagaucugacucccuuuucugguguguuugaagacagcugcaguguacuuauguuuaauaauaaauaaaucuuuauaaaagaaaagaaagagagagcgagacugauaaguauuuaagagcaagaauguuaaugguucugaucugaucacuauacacuaaucacauagaucaaucaucacaugaagaggaagcuuggugguuaagagcacuugaugcucuugccgaggaccuaacucugguucccagcagaugcacagagaagguuaugagccuguguguucuggguauaaccuugcugggaucacauccagaacacauacaaacacacauaaauaaaguaaauauuuuaaaguauaucacacaucaucccacacauaugugcaagcaugugucaaugaacauuuuucaccaaucgcccaaaguggugguuguaugccuuuaaucccagcacuugggaggaagaggcaggcagaucuuugugaguucgagaucauccuggucuacaaagugaauccaggacaaccagggcagugcuacacagagaacgcccaucuuggaaaaccaaucaucaacaaagucaaucaaucaaucaaucaaucaauaaaaugaaaauaaaaaugccaccaguuuuugcaaggcuguuuacagaagcagaaauaaccaauuuuuuacuaauagacaaguggcuaaacaguggcgcaauuuucuacuggaagaauaucgugagcugaaagagaggucuucacguguacagcagcgugcaugagucucagaaacaugcuagcugugaaacaaaccaauaaagacaaaaguucuagacuugaaaggguagauacaauuuucauuaaaugagguuccagaacagguaaggccacacaagagcagucagugcugguucugagagcauuaggauaugcuggaagauaaacucagucacuuuguaaaugcucuguauacacagaacacuguauaucccaggaaagcugguaaccaccucacaaguguauggacaugauuauccaaaaauagaaaacuauacuuuucaacauguuaauucuauggcaugucagccacuuagaugauuuaauagaguauuaucuguguacacauguaaauauucucucacucaauacacaauuaaaaacgcuuguaagagaguuuauuucacugaugaguuuuagucuauugucugcuauuuauuuauuuacucauuuacuaacuaacuuucuuacuuuuugccuugcugggaucacacccuuacaaaaggagacaaaauugaaguccccgagagacaccuuucauguuaaggguaaaacgcaacccacacagguccuugaaguuucaaguuaaggugauuuuaagaaguuguguuuaaugcuggaguuagugaggcacaccuuuaaucccagcacuagggaggcagagggaaaggcagguagaucuuugugaguuugcaaccagacuggucuaaaaagagaguuucagaacagccaaggcuguuacagagagaagcccugucuugaaaaggguaaaauauauauaaagaagaagaagaagaaaaaaaagacagaaaggaaggcaggaaaggaaauggcuuauuuuaaaauaauguguacaaaauauugauuguuauguguacguguggugagagagagcuuuuguacaccacggcagucuaagugcuugagggaaccagaagagggugugagauccacuagaacuggaguuacagauggccacgagccuccaugugggcucuggaaacggaacccagaacccggguccucuacaagagcagccagugcucugaacugccuagcggucucuccggccccugcaauugcccaccgauugauucuguccugagugccucaggcuuuggaggaagagauagggcuuaggaggccaaggucacuauuuugguuucucuucucauuagaggugugaccuugggcaaguuaaccaucaggaagcuccugguuuuguggggugaggguguucugggcccauuuuuuacaaccuuguaaacaccaaguggcuuuaggauaaaugucacuuaaacuuucaaacuuuuauccaaacuccuguuucugaaaauuacuaaguggcugugugaaaacaucugaaaccauccccggugacuuuccuucuuaaugaguauaaguauauucuggaaauacuuaauuauuuugaagaccuaauuuagaacacauucuuuugccagcagucuuugaccuggaaugcuaaaguuauagcugggaccgaauccaugagauuguucuuuucugagaaugcuaagaaauacugccauucuucuaagcugcaucuacaguugaguguguguguggaucauauauaauuagauucuaugagccaaccuguccggguuuuuguuuuguuuuguuuuucuuucuuucuuuuguuuguuuguuuuuuguuugucuguuuguuuuuggagacaggguuucucuguguagcucuggcuguccuggaacucacucuguagaccaggcuggccucuaacucagaaauccaccugccucugccucugccucccaagugcuugcugggauuaaaggugugcgccaccacggccaggcuauauagccuguucuuuaaaaaaaaaaaaaaaacaaaaaaacaaaaaaaaaaaaacuuacuuuuguuagacacucaaaauucaccaguccuguacuccacauaaaauuguauuucuccauugaucuaaccaguguauauuuuaaagaucaguggguggucuagcagcagcagaaaucagauccauaacaacaguaaauucuuguguggguuuugcacuaucaaacuugccaggguuucaauggaacacuauucagucuuaaaggcaaacagaccuuggcuuguacuuuguacaaauuaggcaauaaguacugguuagaagcuagguucccaucacaccgugagguacagcagacaacacaguuuaagcucuguggagaaguugacacagcgauccuuucaaaugagccacugcauuuugggguuaccaggaaucagcgagaaagaugcuaccugauuuagaaacuugagcccuuuauuccauugagaaaaggaaagaaacccacagaaaguuaaaggaaacccacuggugaccgggcagguuuuauuuaucuuaacagggugagccugaguuuuugugaggguucccaaggcgacgaggcuacggacuuugaagugagguuugcaaaagcagauaucacacauuagcacaucuauggaaaccuugacagaaaccauugggcuuacuuuccuaaccgugcaaccgagguaagauauacacaggguucucguaaacuggcgccccagagugaugagaaguuggggcuccacaggccacaagcggggaugcggaugcgcgugggaccucacucugacuuccgcacaccuucguggcagucccuggguggaucugcuggaaccugugugugcagccgcaguccagucaucagauaauuucugcuugaaaauucugagaagcaaggggcaugccagguucaguuagucacggggugggggaguuguucaaaagagccacacugcgaagaugcaaagcccauuuuuggggucacugggguuagugucauggaguuacaacccuccaggcucaggaggguuuucacaguuucacgccagcccaagauacacuaagcaggcuaggcacaaaggaauauuaucaggucgguuccuggacacauuaaaauuacuguaaaaugaaaaggcugcggggcgggggcguaaagcaggcuggauggaacgggccacaaggaauuggggagagcagagagcagaucuuaagagcaccuaguccuaagagcagaaacugaugacaaaugcuaacuagaacaagaagcuggggauauagcccgguuagcugguagugagguugucugacaggcaguguucucugguuauugaucccaggacugcauaaaccaggcacgguggugaggccugcacuugggaaguagaagcagaaggaucgggaguucaaggucauugcucuuacacagcgaucacguucaaggcacguauggguggguacaagagacccucuuccaaaaugaugaugaugaugauuuaaacaaacaguugcuccgagauuuaugacauacacaccaggcaccacugaaaaucuguaauuuugacauccaaaguagacuuagggaauccuauccagcuauccaguuuccuauugcaguaaaggaaagaaagcagacugagccccaaauagucccaagacucaacaccacaccagacugguguaaccuuuuuguuauucugagacaguuucauuaugcugcccagacugaccuaggacuauuaaacucaaaagaucccuaacucagccuccagaguagcuggggcuacugggaagcccuagucaggcuucugugaaauuuuaaaauuuagaagaaauaccaauaaaggcuaauuguggaagugaaaguaaacauuaauaauugccucacugggggacauuacucuguggcaccugacaggggaagggacucaagacagguuacaaauagcugcccauccggugacuaacaugucaaggaaacucuuguuccucaacucguguaaacaaagccugcugcucugugcuguaaaauagcaggcauggguuccugcuucaccuuacccgugugaggccaaagugugaaggaggaggggaaagaggcaggcaacuuagaaagggcacuuucuagaacaagaaauggaaagcuauucucagggcuagacagccucucuugguguauagcaaggagaaaagaaucagaaagaaaggaaggaggaaggaaggggagaaagaaaggaaggaaggaaggaaggaaggaaggaaggaaggaaggaaggaagaaagaaagaaagaaagaaagaaagaaagaaagaaagaaagaaagaggacagccagggcuauacagagaaacccugucucgaaaaacaaaacaaaacaaaacaaaaacaaaacaaaaaaaaaaaagaaagaaagaaaagaaggaagggaggaagaaagggaagaaagaaagaaagaaagagagagagagagagaaaagagggaaagagaaauaaagagggagaaagaaaaugaaagaacaaaggaaaaagaaagaaagaagaaagaaaggaaggaaggaaggaagagaaagaagaaagagagggaaagagaaauaaagagggagaaagaaaaagaaagaacaaaggaaaaagaaagaaaggaaggaagaaagugaaagaagaaagagagggaaagagaaauaaagagggagaaagaaaaagaaagaacaaaagaaaaagaaagaaagaaagaaagaaagaaagaaagaaaggaagaaaagaaggaaggaaaggagagagggugggaggaggaaggaagggcgagcaaauaagacaggacaagauauagaauaugaagugaaggcaaaaauauguaagaaaaugacacucaugugggaaccagacagagggagcagagucugagagaggagugggugugggugggguuggggaaggggaguucucucuguuucugccguggcuguuugccuggcgauaguuuucuaagaaacaacagaaaauuaaaagaaaaaaagaaagacaauuggaagaagcugaucuagacuagcuaaaaauaaacgguaugugcuguuuaugagaaccucaugugggaguuucacaaacccagacucagacaagagugacagaaaagauugaggcuuguccuccucaggaacuggccacgggacagccuaagcugguggggacuccaguucugcugguucaggucucaggugggacacagcugaggugugggguguccugucauggaagccagccuucugaaucugucuggguaacuguuguucauccaugaaauggacagggaaccaagauuccagaaacgucuuugaccuugagggcuguuuugugggcccuggcuccggcugccagauaauccugggcuuguuccuguuucugguuuuuguuuuugaggcugggucuuaucuguuccagaccggccuugaacucccuguguagcugagaaugggcuugaacuucugaucuuccugccucuaccuucugacuacaccaucacacucaguccguguagguggugcuagauaaagaagcuagggcuuuguauuccaggcgagauuucuacaggcugagcucuacagcaauggagcaugauggguacuggaagacagacaugacaacuugccacaguuuguacucagucacaggacugaacauucagucaugugugaagccagcaugcuuaaaugauccaggccaugugugacaaaagauucaaacagaggacacagcaugcauggggugucccuugcucugaagacacucuggucuccuuggccaggcuguucgguugggagcagaggagacuaugggguuuuguuugguugguugguuauuauuuucaucguuguucuuuuugagucagcaucccagagcaccaaacggggagaggcagagccacccgaugggucaguaguuaggagcgcuauuugcucugccagaggagcugggaucagauuccagcaccuagaugguggcucacaaauguuggguaaaucuagugcuagagauccagcaugcccucugaccucugcagaaacacggcguccuuggguagaugcagguaaccuuuccggugaguaacacaaaaacaaacccugaaguaaauucggggaaagauguuuuggcagaaggcaccauugcuuggcuccucaggcuucugcugcucaggugaccaguucaaauucaccauucccaauuaaaaaaaaaaaaaaaaagcuggggcacuccuggaacaucuguuaucacaaauaaggagauuagauuauuagaugaugagcuuagcagaagcaucaucucaggcuccaugcaucccugcugcucuucucugcacgccgcugugcgugcaugcucaggggagggcuucuguucuaucuccugauucagucuugucguuccuuggccaccugaguggccucuaucucugagaucacacaaaagcucugggcuggcaauagaugacuuaaccauucccccuugucccugaacccccuacuccauguccugcaucuuccagugcuuauugaacauacaaagaauugccacagaagagagggcaacugugcaggugacguuguuuuacacagaagcggaacgacacagauggagcgaggggcagugaucacaaaaggguugacuugauuucaggccuuugacuugauuuucuuucuccucuuucucccucccucccuauccccccuuuccucauuuccuccucccuucccucccucuuuucccccucccucucucccuuccuuuuuauucuuucugaaacgcucacugcuuaucuaugucagguuaggauuccucaagucauguaagaccuccccucaccaagaguggcggugucuaagaauuaaccaaaacaaaaagaguuccuuauuuauuagacuugaagcaauaaaauagauccucagcuaguggguucccccagccccuugccuuugucuacugaaccucuaguggggcuccucaguguccuuagaaaacugcccagcaguggacucggaguccuugucaucuuucaagauccgagagucuuucuugaccaauuuguaacagagcaaugcuguggcaaacagacagccuagcugcuaaugacgggccucacacuucaauauuuuaugccaccuuuaaaaaaaaaaguuucaguaacugaagguguucucgcauuaauucuuugcaucaauuauugacagagaauuuaauuuaaaggcaacuagucaguaaccuagggguaguguuuuaaauaauuuauaauuguggcacagauguaaucauauugcuauugauuaggauccagucacuuccgaggguccagcaggucuuaugcuaauuaauuuuagugcgaucaccuuuuuaacuccauauucccugguaacagggacucauuacaagaauaauuuaaugaagugcagucuucuaaggucugugcagagaugaaggcagagggggauggagaccugaacuucuaagauagccaagacuugugcucugauugguagauaacgggucuuaaaugggagcuugcauauuguuaucagcuagcagaugggacaguggaggugaaaagugggacuuagggagcaggggaugacagaaaaaaaagauacuggaagauguugguuaacuauaccuguguguuugcauggguguagacaugucucuguaugugggugugugugcgugcacacgauuguaggaaugucuguguauguuugacuguagacgugucugugucugugugcaugugauauaugggcauucgaguguucguaugcauaugcauguauguggaagccuggcaacaacuucaggggcuucagguauugugcgccauauuugugagacaggguuccuuacugggaccugggacuugcugauucagccaggccagcuggcugucaagucucagagauccaucuucuucugaucuugcucucuacuucccagcacugagcuaauacacacaccaucaccacaucugauuuuuuuaacaugguuucugggaccaaacauugguccucuuguacuuuacuacguuauuuguccaauccugguuugauggacuuuuucuucaauuuuucuaugacauaaacuaagagucauuuugagggauuuggggaagacaguuggugauauaauaaaaauguagacagaugagguuugcucuucccuuaggccuugaggaccaaggaccauaaagagugcucauggcuggauucugugagccaggcagugugagggcagaacugggcagcugauagcuacagguguuuauugagaagugauaaaaggaucugaaacccgguucucugugaagcaauaccugaaaugaggcugaggcugguguuuccacaaacagaaagugaacgggaagguagcuuuucacuaacgucacagguaaggaguaaucuuaaguuggaacccacaguuaaguaagcagacagagucuggauccuaccaucccccucaccgcaccuccuggucuggcuuugcccuucgaguuaagacaggguugucagggccgcaaagagggcgggaagggauugaaucggccccacugcugggaggccaguuuagcaagugaauguggaugagccaccaugacugugaccuguguccuggggacaacugcccaagacucagggacuaagggugggaugagugucuggugggagccugggagaucagagcagagggccauucccgaagagaacaaugagggaucuuuggucauaggguuuuguuuaaaacuuacuuucacagcuugggcugggcacguggcucgguggcuagagugcuuguccagcauaaagcccugugcucaacccccaggacuguauguaucccggcuggaggcgcagggcuguauaauucuaacacucgggaaguggaggcaaaaguucaaggucaugguuagcuauagcguaagauggaagcuagcuugaguuaugugagagguucugucccccccucucucucucugucucugucucugucucucucugucugucugucugucugucucucucucucucucucucucucucucucucucucucucucucugugauaauuuuaaauaaccauacuucaauggcaaauaugccccuuuaaccaaacgugugucaguguacauuugcuacaaaacugcugaccucauuuauuaaaaaaauaaaagugacccccauguccccguaucccuguaucccugcagugggaauuagagaaugagcacacuguauuguguucacacuguagugaugacgcaugcucucggguaauagaaagcaccuaaugugaaagagauaaugaaggggggggggggauagaaccgcacagcauagauuguaauccaaauaauccgggggguggggggaccuggaaacuaacaggggccuacagaaguucucggagaccgcacaggaaacucgcucugaaggugcggaugggccuggaaaccuugugugaccgcuguugcuauggcugugggacagaaaaaaacaaaaaaacaaaaaaacgcagagcuaagaucuugaaagucaaaagauaagggggaaaauugucaccugcccacacugagugcucguucaacgacugcguucucgcugaagccuaaacgaccaaagaacaacaguuucuuccuuuuccucccagcccaaguaacaccuugacacucagccaugucuucuccugagaggcgguucuccuggcuauuuuauccaccagaauauauuuggagcugagagaguauggcgggugcauugcccgcauacccugucaguuucacugcagagccuuggggucuagaaggauggauucaggcucgggauccaggguagacgccaggggcuggcaauucucuucccuuucccucucuucuguuccucuccucaccuuccugccucccuuccccgaaguaucucuccuucccuuccuuccaugaccuuucuauccuuccuuuccucucuuguccuucuuucuccucuccuccccuccucuuccuaccccuccccuccccucuccuucccuccucccucuccuccucuucuuccucccuccuucucucccuccuuuucuuuucccccuucuccucuguucucuucucccucccaugccuuuccuuucccuucuuacuuccccuucuuucuuucccucccuuccucccucccccuccccuccccccuugucuuccucucuguccccuucucccuaucauuucuccuugacaacaucuuucuagguaaccgagacgggucugaaacucauaauccuccugccucagccucucugagggauuauaaaugugcaccaccauaccuggcaagugucaucuauaaggagcucuuugcaaaugauuucugugauugugagccagugucugugacaaauacucaauucugacauuguagcaauaaaagaauaaaggguuuuuuuuuuccugucuaaaacagacaacaauuguagucugccaaucuagguuucaaucaacauugauguguaguuuagcaguuuccgaagugagaaauaaaaagcaagaggcacagcacgggugucaucagugucagaggcaggcgucaucaaccugagagucaaauucaaagagggccggggccaguguggaaggaaggauacugggauagugauccuguucggaggaaagauagggaaaguucuggggacugagugcuggggacugagugcuugcugggacugacugcuggggacugagugcuaauacuaagugcuaguacagagugcuggggacugaguucgggaaagcaucucagugaaucaagugcagugccaaguggccagccuuggggaaagagacugauaguuacuagaaggaagagaaaaggagcgagauccaggagacaggaaaggacuacagggcagucuggagaauaugguugaaaacaugacuucaaaaggagaaagaagggcuggagagauggcucagugguuaagaauacugacugcucuuccagagguccugaguucaauucccaccaaccacaugguggcucacaaccaucuguaaugggaucugaugcccucuucuggugugucugaagacagcuucaguguacucauaugcauaaaauaaauaaauauaucuuuaaaaaaaauaggagaaagaaguauauguguuggaggcgggggaggcaggaguaucuuuauccuugaaucacauuccaauggcaaugccucaaaacuaaccccaggcuacuuagaggaagcacuuuuauugucuuugucuaaagaccagagacuacaucuagcgccauagacaccuaacgaguaugcgugugugcgugcaugcgcgugugugugugucugugucugugugugugagucuaugugggugucugugucugugugugagucuguaugggugucugugucugugagucugugugggugucuguguuugugugaucuugugcauguaccccugcacgugugugugugugugugugugugugugugugugugugugugugugugagucuguguggugucuguguuugugugaucugugcauguaccauguaccccugcacauguuagaggucagaggacaacuugagggggcugguucucuccagcugccaucugggucccuggauuuaccuacuggggucauugucucugacccagguucuggaacauucuaugugggggggggggccuuaaguguauggucagacugauaacacucuucauuuaauaacaguuguguuuuguuuuguuuuguuuuguuuuguuuuguuuuguuuuucaagacaggguuucucuguguagcccuggcuguccuggaacucacucuguagaccaggcuggccucaaacucagaaauccgccugccucugccucccaagugcugggauuaaaggcaugcaccaccacugccuggcuuaauaacaguuuucuaacaagacagaugcugggagccuuagcaucuguggcacgcagacagauggccagugguaccugacuucagguacccaggggccucuaguuggguuccccagaagucaguucugcuaaaagaagcagugguccugggccaguuucucccgggaucccugauuucagcagagggguggggagugugcagcuggguccccagccacucggguggggcgaaguagcuugugcucacgucagcaucuuccccaagcucaccuuuugaaaagggagccggcuuuuuguuguaaauggcacugacacuacaacaagaaaguucauuucaugaagaugauucauuaagaaauaaaauauucauggcugacagcuugaaggaucgccauggaguuauauucuaaugcaccuguccuccgugucaaguccaaugugggaugucaugucgccaaaguuuuauuuagaaauuguuugucagagugagcuuucuaaugugaaugaaaaauucauccccucauuaagaagauucuacaugaaaugucuaggauuuucaaugaacgcaaggacaugaaccaauuacuguuaaacacuuaaagagacagagucccgagcucacucagcaaaacccuuaauugcaccagugcggagggagagaaaaauccaacaccucgaagggcaaaugggaauugugauuugguaaugucuucuccuuugucauguccggaagacccccaucuuuaaaaagacuuggggggauuucgacucagcucuucuaugggauagggccagguguuaccaugucuguccccagugcuuaugcgcacaucaugagacaguauucugacacgcccacgaacuucugcuucccagacaaagugacugaaaugcucugggaaucucuucaguaguuguucuuaguaacuucuuaaccuuccuuuuuuuuuuuuuuuuuuuuuuuuugguuucuucuuucuaaauuacucuguugucuuuaugugcuuugcgcuccuugugucacuuugaaacgaggguaaauaucaaacagguccaugccaagcaaaugacuuaacgacuccagaacgguaggggaguugggagaaagggaaagaaagccauaacaguugauaauaaagucaagcaucucagaaauaugaggagacauaggggaauggcuuacaaaauaaaauggcaguuuacaaggugacaguggauuagguugacaacaaaacucucuucugacacacagccugguucagcuuacuccacgguaggaaaauaguucuucuucaaacucagcacuagucucuuucucucucucucucucucucucucucucucucucucucucucuguauauauuucauauauuuauacauauauuuauauauuauauuuauuauaaauauauaucauauauuuauaaauauauacauauauuucaauuuucugaaaauuugaaacugguaauaugaagacuggaauugguccuccucaacccaccagagccuaugaacuauaauaaggacuccauauucgcgaugcuucaauaaacuauuucaaggaaaaaguugcuuugacucuguagcuguguuuccauccuuugaggcucuaacggugcucuccaaaaggagacaacuacggacacacccuguauccccacugcucuugugggugggaccccaguuucgccucuuuggguuuaauuauauugucucugcaguuuccuuugcauuuccuugauuuaauugguuuuauuuuuauuuuuaucucuuuugagauugucuugcauagcccaggcuggccugaaacuuacuagguaagcuaggacgguuuugaauuccugauccuccugccucuaccuccugagugcugaaauggaugacuggcaugugccacccaagccagguuucuuugccuucguauucuauacauuugucucucuuuuuauuuaucagucuaucugcauauacauuucuccguucaugugcuuuguuuauaaucucauauuuaugaaauacauaggguaauauguaugagucaggaucuuagaacagauggaaagaugaaauucauggcuucuaagaaagucucuccaauucagauaaggaguucugcccagagauguucgucgaugugccacuuaaaaugggaacagggccggggagauggcucgguggguaagaacaguuguuacauaagcuugaguuaugaggacccgaguuugaaucuccggcaccauggaaaaaacaaaccaaaaggaaacaauacaacaaaccccaaagaguuguguauagccuccugugccugcgccuauaagcccagcacugugaggagguggugacagggcaaacacgggguauguuggcugucagcucagcuccagggccagugagaaaagccuguuugaugggaguguguguguguguguggggggggggggggguagcugaacccauaugugcucuuaccugcagucaugcacaugggugugugcaccaacacaugcacacacacacacacacacacacacacacacacacacacacacacgagagagagagagagagagaacaauuuauauguccaaaagaagaggagacauuccuuuguuagccgugcugggacagacgugcugggaguuucaugagacaaaaaccaauagcuucuuuuagagaaaaauauauuauagauuuuuaaauggguguaggcauaugggcaauaauuuauuuuguuguuuuuuuuuuccuuuaaaaaaacauuuuucuacccaaagccuuaaacaggcauguaauuaaaauccaagacaaauucccaaauuuuguacauuuauguagcagaggaaagaacuaucuuauuuuuaaaaaaacaaaacaaaaaaaacaaaacaaaacaaaacaaaacaacaacuuauaguccuaagaaagaagggaaaaacucucugaccuuucuacaaaguaaauuaaauuaguugcuuuuaaaaagccccccuucaucuucuuccauuuaugagauguuaauguauuguguuacccacacagaaacgguggagacuauuuacauaagucuucccugcuaccagauuucaacuugcucaaauaaaucaggcauccagcucuggcccucucgaauuuugguuaguggaacucuuugcuggaaaucguauccaauacguuuuuuucacaaucugcccauaauuaguuucacugggacaacugcgaagaaguauuuugcugcuuuuaaauucauaauuuugguucaagagccccagaauaagauguuuagacagagugaaaacuauuuucuaacaaaucaauauuaauuucucugacugcuacggucucaggagccagaaaugcucuuguacugagcugacaggaaagauuuuuaucccgaccaaauguuauucaaauauuuauaagacuggauaauuuaguaaagaaaauacagauggagagaggcaagaggauuuuuuuccaugcuccuuucccauuuacaaauggaaaaacuauagaaaaaguauagagagcgauugguauccccugccacaggagugagugccugacagcugaagacuuacacccacagagaucuccaggcacuucucugcuagugugcugaugaauuggggugcuguuucagucaagaacaccacacacaucuuacacuggaagaggcaggaucucaggagcacagccaagagcuggggugggaggugggcggguuggaggggucaguagcuaugaacggaagacugcgccacucaggguaaggagagcagagaaauaagcgaaaggcgugcaguugagcucacuucuuaucuugaacucuagucuaagguaccuugaacuuugugaguccuuguuaguuuguguuacacgaacagagccaagagcacagggcaugugccugucaccagaugcauccugcaagggccacgggugguaacgcacaccuagaaucccaguccuagcggggcccaggcagagaggcaugaguuuugggccagccugagcuauacaguaagacccagauagcaaggccagugagauaguauuaucaguaaagugcaggcugcacaaacagggagagcugggcuugcuccuuagcacacagaccggagaaagcuaggugugguggcuugcacuuauaaccccaaagaugaggagguggagacggcaccauucuuaggacuuacuggccacccagccuaguguacguggcaaacuccagacuggugagagacccugccucguaaaacagggcagacagcguucauuccugaggagugagguucacuugugucucgaacauaugugagcauacaggugaacuuacgcacccgggaacgugcacaagcgugagaaaggaaauagcauagaagcauaagacggugacuuccugcucaguccagucucaaccugacggaaggaucgccauuaaacuccucauagcuaaugagaugugagaagcauccuuguccuucccauaccgcgguggggagagcuggcuuggauguuggauuuccuuuucuuuucaugcauguucucugacgacauagagauuuggaaguggucucucuaggugaacagggcugugugacaacgaguguuacauagcauuggaaaguuguccaggugacagcauuccuuuaagucaucuaaugcaggacacuuuucauuuuauuagcaagcccaauuuaacuuucuaaucugagugguuuggaaauguugauuuuuccaaguuucucuaaaaauaucuaucuuaauccaacccugugggucgguuuucugaagguucugaccuccaauagaaaccugaccaaauuagacgguaaagguuuuuagauuuuucuaguacagcaaugacucuauaggugaacuuuucuaagaaacuccaaggaaguugggcgugguggcucagaccgguaaucccagcacaugggaaggcugaggcagaaggaucacugucaguuugagaccagccugguuauauagugaguuccaggacagccugggcuacaaugugagacucuucucucaaaaaauaauaaaauaaaauaaaguaaaauaaaaucagugaaaagaaacucuggugauuugaagaggagacucucaaagagaauuugcuuuggaaaagcggccuguuagguuuuagggagguagagagggaagagaaagggagagggggagagggagaaagggcaaggagugggucagaaggccagccaguggaaccauccuucagacgagauauuuaucauggccuccaauagacaguaugaaggaguuucagcccuugugcuagaggacgcagccucaguuaauaugacacuugugccaugugauggagcagggcacacaugauuuaggcuacaugacagggcugucuuuuucagguaggggugugggucaggcuggguggauucuugcaguccugacugcauagggucugguuagcugaagggccuggguucucaaacagccagcauccugucgcgccaaaugucacacacacacuguguucugaaucaugaaauuaccccagcucagcacauaagauaaaaugagagagcaaaagugucuuuccacucaacccaccaacaacuucuuugagcucauccuguccagauggugauacuguuaaagaagaagaagaagaagaagaagaagaagaagaagaagaagaagaagaagaagaagaagaggaagaggaagaggaagaggaagaggaagaggaagaggaagaggcagaggcagaggaaaaggaagauuaagaggaagaggaagaagaagaagaagaagaagaagaagaagaagaagaagaagaagaagaagaagaagaagaagaaaaacugcucacacuucugugaacucucggauggaccgcacgcuguccaggggaacaucagcaagucagacaagcgaauucccuugccuguaauaaauaaacauggggacuguggaagggcaugcuggcuggguuccaaguguggaaaccugccuguccaccuucaaaaucgugcaagauugcaguuuguuuaauguucgucuuaugugcuuaauuaccaauagcgcuugacuaauuauuucuuguuuuguagacaauuuaaacagagccggggaagcggcuccacacuuugguagcuagcgcaggugaggauuuguaacucauuuuuguaaucgcguaauucccggggggcuucauuacaaacucgaaaggaaacaggaugcacaaagcaggugacagucucauuuccacagguauggggauggcgggggggaauuagggggggugacacacacaagcauuagacugaagugaugguaaauaaaguaggaaguagccuuuagauguuuucgaccgugucagguguuuucauguuaauaggagagaaagugcgaaggcagcagaguccccggcacucggaacugguauuucuucugaugcuggacuggagcuaaugucccugcaagauuggaaaauaagccacaggacagagcccaguauucauccucacgcauauaauucugggugaauuguggaucgcaccaccggggccauuucuguauuauccuuuaacuguacuuaacuucuauuuauuuauuuauuuuuuauuuugugagagcauguauguguaugcgaguauauucaucuggcacgugugaacgggugcacgugcauguguguauacgugcaugugaauagcagaggucagccuuggacuucguuccucgggagcucccaccuucauuuugagacaggauuucugauuagucuagggcuggcaugugaggggagccuaccuggccugugaagcccagaagucugucuguuuauacuucuccagcugcggagauuuccaaacaugccuaucacaccuagcuuuuuaaaguggguuccagggaugaaaccuggaccugucuugcuuacccaguaacaagcauuuuagugacugagccaucucugcagccccccacaacuaccuuuuaguauaaucucuuggucagcuacaaucacugccccgacuccaaaacucccugaugcuuugaaaaaucuaagacuuaaauuccaaaagcauacaagagccugagucggaggagauguuggagacuugcucuuaggcacaaugaugacaccucuuugaugaaaguuagcagccaagccuggcuguacguguugugugcauuauaugugugaggaagaaaauuggcguuuaucuuguggcuuauuuucuaaucuugcagggacauuagauccaguauccacacaaucgagauugaguaucucaguacucaaguggaggacagggugucaacauaaguuuaagaccaacuacgcagugaguuccaaggagauacaguaagacccugccucccccauccccuccaacagucauggaggauagagauguuuggagaugggaggaaaucuccauaaagcaggagccuagacuucauucgccuuuaaaucccaaauaaaugcauagagauugugaaaucuuugcaaugacagcaagcaccaacuccauauuauguugccauuguggaaggagccgcuaucuaucagagaugcacuugaccaggaaauguuccacacagguucauguauuugagccucucauucacagcugacaagguguuugauaagcguggugauuucaaugaaaauggcccccacgggcucauggggaguggcgcuauuaaguguggccuuauuguaauaggugugggcuuuucugagaaaggguguuucugaguguggacuuucagguuuccaaggcucaggccaggaucaguacuucucuuccugcuguacccaguauaucugucugugugcggucacgcuuccugccacgacaauggacuaaagcucugaaauguaagcaagcuccuauuaaacgcuugccuuuauaagaguugcuguagucauggugucucuucuaagacagaagugagugcuagggacucgggucuugcugugacaggccugacccuacuuuuguuuggagaaauguggacugugagacuuuggguugggaaagcagugggaugcuuuaagcagggcuuaaugggccauaacuagguggagcauggaagacacuggugcugagggugguuugaacuguggggcccuggcuuaagacgauucagagaagaauguggccuaggcacaguucuugugaugguuuggugaagagugaagcugcuuuuugcccuugucugaaacguauaccugaggugaaauggagacauggggucuggcugacaaaagugaauugauaugggggcaauuggagcuggcuuacaguuucagggguucaguccacuaucaucauagcaaguaucauggcagcaugcaggcagacauggugcuggagaaggagcugagaguucugcaucuugauucaaaggcaaccaggacagacuguuuucugcaggcaacuaggaggagaccuccaaagccuacccacacagugacacacuuccuccaacaaggucaugcccccuaacagugcugaucucuauggaccaagcauauucaaaccaccacacacuaccacagaugaaguuaugccauccugaccaugauuuaaaaauucuguuggaaacugugagccaaggauaaaggcauuuucccuuaauguguuccuguugaacauucugugggagcuaugagaagacuaauuaacacacuccguaugcucacgaagaccugcccaaugagcaaaccagcccuuuccaaguauugaaacucuagucugaccccgaagcccauagucuuuauacucaaucucucauuuuccuccuugaauucuuucccccaccccauccaugauacugagggccacagaaguuauguguugcaucuauaacaugguuggaguugaagccagccugcugagccucggaagcaagcagaacauagaggagauuaagaaaagaauugacaacauuuauggaacucugaugugugccaagcuacauucuuuacacucauuaucuuauguuaugucauaucaaaugcaugggcuagcuguucacaaaaucauaaauaguggcugacaucugcugaugccugguguuccucagggaacaaaccagggguuuuguaaauauuacuucauuuuuucuccucccccagaaccaugugaaguaguugugaaugcuguuuaucaucccauuuagcugaagaguaaacugaggggagggcagucauaugucccuagagagucaggaauaagccuaagagcucauguuagugagaccugugagacuaucgucccauaugccacuuuuaucugcugucuacccagaucacugucuaccuugggacuugaagcuaaagaguuguugcucugggucccauccacacagucugacccuccaacaccacugugacaccacuacucuaagcagggccagcuaccugagaucaaucggugacagucaaaucuccaagguuuguguuuugugccggaaucauguaugcuaagagaugcaagaagcaggaggggucuuuggccauacuaacauggaugcacccagucucaccuaaucucagaagcucagcaugguuggggcugguuaauacauagaaggcuaaggugcagacacgccuugucuaugggacuuucaucucugaugacagguacaagggagaacaauacuuuaagagaccauccaaucagcucugaauucauucacuaucuaugauacagaugguuuugaugagaaugguuccuauaggcuaauauaucugcacagcugguagaacuguuugggaaggauuaggagguguggccuugcuggaggaggugugucgaugggugugagauuugagauuucagaagacucaagccacucccuguauguguucugcuuccugcuuuuuccuguccaucauggacucuaaccuucugaagccauaaguccaagcaaaccuuuuuauucuauaacuuacacuguucaagguguuuugucacagcaauagaagaguaacuaauacuguaaauugcuuauuugucuuaauaccugaugaaagcaagggaagaaagaaggguuugguuuggucucauggucugaugauucugucuguuguguugaggaaaucagggcagcagcuggucacacuauaucuuuggucagaugguagaaacagauucuggugcucagcucaguuucuccuuucaguccaggaggccaggccaaggaacagugccauccauggcuaggguggucuucccacuucaguuaauccaaucuagacucuuccucacagacacauccagagcuuugucugccaugugaucuagauccuguccuguugccagccaauaccgagagucauagagagcugguuucaaauccccucacccaguuacuuaaaugaguaagucagaccauuuggagaaacuaauucugcuaaaguaugagauauacuaagaacuguguggcuacuugguagaguuggggggauaggauauacccaugggucccucuggagucauuuaguaaguguauguuuauugucuccaugugcugguaaagacaacaauugcaaaacuauuuaaaaagcuggauacuugggauuuuuuuuauucuucagggugagagcaggucagaaagaguagauacacaggacaaaaggauaaagcaggaaggucagagagaggaaguacacagaucaaagaaaugaagcagguagaccagaaggaggaggcagacaggccaggggaacaaacagacaggucagagggaggaggcacacaggccaaaggguugaagcaguuagucaguaggaggacgugagcuggucagacagagaagcucucugagccuagguguagaccugaccuuuacuccagcugaaauugcauacaauggacaaagccccuggauggauaaaggacggcaaacauuccagcuucccagcucagcuggauaauguagaugaaggagugucugaaaguaaggcagguuuccuccauugggugacgugguucugggagggccuuccagggaaagcaucuguuuccagaagagguaucugaauguccugggggcucucuggagcugcagagcugggaaccacuuaauguaacaggcacagcaauaagaccauccugaggaaguucacaguuucuuuccucgcaucuucauuguaaggagggaugcuguaacuccaggaggaaugcaaaauguuaucuuauuucaugccccaaacuagaaaguacauuccacuggguuugcaaaacccuuaagaugaaaauaucugcuugagcacagcguaguagaugagguguuuaaggcauuuuuuuuuccuuuagacuuuuugguuaaucuucuuuuuaguuaauuuucagagauaaaauccaguuauaaauaacccgggggguaccuugacugggguucucugagaauggcacaucuuuaacagccaggguuucugcuguuuagagaucucuggaggaagcgguacuuugaaaauuaucuaaggcugaguaaguagagaacacggauaaauuaaagagcaagggggagagggggagaagaaagagccaaugagaaagauccuuugacauucacgaggcagcagaucuuacccuugaaacuccuuuaggacaaaaaaaaaaaaaaagucaaacuuucaaaaucuauuuguugauuaaaauagagaauugguggguuucugucaugggagaauacaggggaaacgcguccuucuuacaaaagagaagcagaccugagccagagugggagagcaagagcaggcacugcuucaaagagccauuaccaccaccacccccccccccggggaggaauugugguacuaagcugaaaaucggcaguuuuggcacugccuuuaaaggcaacccauggaaggaaaccuguguacaauguaaacuaacauucacaaaagugcgggaaggagacuguguaaggcaggcgugugacuagcugaaauaugaauauuuccucagcgccaagauagacaguggggcugaggucaaccugcaauuuccacacagccuguucauaagaauaaaagaaggccggagaccuagagaggguauuccucugagccacaacaacaauaccacccugcaggauaaaacucgcucuuccuaagugcccucagguuaaagagcaagagagagggguggguagcuccaaguuaguucuauaaaguugucagagguaggaaaauuaccuucuuauuugugguguguguuuuguauauaugcauauggaaaucaaaagacaacuucaguuguugucucucaggcaccuaccuucucuugaguacacgguuucucauucauuagcuuggaacguuaccguggacuagccggccugugagcucgagggauuggccugucucugcuuccuacucacucuagcugagauuacaacugggugcauccugagagucauaaccaagguccuuaagcuugcaagcucuguagucucggauucauuucccaaacucagggaauuccuauuuuuaaaagcaagacguggggcuagagaguuggcuagguggcuaagagcacucccugcccuucuguaggaucugaguucaggccucagcacccaugucagguagcucccaacugccuguaacuccaauuccaggagauucagcucucuucuggucuccacaggcaccuguauaugcaugcacacaccgccauauagacacacacacacacacacacacacacacacacacacacauauccauguaauaaaauaaagcaaaaccaaauuuuaagugaguacaggagcugaaaagaaugcccagaaaucuuuuaccauuaauaacaucaagcgucuccuaccuccuagcuagguacuacagcuggguacaaaaaagcaagcuauggcuuaugcacagagaaguucuaagugacccaggugggaucaguaaguagagaaccaguucaggaagggcagugcucaguccuucucugggucagcucccaucaucacgagggugguggcuccucagguuccagcuccccacugugugcaugcccacccuggugugcccuucuccaugguguuccuucacugugguggggagucacacauuugcugcaguagagugcagucuccauagggaccaggaccucaucugagaugaugccuauuuuaguucauuugucauuacuaugacacugugaacugcuagguuacguguaaagaguuuaacucggcuccugacucuggaggcuggcaagugcagauagcauggugcugguaucuaucuaucuaucuaucuaucuaucuaucuaucuaucuaauaaguuauuuuuauuucuccacuggugaaaugagcugauucaagacaaauuagaguauguauaaaggcagauuuuugggguguauaggcaaauucacucgucucaagggauuaggccagggaagucaccauggggagggagacagaggagaaggggaagagaaaagaaggggaggggaggggaggggaggggaggggaggggaggggaggggaggggaggggaggggagaggagaggaggggaggggaggggagaggagaggagaggagaggagaggagaggagaggagaggagaggagaggagaggagaggagaggagagugcaagcacacagagagacagagacagagagucagagaaagagagagagaaguggggagaggccagaauguccagaucauauaggaaagagccucuggggaggaaagcccagccccuaggcuggaauguucaggguagggggugggguaugccagguaaggacugagggauucugggagaaccuggaggguccacuuugguacauuaaauaugcaccacagcuguuuguccggggucucaauuccaacacuaucuaucaaucuaucaucucucaaucaccuaucuagcaucuaucauucugucaucuauagaauuaucaucuguggaucaaucuaucuguuuugaggcaggacuauacauacguagcucaagcucuccugggacaacuucuaauccucugccuucaccucucagacacugagauuccagacaugugccauugcacucaaguaugcuguaccagggacugaaccagggcugugggcagacuuagcgaacacucuuccagcugagguccaucaccagccucggguauucucacguuugagaugagguccuggcacguugcucaugcuacuuacagcuuccuagugugauucucuugccucagccucccagguggcuuggauuaucaccuccucuauugcccuuacgcagacugugcucuaaaggguggaaauguguguguucuuaagacuucuacuggguagaggcauucgugaagucagcgucaggaggccgugaaccugaaggcugcagcucugaggagcaggaggacuccucuguucugauucagagucuggguggaggaaacagcuagugaacguuuccucuuuauggaaaacagauuuuaagccuuuccaugggaguguacaacauagcagacagguacaauacauacacaagaagcacgccugucgaacaguuucacaagcuguauguucacagcuauaugaacagaagacggcuguccuuugaagggccccugugucuacaguaaguagagacgauggggugaccaccaaugggagggcagacuagacaucaacuggggacgguguguacacagccuccaguaacggguccgagcaaaugugcaguauggaaaaggacaaaguacagaaaaugagcauuuacuggauacuuugccagacaucaugugcucguuugcacacauguuuuccuuuccuuucuuuuucuuuuuguugugguuuuuguuuuguuguuguuuguuuguuuugcuuuuuacuuaccacuuggguuauccaaaguugcuuuuuuuuuaacauuuauuuacuuaaucaguguguguguguguguguugggugugugugaguguuggguguguguguguugggugugugugaguguuggguguguguguguugggugugugugaguguuggguguguguguguguguuuguuggguguguguguguggucagaggauaacuuuccauagucagugcuuuccuuuuaacauguggguuccggccaucaaauucagaucaucagcuuuggccacaagcaucacuacccacugagccauccugcugccucucacuuucauuuauagccaggaaauggaggcaaagagaggucaagaggucgaggccauggcugccagguccgugcuguaccguacuucugcauucacccaccaugcuaauucacuacacugucucucaaccuggcaucucuuugauauccccuccuuuaaaaggcuguugguuauuuuccucuuggugaaauuaauaaccaacuuauuaauaucagaggcuuguguuauguuaauugaggaaggcaaccugaaauaagggcagaaccauugcacuguguaaccugcucagagcuguuucccuacaacuuguccauggucagucucaauuuagggcugagccagugaugcagacuggcuuugguccagaggcagaggucacaggagccaugguacugaggcccagugaacaucaaagacugugccugccauguggccccuccggcaugcacccuggaccuucauaaagacaacaauccuuuaauccaugcaucgggcuccaguucaccccucucccacuuccugccaccaugacacaguuauucaggaaguucagcaguguauccaggucacagggacaaggacaaagccauggaggggagggguuauucugucucuuccuguuuugugacaguagcugagaucauuauuucugacugucugguuaaaagaaaccgaaacagccuugggaauguugcagugguuacaaccggugcuggaugcuguuguucauuuaucugauauuccacgaauguugacugaauuucuucuauguguaaccacaagucgugcuucuuuuuuuuuuuuuuuaauaguauuaccuugaaauaaauuucucuaaaagaaucuauccuagggcuacacagagaaacccugucucaaaacaaacaaacaaacaaaacaaaacaaaacaaaagaaucuauccuaaccgugagucucugggauuuggguggagacaugcaagguucaacuugaaugggcagagaguuaguuuccuauugaaagacucuugaguagcugaggagggugaggagggagagagaagaggaagaaaacaugucauguuacacagaccagguucguguaauauauacagagaugacguacacaaaaaacaaggacaggaccaugaauugggggcugcuguggcagcucugaccaucauugcgagagcuggugacucaagcaguucaggccucugucugcccauguguuaaguggaagguuaaaggggauuucccuuccugggccucugggccuuuaaacauuugaaacacgacgcuuugaacugacagucauaguguaugucucugcauuuagucgaaaagaaacuaggucacuggcaacaaaccgaauugaaagcagaccccgggauggaaagggaaaggcucuucaggaccuucccaccugccuugugguugagaaguggagagacucucccuccaguuggguucugaagccaugucuugucaaagcaucacaucuggacaggugacagacagacacuuggguuagagcugaaguaagagcuucccccagcccaggacuggagagaccagcccgugaggaaacaaacacaugcaacuuagcuuucaaacccaauacauccacaugaggggugggccagugaagucagagagaagcagcgugcucuccauugcugccagccccucacuccugaggcugggagagagcugggagucagguggaaaugagcccacccccagcaggcagcuccggucuuaccucugcaagcucuacuaugaagacaucuagaggugauuccuacuguugaaaagucaggaguguacacaccaggaacacucgcucacccauucagaguuggggaggcacucuaaguagaccaucacuccacagacuaaaaaaucaggauaggagauggggugccgugggggguugguugggaaaaugcucaauacacaagcacgaggacuuguguucaacuuccgugaaacucaugguuucaaaacaaaacaaaacaaaaacauuaaaaagcugagcaugaugguacuagcuugucaucucucggcuggggagaugaagauggggaugucuguggcuuggugguuagcgagagccauucucaaaacuuaggucauagcgccugaggaaugaaugcugagguuguccucuggccuccauaugcaccugcacacacacacacacacacacacacacacacacacacauacacacacagaggcacacacagacacacacacacauacacacacagaggcacacacagacacacagacacacacacacacacacacacacacacaugcacacacauccuuuacccuuuccucggagcaugguuagccguggcuccuucccaucccaccacuccaauuaggcaccuauuggcccgaucugaagcacaaaaccaacacugcccuguuaaaucuaaacugauccugggugagccagaaggguggagaguguauguaccagguuuaaacguucauuagccuguggaaaaauacugugagccgagaugaccgguggccuggauauuuggguaagugggcacaaacugguggcccuucuaacucuucauucccagcagguaccugagagaaaucagcuuucucucaggagacugcaggagcuugggucccaucuaucuagagcauuugugaggcuccaguaagacaguuaaugguuagguaaaacgcauauauaaagcuuuaauuaucuacacuaguacaaggauaaauuuguauauaauuacauauugguacauggauaauuauguccuggacuaauguaaucuauaccgaugcaaauauauaaacuuguucacagggguuaccuccgagugagaguuuuuguggguuacauuuuauuuucuuccuuuagauaacuuggcuuuagggucagcaagauggcucagcugguacaggcaaguacaggcaaucuggacuggcugagcucaguccccaggauuuauaugauggaaagaggaaaccaagucuugcaaguugcucucugaccucuacacuagugccauggugugugugugugccaugccauauauacuauaaguaccguauauacuguuaauaugaagaaacaaacaaacaaacaaguaaacauaaccugggccugcccuaaaugcuacaguagguaaaguugcuugcugucuggccugacagcuugaguuugaucccaacccauauggcggaaggagagacccaaccaucucugaccuccauaugcaggcuguggcucaccuuuuccuacucaccuagacacaucaaaaucugagcaugcgagggagccacgagagaacuggccuccagaggccauagcuuuccacuccaaccacacagcagaccccugcucccugcuguuugaaggugcgaugcaugaacuucagaugugcacaguaggcccaucugggcucacagugggcacuuccuacagcuagugcuuccugguaaggcaccaacauggagccuuuuuuuagccguaacacuucagaccauggcuagggagacagacuugaaccccuaguccagggaaagacuuuacucccuaaccuggaugggucuuugagcggguguacuuaacugaccugaguaguugaagucacagaccagugaggugaauccgcucuuaucccaagacaugugacagaccacuccugcuucccugaagcgcugggacuacccaccagugcccuugaucuucacaagccgccguucacuugggaaaaucacgggcacacggaaagccagggcaccggagacaccuccaagugcagaucaguucacaaagggacgcacgcgcgaggguggccugguggcccugaacacuuaagugauuuuguucccucuucccauuuccugugguacauuaacuuuuauugauagcucauagcuucaacaacuggucgugauuuuacuaaccugaagggcagagggaugagaggcgcccacacagccaaggugcuagggaaacauagcuuguccugucagucccuggguuuuuauuuuuccucucuugcuacaacuugucuuuaaugaggaaggcaccauaauugcaaguuaaucaugucucuggcccccaaagggaggaagggagaaacggccuuuuggaagucugacugcaguugccugcgggaggcccggagaagagcagcgaggcauugguggaauugcaagcucugauuuaugucccggcuggggagaguggcagcgggauuguggguauuuuccuaacacucauauuaaacaaauauuaagucgggagauaaaugagaaagcgaugcaauggaagccaguaagaucaauuuuugcuuggcugugaagaacuuaauacuuccagcuaggaggggccugugcauagauaugugcgcaugucacaugcguguguacauguucgugcauguguguguguguguguguguguguguguguaagcauguagacaccagaggagagccuugaguguuauucccacacucucucuaccuucuuuuuaccucugugaucggaugucucauugccuggcacuuacacagcagugcaaacccgcuggccagugaccucagggaguugccgaucuuccccuuugccaugcagugacuacacagggagaccuggcuuuuuccacauguuuucugaggacugaacucggggccuugugcuuccaagugccuagccccuccccugguucuagaauuugcauuuuggaacugcccgguauguuuuuccauucauugaugcugggaauuguuguuuguggaauagucucauguucguuauuuuuaacaaaucauuauuuuaaagggggaaaacaaacauaguguggcuugcugagcauguuuaacaggccacaguucaguucuucgcuuccacccuuggguuacaguccauccuaucugggaaguccuaggaaggagcuuggagcaguuggucacaugcacaguugagaacagagagagaaggcaugauugcuugcuucugcucagcucgauugcuccacucauaucguuuaggacccucugccuagggaaugguguuucccacaguaggcuggcucaucccacaucaguuaacuuaauuaagacaaccuuccaccagugugcucgugcaccaacccaagguagagaaucccccauugagacuuucugggaaggugagucuagguugucucaggcugaaacuuggaaguagcaaucaucaccaagcuuaauccauccucccuccauuuaugugcacaagucccuugggaaauagagauuugucuugccauuguauggcggggguugggggugagaggugagagggggaggaauaggagcccuuuguaaauugccugagcuucacuguuauaggggucgucggggacacccaggauguccaucagagucaccuuggcuuagagaguacaaagcccuagccgugguguugguuccuauuuucccuuuauuccaagcucuguuaaaaaacaaacaaacaaaacaaaacaaaaaagaaaaaaaaaacaauaacaacaaaacccagucauuugguaaggguacugugggcuacuuuacauugguuuggggggauggcaaagggauaaaaauuagaaaaggaaaaacaaaaguagaaaaaggccaggagaacacagacugucucccaaauuccauuccaaaacaucggcucaccaucaacguacacaguauuaagguuuaaggugcucgugccagcaagauggcucugcagguaacgcugccugacacugaaccuaauggguugcguuugauccuuacaaaccaaauggugaaaguggagaaucuagucccaaaaagcuauccucugacuuccaggucaugcuuaggagugcgcccaccugccuaccggcucacaaacaccaaauaacaucaauaaccaaaacccaagucauacuuagaaaaauuuagggugcuaggagcugggcauacagcucaguagggaaaguucuugcuaagaccugaauugcugaugaccugaauuugauccccagcaccuaaguuaaaaaaaaaaaaaaaaaagaaaagaaaucuaccaugggaguacacacuuacaagcccacuacagggaaggcagaaguaggaggagcuugggaauuguugacacacacacacacacacacacacacacacacacacacacacacacucauaagcacacuagaauguuuauccuaacucaguuuuaccaaauggaguuuggaacagucauccauccgcaaggcuuuguuuuguccauccaagacuggggaucuccuggugggacaugguguuugguuuuagacccuggggcaaggggcugaggugcauauuugauauaccaaagcagaccuggccuccugguucucccagcaucccucaguccuuuccuagaaauccaggaaagccccacccacaggugcucuagcccagucucacagacugcuucagcugggcccgcacacuucuucccccagauggucccacaaccuggacagcacugaagcaacagcucgcccucaccaagucuacaagaauugcucucggugcaacaaagaaccgauacaaccaucauuaacuuauuuauugguucgacaugucuggugaguauuugcuguguggaggacacaaagcugcacucccgggacaugaauaaaugggaccauccuggcuccugacucaauggagaucauaacugacagagugacucuuggguucuccucacgaaggugaaaggucaggagaagcagcgguagucucaagguaccauucuacaucaacaggagcagaugagcucuuugagaucagcuggggcgaaagaaggacccucugcccacaaaauacacaugggucaugaugcucuauauuaccucagaugauacuaggaggucuccggagcccuuagucaaugucuaagguucagaguugagaacucacggcuuagagauuccugagaaggaaagaaugugugguacccacagaagaacguuucuguggaucccacugucauaccuaaaauuacacaaaauaauaugcauccucuccuucuugcuaucuucucuagucuucccacccuuaucuccuauaccaggaugcucauuuuuuuuuuaaugaauggaaaaaaaagucaaaaucuacccaauucauuguuacuuuccuuaacugcuuacuacauauuaagucuuucagaaggcauuaaaauagcauucaggaagcgcucagaaccuggaguuaccaucuaaagaacaaaauauagaaauuacacacacaaaggcacacacacacaccuucaugcacgcacacacacacacacacacacacacaccuucauuuauucuuucacccauucauugauucacaaauauuuauuaaacauuuauuaugguggaacugacacauagcauauacucucauagaaacaauaaccuauuuuucaagaguauugaucaaaaucucuccucuaacaaagucuacacuugaggauaguaaagugauguuagaagccacuucaguucucacacuugaagcagaguuuaugcacuuguuaagaauuaccgauaaaaggccuaaaacucaauauauuuucuuuuggagucacccuaaauuuuugcucuuggacgggaggugacaagaccaaaguauauuacacacacaugcaugaagugcuaugauacaaccuguaacuuuauauaauucauauacuuauaaaaauagaauguaaaaccuucucuuaaaauugagagauaugugagcaacgggagcgauaggccaccacugucaggguauguuaugaaacccugaaguuuauuauaauuucucauuuaagccaggggaaaguaugauuugucagagaccuguuuuguguuagagaaauaccgucuuugcaaagcaaagaggaaacgcccuguguucucucacaugaaauggcuuuuuggacuuucuuccauugaaaauaauugucagaggcugggaaaguaccuguugcaauacccuaaggaccagaguucagaugcaggaccuguguaaaacaugggaugcaauggcccacaugugcacaggugcgccugcacauacaugcacaggcuuacauuuaccuauacagaacacacacacacacacacuccgugucuuuucuuugaaaccaauucaagaugacuauugauacuccgucugccccgucacauccucagaacacagcagaccaugaauaaugccuuuuugaguuuaauacuuuuaaaagccaacucaagcacagaaggcccuaaguuucaggaacccccauacccauugaugagcuagacuuacuaaggucacccuccuaaaauccaauguauugugacaaugacuaaaguuucaccaacaggaauuggcccucuggaauggguacuaaugauaaaauccccggcuuucacacauuccguuuuuaauuaauuuuuaauauuaaaaaaagagagagagaagcuuuucuuuuugcaccacaagacccacuucuuccuggugagguucccaaagguaugccugcucuuuucuggaaggcacgacucuacuaauuaauuagaaauugcaguuggggggaucagcagggggugaagaauggaauucacuccugccuccucuacuuccccucccuggcagcucccucgcagcucagccaagcaggagguuuagauuuggaaaacagagagaaaagugcuacccugcaaagcaggccuggccaccaggccugaacuuggugacacacaggaagagaaugggacucuucugccagggacauauacaugcauauacguauguauaaaauauuauauguggauggaaagaaagucagaacagcaggagcauaccuagaauaacacccacuccguccauugcugccucucgucaggcuucuggcucacagguccuuacaguuugcaguuaacaggugcuccccagcaccauaugcguucacgcaaaugaggaaauuacagaauagguauuuuucuccagaguuaaaaaaaaaaaaagcaagaaaggccauaauaauggauucaugucuacaacuuauucuguuuugcauguguucuauaagguggacacacaguucuuguccccccccucucucucucuccuuuuuccuuucuuuccccuuccuccucuuuucugucucucucuaugcuguauuuaauacauuugaaaagcuuaggugaaaaauauccuguugucaggaccuuaagauuccauacuuuucaaauggguaggugauuggacgugugaauuuaaauuaauucugggcccaggggcuucgcucaguggcagagcacuugccuagugcugcccuggguucaaucccagaaaccaaaaacacacaaauaaagugcuaaacaaacacagacucuucuaacugggugauuagcaaggagucagaguuuuaguaaaauuucacaacguucagggcagaagccuguggugguaugaacuagagauucucucugcucaggcacuuuguagggaguggaaugacuggauggucaagguuaggcuaagaacucugacugagaggcgccagcccucugagagucagcagguaaggcagugaaagugaagaaccuuccagaacaagucuuaaccccaugaagacuuaucagaaaguugcuuaagaaauguaucaggaaugaggcugccaaucaaaccauggaggaagagauggacuuuaggcuagauuggagcgagcacuucuuaccuuuuuauagcaugaaugcucgccagugcauaaccuuugcuggggucuuggugcaaacugucaucucaguucucaauuuccauaguuauguuuuuuuaacaaucaagaauuuuucaaauguguaucuauuuuuuuucccuuaauuucuuugucguuuucuuuggccacuguguuucugugggaggaauccuacuucucccuuuaauuuguacaaauucuguauauuuuggagcaaauuauuuaaugugugcuguguauguacuugagcauguacacacacacacacacacacauacacagacacacacacacacauccuauucaauuucauaacauacuaaacuugaaaacaagauuaaauuauacacugguuuaccacaguuauccgaaagagauugaccuuauuucuauuuuacuauaaaaucacuguaacuucuuauauuggcugcuacuuuucucaucacugugacugaauaacugacgauaagcaauuuaagggagggagggcuacucuagcccaccgugugagggugcagcccaucuugguggaaaaggcaggcuauggcagaaguaugagaaggcagcucucaugcuacacuguuuguauucacucuagaccccagccuauaggaugcugcuacgcacauuuagggcgggucuuuuccccuugauugauccaaccuagaaauaaccucagggugagauuuguauccaaggugacucuaggucucaucaacuugaggauacagugucaucugcccuggaaaccucuuuuagccccucucccauuaacugaaccagggcggcuguaagccuugguguugggaccucugccuuagcacagacugaccagggcaaagaccuggaggaacaguguugaaggaacagucaugcuugagacacacaugguguaaaagcuuacccacaggaugcaaguguccucuaggaggcucacugcugaacaagcucacccuuucuaguucuuccugaacccuagauggcugguucaacuccgcuguucuggcucaaacuccccucuaagcugacugauucaaccugacuucucuaggcuuucucgcugaauugcucugcuuggccucauacuaacucuggcaauuuauucuaaccuucuagcuccuuacucucugacuacaacggccucugcugacccgcacuggacugccugagcucaugaauggacucagcuccaccgcacucacugcacugacucgcucugccuggcucuuaaguugcuucccccuuucucucuguuccccugagaguugggcguguccaacguuucaaacauggcuaauuuuaccuuaaagaugcgugcugagggcgugucugcauuccagcaggaccacacagaccuacccuugccagagcagucacuuugcuggauuaaaauuccucuacacaggaagagggaaacugaggcagaagagggaagcaauaguuuccucccaucuauccaccgacacacaagaguucauuuaaccuuggcaaugacccugagaggaucucuguacacuccacauggggaggacugcauauauuccccaugguuaacuuagucuauacugagacucugacagguguagcuucacauaggaagguaacguaaacaucacuccuagugccuggggggaauuuucuugcucggcagauuuacaaauuggaauugaucuuccuucaaccuguuuugccaaaguuucuaugaagggaaccagcaagagaugggugccuuucauaucaccugugauuaaacuugccgcauuugucuucaaacaaaaguguuuuuuuuccccugcccguaacauauaauuuuagucagcuaacacuaaauuagacacccacucagauuuauuaugauaagaacauucaguaagcuaauuucaagaugaugacuccuauaaauucuuauaauuuauuauuuaguacuuugguuuuuaaucauuaaguacgugaagacuuuguaggucaaaccuguauuaaugaagacaguaaucuauuuuucaaacucugcuucucauccaccuuucaaauuguaaauuaacagaaauagauuuaaacacacuuguaagaacaaaggcaauaauugggggaguaggggcccaucacccccaauugucuaaucuuucuagguaggcugucaaucauggcccugauuuauuuaccgcgugucucauuccuuucuaaaugaaauaauggaguaugaauuugagacgcuguuaguucagugaggaaauaaaacccauaacgcacauuuaaggcuuaauuuuaacaaaaguggcucaaaaauuagcugccgcuacagugagugucuuaacacagccaacacuguuuuauaauuugagagauccacauaccagaaguaaaauauuaacuaaauaaaugccuuacaagcuauuaauaccaucuaaaugacagccuucuuggucucccaaauucauuaguauccauuucaugaucauuuuaaauauuugguguuaaaagacacacaggauuuauuuuguagaacaaagggaugcuaguugauugacugcacagauaauaaauacuguuuccugagcagcaacgucuccucauuuucucuaaaauaagccaauuuuccuuaugauguacucuaaguuccucgugagcaauuugaaagaguaaggagaauaauguucacugugaugguuuuauuuagaaaaaaaaucaacaaauuaaguaucaaagucauagacugcugagaaaaaucuggacugaaaucuagugaaauaaaaauaaagauuauucauuuucucucucucucucucucucucucucucucucucucucucucucuccccucccucccuucuuccucaccgcccccccccccagcucucauauagcucaagcugcccuccuuugcagcugagggugaccuugaacuugugaaucuccuauuacccaguccugaguuuacaggcucccaacaccauaccugguuuaugucaugcuggauagggggugaagccagggcuuuacgaaugcuaggcagauauuuuaccuacugaacuauguccccagucccauuuuugagacagaggaaugcuauguaguccagguugaccuugaacucauggcagcucuccugccucagcucucaggugacuggguuacaagucuggaccacugcaccugcccugucuuuucuuucuuucuuucuuucuuucuuucuuucuuucuuucuuucuuucuuucuuucuuucuuucucucucucucucucucucucucucucucucucucucucucucucucucucccucccucccucccucccucccucccucucucucacucucucuuucuuucuuucuuucuuuuuuuuuucuagacaggguuucucuguauagccuuggcuguccuggaacucauucuguagaccaggauggccucgaacucagaaauucaucuuccucugccucccaaguacuaggauuagugcgccaccaaugccaggcgucuuuuucuuuuuaacacagcauuuuggaaauucuuucagaaauaaaaaagaauguguguguguguccauaauaucgaaauuuuuaaguuauguuaguuucugacuucuauaugauagucuccaucguaccugaagauuuauugcugauggauucucuauucaauuaugauaccaaggacagcuugugguaucucuuggcucacugaaaaccucccuggaccagagguacauccuuaaaagcuuagcuuccuaacagggagccaacuacaucacuaccaugcuauggggcaccuauuaaauuagguuuuucuuccucuguaccuaucaaaggaaagguagaauuuccaaggaucucagauaagaaucucugaugagaaaaauauacaaagauucugccucguggucaagggaauccaugaaaaauggagacuaacuguauuguugagugguuguuuuguuuuguuuuguuuuuuguuuuguuuuaacuggacaacaccuagaaucacaagguagaugggccucugggcuuuacuguugggcgcugucuggaguauguuauugaggugggaagacccacccaccuugugugcugucauucucuggcugggauccaggacugcauaaggacuguguggggacaauggaggaagggagcuaagcaggagguggccuucccugcccugcuuccugcuuacagauucagcacagucagccagccuccugcucuugcugcugugccuccccuaccugccuacauguuuuccacauucauacagacuguauuccucugaauguaagcaaaaauaaaucuucucuaaccuaaauugcuuugccugacauuuuaucccagcaacgggaaaaguaaguacgacaccaggcaggaggcacauaaccaaucaaguuauagaacauccguucaaacucgaauucuggauuuuaaaugcuuauaacuaaaauaaaugcugaaucacaaugaaaucuucagauaccauugaccauguauuuguaacugugugugugugggggggugcuuugaauacuaauggauugguuaaucucauuucacagaggagaaagccaaggcacaacaucguuaauuaccuguuauguucagcuaguugauuccucacagagccaggauacgaauaucaguucguuagauuucuaguguccuuucuccauaaaacaaauaaucuggccuggagagauacucaguggcucagugcuuaagagcaccagcugaucuugcagaggaccaggguuucuagucacagcaccuacauggggacuugcgucuguaacuccagguucaggagaucugacacccucuucuggccuuugaaagcaccagguaugcacauggagcacauacaugcauacauacauacauacauacauacauacauacauacaggcaaacauaaacauaaaauuaaaaauauugccaccacuaaacaccuuuuuuuaaaaagugaaagugguaagaggacuuaaugauuuguaaaagucucauccacaaauguauaaauauuaaagucaaguguuagaugaaaguauuauggggguccuacaugcacccucauucuaagcaagauuuguuuuguuguugauagguaagguuuuguuguuguuuugagauagagucucuguccuggaacucaguacacuacacuagguggcagcggcagugguggcugcugcugcugcugcuucuccuucucccucuucuuccucuucuuccucuucuucuugucuccccuuccuccuccuuuuugcuuuggguuuucugggacaggguuucacuguauaauagaacccuagcuguccuggaacucacuuuguagacuaggcuggccuugaacucacagcgauccaccugccucugucucgccagugcugggauuaaaggugugcaauaccauacccagcaucaccaggcuggucccaacuucacagaggucugcaggccuuugccucagaccuugaaucaaaggugugagcugccaccccuggcucauuuuaauuguaaaugucuugcacugugggcagucuagauagcccacuuuaguguugguaacauacuacaccaaaacuuagcccuucaaaagggugaccagaguuuacacaauuuggguggguuaggaacugaggggcagcuuaaaugacaauuuggcuugggacucccuuuaagucaagagguuucaucuguagccacgcacgagccuaacuaacuaaggcuggaagacagacuuccaagauggcacacuaacacagggacugucucaguuacuuuucugguuauugcgagaaaaaauaucugacagaagcaacuuaggaaaggaaggguuugcuuugcccuacuggucaagagcacagcucgucgugaugaggaaggucgugguggcaggagugcaggcagccgaucaucacaucaugguugcagucaggagguggagagggcugaaugcugcacucagcucucucugcuuugucuuuagucugggaccuccacugcauagaaugaugcccccccccccccccccgccuuagguagauccuccaaccucagucaaccuaaucuaggaacucccucccaagcccagaggucugcaucucuugugacucuagaucauaucaaauugucaaucguccuuaucaguggacaagcuucaguuguuggcuagaggucuguguccuugacacauggacuuccauuugguacugcuugaagcuccucacagugugguauauagucuuccuaaaaacaagaaagcugagagaaaaggcaaacaucucaagcucuugucaaucaaucucagaugccacauucugucacuccagugucaguuaccaaggucuugucuguucagaguacacggagaccacucuacugcaugaaacccaguagguaaggguuacagaguccaccucagucagcaguuggugacugugccacaucccccccuugucuagacaacccuaggcucuuaaguauuuagagguauaccccaacauuucaauagugaaacguagucaaaucugguaacaugggagaaugaagagucaucuugaggagacucaugucuugcccauacccuuccuuagguauauaggcagaaggguggccaaacuggggagcugaauggcuguugaugagugagcauacagaagugcccuucaagggccauggagcaaauccuaaaacagauucaacuaugcuguccuuccuccuguagccaagcuuauuacagugcagucaguagccacacacccaucuccaacaggaggauacugguuuuaugagcaaagcccucucggccccuuugcuacuaaguagaaacaaaaucauggacagcugaccacgagcugcagaaaccucucuucgaggacaaagacugcgcugaacaaaugcguugggucauuaaggaaacagggacucggaggagauaggaagcguagggguguucuuugucuaacuccugucuauuuugggaaacucuucuaugggauuaagaacgggugguucaaccucaucauuaccguauugguaggaguugagcaggcugaucuaggcuucacuuucugcuucggggucagccuuaggcaaaucuguuaauuaggcuaaauuuggccugcucagauucucuccugcuucccucuucugcagggcacccuccucccuccuuacaccaggccaggcucccuacacccuuaggcaacaccagauaaaggucucuccaauccccaguguuuaugugcuccacaucuacagaacuccguuucugccuuggcaagggcugaugaagacaggcagccucauccugacaugggcucuuccugaaggcacugguccagucaaaugacccacuucaacacucaggaaccacacuucaucugguuagauggacaagggaugguaggaggaggcucgcagcccuuggugguuuucucagaaaucaugucaaugacuaaaagcuaaaucauugagaguucauuuuguagaguuagggaguucauuauuucccgguuguugauucuguauuuguuagcguuugcuaugcacgaaagcucuacagaauucaguggguaagaacagcaaccuuccccccucuccugaccccaguuuguuuauuuaugacuauacaaagagcagggacuccuucuugagcgcaggcagucuugguuggucucugcuguuagcuuaguaaugauuggcugcucaaugauucuagaaugaucuucucauauauagggggucagcaagcucccaguucagacaacaaggccuccuuaauguggccugucauccuuuauccagacaugaucuuagaguggccucaggaugguaggcuacaagagagagguccagguucuagccauuuucugggaacacagauuuuauuaagauuccauuggccagugcgauccacaaggugagccuacuuuaccuggugaggaaaugggcuucuccucuuauuguaggcagggugcgaagcagugggcagaccuguguugcuucuuuccugguuuguaacauacugucauuuuuacaguuugucaaauaucucccaagucugauaaucauauuccccucucuaccccaccucucuuucucucucccucccucuuucuuucuccgcccccuccccaccccauguguguguguguguguguguguguuuguuuugaugcaucuaucuguguggguauauguacucucucucucuguguaucucucucucuguaucucucucugucuuucugucugucucucccucccccccccacucuguguguguguguguguguguguguguguguguguguguguguguguugaugcaucuaucucuguggucacacguggagguagagagucaugccugagguacuguccucugaggguuuuuuuuguuguuguuguuguuguuuuuguuuuguuuuguuuuguuuuuuugagacagagcuucuaugccuuuaaccccagcacuugggaggaagagguggguggauuucugaguucaaggccagccuggucuacagagugaguuccaggacagccagggcuacagagagaaacccugucucaaaaaaccaagagagagagagagagagagagagagagagagagagagcgcuucucacuagagcucauccauccggugaggucagcccacgaggccagugagccccagagaucugccugucucuaccacuccagcacugggcuuauaaguguucacuaccacacacacauauucgaugugucucuggggauggaacucaggaccucaugcuagcagggcaagcacugacugaggcaucuccccagcuuaguauugccuaucaagucugagucuucuccacacugucaugcuuccccaucuacacaauguagaccgcuaccucagaacucauuuguacuugacuagaauccucauuccccaagaauuauuuuagcggggaaaacugguugcacagacccauuugccuggcacgggggaagacguggcacaggcucauuaaaaugcaaguguaaaaucuggcucggcucaugucuucacugcccagauaggccaguuuaucaugcugccucuccauuucacacggcccaguuaaauuugugcaggaccacacaucucaaccuccccuguuuugucauuaaaaaugagugucuggaagggcuuccuuccgggaauauuaguuaccuuguccauuacuuacuuaaucauagcugggaguuauuuuuugccuuguggaggcugacuauaaauuauaggcuacagugcaguaaagccacacuuagcaaauuauauggcaugggggaaaacccuugcuuugggggacaaauuauauauuucuuuaaaaauauguuugguaaaauauuagaugagggccaauaaaacaaaauccaggagcauauuuuugcggccuuccaggcauauuugacaacugacucagauggagucccuguuuguaacggggagagggaaagaaagauccuguuggaauuccugucacucuuugagguuccacacguggaagauaugaggaaaacgggacaccuuguugguucaugccuaugacuuaggagauaaauuagucauacugccuuauaucugauucuggaaacucacuggagacuaacaggauagcaaggcacaauuuucucauaguuagggaagaauccuacugugguuagaaagagaaguacauagaaauaccuuaaguauugauuuuuuuuuuaaagauuuauuuauuuauuacauguaaguacacuguagcugucuucagaugcaccagaagagggcaucagaucucauuacagaugguuuugagccacuaugugguugcugggauuugaacucaggaccucggaagagcagucagugcacuuaacugcugaacuaucucucuagccccugauagcccaggaacaaagggcacuucacuagaaggugacaaugcuccuuuaggaacaggaaugaaagcuuuccuauuuuucuauagcucgaaagcugcaugugcuugccuguagacaagcucuggacugaccgaggcagucaguguuccagcuccauaaaccaguguuucuagagaucccaagggucacccaccauuagcucuggccuuggcagcccauggucugucccugggaaccggcuugaggucagucaucccaugaguacacaugguugggcuguuaacaaugucccaaccaacuugggggcaggagagauuggagagauccacacaagacuagcucugagguucuuggguuaaucuuguaaaguagccaguugucuggcucaaaaaguccaccauuuuuuucuuuuuuuaauaaaauguauguuuuaauuugaagauauuaauugcguaggaauuauuugacucuaugauuuauagcccagcuggaaucccacggucuucccccuccaugugugcugacgccauuuucccuuuuguauaccuaucauuccccauuguuuaucuucccugauugauguucgggcucgggauguuuucuauuaugagauucauaauuaucccugguaauagagaaggcuucccuauuaucuucagggaaccugcccaaauuauucauuguagcccacugguacugcaccguaggaaaauaagaauuuauuucccaucccaggcauaugguagauaaaaggauguauuuauuucuccauguuucaaaaggauuaggcuuugaaaaaauaaauaucacuuacgcugucaguaagcagaacugugguucagaguuuagagggccccucuuagacuaagaauagcaaaucuaacucucucucucucucucuguauguauauauauauauauauauauauauauauauauauauauauaugaaagaggagaguaaggaggcagggaaucaauuauagcuuuacuuggcuaaauaaaugaacgcuauauauuucaaccauuauauuggucuacaaggcauccaguaccaccuuggaccucagaguuaacuaacgcacuuauuuauaaaaauguuacugaauuccggcgcuccuugaccccuggcuauuccgggagcacauuggauacaucaucuggguuuugccuaauuacacauaauuaggaaauguaauuaugcuucucaguguugcucugccauuaagaaccgaguggacagcugaaacccuggggaggagucagugcuuccaagaaaacaaacgaaaacuaugagccaaccucuaaaaauagggaaugcacugaagguuaguaaaucaaaccuagauauaaaaauaauaauaauaaaaaauugcucuuggcucuggcuaaauauuuggugguaugguuaagccacuucauggugugcuguuucagccaugcugaggcaggggcauggaaugaauuauuuuacuccucaauuacuuugauuugcuaacguccucacauauuuaugcucuuuuuuuuuuuuuuaaaugccucauccuuuacuuuggaacccugaucugcugaagaaagagagucccaguuauccuggcaaagaauuauaucauuucagucgugagcuugcugcauccauagacaguuagugccugaagcuuaggcacauugaacaguuaugucaucuccuccagcuggagagccucagcccuguggggaagaccggugguucuucaggucagcacaguggucacaaucauccugaaugugccccaagaccuggcugaauaccuacugucaccaggcucugaauaggguggcuucuuaguacaaaaaguuagaauuuccugggugacuagagaaucuucuagaaagguuauuauacauaacuucuggagugggaaguccuucuauguucucgucuuagcuucuguguuuauugaauuuuccucugcuguuauagcagcugacagcaauaaagucgcacacuccauuagaugugcuauuuguggaaacagugcuuuggugccaaaaaggaaaaaaaaaauaauaagaggagaaaugauugccaaaagcaaggucucaaaaauaagugcaauguuagcagcgcucacgauacauccagcuugguaacacaccgcuucuuggucucgccaguccugacaugugugagcguggguguguauguguuuacauuugugugugcacauguguguacacaugcaugucuguacauaagguuuucuuucccauaugucuuuuaauaguuuuuuuuuccucccaugggccuggagagagaaucagccauugagaguauuucccagucuccccgaggaacugaguucaaaucauagcacccauguugggcagcucacagcuccaggggaucuggcauucccuucugguuucugugugcauucacacacaugugagauacacucacacaaacacacacuuuagcuccagaaagaaaucuuuaaaacacucacuuuaaaaugcuuuuugaaucuacuuauuucuuucacaguuuuguggguguacaauguacucugaucaccccuaguauccucuuauguguccuuccuccguccucugauccucaagcucuucuccugcugcacaccuguuuuucuguuuucuuuucauucuuuuuuuuuugugugugugugugugauccaaggaauuuaucgaggguuaauagauagcaugaguauggggaauggagaguuauugauaaaauaacuauuugaaaaagaaugucuaguuguuuuuauugggguuuuggagugaaauuagugaauaacauaauccacuaugcauauaacuaaccaaaaauugauuaaaaaaaaaagucugaaguauaaaauaaacagaaaaaaaaaaaaaaaaaaaaaggaaccggaacaucauagugaagccacuauuuggagaucaagaauagacagagccauccuuagggguaauauuugccacuuuccaugguguuaucaaugcaucucuggacgcagauuugaggagcauaggaagaaccuguucuccuggguguugagggcagcuagagggugcaagugcucaccaauggugaauacaguaagucuugaaacauacaagucacacgucaucaaggcucaaauuguugugaaccucccaagaugccuccuaaguguuggcauuuuggacauacacaguacaaucuuccccuuguuuagaaaguguuugcauuucugggagacuugagacacauuguguuucugugugaagaauagugaauucagaguuaaagccuuaccagcuggcauacaugccccguggcccagggguguguucucaguuuccgggcagcuguguuguauugagacacuggacagagcuguagacaucaucuacuaaauguccagaggcuccagcaugcaucuacaccguuccaaaaugccucuagacagcaauagugacucuguugaggacuguaaagguuuugacuuaagagugaguucucagucccaugacucuggugucgcuuuggggcucuguguaugagacacagaauccugaaacacuugaaccagaauuugcacuuagcaagauaucaugggcuaggugaauugaagguccaucauagaugagcaaaccccagauaagauggugaacaucaauaaugaccagcaggaaucuucccuagugucuguacgaaugauguaggagaaaccaugggcuccacugagacuuuaauagacuucugguaacagugauggcaugcuggaaggacccugcccucauccuuccuuauagaaggacuuccaugaccaccacuuacacaguuauugaaucuuccaccacaguucuagugaauccuuacucuaugcuauacuuuguaccagcuuuccccaaaucagggcacaauugcccuucagaauuggaccgaccaugagacaaacaacacaggaagagugccaggcuuucgcucagugccucagaguuaggagugugcacugucgggguucaugaucauaccuguuuugauuaaaaauaacugaagcaagagacuaaagagauggcuaaguggguaaagcacuuguuggacaagcaugacgauccgaguucaggucccccagaaucuacaccaagccaguucaguugugucagugauuugacacuauuaugaugagaugggaggcagagacagaauaccugguagcuuaugaaucagcuaaucugacauaugugauugugggaaacaaaacaaaacaaaacaaaacaaacaucguaugucaaacagguagaaggugaggccugacacccaauccaauauguccucuaaguuccacaugcaugaauggcacuuguccuguagacagaugaacagacagacagauagacacacacacacacacacacacacacacacacacacacacacuuuuaaaaaaaguuuauaaaagagcuaugcacagcagugcauaccuguaaucuuaaugcuuaagagaugggauacuagaagauuagaaauucuaggccagccucagccacuuaagaaauuugaggccagccugagcuacacaagaucuugcaucacaaauauucuucuaugagaacccagugaaggcgaaacugaaaggcacgggguucuuuucaccuuacacugaugacuacucagacuuacacacagccuugugugcgugaacccuauucacaugcagcaacucaucugacccuucacguacgugcccuucugaaaggggagugaggaccacacagggaauagaagagaggccccauuacaaagugguuaucucaguuucuuuuacuguugcugucaucaaaauaacguaacaaaggcaacuuaagggggcaggguuuauucuggcucaggagguacagccugucauggcagggaggucgauggggcaggaacaugaagcagcuggucacauggcauccacaguuagggacagagugaugaaugaaugcaagcuucugcguggcucccucucuccacauauacagaccaggaggccagccagggaauggugccacccacaguggguggucuucccacuguaaucauuguaaucaaggcaguucucuguaggcauguccugagaaccaucuggcagcugguuccagguucugucaaguugacaguggugauuuuucacauugguaauaacaaaaggggaaugaaggggcuucugguuuugucugcguugauuagugcuuggaccucagagguccuuccgcagcuccuaggacacuuggagaaaggaucuccacagcauggugagaggugcuggcaucagggauuccaauguaucuccuagcucauucuucuguaucugcaaugcagauacaguguuuuccuugguaugaauauaucacuggggcacagacucuggcucaggccugucuccaggguaaacuacuccaccccucccccacuucucacaagugcaagaacuaggagaaauuaaaaauaagaaaaucaacaugcccugacuaucugggcugccguuccauuaacaaccauaagcaauauuuauugcagaaucuucacaccuauuagcacgaggaggggaaaauaaggucacggcuuugcacauaaaacacauccauucuugguccacagugaucacaagggcuccuggccagggggccucguuguucucuuuccaucugaaucaaggccaagguaacaacgggcuuccgcguggccuucugaccauucuaagaacggucagagguuggcuacugcccagcauguagguauaacuacacuuuaaagccuuugcauuuuguaaucugcaaaugagguagagguggcaagagagaagauauaugcuguacaccauugaaauguucuuggcauuuuguuuuguuuuguuuugcuuugcuucuccaaauguccaacaauuguuuguguuuuaauuaugcucuugguguagaaguaccuacacgcacagauucaugggcaguuguaagaaauaaugccgugaucccacauacacuugacccaugugcccuaaugguaaggacaugucacaguagggacacuggcaguggcugucaagaugcagagcauuucuggaggccccaggacuccucaguugcccucuguagccaccuugccccccugacaccacccuccucccagcuacuggccacugcugaucuaguguccauuuguauaauuuugacauuuccagaauguuauguaaaugaauccuacaguguaucacccauggggauuggcuuuucccacuagcuuuuccaguuuuuuuuccuucaaaagucaauuuuccuccccugccaagugugugugugugugugugugugugugugugucugugugugugcaagcuucaccauucuaagacucaaauacacacagaagaaggcagacggccugugcagagcucuguguuccacuuugccagucuuccuccaaaugacaagucggcaccaugaagagagacuucuggacucacacagaaugaccuucacucucgugaguucuguacucagggguugccaugauagcuugauaagucaguauguaccugccuugcaaccacaaacaccugagcuugagccccauagaaccuauguaaaggcccgaggcaugguggcuuacgcuugccaucccagagcuggggaagcagagauggacagauauccaggauucacugaucagcuagccuagccugcuuggugagcaccaauguggccaaagaccugucucgaaaagcgaggugaaugguaugugaggaaugauagcugagacugaccucuggccuagacauauacacaugcauauacacauacacacauacacacacacacacacacacacacacacacacacauacacauacagacauacacacacauacacauauauauauacacacacauacacacacagacauacauauauacauacacacacagacauauacacauacauacacacacguagacacacagacauacacacacauacacacucagacauacacacacauacauacacauacacacacacacacacacacacacagagacagagacagagaaacagacacacacaccugcacucauauacccuuacauauuacaaaguaaaagaaauauuuugucugugcucagagcuggucaaagacauggugucuucaucaguaacaucagcuuucauagccuaauuuuuauagauauccuaugcaaggugauuacgaaaauuaaguuagauaaagucuucuaacagcauacucaucuauaauaaauauugauaggugguaccuauuauugcuacagauaaaccauguugaaauaauaaauauuaauugaccuuucgggaguuuacuuugguuaggaaucaaucauucucaauacaugauacagagucuggcaaugcuuucugguuagcuugucuguguucgaucuccaauccugcauugcugggggggggggagagaaaaagaaagaaagagaaugccuuggcucugagaagcauucaggcuuugagugaugucaaaggccuuugaacaagcuuuagaaaugacauccguauuuguccauuuuuuuuuuauuuugacuuaaauugcuuuugguucaacugcugcagugaauugacuugacgcaauaucauacagggugacacaaaacccggaggaaggagccggcggcuggcaaggacugggaaauggaggggucacagccucgcucuccucccuaagugugggaagaaaugaacaugaaguucacggugaaagguaaucucuaugaaccgugauaagagcaagcgagcgagcgagcagcauuuuacacagcugaagccugccgcuucagccucgagguuauaauaaaaagccauuuacauacagccgaccacuuuuuaagcuuccuacguugcuauuucccccccccccucauucuucugccugcuuccuuccuaggcagccaagugcaacgugaacuccuagaauguccugcuaauagaaccugggcucugauuucuagggaacaaaacgcagaaguggccucucugugcccacauccagccuccgcucgccucaucucucccacugucuuucccuccacuuucuuucucacaucucuuugcccagaccccuaucuugcuuggggagagcaagucgacaguucuuggccaaguucucuggugagggguucgagacacacauccaaagauguguagaauaacaaagcugaucugauuugaggucagagagcugaaguacugacccccaucucugucuugagccuccugaccucuggcaggcuguacuggggucuaugugaguugcuuuguccaccuccagaugcugagagaaccucaacuugaaggcagcugugaggagaaacgaaggacuacaguuaccaaucccagggcgucgucagcuugcuguuauguuuaugacuuuuuuucuuuuuuggaaacuuuuuacaaaaacuuuauuugugaucuaauuucuuuauaaaaguacauuacauaguauugcaaauagagacgcagaaacacuucuaccuaaucaucuauuucacuccaugacuaaccuccuuucuuaauacaaagacaaaaccuuuucuuuuuuucuugcuuugacagggcaacagcuguaaguuuaucuuaauagaauaugcucaugaguccuugucuggaaaacaggcuuccuaucgguugggcuuagaagcuauuauguuuaaaugggaaacauccauuuaacaaacaggcuccuggguucaaacccuuauuuccuagaugggggcauggcuucaggaaguuguggacaguuuaguagguggagccugaguaacuaagccuuugaagggacaacccacaggucuaugcuggcugcuucguggugguagacuuguagcugagacucugcuacaagucccuuccacaggggagguucccaccaccaugccucccccaccaugauggacugaagucuccugaaacaggaagccaaaaauacaccuuccacuucuuauuucuaucagagaguuggucacggcaaccagagaugcaacuaauacagaugcaaacaacauaacgugacugaugaaacgugacagcaggcugagguguggggguauugccaucucauuaagacgguggguaaugucacuccccugggucccuagugccaggucuaugggugcauaagcuuaaaaagaaaaccuuaucccugggaaaaaccauaguccagauccuagggagacccucccaccucuggcucuugcaaauggaacacaggauuuuaaccugacauaggucccccaaagccacaccugugcacuuuacagggggccuucccugcgauccacacccuuaugcuauaagucuuugcaaagguaaaguaauguagguguuaaaacaggcuauauauauauacuauaucugauauauauauauauauauauguauauacacacacacacacacauauauauauauauauauauauauauauauauauauauauauauauauacuauaucugcucccgugcaacccacugccacagagaagaggcuaggcagcauauauagauuucuucccuuucguguguacacacaaggucacuuucuccaugaaucaauagcgcaaucugaauacacaauuuucgugucacuguguauuuuggaguugauauacaucgaagagaacaagaauaacaaggcuuugaagaagugucagcucagacgggagaagaacuuucuauuuucuuacuggucucaacugaggacacacaggugaggaaccuauuuauguaaagugucagaaaugaacaacguagacauugcauuacaguuucggucuggccccuuuucuuaucaaaugaagucugggaaguuuuuacgaucauguuugcuaaaugcauuuuagccaaguguuccuuuuuaagcccucuucagcccacuagccgaguuuacaguaugagcagacuggagaaggcagaguucugcagcugcucugugcucucacgcaagugacucugcaucucuguucccuccaggcagagcugccgcgacgacgaguccagucaauaguacugauuucaggucuuggguuagcauuacauuguaagguuucacagagcuuagcauaauucugcuuucucuuuaacacacaacugaccuauaaauaugcucaaggcacuguguauggauauuuaucuuuaguguuguuuguuuguuuguuuguuuguuuuaauccauuguaaggcaagaugucauacagagcaggccagccucaaacucccuacacagcugagguuaacuucgaaccucugaucuucuugacucuacuuucccaguucuagcauuacaggugugugccaccgggcccuaaguuugggcagugcugagaucagccugaacucaggccuccacacauguuaggcaaguauucuaccgacugugcuuacaauuagccgugcugcuuaccacccuaagaugauguggcuguaaaccguguguaggcuuuaaaagggucuauucaugaccaggugauuuugccugugaguuagagugccaagcaaaugaauuaaaguugcagaauaaaaauguuagcaacgaaacuuaacugguaugcuggccuuugcuuucuaggcagggagacaggaguaugauuuaaaaaacaaaacaaaacaaacaaacaacaacaacaaaaaccaguggcccaguguacaauaaaaaaccuucaaccuacccuggagaaaccauccuuuaauuggcuggaaauaaaguuugcaccacauuuaaccucgugucugguucacuguugguccucaaaacacgugaggugcuguuauaauugucuccacugaugagagacacaugccugguuaugauaaacagccacuguuguuagaguagagcugugaucaccucagacacauauuuccaguaagaacugcggcccuggucaagcaagccugauaaucugacguaugcaaacccucggcuucauacuccucuugauccucacacccuaauaucugcaucuauaaauuccuucuggaaaagacaaacagacuaagaagccaguggaaauguucguaacagaaagaaagaaaaaagaaaaagaaagugaaaaaaaaaaggaaggauuucuggaagccagccuccaucagggcugugcuucugaacccgggacaaagagggucucccauuuugacucugccaucucguccugcuagcugccuccucaucuuguuuaccgaccucccgaguauacauuucucucauuuacuauguuuccuuggacagcaaccuauguaccucucaauaaauuuugguuuacccaggagcugacgggcacagaaaccuagauucaauuugugccgauuuaugagacacgggcacaacgaucguggaaaguuucccgggcuucacuuuauaaauuaaccccuuauuuaaauauucugccgacuuagcacggggccagugcuggacggggacuccgucccucaucagcuuugcuggcuggccuccuggcauuuguuacaggagugcacggacccuucagcacaaacaaugcagaugcgcaagauuuaugacaagcugggaaggcccacacgcuguuguuaugcaggccacagcaagagccaacugagugggcuucgcacugcugggucccaagccuccggaagccgcauuuggggugccugugugagcaguuuugaaucaacugauagcuucagucauucucuugacugaaauacugugguacacuuugggcuugccugcacucauuugcagaggucguugguacugugccgguggccacgggcacccggguaccccuguggaccgugggggcuacucaaaacgaagaauaaaacucagauugucuuccaagaaugccacagccuuaagacuguauagcaaauuaaagucuugcuguggcauuuacauucacguacgcaccuguauagaauacaauuuucaccaccagaaacuuuaaauaugaaucuuggaggcugaggaagcccaagugaagggguacagagagucucaaggaacauguagcuuguauaugaggcaaacaggcccagcgagaggaagugacuuccagagacaaggggcuggcacucagugagccaggauccccagcuucuggguccugggugacucaugcccucuggauagcgagauagccugugguaacugcagagccugggugaagcucuccuuucucucacaaacucaugaccccuauccuuccuguucuucuccuccuaccaggauggggugguuucaacagcaucauuagaguccuugcaaagaacaguuuccagauugauuuaaacauauuugcaaugauugcggggggggggggagggggcuggggggggcuguuugauaaauaauugaauagauuuuugaacuguuggcugcagggggugaggaggcagccggcugaggaggaaaaagggaugcuucgagagcgacaggggcagucauuuacaguggcaaggagguaagggacucugugacucccagggggccugaguggcucagauguucccuccaaucccagcugaugcucucuugcuuggccaaaucgaccugaacagcccagaaggcucugcggccgcaccugucagccccaauccgcgcuacagaaauuuuguuaggaaaauagauguaccaagauucaauuuuucgauugucugaaggcuuaauuuagugaccuuggaaaaugucucuuggaggugaaggaaggagcugagagaguacuggggagggcgugugggaaggacagggcuucccugguaauggauaauuuauuuacacuuaauuuucaggccucugggggaagccaugaaaauagucauauagcuacuaucuuccuuucaaaagcagaauggggagcuauaugagaaagagagagaagagaaagggggauauagagagaaaaaggaauagagugagagagagaggagaugggagggacuagagguagauggagaaagauaaagagagauggauacaugauagauagauagauagauagauagauagauagauagauagauagacagacagauggauagauagauacaugcauauauagauggauagaugauacauacauaugauacaugguagauagauagauagauagauagauaaccaaccauacucuacuacccagcuaagagcaaagugauuuuuuuuugaaaauacuuuuuauuuuaguuuuauuggugugugugggagcacauguguaugugugcaagcgucugugggggccagagaaggauacugcaucuccuggagcuggagugauaggcaguugugagcugcccaacauggaugcuaaguaaguccugaagcuggguccucugaaacaacagcggcaagcacucuuaaccacugagucaccuccccaagccaaggccaaggacuuuaagagaacacguguacaauauaaguauacaugcaaaagagaagcagacuguaccaacccugucaaucugagagcugcauacaaaaguuccugggaugcuggcgguuuccucccucccuccacugugcccucuuccuuccuuuuaucacuguugcuguugcuggugccuuucuugucgagccuaauucuaugacucugucaucccugccgacugcgugugcuggagguguugcaggaggcugcacugcugugcuauggacaguuuuguccauuggcaugaccgccagcaggaaggggcucauugggaaggggaagcuuucggauugggaguuuccaguccucacugucuacaggauccugaggugcugcuggcacccuccuucucccucagcugggugggaucauaacacacagaccugcuggggguggaaugaggacugauucuagaccccgcccagaaaccuggaauacggggguggagcuuaaaugucuguguccaguuggcuaaaucccugguuguucaguugcuugaucucauauuucugggugucaacagugaggcuaucuagagaggagccucacauuugacagaccagauccccaggugagagugucuuguggaaggcucaaacagaacaaaaagccaccguccacgcuggauggagacuuucuagagugauugcuuuagggucaccugcauuucugcuuguaaaucacuuucacucuuuaaguaagcccaauaagcauaagggcuuccuaggguaaaucuggcuagccuauugcuugguuugaccuugggaaucuuaccaagaaggaggagccaugcuucccaacuuccggcaauggggcagaauggcaugggaaggguccggagccauagcuccguuucuccaacccccuucaucucuagggucuccauuugugcaaugggaaggguuacggcaacacuuuaagcuuaacacagggauacuugcacagugugggaaacgcaguuugaaggucaguggcuagagugaaucgcggggcuuugagucuagcggaguccuggccugcuuaaucuuaaucgcaaauugaaauaauaccgcccacucuugaggaugacgggggagggggggaaguucuccaaacguuguuggcacauagugugggccauauuuaaugggggggggguacagaaaggggucuagagcauaaugacaugcuggaauauguuucuuaguaguagucaugugcuaaucuguggcacacaguaggaccucugugaauaggauuuacuauaauaaauuuuaucaguaugaacucauauuccaguagcaguugagagugcccggagcagugcuagacaaauauuggagguucccuagauugcaagaagcaguaauacugacagagaugucagaucuuucugcacaggucuuccucgucccccagcucagcuuccuccacaugcagagucacuuccaguuuugcaucccauauuuucaguccccucaccccuccccgacccucauguccaucuaaggcccuugucuuggaggaugaucuuuagugucauccucuuugcaccaugugacaggcgacaggagccgggccuugggaguucccaggccccaugggguguucagauuggauuagcuggcauccuucuuugcgucugucacuugcugccucuucuguuguuggcaggggugucauuaaggccucauggccugaggaguuaauagagacacucaggguucucagucaccagugccugcagcaaucugcaccuauugauaccuggcagcuaauuccccuucaugaccugacaccuucacuguggcucugucccccguugucagcaguccacgaccucagucucacagauacaaccccaaagccgacuccugacaaggaggcaggggugggccugccccugaccugcagaagcacccuugccucuaccuggauacgguuccucuguguuucucucucaucccacaacaggaggugcuuccaguccuggggucucccuguccuuaaauuagacagaggugugguagagggauagugaagaucagaggugggaccuagagaccuagagauuacauaccugugcugaagccgugcugacccugccuagggcuuccucggugaguuucggggacccuuccucuccuuaccgccaucauaucuugccuccaaagccuccucugaugccauuucuaaagagcucugaagccagaggccagugauggaaagccgggaaagaaaggacuggaauuaaggucgccguuggauccagacauuuagagacuaggcuggauacuacgagacguggucucagaaucccaaaaggaacuagaaaaugaaauaaaaaugcccaguucagaagcaggaaaucuagacugaagggcugggggcauggguucuccuggaaagcauguguugaggaauugugagggugugaguuuggaaccucagcaucuacauaacagcugggcguggcggugcaccccaggaucccuccagugccaguggggcagacagguggaucccaggggcucacuugguagccagucuagcugaaggcaugggauccaggguuagugagagauucuaucucaaaaaccaaggucaaaaugacagagggagacacucaauaaugauguugaucucuugcuuacacacacacacacacacacacacacacacacacacacacacacacgcacgcacacacagccacacugcagcuaucuuaaacugugagacaacgcuucuuucuccuaggggauucauaucagccugggcucagcuaacuugaacugugugcauuugcacggguguguguacauuuaucuaaguuccucaaauucgugggccauagcuguguucucaaacaugagcuaccacaccuccgcugaggcugccguuaaaauguuguuggaguggaccacguucaaguuguuuugugucauuccguagacggaugagagagacccuucccuguccgcagagucuggggauggugaguuugcagacaugacugcaguuacauuuuuuuguuuuguuuuguuuugcuuuguuuugguuugguuugguuuuuuuuuuuuuucugcuuaaggaacggcuugccuuguuucaggacggugggauauggcaggauucuguauucacgcaauaaguuccuccucuacgcccugaugagcgccccccaccccauccccaucccagugccuggcaguuccagcugugggaugcaaacaucugcugggcaucauaaagacacucuauacacuuccagccaagcccugaccuugugaccauuuccaccauuagauuugaaugaccucagcagccgggcugaaaggcccgcccgaguauuaauucacggaaccacaagcucaauuuaagauuuaauuugagauaacgaagagcuacugaaaguguauucaaacuucuaagcaugucguggacagucucucccuguuuuuuucaaguugaauaugaauccgggauuugcuuuagcgggucuguuuacacauuuacaaacaaagggggcucagaaggggcuucuuccucuuuuccuggguucuuugugcuguggcuguuguuuuaauggcagccucggaggagguccccuuagcauccuuuccuuuucuccuuucuccuuuacaaauggcugcccuugccuuuaaggauuacccuugaauuccauuacauuccugaagagaaagcaggcuucccaaggaaucuugcccccaaccuucccucagaguccaaucuaaacaggaggaagugucuggguucagcugagacaguguuucuugaaagcugccugcuauguagcucucggaaauuuaaaaaaaaaaaaaaaaaaaaaggguguguggggauuccaagccucgugcuggccauuuggugccucuugguucuggugaaugucuaaauucugaagauuuuagcccuaacauauuuaagauuucuggccggagacggggauuugacuugguuucaucagaauuuuccaugcuuggcaguuggcucuaauauggaaaccucuagcuagagugggggaugguuuguuucaggcugaagagucaaaaucuaggaugcugcugcaucuggcacaaggcugggcugggcuuuuuuuuuuuuuuuuuuuuuuuuuuuuugcagugucucaaggagucagcccagcuuuggaaucagaggcuugaaggaugagcaggguuguucagcagggaaggccaagcaugggaagccaaguucaaaacccguuacccacuugaaaaguaagcacggaccuguaaccucagcacaggagaggcacugggucuuucugcugaaucuggcuucagggucuggcugagcuccuguuccaggagaacggggugaacugagauaaggcaggacaccuggcaugcucaccuggccucuacaugcaugcaccugcacacauauguguccacauaccaaacacccucagacaugggcuucagguguuaggucaacaacagaugcagcuagguccuagcaaccuuaauccauagaagagaggucuauauccuagaggaugaugguguggaacggcuggggcagggcccgagcugaaguaaggguagggguguguucaugccagacugauaauguagcuuagccuuccuuuccaggaaggccuugcuguuucaguugcugcucuucuagggagucucugaauucaucgggcugucauucucaaggucauguccuuccagggccagucuacccaacugucaaggcagagguccaaaugucuggcuguacugaucaaauggggaucagcucugaugggcccuuggagcucuagagcuucccaugagggugagcugagacucccaggccuguuaccucagcucaacuugcccacaucuacuccauagucaccuccuucccuuuccccagguacugacuuguccugagugaugcuguacauggagaagucuagacuuccccaacugcccagugagguuucucaauugcaggcauggcugugauucuaagaagacuuggccucaucagaaaaccucggacuggggcccaggccaucugucugccuuuccaaaacccuugcuaucuaugauaaagaugggaguagaaugcuccaggggaauagaaagaaaugggagauuuagguagaagccaggagcagcucaucugcacagggccaguuugccuacacaccaaaggcauaguccuaagccccaggagugaagaacuuaacaggggccaacccugagcuacuuguugacauaauuagugcuggcuccaacgaagagauucugaagccaacuuggcagagacuucugaguuuugauuggcaaauuugaagcaaaguucagccaaguucuauaucuauuuuguagugugccuuaugcacaucaagagacgccaacccuuccgauagauuuccagcuuucugguuguugguagcugaagacauuagcucuuuacguagacaaaugcuucuggcaggccagccugcacuaggaacgggagaaaugccugcagguuccucugaaaauuaauauaauaugcugcauuaaucagaauucuaucaagucuacacacuuggcccgggcuuaagaggcaauacuuugaaauugcaguuggcuaaagcuuccuuauucuuggagaauaggagucaggguuuggaaguggggaaaaaaaaauagaacagagcucaaauuuaagaagcagaaagaggaagaagguuuaagcaacauuaauuccucagcuccaccauucaccagaggcugccgaauguuauggaagauuugaccuccgcauuggcaucaaccuacuucaaaugguaggaucuacugcagaggcagcuggacagaccacuuacccccugccccccaagacaucuuggggcugcuuuguacaaugucuuaggccucggguagugacuuguuuguuucugucuagugauaauuuacucccgcucgugcaggcucaucuuggugauuucucaccauugaauacaggucagcaggugacugaaagcauuuuaaaggcaagaggauggcacaguuuagcaacuggcacaggggguuaaagauggggcuugggggauggccaaaugcauaaggcaguugaggcagggaagugagagggcuggggcucagaacucaacaaccuuggugccagcuggguagguaagguggccguggcugccuguaaucccaguguuucagagacaguugggauuuccaggacaagcaagcucucuaacgcucgcuccacugccagcaagacacccugccucaaaagaaaguggagagauagcgaggucagcucuucgggccuccacacacaagugcacacauuuguuccugggcaugaagugugcccauucauaucugagcaugcacacgcucguaggagacgcacaaacacaugcaaagaaagaaagaaagaaagaaagaaagaaagaaagaaagaaagaaagaaagaaagaaagaaagaaagaaagaaagaaagaaagaaagguuaucuucuccuccaauccaaagacucugagccaccaaguaagagcuauccuggcuccucuguaggaaagcugcauaugacaugugacacauuggagccugacacacuggcauucggucaugcuuucuuaaugugacucagcuacaucugcguucguuauuauaacucagugccuaagacauggauauuuuuaaagacaaagggccaggcuuucgguggaaacgcccccguccuccuuguauuaaaaaaaaaaaaaaaaagaggcuccuucuugucuggucuacuucaguaauuggcaggauuuugaguaagcucuuuuaaaagcccuccguuucuauuuucacauuaaacacacuugcaauaucuauuaaaagcacaaacacugaggaacacaccaagacuaccaaugaggcuacaucuggaggcucgguuaagacaggaagaauagagggaucgcucuuguguaguuuuaugucuggguaugugguggggggaggggaggugcagugagggggugggugucaaugcuacaaaagaaagggguggaccccuuccuucuucccucugaccccuguuccaaauuuucccaugaacuaacucuguaucggagggggucaacagaagaggucaauucaggauuugaugacaacuaacuaacacuggacuaggccuucauccgggggagucuuuaugccgagccacaaagacgaagcagagcagaugcaaggauauuucuauucugcuuguuuucuaggauuccuuugcuucaugacccuuugaugauugacugguaucccagggaggaugccuaaggucacacgggggacucgggaacaucugggagagggcaaggccagugaggggguucaagagagggccucuaggcccugaagagaucuuacaagccauuuucaaggucacauuugggcaggcagccagaugugugagcauggacuugcagggagccagacaagggucacugggagccugguggaggggcugccggcagcugcccuuuggcucagacacagacgcggagcaucuaaagcucuuucaccucuuuccaaaugccuuuagaagggcagggagggaagggaggcuggaaacucgggggaagaagaaagggcuaucagucugcugaaagcuucuuccagaaacgcccccuguuccuacacacgugugugucuuggaugaaagugcguguccuggguuaaggaggauguaguucaacaucugagauuucgaacuguagcugucagucaaggguccaggaaggaagcaguggggcacauuaggaucugggggguacuagguaaggacacuccuugcagagcuugauuguaggguuuuaggacugugggugguuuccagcggguaucccaggcuucaaagagcagguauggcugaggggugagaaguuucuagaaagggaggcagucaaugccaccuggagggaaugagcuuggagacuggggaagcugacucugcuuugcucugaagcccuggugguuagcuccucucgcuuuccagaaagagcgugagcagucagucuuccaggcagggcaaccaggaggaccuggggagagaggcagcuacuguguagacugcacaccagugagaacugggggcuuugccagaauaaaguggagcauauuuaucuuguugguaccuguuagcaaagagcacuggugcugguguguguguguguguguguguguguguguguguguguagguccucugguuuuuguccucaucuucuaccuugguaaagcccaccucuccguugacuuuugcuguaugcuucaggcucgcuguccugugacuuuccaaggacucuucucucugccucccaagccccuacaggagcugggauugaauguuccgccuaugcaucuggcuuucauauagguuccggggauuugaacucaggcccauaagcuugugcaacaggcauuguuuuuaacucaacgaaccauuucuggaacaccaagcugacaaugugaccccuuuucuaaugcagauguguagaaacucaacacuuucaauuuuuuugguuuuggucuuuuuuuuuuuaacggagagacuauuuugguaguuuugaaaguaggacauaggggauuuaaagauuaaaugugcacacgcagacagauaaagacagcgagacagagacaaagagacagagacagagaguucauuugaauuagcauggacaugcuuuuuuuuuuuuuuuccaaacuuuuuaggaaaagaaaaaaacaguuccuguugcaaauaaggaggaggaggaaagaugaaagaaaauaauauuccagacagacacacacuggaagcauuccaguagaagcacauuuugccaaaauucucuaggagaaagaacuagaaaggguucuuggccccgaacccaggggccagcaaagcgaggguccagccaagcucuguggcagccagugaugacacugucaggcaccaaggacagucacagucuccugugcagccauggccuuguuauuagaugcagauauucaaacaccaaaggaaaaggcaaauuugcaauagaaauggcaggcucuuucaaccaagggagacgcagaaucaucugcagacauggggaggggcugccagcgucacgaauguucgaauccuccucaauuucuaauauagauuaauggcuugcuugggcgagcggcuggugacuugcuaaaugugcugaccacuggaaauuagcaaaggugccugcuuaaaaaaaaaaagacagaaagaaaaaaagaaaaaagaaagaaagaaagaaaggaaggaaggaaggaaggaaggaaggaaggaagaaagaaagaaagaaagaaagaaagaaagaaagaaagaaagaaagaaagaaaggaggaaagagaaaagaaaaagaaaaaaagaaaaugagcugaaucugaauguggcucccucauccuagcccugacauaugacaaacaaaauuuguugugacaaagaaaaagcaacaaguccuaggugguggggaacgaaugucucaugccuaugacugacugaucuccaugguagccuuugaugcugugggcaagagcuugggguuggcucuggagcucggugguagaaccucauggcuuguaaccacgaugcccgugcccuagguucagucaccaggaaugccaaaacaagccagaccaacagccguugacuugagguugcaaugaucaugauuuaugucauggggcgauggauggcuuauggcuaaguaugcuugcugugaagguguaaggagcugaguuuuuauucccagaacacacauaaaaagcagucaugugucugcaaacccuaaugcuggggguacugggcagaggcaggaggauggcuggggagaggucacuagccagauuaacugagagauccugucucaagggaauaaaacugagaguggaggaggagcaucuaggacaccuucccuuggccccugcauuugcaugaugguacacacacacaaacauacacacacacauacacacacacauacacacacauauacacacacauauauacacauacacacauacacauacauguacacacacauauauacacauacauauacaugcacacacauacacacacacauacacacauacacauacaugcacacacacauauauacacauauacacauacacacacaaacauauacacauacauacauauacauauacacacaaacauauacacauacauacacacauacacaaacauauauauauauauauauauauauauauauauauauauauauacacacaaacaaacauauacacacacauacacaaacauauauauaaacacaaacaaacauauacacacacaaacacacacauaugcauacagacagacacacuuacacacuacuguccuaauaucauuucuguugcuacuguaaaaauaaccugacagaaaccaaauuaaagagggggaggggagggaggaggaaggaaugggaaaagaggagggaggagaaacugcagucaggauguaaaguaaauaauuaauuaauaaaaagguggaauaucaaaacaacuuuuaaaaagcgacuuaaggaagauagaguuugucucaguucacaguucuagguuguagucaggaaggccaagguuaaagugaguuagaacagcuuacccaaucccauccacggucaagaggauauagaccugaaugcaugugugcuuaguggucaucuagcucuguccacucuuagacugucugagaguccaaucuaugcagugguguuacucauuuuccgacugggucuucccguaucaguuaaaacaaucaagaccacgccccacagacaugcccauaagccuacccaacguacauaaucgcuccuugagacuuccuucccaggugauuguaguuguauagaauugacaauggaaaguacuccaucacaccacacacacacacacacacacacacacaguauacacuuugcuacuuacacacauauauauuucaaagucauagcauagcaaaauucuacuggcauaauuacaucucuuucugcucacgacaaaaccgugcgugucuccagaaauuagagcgcauuaucccagaugucagugagacucggcugaagcacugcacacgguuuugguagccaccuuaucaaaacguuauuaaucuaacacuugaaagguauuaaggacagaguggcaguugguuggcacuccaguuuaaaagucucgauguucuucaaagggcuguauaccucuggcuuagaggagguugggaggagggguguggaggcacagaaaauuuaaagaaaggaaacuacaugagaaagaauuuaggcucugaauucuguggcguggagggcugacucuauggcagggaaauuguggaauuuagaggcaguguuaaagggaaaucugcuugcuuccucaguguuuaagagauguacagagucuggggcugcuggguccaagaccagcuaggcuacacagaguucaaggccagccuguggguuuuaaccagagccuaucagaacaaaaacauaaacaaaagcaagguauacuuaaagcugccaaguuguuuuuucccccuuaaaagcuaucaaguaauuaugaaaaaaaaaucugcaugcaaauugaaaauaacaacucacaaugaaguagguauuuugcccauagcuagcugaaaaucgggauuuagcauggaguuauccuaggguggguuccauaauuauguuuaccaccaagauucacaauauuuuuauauuuuauuuccauuucucuacuuuucagaccaaucuaaaagugagucagaaaucuuuuuuugaaacuacaucugcuuaggggcuggggagauagcuugauuggugaagugccugauacacagauauggggaccugagccuggacgccaguaucugcagaaaacgcuaagccuggcgaugcauggcuauaagccuacggccaaagagguagagaaaggagcaugucccggguuuucaccucacauucuucauucuucugauaucaucuugccuccuuugaacaucaauaguucccagguuggacaccacuggcucucuguauacaguaugcacuggugccaacuuuaugcuggguguccugaugaguaggagccauucuguccccacccaacauggggaugacaaaugugcgccaccacacccggcuuucuauuuuguuuauuuuuuaaauguauguggugcuggggauggagcauggguucuuguguuugcaaggcaagcacuuuacccacugucagcuauacacucacagucuuuggcgcaccaacuguggugguuugaauaugcuuggcccagggaaggacaacaagguguacucucacuggaguggguguggccuucuuggaggaaguguaucacugugggggugggcuuugagagcuuccuccuagcugcccgaggaagccagucuuccauuugccuucggagaaagaaguugaacccucugcuucucuuguaccgugccugccuggaugcugccaugcuccugccuuggugaucauggccugaaccucugaaccuguaagccggccccaauucaauguuguccuuauaagggcugccuuggucauggugucuguucacagcaguaaaacccuaaccagauuuuauguuuucacucaucuaaauuuaaacauugacauguggccuguggcuacucuauuagagagcagcuccuggcuagguagcaggaggccucuuucugagacucagcagaugccuauuagagauugccacccuucagucuaaggcacacuccuuggcaccagccauagaaugucuucaggagagaaugaguugcuuuauuucguggcaccucacuuuuuuuuuuuuuuuuuuuugccacauuugaagcagguuuuagccccugccauuaauuaaggacaggguagaaacaaaaacauuucaaaugaacgcgggcccuggauguuaaagcugucaucuuuuuacauggccccaugauucaacgauuaauggaccuuaaaacaaucauaaaacaucaaggccucugcucaagcuuaaaacggggguaguuuuaccucggcuccggucuucuuguuugaaauucauugugugucacggggcucuguaaacacuuuuaaggauucugacauugugguaugagauacuguuaaucuguucccucccugaccuucauuggcugguggcauggcgcaacugcguggaaaauucaugaaaacaucaaggaugcacuccgcgacauagacuagggcacaauaaaccuaaauaaugucuacccugugcagagucugacucaaugaacugacucggggaagagucaucaagcaacugggcuguaccgagaccucagcagcagauacauuguguuuuauuugcacaaacuuuagaacaacuauagggggucaaugugagaacccacccacccccgcccccauuucacagaugagcacacugaguccuggacgugugguuaauaaggggcagggacagaauucaaauccaggcccucucauucccucucaaacagcacuuuuuuuuccccucgugugcaacuacuacaaacuagcuacgucaguuugcagaugguuaaagacacacuuuauuuuucuuuucuuuucugaaaaaaaauuuuaugcaccuaaguguuuagccugaauguauauacguauagcauaugccuguagugucacagaggcuagaaagggacaauagacgccccccccccaaaaaaaaaaucaaaaacaccugguauuacagaugguugugagcugucauagaaggggcugaacccagguccuuugcaagggcaggacaugcucauaaccacuaagccaucucuccauccccuauauacaccauauuuuucaaaaguggccacggugauuugccaaugccacauucuuuccaagaaccaucccguugcccugugagaagguggagcauccuuccucuaccucaguaggcuuucgggucugcccggacagacugcucagagaaggagcaaaggcaugcaugacuuccacagcugaaucaugaaaggcaauguaaaaucgacuuggcucuuucuugggacacauacccuggaagcccauauuugccguauuuggaggaagcccuggcugcccaaaagcacugugacgcgccacagccaauagccagcuucaacuucuacuauggugaguggacagccucuagaugaccucugccuugggcugugccuuuguuuuugucuucaagcuccuucuguugaugcuuguggagauggauacacuguccccacugaagccugcugaaacaugucaucacagagcaguacggccuggggugcucugcgguagauacgguaguagugacuagaacauagucgaauuucauugaaacucuagaagaggcaauugcuuccauuccaccaucaacuauggcuucucacaaaagauacauugggagggaaaaaaaagauauugucuuggcucuggggaaaacacugagauuugaaaagcuuauuauaauagggaguuaaaugagauauuugaaggugaagaaaacagagugucuaguaaauaacccacagguuagauuuauguggcuguacauuuacuaaacugacuguuaaaaucuauaaaucuauacaugggcacuguauuaagucauuaaauuuggaucugaaagauuuuuuuuuuuuuuuuuuuuuuuuuugguggcuuaaguuggcguugggugcuauuccaguguucggaggcugagcaaacguucuuggcaugcuaggaaggggacccuacaaggcagagcaucuuauucuuacugcaugcacagcucucagccacguccuuggcaacuuggggaaagagcuggaaaaauaagacaaaauaaaauaaagcaacuggauaauuguagcgugacgcugccacaggucggcaggggugauguggcuucugcuucacaccuccgugccacauaaaaggaacccuugcuccuuuuaugauuuuaugauuaauuugguuuaauuacauguauguguaggaccuacaggguguguaugugcacaugggugcugugcuuaugggggccagcagggggcauuggauuuccccuugagcuaaaguuacagaugguuauaagcuguaugacuugggugcugggaaucaagcucagguucuuugcuagauagaguagucugaucucuuaacugcagagccaucucuccaaccccauuugcuaugucuggauaaccuaaagccccagugugaaauaccccauucuguccaccuucaacaugauccauaucugugucuguuugugcuuaaggaucucaggacacuggaaaauguuaucaggccaaucucaaauauguauuuuuccuuuacuggauaaaguccuuuugucuacuuuacauauuaagcauuaaaucaucucauuaauaaaauuugcaauuuaguaguguuaguccucauuucauuuacaggacuauauacacucuguaaauaucccuauuuuuaagauguauuacaaauaucaggagacagagccauuuuguacgagcuucccaaacauagacagacagcaaacuauagguaucagcagcaauauuuaaaucuugugcuguuacuuuucccaaaauuuggauuaaucagggugcauuuuacaccuacaaggccaucaggguggcauucuuagaaucacaaaaugccuagaguauaaacaggaaaaucucucucucucucucucucucucucucucucucucucucucucuuucuucccaucccuuuauugauggcugugaauuuucucugcacaccuguacuaucaagguaacuuuugcuauaaacagcauuuuaaaauuaucacauaaaaaacuaucaagcacuaaauuagaaaaaaaacagaaauccgaaagugauagugaaauuuaugaagcaauucugcuacacucaaaggcucauugcuuggcauguaaaaaauuuuugagcugccugcaagaccuggguaagaauuucccuuucaguagggaaacuucgauccacaacaagcucuaaacgagagcugcacacagaacacccgugcugcagaugagcgcuuguuugcaugucuaauagagauaauauuaaaaguguucucucaucauuucaauuuuuuucauuaaaauuuuuuuuuuaauuuggcugagugccucuuuuuuuuuuuuuuccccuaccuccaagagcuguuaauuccauucacugccgagcaaaagucaaagucacagucuaaacagcuuguaaugaguuuucaauggcccaucucaaugaaauugagggcaaagaccagcaggcucaggcagugucagcccucagaauuuauuagcaagggcacauuguguucaggggcagguguagcagagggacugaaguuccugggccuuucaaggggagcccaagaccuuauuaagaaguggugugucagugggaggggcugggaagauggcucggucaguaaagugauugccgcacaauuauggggacguggguucaaucccuaccacucacauugaaaucugggcaagaggaaguuaaaaguaaauagaugagcgccagaccuugucucucucauugcugccgcccaugcaugcuugggauuagagaggugccacccagaagagaaagagcuuucaaucuuagugaugggacacucauugugguuccaccaccaaucagggaagaugauuugcucuuugguuaauccaagaucaccaauaccugcaucuccucuagacaugcacacaucucagccugcugauagugauaggaaccacggggaguauuauuuccuuuuucauugcuaaucuucguuuaggugugugugugagugugcacauguguguguguguaugugugugugugugugugcguguguguguguguucauauacccacaugaguauacaugcacuugucagcccaagguuaaugucgggugucuuccuuuauugaucuccaccuuauacaagacacagugucucacugaauccagagcgcacuguauuaugcucuuggggaucccugccuuucucaucucuuugccugagugccggagccuagaauuccacuccucacgcuuucacggauggguuuuaccugggcagcaucucucuagccugaauucuaaugcuuagcuguugcauuucuggugaguuucccuacuggaauagugccaauagcaucucugugacuaugcuucaaaaaaaaaaaaauacccuuuaacuuacacaaugccuuucuacacaggugcaugauuuccauauaacacaaaauucuuucugagcuugacaaauaaauccaauccuugaaaauggagaauaauuuaacaauacguucuuuggccaaagauguucacaaagcaaauacaauaauacauacgacuaagcagaggcuagggaggaccaaugacuugcuucucucuagaugcuacuuuuaaauuuuuauuuuauuuuugagaugaucuugcuguguagcucuggcuauucuaaaacucacuauauguagaccaggcuggcccugaaaucaccugccucugacuccugagugcugggauuaaauggcuuuaaaaguucuuuuuaaauagaaaccauggguuuuauggaaauaacuugcucugugaauggagguuggggccuuauaccaacuguguauaucauggauauuaaauuaucccugacucuaaugcauguuuuaaaauguaucaagagccaggcgugguguugcacgccuuuaaucccagcacuugggaggcagaggcaggcggaguucugaguucgaggccagccuggucuacagagugaguuccaggacagccagagcuauacagagaaacccugucucgaaaaaccaaaaaaaaaaaaaaaaaaaaaaaaauguaucaagaaccuagcaagugcuaggcuuaaagauggguaccggcaaugcugcgccagaccugauggugagaguccacuccccucuccccucuccucucucccuucucugcucuucaauaacucaguccuucacucagccacucacuauagauuucuaagaccgugugaccauaccaccaacuuguuucucuacagagcucuuuugaaauguccuuuaaaaaauucaucucuuucuauuuuauauguaugaguaacauggcucacauuccaggaacccagaaaaagacaucagaucucucaggacuagaguaacagaugguugugaauugccauguaggugcugggaaccaaaccuggguccucugcaagagcagcaagugcucuucuauguugagacggcuccccagacccuccuacagauuucuuaauguguauuaggaacaaaaauaugaaugcaauucugggggggaaauggcugaccuccaugucaccucauuuagccucacacacacaggacacaagguuucagagaagaaggguacacuuccaaagucuuccacaaacccccggcuuccaguuuauuuaacuaugugcuucccugcauucagcugagggacuucacuuagccucacacgccuaucccugcucuucccggcucuucucacaucguagugcauugcagagaaagugaaacacguguuaaguaucucacacagaaccuguggaagaacaccugacagugcaaaauauacuucaaacacacacgcgcacacacacacacacacacacacacacacacacacucgaauuguucuguguuuaagcugucuguauaccugaauggcaugccccguguaagagugaaauucaauccuauacacauucuucacuguuuguacaacaaccacacugccgaugcugacaucagacggaggccggagacaaugcuuaguuagugaugugcucgagacuccagcacggugaccggugaccagcaucuggacacuuaacagcuaucugaaaagucaggaugaugacacuuguccuguauccccagcauugggagaguggagacagacagauccccggaggucacuggucagccggcagagcuccccugaugagcucuggguucagugaaagauguuauaacaaccaaugccaccacacguguccaugcacauacaugugcaccagugggcacacaugugaauacccucacagggagguacauauaucccauacacacauacacacaggguggggcaggggcagcagagguagacagagacaagcagcgggugcagaacuaaacacucuuucaggacaauuugaugaugucccuuaguacagaucucuuaauaggugaacagagguauggacugaacuguggggaaagcagcugguaucuggcaccaaguaauuuauguaccagacuccccgacagaccugucgucuacauuauaauaacaucuaauccugugccaggcagcuucucuaccugguuugcugcuuagagguagaccacaagugaaggcauuugccccaagucacagaaaacacuguaucuuagauuagaagagucugaccuaaacaccugcauuagagcacguguuaagacucgaccuauaaagucaauacagcuuuaguuuuuguauuuuuuuuaaagcagaaauucaagggacagugugugagugggugggguccuaagaagccuggaucugucuaacauggugagcgccuuuacucucugcgugaaguaggcaaaggcagguagaccucugugagauggcggucagccuggucuacauaaugaauuacgggccagccagagcuacauaguaaggcugugucucagacugucuaacuuaaugacugacuggcuaauucuguaccuaaaaaaccucuaccaccaacuuucuaauucugugggugacuuuauacauaaagaaaaagcaaggucuucauggugagcgguaaaaauucaaacgccuccauguaaggacaagaugccuugcugacuuuaacugugcccaaaugccaagagaaucaaagcagcgcaccaacuggaaggaaaugggcgaguauucugccacccgaggacgagaagggaucacgggcagaacagagaaacccacagcaggaaagaagucaguuccugcauccagccagauccagacuuaacaguuuucuaauuuguguuuugcuucaaaaaggaggaaggguggaguggggcuuaaaagggucuuaugauguaggccugguuggccuggaccucacuaggucaaacagacucgcccaaaacauauaaaauauuccucuugccucugccuccucccaaguguugagguuauagcugagcacuaccaggccugaccuuuuuccuacauuuuauuuuacagaauuuccauuagagagccugguacuuaaugguuuaaucuaggaaaugucuugccaugacucucuccaccaucagcccaucuguggacagcagcaauggacagggugaaggcagguggcagaggcugcuguccccggagauguugaucacgaggaucauguauuugacauuggcuggacacucagacuuucuccgagaacacuucucguuugaaaacuggugcuccucuagaaagccccucggguggcugcggcugagucuucacuuuuccuggcuccuccucgucuugucaguagccaaugggaaccacugagugaagagagccaaugcaagagucuacaaaugaggacagacuaccacaagcucauucugagcucccauggagauccuugcucucuaacuuuccaaauucauacaaggaaaugauauaaagcagcucacguuuuuuuggcauuuucucuggcgucugugauaauauaauaaccaaucauucaagggauaaaggauucauuauggcuuacagcuccugggagggcucgacucuauaucccggcagagaggauauggcaacagaagcaagaggcuguccugucacaacguaucagcuaagcaggaaguagagcaucaacaggacgcugggccagacucuacaguuuccaagccgggcucccugcaacauaauuccuccaacaaggcucuaccuccuaaauguucccuggccaucccaaacaacuccagaaacuggggacggaauguucaaacacacuaugagggacauuucacuuuuaggccaugauacccauuuugcauggaaugaaccauucucugauagcuugucauucguaggauccaagcagaucuugaaacugauauguucagcuuuguguugaaaaaaacgcacaaugugcaugcauggaaaaagcuguccauuccccggcaucccucugaaacacugagggugaaaaaccucaacuuuuauuuuuuaauuuuuuaucuuuuuauuuuuuuuauuuuuggccauggaacacugaacagucacacaaucauuaaaaucgcaucuaccacuggauuuucucuccuucccaguuuuaauacauuuuuauaauugcauugaagauauucaaccccuguuuuuagugcaaagauaaaauuuaccgaccgugacaaacguauccucucagagccuucccgaaggauaacaaugguuuguggcgaaacccaaaugcuuguuccuucuuggccauuuuaguggagugacgggacaaaaaauacugacaggagccccauucucaaauucugucuguguguguguguguguguguguguguguguuguacuuaacugacccaagagauucaggaugcuuuccuuguauccauuaggaacaucaacugcuaugcagucuuguuauacugggugcuacugggacggcuccagccaacacaaagacauccaguuagacucuuucugccgaugacugggccacuugccuccucuuuuccuuagggaguguguuuugggauggcaucaagugaaaagagagcaugaaggagcagggaggguggggguugcccaagaaagcaagacucaagguuaaggcagggguggggggaggggggugggagggugggaggaagcagagaacugcgggaccagggaggagucucuggccuucuggggugcuucuucuuugcaucuaggauuuccagcagauuucugaucgcucagaugauauauaacaaugaucuuaaaaauaaaccacaaaacuuccagcuuucaggcugucucacugguaagacaucaucaucuucccuuagaauaucuccaucauggauuaguucuuagacuucugaccaucacaucuauuuaaacauguguuuaugaacucagauggaccccuggggaaaaaauacacacacacacacacacacacacacacacacacacacacacacacacacacaucaucuauucugaggcuuuucuuugcauuuugcagagcauacccugaccaugaacuaacucaacgccggagaguggagacuaacuccggauaaacuuuucucaaugccccuccccucuuuucuuugaccacacaguuugaaguauuuccuaacuuuacauaauagcuuugcaugagaaacccaugccggggaccauaaugaagugaagguaaucuacacaauuuaaaaacacuuauugugacagaaaggauuggcgagguagaggccguacaagcacacauaaaugaaaugcaucccaccggaaaagccucuugcucacacugucauuuaacggcuccugaauuaauagaccaagaaaggcaccaccggccccaacaaaaugccguaaaaccacgggcagcgaguggugucuccaacuuucauucccuuggggagaaaaggacacugccuaaucuguauucaguccugacauuggcugcaucugauacggaacauuagcuucuaagucucucaauagaccaguguccuucaguuuauauuacuuuauguuaauaguagaaaaauuacacacaacaucauuuaucauuguuauacucggcuauacaucccauagcuuacuguaauauauuuauuuaccccugagacggggagaaauuaaaaauauauauguuucaagaaaacccuauaggaaaagaaucauuguaaaucucuuuaaaaacacacaugcacacaaacucccguggggggcagggagugaucuauugucuagcuaagacugugaaugacaagagguuucugucuaaggacccaguacaggcuguacaauaauucuggaauauauaacaauacacuucacauuaauaauauaucuuuuguucacuaguuuccccagauuuuccuucuucauuuuuuucauuugucuauuacauccuuggguaccuccgauuauuaacuuuuuuugaugucucaccucuagucagaggaagccaagauuuuuauacuuuuccuuaaguccuauggaagaacagugaccacugagccaucuaucuuucuagucuuccuccuccucuucuuccuccuccucccccuaccccucuuucuucuucuuugagacaggaguucacuauguagccuggcuggccuagaacucacauggauuagccuacaucuuccuccuugugcuuggaucaaaagcacgcaccaccauaccugacucaagugucauacuuaccccuccauauaguauuuacgauauaguccuucuuggagcacacauggcacgggacuaacugcccugcuguuccugggaucuuuccggacagacauucacagaagauucuaugccuuuuccuagacaucaccugauuuucuucuucaucaaccgucucccauuugguucacugguuugagccuuguguuuuugccuccauuugaugagaauagugacaauaauaaucagcaucaauggcauucuagucacgggucagucauucuacuugacacaaugucuuguuucauucucaaagguagguguuauuguugcucccauuuuacagaugugaaaaccaagguuacaaaccacaagagacauaaccgguacacagagauacacucuaggugcaucguguauaugaugaaugaagcaauaacaauccaagaacaaggauggaaagugaucauugcauuuggugacugggguguacucccagguauacuccuggguagcauucucccagagacuuguguccagggcaauacccuggauucuucuuuagaaucuuuaagauccaucaguggccucaacacagaggccuuuugggguacucuaucaagucagaaaucaaagaggaauccuugcuucaacuuauaggugacacucagaccucacaggucuccuuucuacucuaucaauucagagaacagacagacagacagaggcacacacacagcuaaagagccagcuuucugggcucagguugccugcagacaacauuuuuccugaagagcucagguuaggauaggcagagugccgcaccucgguuuucucaccucuagagagacaaugcccaugaaguauaaaggacacaaugccuguagaucccucaggacaccuccuggugccuuuugagcaucaguaagcuuaaggauugcagccaccaucagcauuaucaccagcaucucccccagcauuagcaccuccuuccagacaggacauucuucacugugagcaggcagagugggcugucuaaagaagaagcuggggcgaagaacauccugaagacuccaguccuuguaaugagcaaauguuuuuauggcgauguuaagauuaauguaucaagccguggauacgugcaaaaggagaugcacagaauaggugcacaggggaagguaauuucacuguucaccauuccccaacaugcuugaaccuccugcauucuuagggucauccugcacucacuuccauguaaccugguuguuuaucuagggcuccagcaaaacugagaugauagagcugacgacagucacuggagcggugacaauagcaguuauaguuuacugagacucacaaugagccaggcacuggacuggccaucuacgaaugguuucuguaacccugagauauuagacacuauuugccagaugugugugugugugugugugugugugugugugugugugugagcucgagaccaaugcacaagcaaauuccaugucuggagauggcuuacuucuugucauguuucggauaugaaacguugcuccaagguaugguugccagccacgacugagagacagugggaccuuuaggggguggaacucacugggaggaaccugggucacugagcagaggggugacacugguuccuccucugccugcuucugaaccaccagggggacaaauguucccagcgugauauauaugaccuuaucgcaggcuaaagcaacaagcuccaccaaugccauacugagaacuuggaaaccaugagcuaagccgacgcuuucuucucuuuaaguugauuccuugguuauuuugucagggcucugggaagcugaugagcacagacucacacaugggcuuccugacccacccucaggggcugggugaggcaaugcaguucccuguagcuucuuucauggggacacugguauucaugaaggguuugcucucaggaucuaaccaugucccccgcaaagaacucaccucaugauaaacgcaacuugggagaagacccacauauucacgccaucgcaagaccugaacccaagucauagagcaguuuaccauauguccugggacucuuuggggacgucuacccaaacuaggucuuuuuuuccugucagaaauggcauugcgucugacauggauuccccuuagagacucuccuaaacaaucuuuacccuucugagggaauaaagcucauuuguuuuuauuucucaauagaauguaggauucuaauucauuuccauaauagcuaaauaaucuaaaaaauauuaauuuuucugugugcuaugugaccacacugcguaauauuuaaacaacgaagauaaccucucuuguacuacagcuguguuuuaugcuaauaaccagaaucauuuaaucauuaugggcuaaugaccugaaaaauuucacuuuacaaaugaagucauaucugggccuugggaaggcaacauuggauaaaaaaaaaaaaaaugagagaaguggguguucaauguguacucuugaguggagagcagcaagagucuauauugggccccaucaaacuggagacagaaggaacugucuguguacuuggauaagaagcaggaaaggauucugcgaccugcaggguuuggcaguauugcuuguacuucugggaucuuaggcaggguugaucugugucucuccugcugucugcacagcccucuacccacauugcuucaguucugucacuguuaaacuucagguuucugagagaacggagaacacuguuauguauagucaugguauccugccgguaagugaccugcauccuccugcgauuucuuuucagagauggauaacaagccacccuuagcuauuccacaucugcucagaccucauuuuagauaugacauucuccacagauauacguaguaaacucugucuuccucucugagggauggaucaugauaaaucucgaucaauucugcagugaguuugaacucacggccccauauccauacccucugccacacaaccuguaguacccucagucagugggugugauuuccucuagccuggaaggaacccaaugcgauggggagacaguucugagauuuguagguuucugccugccugcuguguuucuaccgguugugaaaaggcucacccuaacauagccgagaucagccacccaucagccaauucccagcuucaugagcaggauuagcaagcaucccaggugagguggaccaggcuuaugaaaacccagacacagggaugcugcgugcaucgaaggcuucagugugagcagugagucggacgccugugagaccugcugcuggucaacucagggucuaguagugacuguauagggcaucucuggacagcacgaaauaagauaaaaccugcugcuggcuucuuugaggaaguccuucccuccccuugccaccauggaguccauuugguaaagaggagagaagagacgcggaaguggcagagggccaaccuucgcgucacugaggcuguuaagugagcucugaaaacuggcuccucuaaauugcacguuuaaaaaugugcauguugccuccaucauucacacuggccccagagagucugucccuggcuacugaacccuuccaaaugacuaaggcccgaacucgcuuaaaccauagaucagucauggaguaguguguguguguguguguguguguguguguguucauucaauuccugguagagggaagagaaaguagucuauauguauaaugugaccucacaaaagugucuccuccugauacuguccacaaaugcacaaugaguguaaagcaagccaaggauaccacuaaugacacuccgguccucuaccaucucuguuccucuaucuaagggaacagggacuccuccaucccuauccugaggacuggagcugguguuuucuaauauuacucauuuguaacuugcaaagccacucuggcuuucuagagcauuugcgauuauaguucauggccaagugcaugaagggaaaagaaaaggaccauauauauaacuucugccucauuuucuuagugccuaagauggccauccaugccaacagaugguuuuucccugggaagaauucccgagguuguauguucauagagcaaugcaaauaaucaaaagauaucauuuguuuuauuuacagaauuucuccuaugugcccgaugcuauagauuaucucuaauccaccgaagagcacaaugaauggggaacaacuguuaccauuuuauagucagagaaagaaagugggggguugaggggcuaaagcaucuugcccuaagacacccagcuauguggcagaggcagaguuugagugucgguccuucugacauggagucccgagagcacggcugucauacgcugcugcaguaccuuugguagaacagauguguaagaggagaauucacaaacgaaugcucaguacgggcuccaagugagaaacaggaaacgcccccgccaaggugcuuccuggugagcagaagccggcccaugccgccucacaagagcugccuuguacgauccuagguuauuuguaaaagcaaaauaacccccagagacgauaauaauuuuuuaaaauacaaguauugccaaggguaaggugagguuauaacccucauacauucgcuggugggaauauagaugguauggccaauguggaaagccauuuuauaucucuuuuaaaugccuucuauagaauuaccauaugaccuagcucuuucauuccacugcccaagugacuagaaaauagcuaccuacaaaagaccagaacauaaauacuuacagcagcauaacucaccuuagccccaaagcagagaccacccaaugcccagcacguggugaccggauaaauaaagugcaggcucagugaacauuagucaugcguaguggggagaauggaacacagauacauugcccaacaugggugaaccaacaagaacauccugccaagggaagaaaaggccuuaugccucaugcuuccacguaaacgcaauacccagaagaaucaugugcaagaacacaaauauuaaauuaaugguacuggggcuugggguagggcaaugagaaauggcagccucauggauacaggacgucuuugggggaugaaauguuuaggaauuuaaugcugacuggagcucaguacugcaaaauguaagauaaaccacugaauuuuuauccuuuauugugugaaagggugauuauugcgucaauucuaucacaacaagguauauuagaaaaguucuuggccugaagggaaugcaguauaccugccagcaacucuauaaagaacacagcaauaaaguaauggaagagauugguggcuaugagugcuugucuaugucuguguaugauuguguuuauguguuugaauguauguacgugcacaugugcucguucaucugugcuaugauggucugcauaugcuuggcccagggagugcuacuguugagagguguggccuuguuggaguagguguggccuuguggguguggauaccuuuuaauacccuugucucuugaagccccagaauuacagaugcgugcuaccuaccacccaucuuauugucucacagccccggaauuacagauuccuacacacaucugauugucuuacagccaguggcaucugcaaccgaaguucccguuccugccucaagcauuucguuguuacuuuuccgugcuagggcaagugcaaauacuaaccaauauucauuuuggagacauaccucccaaucacagucuccacuguggcugggcaucaccguacggcgacacucagagaaaacaccaagugagcccugacugucaccacucuccuacgauuuauuacuugugagcugcgggcugggccuacgucaugccuguacucucuaagaaccuugugcuggugugccuaugauguaauaggcacagggcucuucucuagagaggcagcgguuacacauugacugcucacuaccccuggcccugggugagcuuucagcuuugcacgcugagaaacagcccugacaguaguaccugccacucaaaggagccuuucagaguuaaggucccugagagcugcugcuaagaagugagacuuucuacagccaccagaggugcuugccccucccucccucagugcugggaaggccuagaagugccagggcccccuucgcuggcagugccugacaguaacgacacucugucucacuuugcuuaauucuuaaacagccagucacacuugguuauuguuuuuagcuguacagacuacuauugaauuauuuuuauggaugcuauuucucaauuagugaacucccuggagacgguacaagccuccggaauuuaguuucucucuggcuuuaaucacccuggcuacuuggaccaccugggaacugguuuaggcuccuuuaacuguacuuaccaagccuggucucuauccagcugccuaccuggcuuuugcccauggagccaugggcuuugaauuaggcuugucagucaucgccuguaucuuccagagaaccuuuaggaacugccagccaagagugucccugggaaggcucaggacugacagugggugcuuuaggcuaaggagagaggccgaccuuggagucacaggggguuugauggagauaucaaacauuucaugucuagacuguucaccaugcuuuuucucauaugccccuugucuggaaacagugacaguagggcuagggagauggccugguagguaaaacgcccaugaucaagcaugaggagcugaguuaaauccuuagcacucagcggcauuuaaaggccaggcaggcagggagggauacacgucuacagucucagcauugcagagccgaggcuggugaggaugagcaguuccccagagcucacuagcagcuagccuagccaagaggugagugccagguuccgugggagacccugucuccaaaaaauaaaguaaaaugcaaaagagagaacaaccucugaugccaauuucuggucuguguccaugugcacaaaugugugcaugcuccuauaugcgcaugugcguauacacaaacacuagcacacucacacauugggguaauagggguuugauggggauguccagucucucucuuucuuucccaccuccucucucucauaucaauggcaguggugaccacugacauuuacugagggucuggcaagugucaggguuucaucacggugcucagccuuuacccauucaguccccacaaacacugcuuggagaaguuacuguuauuuauucccucuuuguagaccgaggacuggagagauuccgaaugccacugaacaccgagaaucggggacacuacgugggacaaagugaguccuaagaacaaaguaaguccaugucacuccugaugccaucauugucaccaucaacaucacagaacuggcauugcugucaccugcaucauggacaccaacaccgcaccaaccaaaguaagcaagcaagcacgaaagcaaacaaacaaacaaacagccccaagggguauggcaggcacacccuuggugccuaauaaaugccagcucucuccucugcuucccugagccccuuccaccucguacaaacccauuccagccuaucccgcuccugucccuuguuuugguacagaaugaucugcuuggcagaagugcucgccucgcguguggcucggagugcgugcaaaguccuccugccaacuuucucucuuggcaguggcaccucacaauccgccugcuccucaaggccaggcguguccccaucaggccaccccuaccuuugcuugccucagcaugcugugcuaaagugcagagggccccauguccugucacagacaggaccccacguccugugacagagcucaggagaagcccagcgacaucuaugugugugaauguuaaauuaagucuggugcgcacaaccuggcuaccacacagccauuauaagucauuucucacccaugugaagguacagguuuugguuuuauuuucaacguccuagucacagucuccccuuuuggugucaauuaaguagacuguugguguuacccacaaaugagcuugacguuggaagugucuuuggaaagaucgcacacaguaugauuauuguuacaaucuaaacacuagacuugcagaaaaguaugaaaauggcccugcuguguaauaaagcuacauucgaaagaggcaaagccuucuuaauauauacagaguggauccuacaagauuggaacgcuuugggccauugcuuaacugacgacauuuauucccucucuuagugggacacaaaauuauaaagcaucuuacaacuggcugcauuacauguucauaagcauggcaugucaaaucauggcaugucaggccucggcaguuccgaaauaacaucgucagaaugccucaaauuacaguugacagaguaggauacagagauggaggacuggaaagaaaccgggggcagggguggggguggggggaguggccaauggaggcuggauaugaagggcagggugaggguggagccucccaggcugguggagagaagagaaggcauucauuguguguguaugcaugcccucuguguaugugugucuauguaacuguauuuauauauacauguguucacucguaugugugcauguagaaggcagaguucaauuucaacgguuguuccucaaguaccauccauagaucguuugaggcagggugucuccuuggccugacgcucacugacuaggguaaacgggcugggaaacacuugucuccuccucccuaacacugaaauugcaggcuuguaucacugugccuggguuuuaacauguguuuucuaggggaugaacucagguuucccaggcuugcagggcaagcaucgcacugacggaaccaacuugaaugggcugagacgaucgagcaaguuuuagugauuucuuccucauggugggugugcuagugcacucccagaacacuuugggggcauagccugaaguggggagaagagauacccucccaagccucccagacagggaaagggaaagccuugagugggcggggcugagugggcggggcggggguuguuaacugcugaagaauucgaugugauacccaccacugaagaagcaggaaaaaguggagcgagcggagacagggcagguggcaggaggauaggggaagagaggggcugggagaaggggaaaaagaagacacagcuggagggcaggagacugaaaagaagagagaguuacugaccaaugauucagccccuaagacagcuccucagccucacuggcuucuuucuccuucuugaagccuuggagugguuaagagcauuugaaaaggaaugugcgcuggcgagauggcucagugguuaggagugcuuggcuguuccugcaggguucuaggaauuugacucccagcacccauguugggguagcucacagcuaucugggaccccagcuacagggaaucugaucccuuuuuccggcuccaguagguaucuacacacacgccauacauauccagggauacauauacauuaaaauuagaucuuuuggaaacccauuguguguucauguugggguggggaguguuugcauguguguggcaugcaagggugcgggugugcucgccuaugugugcaugugugacggacagaggccaaccaaguaucuucucuauuguugucuagcauauucuuugaggcagagucucucacugaaguuggaauuagccuuaaguuuagcucggcugucaggcuaugaagcuccuaggauccacuguuaacccaccucucuagagcuagguuuacagacgugagaggccaugcuggauuuuuuaacgugggcauugaggauccaaacucagcuccccacacuuguccaguaagcuaucuacccacugacccaucucccuagccccaagaguaguuuugaccauaugguuugcacuguaaucuguguacguguagcuuuaggaaaaaaguaauggugucacugugaggucucaaacauuuucacaagaacaugucauggggcaagguaugugcucaguaccugucaccuacagaucccacugccaacagccacacugucaucaccauaaucacuuucauuguuaucauuuaaaagauaaaaucuauguccagguaagagacuacauaauagcauuuguagacagugggaagguaagaguguuaaaugagaaagacgccauuuucuagaaggucuaccugucuacaccuggagcagucgggccaggaacauucucucccuuacauuccuucccauuguagaugggcucuguugccucuguucagguaucaucuccuuagcauauuccucaacauacacacacacacacacacauacacacacacaggucuucucugguugacuuucuucuuuuuaaaaagauuuuuauucuauuuuuaauuacauguauguguguguggggggggugcuaugugcacaugcaugugugugccagaaagagacaucagcuccuggggcuggagucacagacacugugagugucugauguggaugcugggaaccaaacuugcuuggguccucugggcaagcaguggguguucuuaaccacugagcugucuguccaucacugagccaucuguccagcacuccucauggccccugugauauuggcuugucugcuuguuuaccauucucuccucaauaccauggaagccauguuagagcaagggaucuuuugguuuugggugaauuuaguauuuuauuacagcccuuagcucuguccaauguccaaagguuaagagccaucucaaugagucaaucauuuagcccaugauugaaagaaugcucuccaaauggugacugacuggacauaagcccaagcuucuaaggcugggggugaaacuuuggacucaaccuuuguggucucuaggggucugacaaaaauuugaaguaccuagaaagaacccugucaacaccauuuauuuauucaaaauagcuuguuucugcugggggugggggugauguacagcuugaagaucagcauuugggagacagaaauagguggcucucugaguuugaggccaacauggucuaacgaaaaacaaacaacaaaacccacaaaacauccaaccaacaacaaaaccaccuugguuuuguuuuuuuauagcuccaccaggaaagcuucccugaggcauuucugaggcacacaccuuugguguauuuuguuuauagggagacaccugacaaagaaaagaccucccuugacauagaugacacaaccucuuggccugaagugucagcauuccccucccucaguuugcugguguaucuguaggugaccaagcccccguggccaugcuuuucccuccaagacggacuuuaagcccugaacuaugagccagaacaaagcccauuccccugaaaccaccuccaagcacuuggcccuggcuaugaggaaaaccaagcuugccuuugcugcaguucucaacuguguucucccuagagaugcuggccuucuguacugaaguucggcuagaaaaggcucccugccugggcuucuugaucuggguggagccuuagguuuuaagcuaaugcaggaggcaaagcaagggaaaaaccagaccuuuaugcccgcccaguucccaagccuuucucccuccguucuccuuuuccuguccuguggagccagaagucugauucuccccuuggccaccaaccugcugccugagaauuaaaacaaacagacagacaaacagacagacagggcucugucuauccuaauuuggaguauaagcucccaaaucaggaugacuacgacauugacuagcucugugcgcuggguggggccaguugcuauucucugagcgcugggugaaaguggaguagugcaaucucuccauaggcaagucagggauaaaacaaguauacagcguugcacaagccccucccacagagcaagugagcggcguuagcuagccuuggugggagcugccuuugcuggacuuuaacauuuuauuuuuaaagaaucagaaggacuuguuggaagcguaucuguuucccaguggugggguaugcggggcagauaauuuuaggugcuacagagauucccccacacaccccuuccagcuauaacauuccaagagaagacuaaguucauugcuuuaauucagaccugucaacucccccccaaaaauagcugggaaucuaaacuagggcuuggaaugaaccaagcaggugauugccaccggggagguggggggagauaucauauuccugucaagagccaccuuguggaaagugcacacugcuggguauacacgggcguucuuuaaaagaacuagccuggagcuggugcuggaggccccgaccagugccuuucaaagaagacagagguggcgcgggcauggcuggggacacaaacgcaauggguuauaugguuuuucaagagaaaucuuccuuaagaggaaguuucuuuuuuuuuuuuuuuuuuuuuuugcguguucauaugggagagcaguaggggaggaggcucucaccugaugugcugagaagacacaauggagaaggugcuaaauaaaaugacugggagaucgcaccuuuaauuucguaccuugaauuucuauugcgucggucuucugagaagcuuggaccgcucacccagauugcaaaaugacuuggccccguccucacagucaucuugagaccaggaugacagcagggacaugugacacacugcucaacaacacagacaucagucgugcggagguccggcacuggguaaauaccagucuauuuaucagcuuguggccuugcugucaccucguuccuuaccaagugcuaagccaguuauaugaaaccugccuucagcagggguggggacuaacgggggggcagggggggggggaugacugaucacugguuacccagaacuggcgugcgaaagaauccaccagccaagcuggggaggucaaagaguaaaucaggaagcagguugcaugggguucaggcucaccucaagaggaagcuaaagaugggagaagagaccaucauagacaugaaucucagaagugccgucucuguagcuggugguaacagccccaauaagcugcaguguguuagcguguacagaaaguagcuguccugggauuugccaugugccaugcaacuugaguuccaucccuggggauccacaugguggaaggagaaaagagacucgcagaaauuguccucugucccccacacacaugcacacaauauaaguaggguuguuuguuugaauuuuucaggcuggggagauggcucagugggugacacucuuucugugcaggaaugaggcccugacuccagauccccagaagcuacaccaaagcgggugagguagugcacacauucacagaguaggagcuucuaccaggagucgggaggcagaggcaguccaugagaagcucacaggcuggguagcauagccuaugccguagugaguguuuagaaagauccuguuucauaggagguacacaccacagugcacauuugcuuauagucacugcccccacccaccccuguccacacucacacauacacaaguuaaaaacaagcaaacaggggauggagaagaugacucuguaguuaagagcagugauaacucucucuggggaccggaguucaguucccagcacccucauggaguggcucacaacugccuguaacuacaguuccaggagauuggaugcccucuuuuggcccuuacagguacccauacacacacaguaugcauauacucacucaggcacucauucauacacacacacaaaauaaaaucuuagaagaaaacaagauagaaacuuacaggugugcacucuugugcuagcaucuucuuggaugcuauggcaacaccaguuuucuccuuacuaguuaccaaucuccacguucaggcuuguugacugucacucagggugucugaccccuguggaccagagacccucaggagcaaggcacaguguugccuuuugucugagucucuguugccuucaugauauuguagaagacaacagccaccagggacaucagacuucuuaaguuauuuagauucaauucaaucaagucaagcuucuagacccucagucauaccagccauguuucaagugcuccuuagcuuugagugaacacugagcuggaccauacagacacaaaucaccuccaauuuaguaugcaauguccugcugggcaacguggacacauggguggcagagacuccaugugggugucuguuagguaggagagacagggaggacagccaagagcaugauggaagagagaaaccaagggacaguaauuccuaaaaaccuaaucccugaagccucccugcgcugcucucaugcuugccuauccucucuuuccucagagauguuuuagagucucacagagaugugaagacacgcauguuguguauacacaggauuugguggacuagaugcccauaaggacuccaaaugaacuagaagguuacaggacuggggcuggggcgguagcucagacuuagagaauuugcccagcauucacaaggcccugugcucaagcccaacacuccuaacagagaagaacuuacaccucucagcaggucucacauacugcuacugaacaggcagccauguucacaguuccugugcacgacccacagaccaucacuguggguccucaggauccugugcugguuagcuuuugucaacuugacacagacuagagucacccaggaagaaggagccucagcugagggauuuucuccauuagacuagccaguaggcauaugugacuugaccacccaguucacuguggguggugccacccccaggcaaaccaagaggagcaagcaguaugcagaguuucuucauugucucuacuucacuuccuaccuccauguucuugccuugacugccuaccuugucuucccuccgugaugaacuucaauauacgaacccuuucccgaaucgcuuuuggcugugguguuuaucauaguaucugaaagcaaguuaggacacauccccauuugacagaugaggaaaccaaggaacaggaggcuaaguuggaguaaagggaguguccgaggcaagcaggucugcuucuggaugccagaguggcaaucucugugcuuauaguccagucaagucuaggaaucauccugaaaguaccaccccagauccuugaaacauacagggcguuuucuuccuucucaauucacuuuccaagugucuucuggguuuggaagcugaacuggggccuacugaagaagccaugaugucuuugaauaggaucuugauggggguaaacaucugaucucuacagggaagaauaauuaauaauuaauuaucauaacaugacauggucauguaaggaaguaaggauucugguggcuccuacugaguuugacucaggacagggacuccuacagaaucucaauauauacuaauugagcaaugccaacgagaccaggcugauggugggcagucugcucuugauucaggaggaagcagugagcugaaggucaaagcuccuuuggcuaaaggaaacaguagccagcaucgcagggaaaauaaugguagagauuaccauaauacuucucaucccacuuccugugugaauaacugcuggguaccuaguugcuaagguucacgucuugucuguaaggaagacauuguuauucucaugggagcaagguggcaguggaguuucaggccugccucuuuccccaccagguuugcagaaagguagguaguagucuccaaacuuuugauacucaccccaccccagaagggugccaugguggcuucucgguuucaauaagagaggaagaaugcugugaguauaguuguucuugaagaagcagacaagccacaaaagaacaucauuuuggggaaaaaaaaaaaaaaaaaaaaaaaaaggcucaauuuuacucaucaaaaaggcagacagggugggggugggguacacacugugacucucaaagacuuggcugggagcagucaaaacacuccuaaguugcaaucuaugagauauuuuuguuacauguuauuauuggcgagggcugaauauagcccugauaauuuuucaguucagugaacagagagacgaggagccagggagguaggaggaacuaagguauuucaggagucagacccuucuaaaaauagggccacguuugauggugggagcucugagcaugucuccccuucuccuccuguacccgugaugugggcuuugaugucuacuccuuucugucuagcuugccugucuucucaguagccccuggaccaacucaacauguuagccauggcuggccuuaagcucccccccaaauguguuucuguccugaugugucccaaguuugucuguggucuuuccaauccuucuauuguuggaagauuaauuuauuuacccccucagcguccucugagguggugccuacuugggcacuaccuugugcccccuccccuauuugaauggacuguuuucuuccucucuauugcccugggaaaccauagcaagugacccugguguuccaguccucuguacauggcucugucuguggugcgggaccaugaguaucagagccaugggugacgucugguuuaucuuugauauggcagugacugaugaaugaagagguacacuugcugcaugguucuguaaagggauuugcgauaucccuucagggugccucaugaccaaagcgaugacaugggccaaggguugccuuuuguguaaacaccacacccacauguagagacacacauccauaagucucucaaggaucuggcuagaaaacugccacaagauuaugaugauguggacuccaagagcuggcaguucccaaucucuacugaauuaagucuccugccuuucaucugaaugagucagaagagcuuuguccaaggaaccaaacaucaccaagugagauaguuguccaaagagugguggugguagugugugcacucuuucucucucccucucccucguccccucucucucgguguauguguguguguguguguguguguguguagcgauauauuuauaagcaaccugaacauuuagcaaagaccucucuucaucccuguacucgugcaauucuguuuucaaauuccuuuaaaaacccagaaggaaaaaaaaaaguguguuaaauucaaauugccgcucuccuguagaauuaugugaagaaguaugccaacaaagguugaggccaguaauuacguggcagccgagcucuuguucuugauucucaugcaaagcacugccugaucccaauuagcacgggcuuguuuuugccucucuuggugugcugccuccugcccaccuuccggggacuccucccuguggguuauuuguucagacgcaguuccagacacaccacugugauuuccuucuuaauaaacacgauccagugaggaacggaagacaaugagaggcaccugcgcugcuauuauaacuucucguucccgcccaccagcagaguggggcuaugaauaagugagagcagccagucuaagaauaguaacagcacuuucccauaaacacacagucauaaaacuucugcucacaccaaggaaggacaggcguaccaggccgacaccauuguuggaaacuugguaggaaugucacucugagggccaaauguuugcuguccaugacccagccagugacugaggacaguccccauuccaugcuacaaaacaaaacaaacaacaacaacaacaacaacaaaacagccgagcauuccugaaauuguggcaaguccuagauaaugucagacgggggagagucagagcaaugguagagaaaaagauaaacaaacaaacaaacaaaaccauaggcuguggugucagaaaacacaaauuuagguuugucuuaguguaagaaauauguauuaaaguggggcaguggggagaugucuuggucaauacaucuccagugucugcuuugcaaguaugggaaccucaagguggacuugcagaacccacaaaaagaccugggugcagcagcaugcuccugugauuccagcauggcagaggcagagaauggagggucaggggacagggaggguaugcugcuguucagccugucugcauggauacugugagagaugcuagcuauggccacagugauuuagcccgacugcauggauacugugagagaugcuagcuauggccacaguuauaguuacuagguuuuuacagagauguuauccacaaggcgggagccuagagaugaggaccacacuggccaggugauggagaggagagcagaucuagggagaacacacaugcacacuguuagucucaugggggaaauugaguccugucucuguuucgcuguuucuugagggccuugcggggugggaacauacauucaacaaaucauuugccguuggcaucauuagaaggguccuucugagugucuuuacaugcgugccuaccaucguuauuucuaagacgguuugucacccggagcagaacaggaaccgcuuuggccuugcuggcucugaggucuuuuauuaaguuggaucgcugccuagcuuucuaguguggugucucuguuucuguccguguuacugccccucucgccaauccacucuuugggggacccauucuuugggggaaaaggagcaaauuuuagaagcuucucuagaaggaaggcuucccacaucagcaugcuaacucucaggcguccucuaagcccccacucacauccacuagguugcggcugccuccucuucaagcgugccguguaggcucuggccggagggccuuugcacucgauggcugcuucuucugggugaaugcucugccagugacauuacucccuucaggccugcauucaaaugcugccuuuccugagagcccugucuugaauacucccggucaaaaaugacacaccugagccuucucauuuucuucacucagcuuauuucccccacgguauuuauugaacaucugucccagcugucaacagaugaccugucuuugucguacccagcugccuuggcccugcuuaggaccaagaacugguuccccugugccggcuggcaccacgacaaacuuagccaguagagggcacuagagggacacuggaggccucaggcucuggugugagguucucuggaggcaucucccugugggcaacucaauccuguccccuaaacaggaaacguccuagcguacuccuccuccugggagacuccaagugacuuucauggaugggcaucuccaguguuauccugaccugggacuagagagcggcuucccagagagucugaccuucauggagucaccagccacccaguggcuuuucuccagccuuaccccuagagacccuugcaggauguccuucuagcuugggcacacugucucagcacucccaguggcagacuccuggacuuggaaagaguucucugccccuugauaauucacacccuacuguagguaguaauguuuaacuuggaacuuuuuuucugucaaaagaagugugacguuccaggcccccaucugguuccuggcugacaugguaaaugaucuauugggaacgaauacauaaacauagaagaggacuucaguugaggaggauuguaucuguuaauuacccauuucauauaacagucucacagaaugcaaaaccuuguuucguuuacuuacuaugccaccaaaggcuaggaugcacacucacuguuaugagcacugaacaguuguuuggagguuggaaggaaguagcaaaguaagaaagagaagcagggguaggggaagggaaacagaaaaagagcagagcauggauggauggauggauagauggauggauagauggauggaaggauggauggauggauggauggauggauggauggauagauggauggauagauggauggaaggauggauggauggauggauggauggauggauggauagauggauggauggguggauggauggauggauggauggauggauggaugaaaggauggauggauggauggauggauggaaggacagagcauuugggugaaugaacagaugaaugagcaacugaaggaauugauggauagauuggugggcagacuguaggauggaugacuggguagauggauggauagauggacaggugaaccaauggaugaguugcuggcuuucuggauggaugaauggauggauggauggauggauggauggguagguggguagauggacggguggauggguaguuggguggauggauggguggauggguagguggguauggguagguagauggauggauggauggauggauggauggauggauggguggccuuccccuaaacucucaguugucaguagauggucugaaagaacaccugguaugguucagaugauuuccauuuaaacuuuccauccuacuaccaacugauuagaauaucaaaacaccucgccaucaaaugccagagcccgaggaccacgccuagucuugugacccucuuagaggagcauaaucaagccgaaucgagcagaggcuggaagaggagagcaucgucaugccaacgccagaccuuugcggggcuuguuucaauucugauggucaacaugagugaguggaaaccugcccugccugcucuuugguauagcagccaucuuuuguuagcaugcagggguagugaguccuggccuccucucucuuugacuagacaguccugucuauguugccaccuaaucucuggugagaauauucauuuucucgcuccacagagagauggacucguaggcuccgaacugagcguuucauugcaccauaaaacauacuggcuaauuaaaauucuucacaauuagagcaacaaacuacauucuaagcgacugagcccauuuugucaccucuggaaacuauagggaaaaccuguguggagauuaguaagcucugaagggcuuauuuaguuauuuuuggcccucagaucuccuuuggcuggcuugggguuucauucuccuucgccuuccuuuuuuuuuuuuuuuuuuuuuuuuuccuacugaggcccuguucuuuuagacucaugcuguugucuguuuauaaaaauaaaccaaaaagaaagcuagaaaaucccaaagccacagauuacaauuaccuaguaaaacacauaauaagaauauaauacagcuaaugaaagagcaucaggguguguaauaccagccucccagauguaaauaacgacugucuguuucaauuacuguuuucuuuuuaccucaaauucuaaagagcagcggaggaaauuagugcccuugaaacucgaguugcuggaacguagccacaagccaagggaaaguggggaagagacaaggcaucggaguguuagaccuggauggugcuuucuucaaagaagaugaagacaugagggaacaacaacaaaaaucacaugaaaagaugcuugacaccauuaaugguuagggaaauagaaaacaaagucacaguaagaugucacuguuuuaaacuaagaaggcaggggcuggagagauggcucagcagugaagaguucagacugcuccuacagaagacccaaauuugguucccagcacucauagcugcuacuugcuuuagggggaguccggcgcccucuggcgcccucuacuggauucugacagcaccugcacucauaugugcacauaaccacacacacagacacauacccauaauuaagaacaaaucuuuuuaaauaaaacuaaaaccuaagggcaaauaaaaaaagaaagaaagaaagaaagaaaggaaaagggaagacaacugcuauuggcuaaugguuacgauaaaguugacucucacaggcugccagcgugaauguaagagcacagucuugacaaguguuaaaagguugaauguggagccauucuaaggcccagccauuucgcuccuagauaaauuuucaaagggacugagggcgauauuuaaacagauaguuguauaaaggaguuccuaagagcucugcccacccuagcccaaaguguccaagcaucuucaauaaacuaaacuggcuuuuguauaauggaauauuaccguuaaaaaaauaugaaggaacuugagccugucucccacaaggcuauggguauaucagggauaauggggaggaaagacuguaacaaucagaagucauggaggacugcugcuaaauacugucuccuagaaaugacagggucgucgcauccacaaacucucagcagcuauggcugccaacauaagacuugcacaggaucaagcuagccaacauucuaacagggggagggaagagacucacaagugggggguagaagggagauaugaucuaaacauacuguacucauguaugaaacuaccaaaagacaaagcaauguuagaaagggaaucuugccauguguuacaacagggacagaucuggaaggcaugugcugagugaagcaagccagccuagagcguacugucagacuccaauuguaugagaguccuagaaggggaagcuucacugaagaacaaaguggagcauggguuaucauggggaccaagaaggauguuacucauauuuaauacauacacaguuugugcuggagaaaauggaaggauacuagcuaugcaauagacacccucccucaucuacagaggaacauuccaagaaacgcaaugggugcccggaacugcagagagcacggcccuguguaaucaccaucacaccauggucauucaaggugucuaagcaggacagcgugagauuuuuaucauuuuacagaaggaagugugcuuucagaacuuauaaacugcuuaguuccagaauuuucuacauaguaguuucagggcaugguauacuguuaaguaccugaaaacauagaaagcagacgaaaaugaggacggguuccuaaggaccauggggaugagaugaggaugaggacagguuccuaaggaccaugggguugcaaguaaacgugacagcacugaaugagcaccuucacauauaguuaauaaauagaacauacaguugagaaauaguauguuuugacauaacacaaagaaggagagagagagcgaaaggaaagaaagaaagaaagaaagaaagaaagaaagaaagaaagaaagaaaggaaggaaagaaaggaaagaaaggaaagaaagaaagaaaggaaggaaggaaggaaggaaggaaggaaggaaagaaagaaagaaagaaagaaagaaagaaagaaagaaagaaaggaaggaagaaagaaaggaaagaaagagagagagagagaaagaaagagagaaagaaagaaagaaagaaagaaagaaagaaagaaagaaagaaagaaagaaagaaagaaaggaaggaaggaaggaaggaaggaaggaagagcgagccaccaugcaaccugaguauuaaauccacaggacaaacuaacaggccauugcuaagagacuauuuccucuuauguuacaaaaaaaaaaaaaaaaaaaaaagacuguaacaaacuugauaaacugaauucuucacuuuauagcucgcucacguggccaaugaacguuuucuaagguuggcaaauacccggagggaugaaggacagcacuuucuuucaguccugggagguuuaaauuuauugaauagagaggcaucuccccuuagccaugagcucuucuuagcuaagaugaccaaaaggugccucuugcuggacuggagggaccucucucuccaugaaacaacucuuccugacaggaacacugagauguuuaauaauaugcagacauauuuggagacaggcaaggggggggggcugggagagcaaagacaauauggcgccccacaaacugcuggcugugagagaacacggugccucuucugugaagaugaugaaaugacacuucugcugaagcaccagcugaucccacuuaggucgccacuucuggacgccucagaccagauccugccugcauccuguacagcuggugcauugcaagcucagccuccugggguccagggcacagcccagcacuugauggaggggaggccggggagaguagaccucucugguucaaggugcuaggguccgcacaaucccauucagcuuugcccccaaacuacaggacagugaggaaagggggcaacagcuccacugugccaacaaacaagcccuggacuggucuucauuaaacauggggcuccagacaaaauaagaggggcauacagaauaaccaguccuguugggguagaggagaccauucucuucauaaucaacgcauuuaggaauuuauuucuuguaugcuuggcuccagguugauguucuguuauucccacccugacggcauccugccaggcacgggguguggguaucaguggaugaacaugaugcucuuucaugaaguccuuccucuuuugcuucucucaugcaccaucccucucaccuagcuggucaaaagcuaagucagugggaaucucuugucuguggcuaggugcaaccugacuaucgaaaaccaagcaugcagauggcuugaucauggcucagccuccagcucagcaaggagagaugccaccugaacuauagcccuggggagugacagaaauggacauuuuucuucuaaacaauggaauggacggagggagggagggagggagggagggagggagggagggagggagggagggaggggcggucaggcagacaauguaggcagaggaagaagacgcuuucgggaauucaaccacaaacucuucaaaugcacaauacaaauacagcgccuaagauguaacuucuuuggaaugaagggaaaugucacacacauacacacacacacacacacacacacacacagcaucagccuuggccaucucaacaguccaaugaguguuucuuaucauuuacccaugggcucagagagguccauugccacacucagaaucacgcagcaagagcggacagaguauguaccaaagcugccguucucaaccuccaugguccagaacaacaaagaguaugguaggagucuggggucugagggcucgugucacacacucagauauacagcugaguagauucuugcuuggaaugguguugaccagucagaggauacagaaggguaacauacuuggagaacacaugugaggcaaugcaggggugcuuauacagucuccccaggguuaggguucacguuuaguaaccuuguucaguucuucugaugggacagaaucuugcuuuagguucaguucaucucuagcaucagcaucuugcccaccuccugcuuacaugaaaggagaacaagccuuggucuucagcucuuuucuggcucccacaguuugcugggaugaacaauaucugucuauaguuauuuucucuacaucauuuaguuuuauccuuaucuauuuuuggcaaaccauauugaucuuugcuugguaauggagauagaaagauuccuuuuaaaacaaaguuaauaaaucuaugaauugauuuagagaaaaaaauuucaauauuaaugaaaucuuaaaggcuuuaaaaauuaaauaagaaggacacggagggaagagcaggugaagagugacaggccuuggaaaggaaugcccugcauggcucagcacaaggucagugcugcgagcuguaauucuguggaucucugagccaccagaugauggcguugggagcuacagccucugggaggugacucaagcaugaagguggagcaccuucccccugccccauggcuggcaguauugcccuuaggaggagcacggaaugagagauugucucuuguucuuugccuucuaaagacacacuaagaagcaaccucugaaacuaggcagagugcccucuagaagaacuuggugcaguggcuacagugcaugugagcuucuggcuuccagagcuguagaaaaugagucugugacucagcacucuggcugugagauuaauuuccuucauggaccaggcuaguaucauagcuaucacagggaaggcuccaacaguuauccauguugcuuaccagugaggugggucagacgguguucucaugaauagggcaagaugccugaaagaacaacauuaaaaugggagggggggcagcauuuauuucugcuuacagucucagagagcucaguccagucaggcguuauguagacccaaacauuugggcaaagcaucaugguggugggaacacgugguagagaagccucuuucccucauuucugacuggaagcugagcaagaaacaggaauggcugagggcaagauacaagagccucaaucacgugccccaaaugaccuacuuccuccgagagggcuccgucuccuaaaguuucccugaccucccaaaauaggaacaccaucuugggacugaacacuuaaaccugaaccuuugugggacacuaaauacucaaaccauaauaacaggguguccuaugucccacacagcugacaccuucugucuucccggccacucuucagacuuuacauaacaacaaucccaaaucccagagacuaugugauaaacucagucugcauggggagggaaggcgccggugguaauuccuugagaaggcuuaaaccaaaacgaacuucaauauuuauaagauaacacuugcaggauuaacccaucuauuuguuaaguagguaaagccgcuacccaugaaaaguagugguuuuaacaaacucacguagccuggauccuguugggccaauuagauaaacucugggggaaagaggucugcaguggacagugucugguaagaccacacuuacuaaagcaugccuggcuuuguucucuccucuccucuccucuccucuccucuccucuccucuccucuccucuccucuccucuccucuccucuccucuccucuccugguuuuuuaaaacagggcuucucuguguagcccuggcuguccuggaacucacucuguagaccaggcuggccucgaaucuauagagcucugccugacucugccucccaagugcugggauuaaaggcaugggccaccacugcccagccguaccucauuuucaguugguaguuccaaauaggacaguuuggagucuaauuuggcagccagaaucaguuuuuuuucuaguuguuauagguaucuguuguuguguaacaaaucauuccaaagauguacagacugcaccaauaauagacaugaauauuucgugcagggugucaugacuaagaaaaguaugagcugcuuagcuuggggauucuggcuuggggccauguugguagcuuccaucagaacuagagccaguuguagccaucaaggguucaguuagagcucuggaaucaacuuccaagauggcucccucacguaggaaguggaaguggcuggauuccucuccacacaggugacugaguguccucacaacacggcagcuuucucucccgcacagugagugauccccaugagugauggacaagacucagaaguugcaucuagucaucucugcagauccugcuggcugugcagucagugaacagaagacugugcaaagacagcaagaccuggaauggaggaucacgaaaccaucauggauucuggguuccuuguucaccaucccaaagcuagcuggaauaggugcucgacuguguuuuaaaagaagucuguauggcugugcucaugagccauccauuugcauuaugagcuaguuggggaagaugccuaguuauauggccuggguguuuguaaauauauuugagucucagggucauuauucugggagcuugggggcaggaggaaaaacaugaguauacagaaaacacguuacauuacaacaacacacucaugaaugcauguguacacacacacacacacacacacacacacagcugaaauuuacccaaucaguacaaagcaccaauaacuaaugagccuccuacaggaauauuauuaauaccucaguacacuaaaaauaauuucuuuccccagcuuucucuguguuuggcaggauauuuggcucuacuccaucuucuaauggcccaaaguaaacuauugccuaacuaaucuuuuuauagaauccuggacuccguaaacuucagagcauccugaauuaugccuaagggucuucuggaguucuguccugucucaacagccuucacucuggcauccagagcugcccauuuuguugauuuggggguggggguggggguggggguggggugggguggggugggguaggauggagggagguccaaauacacauuaaguaagcacaguuuugaaaagaaaccaaagcauucauaaaacaccgugcacaugacagguccagcugagaaggacaaagugcaugaggucaaggucccugcuaggguuugacugaaaugcauccagguucccccuuggcccagcuggggaugcuguucugugaguuggugaaggugggaccuacuuggagggagugggccaaggcaggcugggacuuaagaguuacaguccagucucuggcuuucuuucucugcuuccugguucucagucacguggucuuaccgccaugaacccugccaugcugucucagucuggauggaguuaaacuaaccccuucuuuucuugaguugcuucuaccggguaacugagggugaaggaggaauacaaucugcagcugucaagagugauccauguucaaguuccccuaguguguguuauucauucaugaucgcucccuucccccuuuccaccacccauggcugugaggcugagaccucucaacuaaagcuccugagggaggucuucacaguuggaaagcugcuaugagcaugagggucaccaguggcuggaacuuggagaggaacagggccagaugguugaaugauuggguaccaaaagacaguugauuuguuccagucuuccacaagagaguagggagaugcccuugacgcaagucauuuauacaucacaaacaaaaccaaggagaggagagcuugaagguuccccaacccaaagaagcgguaaacuccugaggagagagaaaagcuaauuacaaugacugggacauuacucagugaauccaugaauuuaugaaucuaaugaccacaguguacuuccaaagauaccugcaauacuuaaguguccaaacaaagauuucaaaccaugcuaugucacuuuuuaaggacccacaguaugugaacaauggaaccucagcaugaguucuucucacuccauccugagagcagucuugugagguuguaguacugaguaacaggauuacaguacuaggaaaaugaaacaccauaugggcgggaccuggaggagcaggacucuuccauggucaaaugcgaucugagaugucuugaaaacugcucuuaagaguguccuuuuacaagaauggcauggacacauuuacaagguauguuguagcccaaucugaaggagcucuggucaugucuuuggaaaguucccuuccccgguaaaaaaaaguauuaacuuuucagguggugaguugacugggaauucccguggaagguagagagagagagacaccugggcaucucagagcaagaugacugaccaacuaauguggggauguugaacaguguacgagcacuauggcuguccugguagguauuaccuaaugaauauuucuacccauucuguaucaucacacagacuuaagauaauuagcauugaaagccccuauggucccaaaauaggacaugacccaagggagagcaacuaagccugcuuuacccagaccuagaaucuagacuaugucgcccaauguagucuucaucaucaugugguaagagcaagcccuguaccuaggcaugacaccaccucuccagcagaugaggaacacccauggggcaaguacuguaagcgaguuaucagcccucugcugaguaaauagagcuccugaccuugacuccucgacucuuuaacugaaggccuguagacccucccaagcagcucgccagggccagaagcccaguugaucaugagaacaccuccucuuguuuuccuaaccaaccacgacaaagaaccauuggcuguacugcucagcgguuaaagcagacacgcaaacacaaaucugaaucuguaugccaauggccgcaguaaaaagaccagcccauauaugaauucuagguuugcuagaaagaccuugucucaauuaauaaggucgaaagaugaucaaggaugauuaacagcaucaaccguguacagcaacagaccuucccaugcacacacacccacacauacguaaaacaaagaaagaaaaacugugcacagguaaacagaaggaaacccauagcuaacuauaccagugcagucaccggugcugagggauacaacuagaacuucugaaggcuuuguucaucucuggucggugggucagaacaugagcgucuuccuuaauaaacacuaauugucuggauaaaagaaaaaaaaugucccaaggguacagcauucaagaagaaaggcaaaaggagacagcacauaugaagaacaguuuggcucuuuuuauucugugccuguccuuuuagaagcacuaaucuaggaauguguaauguuccacguauucaauagcuaugacauguaugcuugcuaaccuaacagacacauugaucucaggcugucugcagucacacuggaugccuacuaucugaaaauucacuaaguaccuauccacugacugcagacaggggaaggcaaggcagcaauggagauaacagaacaagacaugggacuuccggauggaggugggacuucuggauggaggugggacuuccagguggaggugggacuuccgauguaaagauacuccaggggccaaguucgccaauguuuucuguuacauuugcucgaacgucagguuagagcgaaaaggacuuagaaguucuuucuguaugccggccuauuuuucuccagcuuuugguucaucgcagacuauuuacuacugaugcggagauguaaggagaggacaacaguagaacccuucuggaagacugacuucuagauuuccuacugaggacucucagaguggagaaagucaaauuugauaccaaauaaccacgugggauauguuugugagcuugagguguuaaaggaagaguuuauaaaaagccuaguuaaauauaggaaguacagucgcauuccagguaacucgagauuugaacauccaauacggcuuuaaugcaggcaaucuaguuggcccguuuucacagcuguauaauauauugcgucuauuuuaagaucuguaauuuucccuccuuagcuauuucucaacgagacccgaaaacauuuccucucgccugauucaugcuccgcuauuuuccacaugcacauucuucacuuuuauuuuucucuacuaaaauaaauauuuaccuaguuuauauaucccuaacaguaagggugggggaagcaauaaauaaacaccaaacgcuccacgcugaucuaacgggcuaucaacuccaaaccuaaauguugaauaucucgguccccauccccacacuguuguuaacauggguaacucaauguaaaaagcuaugggauuuuuaaagguuuuaauguuuuuaauuugaacucuuaaaaagcccccuccccccuuuccucucugcauggcagggaauauaaguccuccaggacucacuuuccucaucugugcagugggaccacagccacucauggaccagcccugacgaaugggaggggagauucccauaaaagugcccaaccuggccaaugagaacucccacacggcugggcuauguucagcgacugauaauuuuagacugcacuuggcuaacugcucugcucuggcugcuacggauaagcccugcgguccuccguuucauucagguuuggguuucacuguggcccccaaggaguauaaagaugaauuauuugauugugaggagauauaagagaucguguguugggcugcuuugcaaaucaauucuccucccaaagaugcuccuuccugcuugagauauacggcuuuguacggauucuggcggcaucuguguuugucaugucagagggcaagguacaugcagauggaauaucacugagcgauguaauccgagugcacaugagaaaacagccuccgagggggaacccuucacaguggcccugacagcaccucaaauaagcauuuaccuaaucuccccgcugauuccuaucaggguucagugacuucacucagcugccagcugcuaaccaguuagggcaugcugauguucuuguccacacuguaauaagaucucgggucuuucccauagaaaauuaacuuguugcuaggguggggcacaagcccgagagaagagugaacaucacggccaguaggggccagguuacuuguguucuauuuaucaccgaaucccggggaggggagguaucgaggagaauguccagcaaagagaagguggagacaagcaaaugacuggccagcaaaggcucaucaccccuacuaacgggcaauagucauauccacuuauaaccuuugggcugcuuuauagaugcuggugaugagcugcucauaagggcguagacaaguuucauucagucauuggauguauacugauuugucuuuuuuaauaaacuggagacagaacuaggacaugacucuggcauguaguauacuuuaaucuccaucagguuauucccaucacaggacugccauauaaggucaugaacucauauucuaggucagcaaaagcagaaaauaagagggggggguuauauaaugcacucagugccccccugggaccccaguuucaccuaccgaaguuccccaauguuuuccuuuacguucuugggcgcugccaccauuacuuuuguguuaguaaguaaacuaaagauggcuggaacacaggugcuaccccgccacagcacacggucugauuagcaagugacuuacuggacgguagcguaugcagcagggacacacugcacagcgggauaacacaguucugaguuagacagagcaugauggccugagaguacaccgugcugcucaggguuguacaaugucacaaauuacacacaucccauucuggagccugagcagcaucacugccugcaacagaagcaagccacaucuuacaauuguaccuggagggcuggagagauggcucagaggcuaagaguacuuccuacuccuccagaggacccuaguuugguucccaacacccacaucuaauggcucacaugccuauaacucaagcuccaagugggugugacacccuaccauaacacugaacucaugugcacaugugcacacguacaaaauccugucuuugaacacuugguccccagcugucagugcugcuuuggaagguucuaggagaaaaagaagaggcauucuggggggagguaggucaaugggaugggccuugggguuuuaccacuuccuauccacuuuguuuccugacuacagaugaaccucgaucaguauucucccacuucugacaagucuuccuccccaugauggauggcaucccuuuggacuaaaagaaaccucccuuccuggcgucggucagguauuacaucacagggauuagaaagguaacgaaugcaccucagcuccuaagaucauccugccgauuucgggccuaagucuaagucagcuuucugguggacacugcuuugauaaguggcccaacauccaugcauuaacuaagccaaaaggugcucuuggaccaaucccagacuggcucuccugagucacgacuuccuuggagucagcucuucuccaagcacagauguaaguggagacacguccuggguuuucccuguguccuuucuaagcaggggcuggggcaggacucugcucacagaggcuuaagccagggcuggaaggaacagcaggagaauuuccuuuccuuggcuugguucugucacaauauacauuccuccuauuaaaauacagugugguuuuuuuuuuuuuuuccaaauggcaugaucuacuucaaccgccguauuucaucugucaucuagcccccugccuacccugaacauuggucuuuuggaaccauuuggggagaagggacaugaaaaagaagaagaagagaaauauaugauggggguguggcugugagaggggugggugucuaugaaaauuuaugugcugaaaaacagcuguaaaauguuuaauguuucaaugaacguuuuauguuuacaauaaaaaauccuccagccaagaagggcuuuaaaaguuauaauucuagacagugccaaaggaaaaaaggcaaggggaacagauuccacaaagccuuccccagggauugacaacccccaccgcaacacacacacacacacacacacacacacacacacacacacacacacaccauugaauaauaaaaggaucucccuucacaugauggauuuagcacccagcucaauggugagggagacagggaaaaccagucauagccccaggggagaugaccaacaagaguggaaauuuuacuuguuccuucugaaggccuuggcaauccaggcucuggaaggagggguagaaggaacagaucaagacacuugguguagccggaugcucguucagaccugaccagugagucaguucacuaacagugagacugacuguguguaguaggcugguuuugacagcgagacucagauucaaauucaaaaauccauucuaaggguuaucacuguggcuccguggguaaaggcccuugccgcuaaaucuaacggccuaaauucaauccuugggauacacaaagugaaaggaggggacuuuuuuuuagaaguugucccccuuccagcaacccacaaacacaugcccuucagcacuaaaaucuaacaaaucucuacucuaaacuggguuggacucuuaguguguuuuuuuuugcugguuaugcugggcauugaaccuggaacuuugagaacaccagcgaagugcucuaccgcugagcuacaguuccaguguuuuuguuuguuguugguuccccacccccacccccaccccgagacaggguuucucugugcaauccuggcuguccuggaacucacucuguagaccagguuggccucgaacucagaaauccaccugccucugccucccgagugcugggauuaaaggcgugugccaccacacccggcagcuuauuguuuguuuguuuguuuguuuugaaacgaggucucaguaggcagcccagguuguccuugaacucaugaucauccugccuuagucucugaugggauggcagaugggcacuaccaugcccauauuuuagugaguucuucagucacuuaggauccagugucuucaucaaccaaaggcacacagaagagcaaugggcacuacuagcacuuaugggcacuacuagcaccuauccacugcuguucucucuacucaucacaccuccuaggaauauuuuagguauuuaaaaucugcaaugaacaguguuucuucugagcgugugcugaguguuaccaucuugacaagccuuguuuuggguacagagcacagugcaaggaaguucuuuaggaaugagggaaggcaaaaaacgucauuuccauggugacagaggacagaccccuggccucagaggcuaauggagcuccccacuuauauaagguacaugacagcauuuagucucuagugcagaauggcuguggccugugugguggcuuguaggagagggagccuuacagacucauagguuugcauaucugauccccaguugguggaacuguuacggaaggaucaggaucuauggccuuauaggaucuauggccuuauaggaucuauggccuuguacagggagauaugucacugagggcaggcuuggagguuccaaaacccuguccauucccaguguggugucucugucucuaacuugcagugaaagauggacgcucucagcuguuccugccgccaugccucugaaaccaucagcuuaaaugaaauacuuucuaaacuguuuugaccgugguaucuuaucacagcgauagaaaaguaaacuaagacauccugccaaccuucuugcuugagaacuguaccaacugugaaugaccuguucagagaugaagccuuagagacugucaccaccguucagugacaguauaaauguggcuuccggggggagagaggaggcugucuccuuccccugaugcagugcacuuccugcuuaugaaccugcaugugccuggcuccuggcugggcugggaacaaucgggggcagggaaacgauguucaugagagacucugaggaagcuccacaugcuaacuccauuuuuucccucucucugggggguuccaggaaguauguggcccuuuccuugauaggucaccauaucuagaaguccuuaguaucuacuauaguaggauggucgcugugacaagcugacuaguugcuuggcacuccaagaaguuucacaagcacaccagauccagagauaugguggacaaaacucauguugucaaccaaagggaaaagaaaacaagguugcugaaacccuugagaacugaggccuaagggucacaucagagacugcgcagacauaaacaguuaaauucaggacacacugugggccggcuaggcugcugcagaacagcggcuuauacaaaccaugaguacaaacauauuuacucaugcauacauagauccaugcauacacacucacucguacauaccucaugcacaccuacauauacauuugcacacauacacaaacacauauacacacacaugugcauacacauguauacauaugcacacacaugcacacauaugcccacacagguacacacauguauacacaaacacacacacacaaccuauauauuuaucuacacauaauguauucacuacuacacauaacauuacaaagcaguaaaauaaauaugaacuaaaacaggcuguaagaaaaggcauauacaaguaggagauucugguuccuuccaauacccuuguucagggucacagggcuucccuauggaaaacagagauggauaagcuacccagucacacucagaaugcuuccucgcuagaaauuauuguuugugggugauucagaugcacgugggcaucuuuuuauuugcuaaaucuggcaaagcucaggggucaguaaaugcucucguuaauacagaaaaggccgcaguaaauauuccaggcuuuugcuggccuaucuuugccacccacugaacuaauucaucgucaugugaaggagcacuaggcagucccuacauaaguaagcuaucucuguuucaauaaaacuuuauuuacagaaccaagaacauguggauacuaagcacagccugcagcuguggcgccccugcccuagggauaacaaagguacagcccaugugaaagacgacuccuggucuguaagacacagcgccuguacuuacaugucuacaguaauauggccuuacacugaaaaaaaaaaaggugggggguugauggauauuuugugcuuucuguaggguuucaagucagggccuguaaauagacagagaaugauaauaacuucauuuaaaacuggggagguugagaugggaaacgaggcuaucuagccucacauauacauguacauaugcauacacaugcauucaugcacacacacuucaugcauacacgcauauacaugugcacauauacacaaacacauauguauacacgugugcauacauaucacacacuugcacacauaagcacacacauacacacguagccccacacagguguacacauaccacacacacaaauacacacauacacaucuaaacuaugugcucugguggaguagccuuuauugugucaaauuaaaagcuuccccuuccucaauuacuagcaauucaaucggccaauuggcagccauaacacauuaaccuuucugccaaaucaauuucaccaaguccccuuccagcacucagagaaauuaaauggcaccccuaugccugugaggaggggcacacugucugcacugccuauucuagcuucccguccucaccuggaacucuuagcacaguuccugaccaggguccuucuccuuagcagaaugccaggagccugccuugagucguuucccguauccuacaaccagcuggguacaaaggcccaaggcaguggaugcugccaaccacuauccacagcgcaggccucacaaaccucacagcccuguugguuuugcuugagauaaaaccaaagucuugcugucacaaguccaggugaugaauacauucaccuggacacugaaccaacccgcugcugaagucacacgggugucaugggagacgccagauccagcccuuccugccaccucuggcugggggcaccugggcuggcuuccuaagaaugggaggucaagccuacaagugauggcacacaccuuugaucccagcacuugggaggcagaggcagguggaucucugaguucgaggcuauccuggucuacagagcaaguuccaggucagccagggcuacaaagaggaacugugccucaaaacaaaauaaaacaaaacaaaacaaaacaaagcaaaacaaaacgaaugggaagucucagaagauaauaaggcuguuuucuagcuuugccaugcuggcugccuagggaucaggugcagacauagcaacaugcuauguuaaaaccaacauaugcuaaauuaaaaccaaccacaauaauaaaaaaaaaaaagugugaaugacuguuuauggaugagccagaauaagaagucucuuuacacacacacacacacacacacacacacacacacacacacacuccaccaucuuagagaggugagagaauacacauaguauuguaagaugccaguggcuuuggugcaguacaaaucucauuauuucaaaauucucucaugccaucccccuggccagcuagaacccagauuucucauuuguaaagcccagagucauacacagagagaaucuucgaauuacaaguuauguauaaauaccgaugugaugucuaauuacaaugguaaugaaaucgcagucaggaugauggccccagcacacgcauaccucauauuuaauauuaggaugggggaacaugaucuccccaacucuggcagcuucccaaauccagaaaugacugcugcuuccccuccaaugacagccuuaggaacuuuuaugagacacgcacagggccuugcagaaugucacuuuugccuaacagagcucuuucuuugagagacaggaucagaaccuccaacuuggaggcagguggcagccgccacuuagaaggcuaccucguguugcuugaggccugaagaagggcagccuugacugugacagcagagccccucccuguugaucugggcucacugaagcaugcuaacgccguucuuuugggaugggggaaauggauugagagaaaaaaauauauggauaacgggaaacgggauugugucgccuggguaaagggcaggugagggaauaguuaaguaaggacucagccacagggugcauucuggacaccacuuccacaaaugugaccuuguacacaugacuuucuguuaggucagcucagggcaggagagcaaugggagucaccugaagaacagggucaggcagaauguccucuguggcacauggcuuucaaaccuucguccuaucuaucccagugacuauagaugcuuggugucaccccuccccaacuuuuugcuuuguaaagauauucucugcucuggaaucaguuucugggcuucuguggucaaggcaaggaugggauuguacaguaaauaccaggaagccauuuuguguugugggggcuuauaacuaaguacauuaugguugucuguaugggaugugaaugggugcccaauaugggaaugagagaaggcgcgugcacgugugugugugugugugugugugugugugugugugugugucccuagugacuacauggggccacagaaauggaauccacuugugccccccaucggacuccuuuuucuuggccaucagaucuuuuccuaauuuuuauggucucccccagagaauuguaauugacugauagccuuguauugaaaaaaaaaaaaaaaagaaagaaagaaagaaaaaagaagaagcaaacaggcccugagcccuggguuuaggcccugggguuucugacucuacugccuuacuuaguucauggacuauaaacuacacucugagaaauggguuguaucuuuccugucuccaaaccagaacagaggcaucaguucaucuuggagauugagccugcugauccuugccuccuuccauccuuucgucugucuggucucugugcucaccgugagcuggagcugccuagaagugaugcguguguauauugaggaccagcgccaagaagacacaucugaugagucuuguuuauaagugguguggaugucuucucagggguuucuuaugguucugaggugaccaugccuuguguaucagggaggggcaaauucccaaaggcagacagguguccuuaagagaagggcuaucugccugggauacgguugaguggcggggaauuugucccauaugagggagaaccugaaucugacccucagcucuaaagacagaagagagaacgggaccucguuaggaugaugucaaccacagugcccaccaccagagcaagauaagucuacccaguggaucaggucaccuguggaaaugauagcccaugccagaacacccccaagcccccucccaucauuuugccaauaaggaaacucagcaacuucuauuuccacaaaacacggcagaccacaucaugugcaaguaccauccagcacagagaacacugggcucuggcucuagcuauucaaaugaccugcagucuaaggcaccuacuaugugcuaaggccucuuuacuaccccucugccuguggagacacuuaggagaaugugccaggaauaagacacaucuagaaaucucugcacacagaaaaugucaucaagucauucgcaacugcuuuccagaaagaaaaaaaaaaaaaaaagccugcuucagggugcagagaacagacacacacgcaguguugacgcagggcucacagggugugauuuucaaucccaagggcggugaaacgguuuugauguaaacugagaagggacuggauggcguuuucuccaaggguuuugucuuccugucagaggauuuugugugagugguauuggcuucccuaaacuucccaggccauggugcuuaucccuguacuagcaaauagaagcaauauauauguauguauguauguauguauguauguauguauguauguauggugcauuaugcauguauggugcauuauaacaauacagcucaaaaccaaagugcuaaaaaccgaucugccagggagcugggcagguggcucagaugguaaagugcauagcguacaaacaugagggccugaaccuggaccccucguaccuccagaaaugcugagcagugugugggucucugauuuuagugcuggaugggacagacagacaaggacuccuggggcuugcaggucauccagucuauccaaucagggaacuccagguccauugacccugucuccaaaacgacacuacaccuauacaagacuggcccugugaacaaucaguuuuggguaggcagggagcguucaugggguccuuccccauucugcuauggauaacauucugggaaagagggagucauugucuuuagcuguccaccuauacaacugaggcuauaaagcuucaagagauaacuucaaacccaugguuaauugcaaugggucauaaaguaaaaaaaauaaaauaaaaacaaaaaaccuaauagauaggaaugugagaacgagaucucuagggaaagcggguggcaggaguaggggcaggcuugaggggagauaggaugguugugugugagagcagucaguaugcauuaugcacaccacacgugugaaacuaucaaaggacaauuuuaguuaauaaaccaauaaaguagcgaacaaccaaggaacauacuugauauugacuucuggcuucuauccaugcacacacuggcacauauaucuaugcuuguacacaucauaugcgugaguguguguguuuaguguguguguguguguguguacacacucaaucauacacacaggugugagugcaccugcauacaaaugaauuaaaacaaagaugaucugcauuuagaucuauagcacagaaaggggcaagauuagaggaggaaacgagagaguguucagagggauaguugggaaaaguuacacaagugaggacucucugcuuucccuugaaggcagcagagaagccacgcugcuaguuaauagaagagauaacgggucugaggaucguacucgaucaccuugggcuucguucuuugcuggaauccagggcuguaaaagaguugcucaccuagugacgagcacuugccacagaucuaauuacagauuaugaaugaaagagagggggggggcggaacaggcagcuguggcuaccgugucaccagagccaccucccucuuccugcuggauggccuggauucuugcaaaagagaaugagguugaaauaggaugaucuuacgucucagguguggcccagagaugagcucacacagucuguuuauccuuuuccucuucuucaagccuagcgcagacagguugggcuaaguuccaggacagauaacaucgacauccagcaauaagccacauuacacugugucuacagcuacaagcaaauccguguuauacugagggcugaauguuaaaucacugcaauuuggaggcuguuacaucaacuggcucugucugggacaagaacacagggcacacagcaugcuugcuuuuggcuuugauauauugggaacgcaaugugcaguuguccagguugaccacaaagagagcucugguggccagagcagcagagaagauacuccucagaugcucugggagagaauggaacaccucagugaugggcaagaagcaagaaaagacaagaaagcagggaagacagaaacacacaggaaaaaugaggcaacaaauauaugcuaugccuguaguuaauauauagcuacaauauauaauaucaaauacccauuuguuguuauagucuggagcaagcaggagauugcacagccagcuucccucaucucccuccuuuuuuccuuucccuuuccauguuuccuucuuuacucucuuccuuuccuucucuucuuuccucucucccuuccuacccaggaacucuugcuauauagcaagaucucagucugccuuauauaccagaaggcugggauuacagauaugguccacuauauccggcaaaaaugcuuuuguuguagacagacaaugaauauguaaaucaacagugggcuauaaugugucuaugucacuuaucuauugcagaacacaaaguggugccuaaaucauuagcgaugguuucugagaauuaugggcugagaguuauauauguagucaacgcucaaugacccugaacacauaagcuaagaagguacaggagccagcgguggcaaaccagauacugcauggccaggcucuaggcacuggcuaugcagcgugccaccaagggacaugagcucuggguuugacaauagggaaagggaaaugaacuuaucuuuugguuaaaacaaaacuaaacguguguguguguguguguguguguguguguguuguugaugcacagugcauaaauguguacgcauaagugugcacuaaggacaaucugugggagcuagaccuuccuuuccacccgaugagcucaggccaucaaauucaggucccggagaaaaugauccagugugcuuugggaggaagaugcucugcccacugcucugauaauggagcuguugaagaagagcccuaagcuucagaggagacaagcaacagcgaccauggaagcuaaugcauguucacgcuugcagaacuguaaauucaagguuuuuucuuccucuuauauugccagagccucaacucaauuuaagggucaagaaauugaaaugcuggcagacucccugggaacgaauauggcagcccagauccuaaacauauggcugcauuucucaaagaugcacugagaugagucccugagcgagcaagaauuagggguuccuaaggacuauucuagaacuacacucaucuaucuaucuaucuaucuaucuaucuaucuaucuaucuaucuaucuaucuuucuaccuauccaucuaucuaucuaucuaucuaucuauccaucuaucuaucuaucuagauaagggggaaagaagaaagaacauguauaauuugagacaaaaugagguguaaggguuuuagugugggcuucucauaacugagacugucgcugccaaacauaauuucuuggggaaaaacacgaggaaacaauugagaaagagcuguaucacugucaugcucagauugucucgaagaugcucuaggguugcccccucacacacacacacacccugcacaucaucuucaagucuaugagaccuuaccgauggggucuggaagacucacauccauuuccaaacacuaaagguucaaaauugagaugagaagggaugucgcuaggauggcuggaagggacgggauagcauugcggcuugacggagagcggaacaauuaaacccaaaacguuguuaucugaacauagucauuucauauggugacgcuuuuauauguaaauuauuaaaacucggaaacaaaaaaaccuuucacuuuaaauugaauggcgacucacuuagaguaaaaacgguuuggugaggacgugcuuaaaaugaaaauaaaacacuauaaguaaaaggaaucauauuuugcagggagaaaaugcaaauaaaggcuguggguuuaccccccuuguuuguuuguuuucuuuuugauugcuccaugcuauaccgaggaaaagauaauaccgcuggcuacagcuccacucuuaacuuucugcuuaaagcuaagcgauguuuccauuugguaaauuauaacuguuacccaaaccaccucagaggagaggcuacacggaaauauuaucaacccgagaagacagggaaaacguacuuauuugaauaaagaugccuauuuccaaauguucuuucagcaugucuggggaaaucucuuuucuuuggaaacaauuauacuuaaaaucucccuccuauccugaaauaaaauuugaugucaccugaauagauguggcgaagguggucucacagaagcaaugcauagcaaugcccugugagaauccuggagggacuuuacuucuuggccgccaucuuucucauggugccuaggaucugagcuauacacaguuaaugcuacuucaagaauauuacagacaagaaaaugagacugugagaggaaauggcuucccugaugcccagggacacuauaggauagguuuagcucuccagccaggugugcauccaucacuggggucauaaccucaaccaaugaccauuagcucugcuagaaaggaauucagcugcuccauuuacccacucaauacuacugcuuccuacagugucugcuaccucacagguuaacaguugugcagaaggaaugaagguuguguuaacagggccacgggagccacuuuuccagcucauggcuugcuccuacaugaucuauguccauucuucacugcuacccucuugauuccaaugacuucucuauuucccacuucugcacauaagguagaauuguaugcauugaacacucaauaaauauuuuuuagcucuaaaaaauuccuugggggggggaggaacugaaccucuuaaacaauauauacauacauauaagcauaaguauauauauauauauucauauauacacacauauacauauauauauuuguacacauuauauaaggcauauguuuacauauuuaaaauacaaucauuuagagagagaugaaagaaggaguaggcacgauggcaccugccuuuuaucccagcacuuggagaggcagaaguaggaagaucucugugaguuuaaggccaaccugcucuauauaccaaguucuaggccagccagggcuacauagaaaaacugugucuucaaagaacaaaaaugaagggcacacacacacacacacacacacacacacucuauaaaauauaugcauauagaucauauaaacaggcauauauuuuagaguaucaacuauuaaauaaaucauacauauauuuccuaugaagaagagaggaccagcaagauagcucagcaggcaaaggagaucucugcuuagccugagagcugaguucagccaguauccagacuaauacauggcaggggagaaccaaguuccugaggucauacucuaacucccacacccccgccucagcagaugcaugcgugugugcaugccucggaaaagaguaacaauaacaauaacagcagcggagauggacacacaauagaucaaugucauuaauuuuuuaaaaggcagaaucuucccacagcaacaaaauaaauaaauuaaaaaaaauaaaaggcaugauuuucuagcuaguuaaucccuugugggggaguaucauaucuucucuucauguguagaacaugggacacccuccagacuuaguuacaaaguuugacucugauucuaaaguuucaaaagaaaaaggaaagaaaagaaaagaaaagagcacuaaauucauuuagcuucuaguaauggggggaacagaccuccugugcugguuauuuuuauuauuauuauuauuauuuuggcauugguuccuucaugaggaugcgcagugagagucccuuguggaauuuucuccugacuuggcaucacauauggccucaguggcaagacagcuguggagcuacguaauuguuuacaaaugugcaaaauaacuacccaaaccaauaaaaaauaauaacuugggcauccauaaacagaaauacuauaaacacacaauggcccauacuuuauaaacacuguggagggaaaacagaaagccacccaagcccccuuauuuugaaaucuccuuccauaaggccgaugacauuguugguaaucuagccagcugaugcccgugccauauguagcaaacgccuucuugaucauuagcaacaguuacaacuuagguauugugcuggcugguuuccucugucaaccugacacaagcuagagucaugacagucaaagagauccaugagauccagcuguaaggaguuuucucaauuagagaccaggggggagggcucagcccacuguggguggugccacccauaggcuggugauccuggguucugugagaaagcaggcugagcaagccauggaagcaagucaguaagcagcgccccucccuggccucugcuuuaucagguucugccuccaggauccuguaguguuuugaguucuugucuugacuuccuucaaucaugaacagcaaugugaaagugcaagcuauugaauaagcccuuuucuccccagcuaacuucuuggucaugguguuuuacugcggcaacagaaaccuuaacuaaggcaggugucauuaaggggaccucagaagaguuagacuuguuuaucaugagauucaugucagccuguucuaacaaagugucaaagcagcaaauggcuuccuaucaccaaagacuuagggaagguugggaaacacaguggcuaccaagaggagggaauggaaaugaacacaggcuggagagagccuucauaauagugccaacuuacugugcagcuuacucccccccccuccggcucccccgggauccaugcaagaccaaccugaagggauucuacagcggagcaucuauccaaagagggaacgguccuguccuuuggcgauucuuccuuugaaacccccuuuuuuguuuccauucuacuuccuuuauuugucuggaaagacuuuccaucaucaaaacccaaaucaguuaucaccucauccaggacaauggugcuaucaucagagacacuggaucauaccugucucagcagcacuuauaugcccuggacccugaacucaaacacuucagacacguuggucagcugcagaccaaacaugggucaaaacaugcugggguuuuacaguuuuauacaguguguagucucccaucggguggaauuauguuauguuaauguguugugccgggaucuacacuuacugcaauuauuauccuacuacuuuccaaaguacucacgagguccgauauucacaugaccuuucaauuuaucaagguucacugcuuugacuuaaguuuaguuuuuaaaacacacacacauguucacauuugacagaggccccuagguguggugggagagggcugacagcccaugcugaaucauaugaucggugacaagagcaucucccuuuugacacuuuucauagaaaaugugacuuccugacacgcccccacccaaacaacugucugugccaaguuguuauuagccccauuuuacagaagagaacgucagggcaucccugcucccugaguuuggugagcuuaguaggauauuuccuuuucuauuguaaaauuuaaugacugauuaaaaagaacaagcuaguaaguaagaacacauaaauaaaagcuggccgaggagacagaggagucaugugugguggcacacaucuguaauuccaacauucgggaggcagaggcaggaaauucaggauuucacggucaaccuucgcuuacauagagaaauugaggccagccugggcuaccugagacuguuucaagcaaacaaaaagauaguuccaaucugaggcuacaaagauuuuuaggacacaugcacccauuagauaaaugaagacccuguagucggaaaagcuuccuuuugcaccauguaaauaaaucucugugaguggccuucuaugucuuggauaaguguccccaaaaggcuuauauguuaaagcuugacagcuggucuguggugcuauugagaggcgacagagccuucaagagaagggacguauccaggaagcaacaccaugcagauacaaucuagugccacaaagucaauaugaagaggauguuggaaacugagaccuagccugaauggcugcugguggcgguuucucuuccucccucucacuuugaauccaagugggauauucagugccgcggggccucuacauuaucagaggaaugaucuagagcaucgcaggguugaugacccggaaccugacaagugucgggcugcagagccagcagaacucgugacagacggaaacugcuuccugaagagguucugaaggagcaagaaaggcaaaucccgggugcuggaaccaagcucacuuguguuuuaaguagcaguagaaugccauuuucacagaugaaucuucucaucaguuuguguucccgguuuuaaucuuuggcauccagcucucagccaguagccaugacuuuggcacgagucacaccaaaacgcauaaggugccauacgccaugguaagauauauuuaucauuuaacaggcugccuuagcuucauuucuguuauugugauaaaauauccaacccccccccccaaaaaaaaaaaaccacuuaggggagaaagaggcuuauuucaacuuacagugccaagugaaaaucugucauggugggaaggcaaggugggaauggcaagcagcccgggcauauccuuuccucagcuaagagcaggcagaaaugaagacaugcuugccuguuuguguucuauuccaucucuccccuuuugcacaguucaggaccccuuaccuagagaauggcacugcccuuaugucuuucuuacuuaggguuucuguugcuaggaggagacaccaugaucauugcaacucuuacaaaggaaaccauuuaacuggggcuggcuuacagcucagagauuuagcaucaugauaggaaacaucacagcgugcaggcagacauggugauggagaggagcugagaguucuacaccuugaucagcaggaagaagugacuaggagccacacugggcagagcuugagcauaugagaccccaaagcccaccccuacggugacauacuuccuccaacaaggccacacuuauucuaaugaggcuauaccucuuccuagugccacucccugugggauaagcauucaaacaccugagucuauggggucaauuccuguucaaaccaccaugacacaaggagccagugucuuccuauaacaauuaacguaauuaagacaaucuccuacagacauaucacaggccaacccaguuccucgcugagacucucuucccaugugauucuagguuaugucaaguugacaauuaaaacuagccaucacagggcugacaagauggcucagugguuaagagcacugacugcucuuccgaagguucugaguucaaaucccagcagccacaugguggcucacaaccauccuuaacaagaucuaaugcucacuucuggagugucugaagacagcuacuuacauuuaauaaauaaauaaaccuuaaaaaaaaaaccaaacccuagccaucacauauuaccacaucaaucauagcauaccauagaaaucauauaucauaugaaaucacauuccuuugccugggguccaucccauccuucuucacauaaaagaucaccuccauauccugagagaucuccuccauauccuacaagcuuuguucugaauuuggacuaacuucagggugcacacacaggaggaauucgcaaggccuguuuacaacaucgucgggguccguacccgcaggucucucugggagugcauauaaaacaggcuacgaagaggcugcccugcacucaccugcaaacacugaucaauacucuggcuccaacacuaaugugggaauccgagggagcguuuauauuaaaacugugcuguguccccuuaugggagguuccuccauucaaucucuugucucaaauccacccaucagaugguguugcccagaggugucaccggacaaacacaucuguaaguguuaggcuuuaucauucugccaucuggucacacuuuaaucaccaggaucuuuggggcuagccuuuuagacgacgauucacaaaccgcuacauacucuaaaguugauagucuucccaguugaugaauuagaaacgagugugagauucaacgaaaacuaugaauggcuucaccuaccgagucuuuaaaaaaaauauuauuuuaaaaaaaugugcaaauguugugugugcccaugagaaagucugggaaucugugugcaaugcccuggaggccagaaaaaaaggcauucaauccccuggaacuggagucacuggagucacaggcaguggcaagccacuuagcauuccaggaaagcaauguggguccucggguagagcaguaaaugcucuuaaccgcugagucaucucucaagcuccaacuggucaaguuuuaaaauucccacuggaaagccgggcauguuggcgcacgccuuuaaucucagcacuagggaggcagaggcagguggauuucugaguucgaggccagccuggucuacaaagugaguuccaggacagcgagagcuauauagagaaacccuauccaaaauaaauaaauaaauaauaaaaauaaaaauaaaaucccacugaagagcuacaccuuuaaucucagcacucaggagguagagguaggcagaucucuaaguucaaggccagccuggucgacaaagcaaauuuccaggauagccagggcuacacagagaaacccugucucaaacaaacaaacacacacacacacacacacacaaaaaaaaaccaaaccaaacaaaacaaaaucucucugaagcaugcaucauggcaagacugggacaucuugcaccgacugagugacgacauuuccagcgagucuuacugaacaauggaaaugcuggguuucuacaagaaggaaagugcuguccucacauucauaaugcucuagcaucgcuagcaacuuacaugaagccuaggcaugccugcuuuuucauaucacucaaaggccauacaggagacagggagaggacacucuugagaaaaucuugcuuccucuaccuagguggauuuagagaaucugugugggcuuuucucucacugugacacuuacccuccaauuucccaaaguccucuggaacugucuuucaguccugaaauuugaccucaaaugagcaacuggauuguuuauagucuacucgucaauaaaagagcaaguggggcuagggagauggcugaguggauaaaggcacuuauuuggcaagccuggcaaugagagguuaauccuuaggacccaccuguauggagcuggcuccacaaaacuggccccugucuuccauccuugcacaauugcacgcaugacacccacgcccccaucacauaaaacaagaaauguugucaaugagcaagucuaagggccuuuggggacagaagugcuguauaaugucucccagccuuccguguauaagacgagggcgcaaaggugggcgugguaacgggcaucuguaauucuagcacugcugugugccgagauagcccuggagcucaguggccaacuaguguggccaacuggugagcuucaggaucacugagaaauccuaucuggaaacaaugaggcagggagcaacugaggacaaugccuaguaccaacuucuggccuccacugaugcauuuacacaaugcaugcauguccaccugcauaggcagaugcauacacacaccacacuguauaugcaaagacagaagguguucauucuugcuuccccugcgugcugucaaugcuagaauaccagaaagaagcagcagaagccaccccucucuuggacaugcugcucucccugacauccgucugaacagcucucuuaugugcaccagcuugcugccugcacaggauucucugugcuggucauuaaagcuguuccuaaccaucccaaaugcaucaguugagauagaggacagcuagcuucgugaaaagccugaucgcugggcucagggugggagacagacggaugacgguguagaaugccuucaugguagagcuuaucacuuucagagagaggaaagcccugaaauggaagaaaguaaauaagaguguuuggcugggcugcaaggaaaacaagaaauguguccauuuaaaacaaaugcccagugaagccacaagcauggaguccaggguuaguccuuaggauucauugaguggcacggaagacaaagugccuggagcgcacucuccagggacucccagcagugcuuguguggaagggaggugcucaggugccagucugaugagguaggaguuauagccaggccugaugaaacaggccuguccaguuccuuagaaggaugaggcaggggcucaccaaauccaggcuagccugggcuacuaggugaaacacugucucaaaacaaaacugcaaaggaacugaagauguaacucagacauggagucuagcauguagucauagucacuguguuccauccccaggacucugagaagaaagcaaacaagccaggacauuuauaaaguccacacccagagagccaugucaaaguugaacugcaucucuagugcuguccuuguccccaagcuguggcuaccuguaggcucaaggacuucccacuguuauuucugcucuuaagccccagccccaaaggccccagcucugcaggcccccgaggcugccgaacucccugaggcugacaucugugaucaccacuuaacugaaaugaguuaaucuuguuuuccagaugagcuggcaccaugucuccugcaggcugcgauuacagaaugaacgcuuuguguggacaggagggcugggagcuuuucccagucccacuucacacauacacgcccagccagauucuccauccuccucccgauugccagugugagauggaguuagaagacugaggagagagugggggccuuccgaccgaaaugagcaacaaugggccuucucaacggagaugaugucacuucaugagagcucgcucacuuucaggucuggaaacacugcuuaaauggauggaaacaacuacuugcaacuguuucuguuuguuugccuuugcucuuaaaacacaucagucaagaaacaguuacauuccacaggguuccugcauagcauuugcuaggugcugggccaagaugcuagggugguuuuauuuguuugaauaagaccaaugcuuugugccuccuuggguggcuguuagcauuguauuucacuaagacaaacaaagcaacaacauguuuuaggcucaguggggaagaauaauuuugcugcugcucuuccuagagaauccguguuugguucccagcacccugccgcaggcuucguacaaccaccagcuccggcucuugucuuuuccugccuuccacagguauccacacacauguagcaagugcacugacagucgaacacacaggaauaaaaauaaauccuaaaagaaaaaccauugugcacgacaugguauuguacaccuguauguaaugccagcacacaagaggcuuugaagugagaggauugcuaguucuaaguaaugggauaaaguccuguuccaaggaaccuggaaagaaaaugggagaagggguggaagaggagaaggaggaagaugaggagaagggaggaggaggaggagggagcaggggggagaggaggaagagggaggaggagagauggaggagggaagaagagaaggagggaggaggaagaaggaagaagagggaggaggaggaggagggagaaggaagagagaggaggagggagaggagaaaaggggacaaggaggagggaggaggagaaggagggaggaagaagagggaggaggaggagggaaaggaagagggagagggaggaggagggagagggagggggagagggaagaggagaaggagggaggaggaagagaaggaagggaucugcaccauguccuggguuuggguucuaaauuguauagagauauagaaggugaguugcucugggugguagcacacaccuuucuuuaguccuagcacucaggaggcagaggcaggcaagucucagaguucaaggccagcauggucacagagugagucugaggauacccagggcuacacagagaaacagucucaaaaaaaaggggggggaaggaagagaaggaggaagaggaggaggaggaggagaaagaagaggaagaggaaggaaggaagaaagggagggaggaagggagggagggagggagggagggagggagggagggaggaaggaaggaaggaaggaaggaaggaaggaaggaaggaaggaaggaaggaaggaagaaaaauuaguugagcuuaagugaugugugcuuacucucuuugguuuugacuguggauguauguaacuagcugccuugacuuuuagacuucccuguaauaaugaaccugaaauuauaagacaaaugcuuuucucucuuaaguugcuuucauggggcuauuuuaucacaguaucagaaguggaugccuucuuccuaggaggacagggcccaucucuccaguccaacaaguaucacugguacccagcacagccccgaaccugacagaaccucaguuccuuucaaccaugacucuggggaaggacaccccuggguaugacaccaagggacucugcgguggaugguacucaaaaggcaaaccucccagcugucagucaccgcuugagaagagcaagcuugccugcguucuuauucuugcauguucucagaaguggagauuauuaucuaagguggguuuuuaucuggagguuccagguacuuccaauuccaagauuuuuauguggucagagcaaugccccaagaaauaucagcuugugaauccuggccuagccuuaccuggacuaccugucuaaucucccugaacccuaguuuacaagagcaaccggguaucucagcaagauuauggaagcuauaccuccuuagccucucccuccaucagcuuacggacaccaagaggaggaugcugaccuuuucuuaauguaagucagagcucuaauaagguccuagacgacuccaggugacccuggcccgacucugugccugccugaacuucuuucuuccucaguaguuauaaaaggcggauggcgggcucugggggggggggggauggagggggggauggaggggggggauggagggggggauggagggggagaggcuggagaagaccagcugcaggugguccugaguauccaggcccuuacuguugaguggcuccgugaugggccagaugggagagcugaggcauagacuuugccgaaacaagccgggcgugguggcgcacaccuuuaaucccagcacucgggaggcagaggcagguggaucucuugaguuccgaguucgaggccagccuggucuacaaagugaguuccaggacagccagggcaauacagagaaacacugucucgaaaaaaaaaaaaaaaaaaaaaaaaaacccaagacuuuugccgaaacagcaaacacucaggaguugcucaaagagcccuugaggaugucuguucccuggacagggugaggagggugguaauggugguggugguggugguggguuguuuguuuccaccgguauuccuagggauuuacacaagugccaugguuccuacuuuaggcuucuuccaaguaggcaaaugaaauguuaagggagagaaguaaaaaaagcuucaaacgggagaauuagaacccaaggaaacucuaacauguauuuugggcacacacaugguauguaugugugaguacccccccccccacacacacacacaaauguauuuuaguaccaggugugguaugguggugcaugccuuuagucccagcccuuaggaggugggucucuguggguucuagaccagccuggucuauagaggaaguuccaggacagcaccagaauuacauagugagaaccugucucaaaaacaacaacaagcugaaaccaaccaaccaagcaaccaacaaaaacaaaacaaaaugcaagcaaacaaacaaaaaaacucuguauuugggggucugcaaaauggcucagcaguaacagugauuucugccaagcaugaagaccugcguuccaacuccccgaagcuacuuaaacccaagcgucugagucaguaauccuaacacuguaggggacggagacaggagaaucccuguggcccacugucacaugcugcugaagacagcccaucacagggaacaagguagagagauaucuucugcuagauucaugcugguucaaacaccucccucauacaacaccccacacacacacacacacacacacacacacaccacaguguauuuuauagaagaacuaacugugcuaacaagacaagcaagcuuacuuuaaaaaaaaaauguauuccuauauauaaacauugauuagguuuauggucaaaguaaauaaauaccacaguuugaggggcaguguuccuucaucaggaugcacuauugccaccugguggugacauaccagaauugcaagaauagggccuuguucucaaacuugaugcaccuaacaguaacacaccggggccaguguuuguggcauuaugcaaaauucuuacaaggaaggagcuggaguaaauuacacaaauaaauauucauguguuuugcauggaugaucccagacaauaucacucccuuuucucuuauuuuaaguguuugaaacucucccaagaagugguaagcuacacaguaccagugccucucagguuacaaauucauauggaguggagucgucugauugacagaugaugauaaacuacggaggaacagcaacagacagagcuugggaugcagcucaucugcauagccacacccaccauuuucccaaacccucucaaaagaaauccaguugacucuucuaagcuuugggaguuuuuguuuguuuuguuuguuuguuuguuuguuuguuuguguuuuuguccauauagagcacguuugucagcuagggccagaagcaauggugguuauaaaguaaugggcaggaccaugucuaauaaauguaaauacgcauugagaagcacacagagaugaaaccccacauacaguuuuagaggccggccaacugaaugugaauaccucuuugcaaaauccaagcacccagaguuugaauguccaagagaaaucacaggcuuuucucuaacacggagaaccacugcuguguugaagggaauaagggacuccaucagcugacucgccagcuugcaaaagugaccucagaauccacgcuguguuucuaagucacaggagaaugaacuggaagaauaccggccagucugggggaggggaggacuuuccacuuaaaaagaagaagaagaagaaaaagacaaaaacaaaacaaaacggcggggcagguugaguuuuagaggaagaagaggccauuuaaaagccaaauaaaagaagcgggugcaggcugcaaaagaaggcacacaaugucaacgcucugaacucgcucaggcuugguuuauuuuccgaguuaaugcacucgugguugagccugaaagagaaaagucaauggggagaaaauaaacagagcguuugcagagcuugcccugcagccccucggacugucugcuuaccauuaccccguuuuaacaugucauaaucgcucucacgggcgaagacacccuuccugcagcagcggaccaagaaugcaugacuaauuuuaaccacuugugcgcaucucccaauggauggaaaccucacauggcuucuauggauuagaaguucugagaguggcgacagauacuaaggaguugggcugcuccucucgcaucggcccaugggucuccaaugaguugcugagggaccccccagaaccugucagccuuugcaggugcugcauacauccugagucaugguuacagaaggucaagccgggacgggagcaacggcccggcaguuaagagcacuguacugcucuuugagaaaacucaugguuggcucccgacacccagugaaguagcucacaacugccuguacgucauuuccaagagaucucuucuggucucuucagguacugcacucaggggcacauacacguaaaaucaaggauaggaaagugcagacucacgagagagagagagagagagagagagagagagagauggguggucagcuagcauuuaaccaucacagaggguuacaacagagagagauggggcugugacgaguugcccugugugguacccacugacuccagguucagaucauccgaugcaaaggagggaaaugauggguccaagauagacagacauagaggcucaaagaggucagcuaauugcccccaaagaaacagcugccugugcuucaacauaaauacacaagccucagacugcuccuuccuaccauaggcugaaaggcaucuugcgaguugagaccgguggcugguaacuucaggaccaaguucaccauuggaugcccugugucacgugauguucauacuacagcacuggcuguccccuuugccaccaaagcauccaccaguaaguggcucaaaugguaaaugacuguaccacauuuuuuuuuaaguuaagaaaaaaaagaaaagaaaaaaagaaaaaagaaaacaaaacccuccucgccucucucucucucucucucuuuugguuuuuugagacaggguuucucuguguagcccugacuguccuggaacugacucuguacaccaggcuggccucgaacucagaaauccaccacugcccggccuauuuuguagcucucuuuugugacagacucucagcucccauuuuguuagugaucauugcagaaggggcuggggugaagcagaaguucuggaggcaacaauguaguaaacagauggcuugagucacuuggagcaguuagaauacagggggagagggaagagaagagaagacuaaacuccaaguuagugccuuccaccucacuucuucacggguuuuugguuuugguuccuggcuuggcuaaggucaagguuccuucucucagucuaucaugcugucccccagagagcucucccggacaccagcgauacagugcuaucucgaggucuuacucuugguuuuguuuuucuggagggggcaagggguguugagacaggguuucucugaguaacccuggcugucuggccucagacucggacaucugccugccucugugaggacugagacaaagggugugcagcacaccgccaggcuggaggucuuacucuuuaggaaguuucuuucagaagagauacagaguaguuguuggcaggacagggcugcuggagggccugagguugucuuuaaagacagacccaaguguaagggcuugggaggcugggcuagggugaauccuaggaggaaaggaggagggagggggaggcagagggggagagagagggagggagggagaggugggggggagggagggggagggagagagggaggggaagaggagagagaaggaggagggagacagagagggagugagagaggggagggaaagaaaggaaggagagggagggaggagggagagggaggagaggacuaccucugugugucagugucccaucaguguccccagugcagcaguauacagcucuucucugacaugcucuguacccucaaccccaauucugccugggccucucguaggacuccugucuggcaggaaugacuauauucuuuggacacccccucguccacauuagacuuuccccaguucuccccauuagggaaaagacaagccugaaggccugggggcggccaguagaagaacgugucugccaggaaagguuuauagucucauuucauccugcaggagagacguggggcagagccucuguggagggaagucagccucacaccuagggaccagguugaccuacuacugguucaggaaccaggguccccaagcggaggggaaagauggagggaagaaggagaggugggagggaauggguggagagaggguuguggguaguauagagaaggaaauaauguggaauggaggggagaguugaggguaaggugcaagggugagaaaggguucaaaucucaccgccucucccuggcuccucccaucugcaagaagaugacuaaauaucugccugucccuggcuccacacagaguguuuucugcucaggcgccuccugcagcccacaggaaacauccuaccuuaucuuuacugcuccauuugagauaaggagauuaugcacagaacagcaaggcugaaccgcuugcccaaggucacacagcuauaccuagcaaacccuggauuugaaccaaggcggccugggcuccaagcccuauccuuuuagaacaauccugugccauccacugaagcuccugagaacgcgccugugcccugaccucugcccugggcgauacuuuuucugaguugacugggguugauuauagcaaaccuucaauucucugcaugcuaagcuguuucuuuucuuccauuaaacucaaaccacccacuugauacucauuaagcauccacucuguggggaggugggcacccuuuuaaucccagcacucuggaggcagauacauguggagcucuggguuccaggccagccuggucuacagagugaguuccaggacagccagggcuacauagagaaacccugucugggaaaacaaaacaaaagcugggugugguggugcacgccuuuaauaccagcguuugggagggagagacagguggauuucugugaguucaagaguagccuggucuacaaaucaaguccaagacagccagggcugguuacauugaaaaacaaaaagucuugucucaaaacagcaccaccaccuaccacccccaaacaaaugacaacacacacacacacacacacacacacaaaaccaaaccaaccaaccaaacaaaaacaagcaaagccaaaaaacugcaacaaaaagcaaccacccuguagugacaucugugguggcuuaaauaugcuuggcccagagaguaacagaguuaggagguguggccuuguuggaggaauugugucacccuggggguaggcuuuguaauccuaugcucaggcucagcucaguguggaagacacucauccuggcugccuucagaucucuccacucucucagcucagugccuuccuggaugcugugguacuucccaccuugguuauaauguauugaaccuccucggaaccugaaagccagucccaaugagauguuugccuuuaaaggaguugccuuggucauggucuguucacuggacggaacccucacaaagacaccaucuccuggaaucuuuauuauagaugauccucuuucagcuucuaguucuuucaacuauggcuaguugugaccaugggagggcugaggccaggccacuggaagcucagaaauaucacaagaaaaccauuguggcggcaggauguaguggcaucuaugcugacauagugagguacuauaacagaacagagggugggccuugcauggggauguggcucacucuauccaaucccugggugcagugcuaaugaguuucucgcccauauaguccacacuguaaacuggagugaccuuggcuacugugcaucuuaacuguguccacacacacacacacacacacacacacacacacacacacacacacacacaaaugcacaaauguaugugcuaaagucuacacuagaaguaccuagaacuugaagguaggguuccucacucaugggaaaagguaaaagaagauggcuucugucucucuauucauccagaaagagcgcaacagagaugugaccaucugugagcaugaacacaguccugugggaacucuuaucuagggcccaugagaagagguaugaggaaguaaucagagguuaccacagaccgagacaagacgggguuucucaguaaaagaacacugggaucucugcucugauuucuugccugcugugucucaaccccccauccccacccccgcuucagaaucccugaaggggcuucuuaacaugugguauagguggguccuagaaugcucuucucuaagaacucuccaggucguggagcugcuccuccuauuggagggcucaccuugagaacaccugggcuaauucaauguagccccuggaagagccgcugcuccccacauccacaguguauuugauguaugcucgugggcguucggauguuggauucuuucuuggucagggcuccacggauggagccuuucgugaagcucuguugugcugcuacaggcaccgaagcccuaauucaccugaugcuggacucucucaguucacaaccagaucccccauuccuuugauccgucugaacuuugcaccuccggcuuagaaaguguuuucuuuucugaugugaccuuggcugccuuccaggaaggcuuccccuucccagccugcucugcccucucugaucuagcccccugaaccuuccuuggcaggcaacagccucccaggugggaugugugugaaacuaucugaugaagucagcuaaacuccccaugaccuaccucugcucugaaagacaggcaacucuugcucccuaaacaagggcaucggugugccugcacucaugucacagagacgccucggacaugacaagaugggcagacgcucagucacuggcucuccgauuuccugucuccuacuuguagaaugagggaggaacaagggugaauuuaaguucccaggccccaggaaugaauguccuacuauuauucgguaaguagacagagcaucaaacugccauuuaaaucucuguuucucuaaccuuagguuugggcaggucucagaccaaaucaggaaauuuucuuagccgacaguaaaagcaaacaaaacaaaacaaaaaacaaaaccaaaaucacaaucggucaguguacagauuugggggggauaagccaaaacugaggcaccccuauggguucuucccaaggugggggccacggaggaagagggggcagagucaggaagcagucagggagggccauaaugaauggagucuucaaagaucaggcuuugcaacauuuugucauggaguaggacgggguucgugaccuagaaccguaaccuagaagccaacaacggaaggcuuccagggaagguagagucaguuuucuuuaagcaugaggcucucggugggucaaggacaguccggugaaugguucuguacccggaaacauaugggugauacaaucuggaguugguggguuaucaaauaaauuaagaugaugcaaaguugacacggguggggagguagggguggaccuucgaggaauuagugggaggaguuaauaugauaaaaaaaaaaacacauugugugaaguucccaaagaguuaauaaaguauuuaaagcaaaccaaggaaggaaggaaggaaggaaggaaggaaggaaggaaggaaggaaggaaggaaggaaggaaggaagagaaagaaaaggaaaaauguaaaggugugggagcaggagggaggcuuuguguccuagguccuagaacacagggaugucugugaauauaaauaucauaaugcuaauacugugagaauaauaaaauggaauggauacuagcagggcuuucaaagccuaacaguaguuuugacaacaaauauucauauuucaucugaaacuugugaaaccuuuugccuguaaucccacgagcggcaacacaguaaaugaaagcagcaggcagucgagauuaauaauauucugucuuacaucggaagagcauuugaaagacgagacuugcuuuaucuauucccugucuuaaugguccucauauugaaacagacugaagccgccgagacgggcugggaagcagucauagauguuuuauuaauuuaugggaaagugaaggacccaccucgagaggcuuaagugggucauucugaaaccgugaggagucagcggugugaggaacacagguugaaagcgugcugugcgacacugggcucaagcugggacugcaaaagugucucccaugugcuagcaggguccacagucuaacaaggcacucuuaggagaaaaagcagucuguucucguguggauucugcccuaugcuucugucuugccacagucuagaaggggccaugucaguaacuccuggccacgcaggaggcuuuuguugguuagugggaauaaaugggcuggauuuccuuaaguuuuaguguucuauguauauaccaugaugaagugcaauguaugggcaugcccagaauccccacaauccccaauuaacggcagagcaucugagaacgagacuggcguuucuuugcaaagacuugcuuuuuccuggacuaagugaagggcuuugcuuuucuuucggagggugccacuuuguuaggcauauggcuuuuuuuuuuuuuuuuuuuuuuuuugguauaaaugcagaagcaaagaagacaaagugauauucagaguuuggacccagaaucacccaugucuucuagggcauagguuucacuccaguccuaagucaugcucuugcuucucaagucugcaaacucuaauggauuuguuuuaguauuacaugaccagcaauaccuggugucugagaccauggagaguguucuggcuuccuauuuauuuauuuauuuauuuauuuauuuaucaagccaggguuucaguguguauagccuuggcuguccuggaacucuauagagcaggcuggccucgaacccacagaaauccaccagccucuggcucccgagugcugggauuaaagccugcaccaccacccccuggcaucuccuuuccuuucuguagcugugauaaaacaucaggcucaaaagcuacuugggggaggaaugaguuuaucugccuuacaguucuaggucccagaccaccacugaguggacagcaaggcaggaacaucagcagcuggccacagugacauccacagucaggagacuagaggaccaaaggcacucgggcugccuuccguuuuacacaguuuagggacaccccaugagauggcacuguccacaauaggcuggguccuccugcaucaucaacugacaauaggaaugcuccccucaaacaugcucacaggcccaguuggcaguuaaaaccaagcaguacagagaggagcuucaggagugagaagaagguuggaaucaugugucuugcagaagcaucuagcaaccguaguaugcacuuaacuuugggggcucagauaagucuauaugguuguggacugccuuguucaugacagaacacauaguaaauagcccaacaaugucagacaacauuuaauaguaacggccugucauuucuuuuacuaccaaaaccaccuccacacccugccagauaccacccgggaagcccaguuucuguuacccuaguacccaccguuugaaucccuacuguguucuuguguacauuuuaaacaaagacaaguaaauacuccuauaguaguagggaagcgucaccauggcuggagauuauuuaggacuuaaauagaagcuggaagucucgaaucuagugcaguuggcagguugaacacacacaauggaguugagaagagauaaagggacaaacaggacaaagaacaggaagacagaggugugcccucagaccuacugcaaagacaggcaggacgugaggaagcguguucuucgugggguugaggccccacugcacagguaggaauucaugccuaagacugagcacacaauuaaaacccuguguccaagaaggucuuaggcuccagagggagacuuaauuaccauuguucagcuagaacgaaauggcaccaaacugcuucuaugugcuugccuuuguaggcaaauacuauaccuagccucagucaggagaugcuuggcauugcaaugaacugugcugaagacagacgcugagcuagcuacccaaggcauuaaggagaagcggugguugaguguuuagcccucaauaggacgccuauaccaccccucuaaggcuuagagaacauagaggaagaggagcuggaaagaagguaagagccggaagauugggagaaagacugugaaauguugccucugaggcauacacagccguagcagucuugagcuugucguagcagcuguggcugucuaucaacaauuuucauaagcgccgugcuggugcuggcugaagcucuggaggagagcugaugggagguugcuggcaagcucuagguagcaaauggaaacgaagaccaggauguccauauggcugugcuuucaaacucucccacauggugaaucccaagggaugagucuggaaucacaucccccgggggaaauggaguguugaaagguguuuucucuugaacaagucagacaaaggaugccuuccuguuacauaacauuugcucuugcauagucuauucauuagagaaggaguugucucuuuaauccaacacgguuggauuuccuguggccuuuaauauaacuccucuaccaguccucaaccagagggaauccagaagauuuuguucuguuuuguuuugcuuugaaggcugaaucucacuauguugcucugacuguccgggaacugauugaguagaucagaucaggccuccagcucacugagaaccacccucugccucugccucucugccucucugccucucugccucucugccucucucucugccucucugccucucugccucucucucucucugccucucugccucugccucucugccucugccucucugccucucugccucugccucucugccucucugccucucugccucucugccucucugccucugccucucugccucugccucucugccucucugccucucugccucucugccucugccucucugccucucugccucucugccucucugccucucugccucucugccucucugccucugccucugccucucugccucucugccucucugccucucugccucugccucugccucugccucucugccucucugccucugccucucugccucucucucugccucucugccucucugccucucugccucucugccucugccucucugccucugccucucugccucucugccucucugccucugccucucugccucucugccucucugccucucugccucuuugccucucugccucucugccucuuugccucucucugccucucugccucucugccucucugccucucugccucucugccucucugcugaagguugggauuaaagguguguaccaccaguucccugggaagauuaaaaccauaguuuaaggaacaugagauucaaguguucuccucauaucacaaagacaauguuaaauaacccuuaagcaggcuauccuggcuuuggaaacuuccaagagcaccuagguuucuuccacucuauguuaauuacuuauuguugugauaaaucauuuaacagaaucaacugaaggaagggagguacaauuugacucacaguuggaaaacaaagcccagaaugagugggcaguugaggcaggagcuugaagaagagaccagauacagggcaaccagucaggaagcagagagagauuaauguugguguuuagguaauauuuuccuuuuguauucaguccaggacccaucccaucgguuggcacuaccccuguuucgaucuucccacuucaaauuaacuuaaucuagaaaaucccuggaagucauacccagagacuugucuauucccugacucuaggucccgucagacucacagaauuagccaucgccaccauagagaguucuuaaucagaaccugaaggauuaagaaccccucagacgacagacacccauuucucuuccauucauugugacaaucaaaagagaaggaucuaugcagggaccuucagacgacugcaaaagucaaguucaagcgcacuuucauccuggcacaugggucuucuucuuuccuaacugagaacccaccacggcucuuucccagaggauugaaacaaagaucaagugagacucugccaagcaucuccaggcccaccagaaggauuuccucuuucaucuugucaugggauaaaacuagcuagaaaaaaaaauaaaacaaaccucuguaagacucuuccagggaaacuguuccagaaauaagagagagacagagacaggcccagagagagagaaagacagagagucagaaaaacagagacugagagaaagacacacacacacacacacacacacacacacacacacacacacagagagagagagagagagagagagagagaggcagagagagagagcuaugcauggccucugcccaccagaaguuuggcaucacagaccacugaaacacacuaggaucuaucugccccugacacacagcuauucccucaauguccaaacaucaggggaaacaugucucucuugcuuuuaugaacuuccaaggcaauaaagacuuguauucaaagcacuuucacuuuccaaaaaaaagucauuaauacuuguuuaugacaucagaacccauuagugacgauauaucacauaugucagcucagcggggaccaucaaagguggucaaggaacgaugcuggauauaaagacuagacugggcuucacaauuggaugucaucuaugggaaccugaacacaaaggcucagggcaucuucgacauuugaaaaaucccuggguauugauguacagcugagagauaacgucaaagcauccuggguaagcugacgggugcucuggaggcguccgcauacccgauacauccuacuguaaggcauauucagacucacuagcagugccuaaauaauucaggaacuuaaggguagaaguuuauucauauaugcagccagacucggccaggaaaaugcugagguggacgagaggcaagagaccaggcuaguagaguccuuuuggguuuggagucgaguacccugaugucuguauccuguuucuaccaaaugcgucuacauuuuuaucaaacaagguuauuuuauguguaugucaaugccauggcaugguccaucugaccucagacuaacagaguuguuaccuacugggaagggacuaccucagauggaaagagaggcgggguacaguucugaacaggauaaaggcaucaggcaacaaaaagccaagguaagccgggugugguggcgcacgccuuuaaucccagcacucuggaggcagaggcaggcggauuucugaguucgaggccagccuggucuacaaagugaguuccaggacagccagggcuauacagagaaacccugucucgaaaaaccaaaaaaacaaaaaaauaaaaaaacaaaaaacaaaaaagccaagguggggaugccacaggcagugaguucaaggucacuaagugguacuaucaagggggauggaauucaucauaauaaacuucacaagauucuugcuacagguaugcccgggugagucaagaaggguuuuuguuuaggucuccaauuuagggagacuccuuaagacuagacugugaagccagaugugguggcccacaccuuuaauuccagauagaggccaugggucucucugaauuccagacuagcaaaggcuauauaggaagagacucucuacaaaaaaaaaaaaaacaaaaagacuggccuaugaagauuccacaagucaaagggacgaagaucauauauuagcuugacuaaauucagucaaggauggucugucugucugcgagaaguacaacaggccauguuaggacuuggcaaagggagaguucuuugucucugucucucugucugucugucuuccacagggucucauguagcacagaugagcuucaaacuggcuaaauagccaagaaugaccuugaacuucugauccucuccagccuuugaccccggaggguugggauuacaggugggcacugccauuaaacccagugcuuuuuccuuuccaugccgggcaaaugguugaccuugaucaacugagccacauucccagccugccggcaaagguuucuuagagagaugggagguugaggcugccuggauguuaugggcaggcagcagaaaugaaaugcacagccaacaggcggcagagcagaguuugguaaaugccccauguuucuguguggcaacagagcuuuucaauggggucacuauagacaauuagaccaguggggaucugaaugagugucuguccugugcauuacaggauauaaggcaaccuccccacgcuggaugcuaguagaaguggcuuaggcugccgcuucucgacauucugaccaacgaacugucucuagguauuuguccaaggaagaaugucccuggaacagaaggagaaaggacaauguguagagaguacuuaaaggaccagcgugugaauggcuagcucauagagcacaaagcagcacacaugacgggguuguggucuauguaacaaaggcagauucugcccgucucugagaaugacuguuuucuaugcaacagcaaaauacagaagugaguuuauacacggagagcagaauaaaaccggguuuguuagaacccccauauaagaaaaauagcaagcgauacgacaaaccaucggaagugaucuuuauguauugagauauuuggaaagaaaacuauuccucuaucugauuaacaggcaaggauguagacgacacaagauauaaaaguaauuccuaggaccagcaggaugguucguuggguaaaaauacuggguaugugagccuaauguucugaguuugauccuuagaacucugcaugcacacgugugagugccugcacacacauuaaugauacaccgccuuuuuuuuuuuaauguuuaaugcuuucaagggcuaauuuagccacuaucuugaaaaacauuugcacgucuggccacuuuuaauuuuauaauuuuauuuuccauuugaugguuuccauuauggcuuaccuuuauauuuacauucaaaaaugcauugcuauugcugaaaacuugaguauaaaggggaaagagaacagcucccauucugauuuguuugcucugugacacucuauggagauuucacaauuauuuacuaauuuaaauaaccccaauuucagcagacaaugagcagguggcaaguuugcuggcacauccccaucugaccucgccugcguuuucuuuucucauuccugggcacaauuagcaaaggacagagagacggcuauuuaacaggcuaucucggcuaauuuuuaaucucuuuuaaugcaggaauuuaaaaaaaaaacaaaaaacgccugcuugagagcuucggggauuacuaaauaauaaacccugaagguuccaaaaucugguuaaucguuagaccuggagaauaugaaauauaguguuaauuuagaauaacauaaugccuaaaaaugaagcgaguaaggucuaauugagcuaugaacugcuugccugguacuguguaauaugggugaugcuaacccaggguugcugaguuguagauaaccaugacucuuagcaaauauguuuacuggggccucucgcucuucauuacccaaccucauaaaguauaugucugcauauuccgauaaaacauaaaacggcaaggcggaggcacaauuaggacaccccaagaagccgcaucguaaaccaguaucugucucccaauaauuguucacuuaaccgugauaaauauuuaucagugugcaagacaacuaacccuggaacaacuguggcccaugcuaaaaacgaagggagacauuuagacuuuugauuuuuuccauuuggauaagcgagacgccuuuagcucaaaaugugaccugaugaacugccgugcuuuugacuuuaagugauuaucacguuguaggaaccaaccagaauguggugggugcauauggccagguucugcuuaaagccacuuggguuuccugagcgcugcaagugaaagccacagaguggacaaaaguggacgaaaauguagcuguucauuuguaugguuguacagaucauaaccuuuuaugucuguggaacuccuugggaaaacugucauuacuguuauucuuuuucuaugaauguauguaugcaugcaugcauuuguuuauuuguuuguuuguauguuuauugguuuuuugagaugggguuucucuguuguaucccuagcugcccuggaacucacuccguagaccaggugggccucaaaugcauagagauccaccugucuuugccuucugagugcugugauuaaaggccugcaccaccaccaucuaggaaaaaaaaaaacaaaaacaaaaacaaaaaaacaaaaaacguguccuuaaugguccuugguccuuagucucuugucagucaugaugugcuaacuggggaugcaggaagaaaagugggauauauagcuaugcagaugugugugugugugugugugugugugugugugugugugagugagugcacacgcgcacgugugcgcaugcacacgcaugcuugucugugucuguacuguagacucaggcacuuguucggagaagggcucuguagauuagcccacagcauuguaugucuuccagagcacgaccucaggagaaaagggcucugccauccaggugacacuugucuucuggcagaagagaaugguuuugucauuguuagaaagaugguugggggugaggugggggggggggggggaagaaaaacaggaaguagggguagcauccucuacagauagaaauagcucagaacugcuggacccauccugaaagcaacuggagagagucauucaaaaaccaaacagcgaugguucuuaaacaggagcaguuaccacuugccaguuaacagagcaugcuucuguuaccacgugacucucugacucaagacaucugcaacuuggccagggaugugacauuucuaacaaauguccaggggaugcugcugauacaguugacccaugaggcauacuuggggaaccgaaauccgauagcaaaggaaggaucuagaaggugacacuuuggggaugaaucccugguuaaauguaaauucuugucccaagccuguuauccuuucuuuuuccucauuuugcaccaucugaucucuuccccgucuuccaucuuccauuuuguuuuauuuuagaugucuauuccaauuccccguuuccaagucucucauauucuguaucccccuguccuuuccuauccuuucuuuugaucuuuuuuuucccccaacucucaagcuugcccugaaaucccuacguuagucauaaguagccuugugcugggcucuucacagugaccgauaccaucagaaaagaagcagauccugaaaaacagggucucuuuccccagcgagcaaaaaugaaggcaaugggucagagcagagcaggcaggguauggauuguguuccuggcaggcgggagcaaaaugcgguuacauucagcauccuguaagcaaauccauguccugugggugugauuuuuauacacacugccaccacugggugugcaugcuacuguagccugagcggguucucggaguucauuuucauuugggggauuuuuuucuuacauuuuaggauaaauagucucuaggucuaguuacagugugcacucaacucccacacuguguggagauuuauagcaaaaaugaccacuggaagaacaucacgaggggaggaaucuuuugggggcagacuuggcuccucuagucuuuuccugcuggacucugauucacacaagacaagaauccacacggccagaguccucugaucuuagcagugcgucauccgaaaugagcacggaccacguaacucgacuacaccuuaagggaacaauccuagccuggcugugacuggacaagaugaccucagacaucuuuuauaucccuccugggucauaaagucagaauggaaacucugaccagaaccugugaagagaagagaugcuaagagucuucagucuaucuaagcaauacuucaggugguggaccauguuacagugaucaucagagagcgaggagacaacacaaaaacaaaaacaaacaacaacaauaaaaaaacccuuccccuugucaccagaaucaaaaucaaaaugcuuccaaauaaggucauuuaugaauaucuacaggcauggggaggguagaagacaugcugugcuuuggcuuuccucaccucuagaggagugaguaaccagcugccauccaagugcccuguuggaaagcuaggaguccuuccugugcccagaacucucaaguuccucuccgggguccugacauggggaguuagaggaggggcacagggaggauuaaacagaaagcaagagcuauauaagagucagccacggucucagcuccaagucucuccagcaaggucaucugacaaaugguaagcuuuucucccggugguaagucccuccucuggcugaccccaggccuucagacuuuucuucuccaaacaggagauuccuaggaauauucuaauuucuugggggcucauucaauagccagacgugagcacgaaugucucuuuaggauucauucauuccugucacuugggagaaggagagaggggguagcccucugauuuucacauguacaguggcauguccccuccacgugcauacauauauacauagaaauacacuuuuaaaauugcugccuagaagggaagagacacaucugcuuacaggaaucucauggugaaaaucucucucugcuuugaaugggugacuucagguugaaagguucucagguuguuaaaaagcuaugauauucauuuuguggcggcggcgugagcucgguccaaccuauauccugaugggucccguuuucaaggguaaacaccauagucaguuagggugcagugacaauagcagcuaauacuugcuaauacagugacaccgacagugacaucacagaccccgacuccacugucacguaacugugggcacgacgggccucucugucagggcagaaacuggagcagcccgaaugaaugaaugaaugaacacuccaagaagagacccaagaacucagagagcuucggcaauauuugggaaccagcuagguacgaauaccuccaacccuggacucagagcaggagaaugcaaagcggcaggcaggcuggggucugggggcauuugguuuggaccaguugaccaauggauucucucucucucucucucucuguucuaggcagagaacaggcuccaucuuaaagggcagccugcugaggccaccaggguggaacuggcugacucaggacggacgcuaagguuugugcugagcagagggaacuguccuguccacuucagggaauuaacggggagucggcuuggcuaaucagguuuaacaccugcgacauggacuccucugagauugggcuuucugcacccccucccacccccgagaucccgccuguccauagagacuccaccgggcagagaaccuuucucagccugauccaguuuccuuccuuuacuguaaacaaaggaacacucugguggcaccaaccagaguuuggcuggggugggggugggggguccugguuaaaagguucugguuugagugccugggugccccuuguuguuuccuuacacagaagugauguaauuaagaacuaguguaccuaagcugagacaguuccuccucugccugguagggaguuccacagaaauccaacagcccccaaguacuaccuaguguacuagguuaguguacuguacuaguacacuagguuaguguacuaguagucacuaguuacaguagaccaagccugauuuaaaucuuaauuuaaauguaaauaguggccccgggccauuggcuaccuuaucuauuagacagaccagguccaccgccuucucuuaguccaacuuucccaucagcccaggaaaguaaugcaagguuguuuacaccuuggagucagaugaaacuggagcggaguucuugaguucacuaucacgcagccaguucaccaggcaccaggucuccucugauuccaggguucacaaagcuaacaggcuuuguggcuauugggcagguaggucguccuagggaagccacagcucagaacucugccuaagcaaagugaaggacagugaccuucuuaaugaggcaaaaugggggggggguggggaagagggagggaggagggaaagaguggggagagaggggcugcagagaucgcucaguaguuaagagcaggugccccucuugcacaggacucuggcucaguucccagcacccacaucaaccuauaacuaacuccagguccaggggaugcaacacacacucuuggcguccaugggaaccaggcauacaugcagaacauucacgcaugcugcaaaacacuccuacacaucauauaaaauaaucacuuaaaaaaagagagagagagaguaacaggaaagaagccaaucgucaggcaagguguggaaauucucucuagucugcuacuuguaacaaacagcaggugcgaaacgcccgccauauacaaacacaggagagagcaaaggcaggcaggagcuauggagcugggcucuuugcugcuugucuguucccuagcucaccagcccgaggccaccaucagggguaccuuuccccuuuuaaaauaaacugccucuauuugcauccucauccccgggacccugguccacuucauugcuugggacgaggaagccugggaucugagguauaucccagacacugauucagugucccaaacucaacagaagugaguggggacgccucuuuccgcagggaaaauguuauuaaggcucuuauccuccuccgauuaaacguguacauccacuuagaugugagcagcuucugcuacgcaugagucccaugcaggccuugcuuuuucuagcagggaacuacaaauaggguuucuugcucgcugcuuugugcagauuggaaacaaaaacacaaacaaacaaacgugaaccaaccaagugcuguguugucugacuccaucucuggacugaacacagcggugucccacugucauugcgccagccugggacuucagcaaaugggcuuucugagacccuggaaacagguucggcccaugucagcauugcugccucucccccagggcgcggggaaaagcaaagcagaaagccgggagaagcugacugaagaugagcucucugaacaaugugugccagguggccguguaucagcagaaaugucccuagucuggaaauaccguucguugggcaaccaauaguuuccaaagcccucaugugggucauagcagugcaggugccgugugcauguguguuuguguguuuguguacgugugaagaccagaggucuaugucaggagucuuccuaggcugcagcucacaccuuccacaagcuggggaugaaccccaggguuccucggcucuaggacuacaagaccuagagcucaccgccacuccuggcuacuguguacauggaugucaggacccagcuuaggcccccacguuugcaugguacccauugcaagccaucuccauagcugcuagauauagauauccuuuuuuaaaaaauguuuucaaaucacaaacggucugaacagugaauuuuuagucauuaaaaaauaggcagugggggugggguggggugggguggggucuggggagauggcucagugguuaaaagcauuuguuguucuugcaggggauccagguucaguccccuguauccacaucuggcaguuuacaaguaccucuaacuccagcuccagggggaucuaucugauacccuccucuggucucugugggcuuuugcauucacggggacaaaucccuacccagauccagaagcacauaauuagaaauaaaucuuuuuuuuuuuuuuuuuuuuuuuuuuuuuaaagaaaagacuagguaaggaauagacaggaacucaaaagcauuugccaggagcccgugagcuuuacccgaggcgggcauaaugcguaauugaaaauaacuggacuuucugguccuugcuugagggugagauagaccaagauuuuaauauaaaagcaacucacagcuccuuagagaaggcauacagaggcauuaaaaacaauagguuuguuucuuuuuucaaaauuuuauuucguuuuauuugugugugugugugugugcucgcacacacacacgcgcaccugcuugucugcacgugugugacauaugugugguuacgguacuguguucccugcguugaggguuacagguggcuguauauguugggcccggaacucagaucuucugugugaacagcaggcguucagcccugagccccucucuggagccccugcugcuuuuuauugcgcucugccaauaaaggugcaauuggcaaacaucaaccagaggaaacagucuuuguucggaccuguuuuucugucccuuccgcuugauauuucuaaauuaacuuaucaauaaugaauuaaaguaaugcggaaaagugggacaauacugcaccuuuaaggaaauauuauuucuccucggguccuaucaagguaaauuucaucaguauucgaagaaugagcaaagcacuucaacaauuuauuucaauaaaagaagacuuagccgaaaggaguauaaaugaugagagcuugcuuuaaacugauuuauucccugcagcaauaaaaggaauguuucuucacucagcuguuuaauaugcaaauaugcagaacguccagcccugacagcgcaucauuaauaaaaccuugcgcugagcagagcgcccgauauuucauccugaugaaaaugcaugaugaugauuuuagacugugggcucucggagucgaacaaugugccuucccagcgaccggcgacggagcccacccucggcagagagggcucugcacgccaagccauuggguuucugcagcagggggucacgggcacagugcaugcccaagagcagaguggacagucuuucacgcuuccgagugggagagggugagcuugguaauaggggcagacaagggucugagaugcucuucuuuuagguaugguggcaugcuaauuuuuaaaauuuuuauuggcuuaauuuccuccucaguauucaggggaauuccuacuuggagauaggcucuaugcuagcuuuauggaauaagauaguacacauuaaaaaaaaaaaaagauacuggccucaugaaaccaaaccaccaucuuucccuaauauucaguggcccuguuguuguaaaacuuuaaauggaacgaaguggagaaaauccucuuauaaccagauucuuuacucucucucucucucucucucucucucucucucuggcagccuuuugagauggaugaaugguccccguguuaggauuuugaguucuuugagaaagggccgugguggcguguauauacaccagcacagugugcgagagugcgggcccaagugugugagugugaauccaagugugcuacaguacacaggggucaggggacaagcuggguauagggccuucccuuguucccaacacgaucuccagcucccuucccgcugcguguccucaggcuaccuggcccuuccuggauucaccugccuuucccuccagcuuccuauaggagcucaggaauucugauaagguacaacgguggccuggcuuuuuacaagggcucugagccucugagcaagagcuugcaagcuugcaagcgggcuuucccagcugagcuaccgcccuaaaaaaagguuuuuuuuuuuuuaguacuuuacuuuuuuuuuuuuuuuuuaaauaucuuuuacauuuuaucuuuucuuccuuccuuccuuuguuuucucuugcauauggccgcccaaggccaaggcuuggcucaaggucucaaaguagcugaagauuacccugaacuuccugccuccagcuccugaguuaugggagucuaagugucuguacuaccacauaccugguuuacgcguugcuggggaaugaacucaaggcuccaggcgcaccaagcaagcuaucuccugaguuaugucuccagcucccuucugaauuuuacagcgagugaaaggaagccauauguaugaucagaaaaucauguuaaaaggggggggugauaccccaaaccccaaaacguaauuccacacacauacacuauccacccacucccucuuccucuccccccuccucccucccucccuccucucccuccaucuaacuaaaccaaccaucucaggagcaucagcacuggaucucuuggaaacuucauacaaacccugcuuggcugacuuaaaagauacacagacgugacaggggacuaugaguuacuaguuguaaguauuuagaacacggccuggaauuuggcacgguccaggaaaguacuuguuaaaucaauaaccgauaaaucagauuaacccugaaagcaugccccucugcaagggugaguuuucuguaaacacuccuuauggaaguagauaaaggcuauggaaacuggcugcugcuucuccuuucuuuucuuuucuuuuuuucagccuuucauuuauaacuacugcacaguccuugucuguaagaacugcuccaagcuagagaaaauuuagaugaaaacucuugacucugggggcugccuggcaagauggcucagagguuaaaguuuuugaggguaaauugucaaccuccugagcccaugucacggcaggaggaggaaacagacgccacacuguccccugccuaugaauguacuuucauacuucauacacacguauaacaauccggaaaagaaaauuuaaaucaucuggcucaaacacccaugcugugugaccuccaguuagucucuuaccuaugcaaaucccauuuccucauugugaauucuguuugacacuaacaggaccuauucaguuugcuuuuagagggaguuccgaucuggguagcauugugcccagagcagagcucaacguccccguuuauuaagcaucuacuauagaccgagugccacgcacacauccacauagauuugugugagaacucuugagcacagcccugcucaccacacuuuuuuccugaaagaagacuaagcacgggagccuuaaacaaggccaccagcagaguguggcuuugaauuugagucugucugucacuaacuccucaacuaaauacugucuugacaccagcccugcuuaucuccaggaggccuggaguaaggggggccaaaaaacaaaacaaaacaaaaacuagauccaguaauggcucaaaaacacagggagaaagaagagauuucccucuuuccuuuuuaucuucggucacaauucaucuucacagagucuguccggaggcaggugacgagggugggcgcgcucagcuucacagaaagaggaagggccugugaaguuaucaguggcugugcugucauuucgaaagcauguuuauuagagaaagcccauucaugucuguaauuugugaagguuuuuuucccccuaacuuuagaaaacuccaggaaaagaagaagaagaaggaaaaaaaaaaccaaacuuacuuuucaaaucugugguggugcguguugggcaggagacaccucucugcccucuuuucugacccuacuuuccucucuccccgcccugugugcccucuucauccagccaagagaaugacucucacugccaacaggaagagagcgguuggcguugauuuccgaauauuccaaugauaaaucaaucguuuagccagauucaaugaaguuugcaaacccuuugaaucagcucccggugagaauccaccaagucuugggggcagaauuugcaguggccucuugcagguccuguccguguuucugauuuuaugugugcuuaguaauacgcccucauaacucagaugggaugaaccaauuaaacauuuccccauagucugugaaagcgcugcccuuggcauguuuuuugcauggcgcaaaccucugcgggaggauacgauagaaaucuugcacuauuuaaauauagaauugggacaucaaagaaaggguuguauugaaauaacauggauaauuaaggaaguggggaacagcaauaacugauuuacauaaaugcuaaugagucucuugacuuguuuggcaauuugcacuuugggcuggguaacgguggcuccgaauuuaugaucuaauuuuuacuuuaauauuuucuuuucgcaaguuguaacccgcacugaggagugccugccaacaucuaacuucuuggccuucaaccauccacaaguacuucuuucucauccucauuggggauggauggaaggggucugugaguuuccagaacacccugcuauagauggguuucuuuucauauuaugcugcugccauuguuacugggagcgaggcggggggggggggggggggggcgcggggggagggguguggggagcgggaucaauaacauuugagguauccagaguuggcuaagauaaccaggcuagcaaguggauaucccguuggcuaagauaaccaggcuagcaaucuugauaucucagagagaguaagggguuucauauuugccugccccuugccauuuggagggagaccccgugggggggggagaucacgaagcuugagggguagugauuauucuguaccauucuuaggugucuuuugcuucagagaagaaauuacaugcauugaaaaucgccauuuuauuguacuuucccacugaucucgcgccacagggccaccaccucccgugaaugagaaugagagccccugccguccccuccggacacucuucacgcugaccuucaguguacccuauuucccuccgagcccucuaagcuugauucauugcuuucucgggccauucccccuucaccccauugauggcuuucagagcugcuucaauuuucaagcccugacaagcugaggcgauggccggggcucugucugcacugucuuauggauugugcaaggucacugccggcgagaggaaggaggcagcccgcgcauuuaucaggauguauuguuuuacuuuuucuauccaucaccgaggcgaugauucuauuuuagugaaaauccauugaacuccgaucaagucagauggcuguuaucauuggagacucaaaagcugucaggcuguaaucaguacaaauguuggaccucaggauggggggcucgggcccaaccguggucuuccagggaucuugcuggucauucuugcuuuuaaaauuucaucccgucauuuugauuuacguaucuuuucggcuguucuugcaagagauacaaaucugguuaugccguugggaaggaaccgguuacagacaauuuaggcccuguauacagacacuauggcccccuuccuaugcgcuugcugcuuauucugggucuaauaacugucucccugucaguaugaguauacaccccuaagugaucacagaugcugaacacaaggaaugcauggacacacacacacacacacacuccacucccagugcaaggcaccacacgcuaacugccuguuuaguggucucuugaacauuacacacugucagaucaucacacuugauguucuagaguauaccaugaauaggcccaucagccccccagugccauauauauuauuauauuaguauacaauguaauacauuuauauauacucuaauaauauauauuaaauauuccuacuuaauuuauaagaguuuggggaaguuuuuaugguacaauuaucaccucaaacagggaggagagagagagagagagagagagagagagagagagagagagagagagagaacucucugaaaaaaauccuuuuggcuugcuuuugaagaugggaguuaauuaaacaugacacuugaauaauguccuuaaaauacaucuucuauucugccuguauuccaaacuuuuauaaaagggggagugucugacagcagaagacaggcuggcuuuuaaucaggauucuguaguuugaagcaaaacuuaacucuuaacuaugcagagaagcaaacgaagcucucuauuggcugucaggugcagguuucuacccucgucccaguuuagaucugaguccagcagaggagcuuuuaaggaauaagggacaacacuuacaagacuccaggcuuagggccugcuugucucucuugagacaguuuaauguguaaagcuaccucccaaagugcucccuucuuuacagucccugccccuguuccucuuauuagcaagcacaacugaauauugacaguacguucuuaaauuuauauuuguauuauaaauauaauauaaauauuguuuauauuauaaauaacagcaauaauaaucagggaaguuauuuauuggccacuuacccugccugagucagacaccagugcuuuacaugugcugucuggaccuuaaaaagcuuacuucggugagggcagagaucuggauuuuaagggaagaacaccaagacuccaaaaacccuagcaaugagccagguacaucaaacuuaaaaauggcagcucugguggaauggugcagaggcucaccugauggagcuggaguaagagaaagacauccagccuggcuuaaaccccaucaagauccagauaguuagaacuuauaguacuuugcauauaaaaugcccuccaggguuucaaguguuugaaccaguguggccuccagccauuuugaagguaaugggcgggggggggggggggagacacacgggacuuggaugguuggugugugucucugagagagagccuucugaggauuauagcccagaguugcuuccauucuaagcuguucccugaucugccaaguugccaguaaguuguucuucacaguccugcugcccuggaccaaacaaugccugcuuccccugaaaugcagugaaaaugaauuucucuucucuugcauagcuuuguuugaugcuugaucacagagaggucauguuggguugaaucaggaacugagggggguggugaagaaggguuaagcugggaaaggucaguacugugacagcagagagcagguuacuggagacaucugggaacagaaucaucauuuuucauuaccuguaagcccccagcuucucucucucucucucucucucucucucucucucucucucucucucucucacacacacacacacacacacacacacacacacacacacguacgucaaaagucaggccugaauugcugguguggaaggaugaaagcacuaagggaaaaauguuucucuagaagguguguucucauaauaggagugagacaagcccaaggaagcacugagacguggggguggguggagggcauacuucauucacuugucuuccaauaggcucuugcuagagguuggcacuuuggcauucagaaccagaugacuccuucuugguuggggcuguccaaccaagaagcuucccugguuucuacccacuacaccaguaguaucccucccuauccucagguaugaugaaacaaacaaacaaacaaaacaaaauaaauugcaaacacugugaagucguaauaguagccuugacuucugccauucuagguggagagguuaaaaagcuaaaaaccuauucuuccaggacucccuugcagcuaugaucccagauacaaaucuauccccuugauggcuagaugcuagcaggugaggccugggaaguagccucaagggagugguauauccugcucauucugagauuucccucuguguaacuggagcuuccuauccuccuauucugaaccuauuuucagccguguggugauacacaaguaucagagagagacaacuuuggauuccccuucugcucagcuccgauuguugcuucagugguagaaggucccuggaggguaaguuuuguauuauugagggaggcauuauuggacaccgacuucaaauaccuccuucugguuuucuaaucauucuguaagcaccaaaaugccuucauuaaauuccuucaugucuaacuuaaaggaagagauucuuacauguugcuuugagcauagaugauucacucacuagaguuaucuuucgagugacuauaaugcaucucaucagacucaaacacacucugggucucagaacaugcagguuccuuuacucugauagucauuccuuccaauuucucugcacugcucagcuucacaggacaggcuaccuccaaacacccagcuuaaagcugaggcccauauugugcaugguaaauucuccccaauuuuuuagguaaacauuuuucccuuagugcuuucauccuuccacaccagcaauucaggccugacuuuugacguaugugugugugugugugugugugugugugugugugugugugugugaagcugggggcuuacagguaaugaaaaaugaugacucuguucccagaugucuccaguaaccugcucucuguugucacaguacugaccuuucccagcuuaacccuucuucaccaccucccucaguuccugauucaacccaacacgaccucucugugaugaagcaucaaacaaagcuaugcaagagaagggaaauucauuuucacugcauuucaggggaagcaggcauucuccccaggguaaaucuuuacuccucuauaccaagccucuuguggcucccaucucugguaccuggugaagauguggucauuacccaugggccuuauauaaccugcagggcucugauucauacuaaggguuuuggugccuaggucagagcaagaauauaaugauguaagguuauacccuugucuuagucaggguuucuauucuugcacaaacaucaugaccaagaagcaaguuggggaggaaaggguuuauucggcuuacacuuccauacugcuguucaucaccaaggaagucaggacuggaacucaagcaggucaggaagcaggagcugaugcagaggccauggggggauguucuuuacuggcuugccucaccuggcuugcucagccugcuuucuuauagaaccaagacuaccagcccagagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacaacccuagauauaucagagaaaauauaugaugaacugaugguuagaggaagggauagaaaauuguaacauuauuccuuacugucugauguugugcuaccucauagaacuugaccuugaagcacuaaguggaggcccaaagcaauuagagaaaacagagggaacgauguacugguuaauauagggcguccugauggcuaguuugcuuaggaagaacuuuggauaagaccagagcaaagugcuaggugagagagcagagggaggagccagagcaggaugaggagaggcaugcaggaagcagaacacucaagcacuaagggcuuagcaauuccccaugccucagaggaugugcaaacagacuugguauggcaggaguugccgagacacagggagagugcucacgugagcucuucaguaccacacaaugaaggcaugggaugcaugcauagccuccucuucagcagccuucguuuauuauuuaaaacacucucaguuguuaucuuccaccaaaaagaaguccccgugaaaacauuagguaagacuuuggguaaacauaucaaccgggucggucuagagaugaugucauaagaaacccgucacuccaucaggagcguaaaucugacagguucauccaugaauuccuacagaauuuguuggcaagcauguaaccagguguacuucacccugucaagcacaacagaaaagcuauaggcagggcuuuuauaagaagaacggagcagaacuacucagugaucaccuauguuuguauuaauggcagcuuuuuuaaagcuaugcuuguuauuuuuuaauuaaauaugagaguggaccuuggggcauucuuuugcacacagguuucagaguuguugaaaacugugcggggaagggagaacaccaggaaugaguuugugagcgaacauguuccaccagagggccugugcugaguauauacccugccugcuauacccagggaggccuuaccaacagcuugcuaugcugagucuucugcuacacguuuuacacaaaagcucuuuguggugauaaccaaaucgugaaauuagcaugauccuuagguucauuuugccucaagcacacucaguugcauauuugccaacaaauucugaaggaauccauuggugaaccugucugauuucugcuccugauggagugcgggguuucuuuucuuuucuuuucuuuucuuuuccuuucuuuucuuuucuuuucuuuucuuucuuuucuuuucucuucuucucucucucuuucuuucuuucuuccuuccuuccuuccuuccuuccuuccuuccuuccuuucuuucuuucuuucuuucuuucuuucuuucuuuuuuugguuuuucuagacaggguuuuucuguguagcccugacuguccuagaacucacucuguagaccaggcuggccucaaacucagagauccaccugccucugccuccugagugcugggacuaaaggcgugcgccaccacacccggcugagggguuucuuaagauggcaugaacugguuggcaugguuaccaaaugucuuaucucagacaaggaaacugggguuagagaagucaggugacuuagccugggccucagagucuuuaagcuuugaaaaaugaagauuuaggucaaguuuggucguuuucuagagucuguggcuaucuacuuggagcuauuaaaaacagcuuaggacaguuccaaagagagaaccuucuuggaggcauuuauacuggggagagucagguaaaggauucugagcuuugaggacccccuccacccaagauacuauagccagggaucuuggagcugggagaagacacauugaaucuugguauaagagcaaacaaguaggcuggaguagagcccaccugaaacccuguacucuaggagauggaagcaaaagaaucaaguccaaaaucaucuuggguuaccccaugaguauagccugggcuacacgggagauacuaucuuuaaaaacaaggagcuuucaaaacagcuagcgggugacugcuuggucaguccugugcucuucuggggcuacgaggggaugccaugaccaaagcccaucacccuuaaauucuaagaagaggaacaucuguuagagcuggcaagaugguggcuuauuggguaaagugcuugccaaauaaccaugagguccugaguugagaacucauguguaaaaccaggugcuggagcccaugcccauccucccauugcucugaaggcaagagacaagggagggccccagggaccuuggaagccacagggcucugguauaggcacugagugacgaaacgaacccaucuccaucaagaugguaggcgaggagcaauccugggauuguccucccucucagaugugcuugcagugccaguggcaccgacugccugucugcuggccacugucuucagcacuucaaaacauuucucuauuuagcacuugcaaugaccuugucaaagagagucuaaugagaaagcgggaagaccaacaggcaagugccaguuguggaacugaaggugguggguacgggaagggagaaagcugggcuuuuagccuugaauaaaguguugagaaguaaagauacaaccacuguuuguauaugauuggccaagggaguggcacucucccagagaguagaagguguggccuuauuaaaguaggugugucacuaugggugugggcuuuaagacccucauccuagcugccuggaaguugguauucugcuagcagccuucugaugaagauguagaacucucagcuccuccugcaccaugccugccuggaagcugccauguuccagccuugaugauaaugggugggcccucugaaccuauaagccggcccugauuaaaugcuguccuuauaagaguugccuuggucauggugucuguucaccgaaguaaaacccuaacuaagucagcuaucuaaacuccuucacaauuacauaaggugauuuggggggagggggcaugauuuucauuuagccagcauggauuuucggguucaagcaaacagguaagacaucuaguuucuucuacaucccuuugaagccccuucuuauugaaaucucaaaaccuggacauccaggcuuaggagaagcugccuggugucuuaaguucagacuuacuauggcaccuccuucugcagcuccauacagggaaguuaaauacaaaaucuaucucucuucuucaaaucuccucccaaucacugaucucuccaagaaaaaaaaaaaaaacacaacuaaacagucucaucaggggagaggcagcgagggcagaccuaagucaccccuagaauuaacacaccugcucuuugauccacccagggcccuccccaaggugaccuugucagacaacucauacugggucaucuauguuguccaggggcucagggucccguccucggacccaggaacugcuucagaccucacggggauacauuacaauugugaacucacuccacagaaauaaggaacaacccaggacuaaguggaaauagccauucuccucgccugcccuaggauguggugaccaggaccagacagggaaagaaaggauuccucccauggcuccggaagcccucaggcgggcuuagaaacacacugcccaugaccacagcccagggcucggguaacccugaccgcaguagacaauaccacagggcccuggccucuacuaucuuuuguccccaucacguuucccuaauagaugaucccaccgauucccauuggcagcccuuuguaccguaaugaacaggaugcaggcugaugaaugcagccaccacgcagaaaacgucaguucuuucauuaagcaaaccuccccagguucauuguauugaaccaggguuuaggcuauuacgcugacacaugacagaaccaauucuagucacauuguaagugccuauucauguuuggcaaauucuacuuuccgcacauacgcacauuuagaauuagacgcuggcugccugcaacuccuccccccccaacccccgcccugaaaucuauuuuccuauuuuuaacugcuaauaauuaagagaaauccugcuuuaauaacagaaucucaaugaaccuaauucagugggggacauaauggaucgccacacugugauucuuuucugacugcuccacaggcaggcuggcuuuucgaggacacucagauauugacaggcuauguccauuugcagaagggaacauaauaaaauauuugcacacgggguccugacacugcaagcucuucuuucuacucacuguuuaaaagagaaaacauuucuuuuucaaguuuggauucccugcuugugaaaaugccaucacucugaaggaaagacugaaggagcaugccugaccaaggggcagcucggggcaccaggacaaugaguacugauggcucuucuacccaucacuucuuacgugacuguaccucuccauaagugugugucuggggugucccuggcaucggcucaaacuuggugccaggauuugggcaagaggcuaggagauuugcguuucaguggccucgugcuguggcuacugacucucuugucuccuucaccuaccacccugacuucaaaaauaguggcugcuuccucuccuuuugcacaggccaaaaguuucagcuccagagucgaggcgaucacuguaccuacaguuuuguugguauucacugagauauuugcaugaugucauuuuuuggggaugggguucaguuguugcccccucaaaagccccaucccacacagcuucggaaaugaaagaaauauuagugacugguggaagcagagcaugauggucugcauaugcucggcccagggaguggcacuauuaggggguguggccugguuggaauaggugugucacugugggcaugggcuuaagacccucauccuagcugccuggaagccagucuucugcuagcagccuucagaugaagauguagaacucucagcuccgcccacugccaugcucccaccuugaugauaaugggcugaaccucugaaccucuaagccagcccaauuaaauguugucguuuuaagacuugccuuggucauggugucugaucacagcauuaaagcccuaaguaagacacagagugacugcuaaaagggacaggguuuccacugggggaggagggaagaagucauaguugggaugaguguggccuuugugaccuuagcgucacucugauauacauguuauuccauguucagacaagaggcagcgugggauucagccuucacggcugagaugugucuuacucaucugacacuggacucuccaaccuucagaguggaagccgggaagagaguucuguugucucuggggcacucuguucuaauauuccacaaacccccaggauggcagcuguccagcagcuaucccugcagccucuccucgacgugcaucccaacugcggagcgcacaccacccgcucugccuuccugccacuccucagugucucaccacccucaacucagauuuauuacaggcuuguccauaagccuaccucuagugaaaaugacaaagaaacaccuugcuggaagguauggccaaagguaaaucauaaaccuuugauaaggaacgggacaaauccggacaaacagcugcucuaucccacuuuguauuaagcagauaaugucacacagaaaaucaaugugcaauauagacagggguggcaacggcaagacuuggggaucaggcuuaacgguuacaaagugacagcgucagaacccccaaauacaugagaacuacauaaauuuuaaaaacagacugcagauucccgauuuacuagaccugccugucauuucaaucuccuuuguaguuggugcuaaguccugggacgucacaggcauuucuccgugggaagggcagaaaggagacugcugugacauuuuagauaaguuggcaacucgugcuaaacagauuauuucaauguuggcuauuuuaaaaauauuauauuuuuaauuuuguguguguguauauguuucugugugucugucugugucugugugaggguaugugcacaugugugcagguauccccagaggucagaagaggguguucaauccccuggagauggaguuagaggugguuuugaguugcgugaugugagagccgagcuggggacugagccagcccagaucucugaagaagcagcaagagcucuuaacugcugagcuaucgcucaaguccucaaaagaugcacacauuucccccacccagaaccacuacuacuagaaaugcucccuucugauggcaucacuccagugaacaucacagaugugcagggaugcuugugacaaguaccgccgcgugcugcucucguuucucaguuaugcugggaaaugguugaggaggaagaaucgaugcuggagccccaacuuccuguccuaacuugacaagcggucauucauaccucagagugugccuguuggagucuaagacacacaaagacucggguggacauuguggcucacacuuacaaccccagaacuugggggugggguggggcgcgaugggaguguccuaagcuaugcugcagcccuuaccaauaaacccaagagaaaaaggagaagaaaaccaagcaacacgcagaaacaugagcaagcuuacacauaaauaugggggcagaggggggagggaaggaucacacgaaguccagagggacugcggaaaucaagccacgucaccuugguggggucuaaguucuaagcuucgaaucacagcuuuguuuauucuuacuuggugauaauuguucacggcagaacguaucagaaaauucuauaaugggaaccacagccaggaaauaguaaauaauuaaucaccuccccucccugccucuugcaucucuguugauauaaauggccguauaauuccaaacccaauuaucacuacuuagccauuccauuuuguaguuaaaaucccgcaaaauuaaagugcaucaauuguuaauggcaauagaccagacaagggauuaaagauuauuuuaauguuuauuuccugucaagacaucuuuuggcaggaaacaccgcagacaaaaggcugcacgcucagaugagauucauauauuuaaaucuucuaacuucuaaaaacauuauggauauaauuacuuguuuaauuuacuuguuccccuaagauacaggcugaggaggccgagccaacuuuaugaugaaaaguucugagacaagaaaggcagcgcucuauagcuuuguaagcuauuuaacguaugcagccacauggaauucaguuuacaugcccaccaugaugaagaggauggggcgggguaggcagcaaaggcagagagaagggaggacaaaagacuuagaguucaaggcuccccucugucacccugggcacaugucaaucauggucucuacuugggccucaguuccuuguuuacaauaaaaggcaggaaaggacccggugcagagcaaccuggccaaaaaaaguaugugcaaagaauguggaagaccuggggaaagucacguaauuacagugagguaaccuacaacuugcaaugucauauguacacauucugauaugguugcccuuaccuguaacaugugaacgugucaaugggaaugccucauacaugacaauccaacccuuucaguuaucaauaacauacacacaugugugaugucucaggcauccauccucaccuucgcucccccccccccaaggaagacugcucagagacaguguaugaaggacuuuggaguccaguuucagaaauauugaucugucaggugugguagcucauaucugaaaucccggcacauuaagaggcugaggcaggaggauuacccccacaaguuuaaggugagccuaggguggcuauugaggccuugugucaaacaaaacaaagcaaaacaagaacauugauccuuuugcaaaaaucaaauaguauaaggagguuccuuacuuuugacaucugugcugaguaagggcaugaaggcuggaaggauaccucagcacauaacauguguggcucucucagagggccaggguucaauucucggcacuugccugccagcucacagccaucuguaacucccaucccaaggucuucaaugccuccucaggcacugggugccugugugugcagauauacaugcaggcaaaacauguauacacauaaaauaaauaagacuagaaacuucuauguaaagaaaggauauaaaauugauguuuuuauuacauauuggauuauguauauauucagcaaaagagaguugacagguggguagguaacuauacugauagauagauagauagauagauagauagauagauagauagauggauagauguacuauagaugacugauaaacagaagaugauagaugauaaauagaagaugaugguuacauagauagauagauagauagauagauagauagauagauagauagauagauagagaauaauucuacuguauacccagaaucacuauuuaaaucauugagaaucagaauuggaaugagucugggcccuuuuccaaagugccguguuuauuguuuaucuguuucauuaggacauaaaaacuucacuagaauauaaaagaaauuucauuaguguauaaaaaccacauaggaagagacagaccucugcuuuguucaacggugucuuguucagauuuaacauuaaacuugauacauaccagguucuugauaaaccccacggcaugcauuauuuucacagagggauuuacgccuuguuauucccgcugucuguguauuaacaaaaccauaugaucccucagcauugggaagcuuauccacagccacagcccaggcgaggggccaggccauugggaucugcagggacauuauaaguccugaguauagcaugucauuagucaggacuugagagggcugagggacagcaugcugcuucaaggagcagaagugucacuuagaagaagggucuuggguuggggagaugguuucacccaucuagugcuugccacccaggcaugaggacucauuaaaaagucagugugacgauauguauuuguacucccaguguugggagguagagacaggaagaaccuuguggcucgcuggcaagccaaccuggccuaaccagugaucucaggccacacuaagccuuugucucaaaaaccaggguaggcaccucuuaagaaccaaaacuagacuauccucuggccuacacagacauucauccaucacgaucucccccagacacacacacacacacacacacacacacacacagagagagagagagagagagagacacauacaaacaaacacacacauauacagauagguaaacagauacgcacacacacacacacacacacacacucucagagaggcuguccucuucaaacaacagccacaauucaaagccaaguccaagcagcucaucugcaaccccuggaccccagagacaagggggucacggcuaguacuguaucaggaacuccaauaaugccaccuugagccuaggugccuucacucuguccaugguccccaucagccuuggccuuaccucgggcugaaaggugaugagguuucugcaucagauggccccugugaacccaaauugaaccaacaacuagaggaagcaaacaguccuucuccaucuagggggagguggagauacacagagacacacauacacacggacagacacacagacaccgacacacauauccagauagauaaauagacauguacaugcacacaugcucagagaggcuguccucucugagcccuccacauucacuggucaguuaugggucaugagucuacugcauagccaaccacuggcuggcacacacguuucucagguggauauguagagucauccaucauaauugcuaagccaguucaguacaguagugccccgcuuuggucccagcauuuugagguugaggcuagacgauggaaaguuugaggcuagccugggcuacauaguagguucaaaacaagccucagcuacaaaggcaggagagacuguaucaaaagaaaugcuuaagauaaaacaaguaauaaacagccucaauuaauuuuuaaaauucaguauucagacuguaaacaccauaacuauaaaaaaauagagaaugguucaauaaaacacaauucuuccauauggugccaucuuuagagucauuaaaacauuuuccaaaaaguguuuaaugauucaaacauuuuuauaugauagauaguuuacgaacucagcuugccaaaugcuagcauucgggagagaauauacaagauauugagaggauuuaucucagaguaaugaaauugauagaacacuuaaauuuuccucugccuaaguuucuaaauuuuucuacuucucaucuuucuaccauucauguuaucuacuacccaaaucaaaaccaugaaauuugauucuucaaagugacaagggauaggugaaugaaagaaucuaaccagggucugaagaauggcuuaguuuaaaagacucagcuuguaaacaggaaugccugagcucucgccucagaaccaacauaaaaguuccagugcucucugagcccagugcuagagaagcagagaccuguggacuccugaggcacucgggcuagacaguuuagccuuacucgugagugccaggccaaugacggacccugccuuaaaggcaguggauggugcuccuaaggacgauaccagagggugccuggcuuccauaugcaccuguucacgugcacuuacacaagcauguaaaguuaaauccugcuggggauaaaggaagcuaagccuaggacagggaagauggcacguggugcucuuuugugagacgugacuuuaguuuccaguuccuaugcugagaggcuuggagccaacucgaacucuggaaaaauccaaaagccucuucuggccucuguuggugcuugcacacacacacacacacacacacacacacacacacuccuauagauauacauauacaccccuauagaacacacaccuauagacauacauacacacacaccccuauagacacacacacuccuauagacacucacaucuagacacacacaucuagacacacacuccugcacacucauacacuuauaguaauacacauacucccaaucacaauaccccuguagacauacaauacaccccuguacacacacacacacuccuacacauacacauauaccuacacacacuuaaaaagaaugaaugucuaaaaagaaaagagggugucagucaaaucagaugcuggaugugaucaaauaauuuacugaggucauuaguauguuaggaacugcacaaugcuauauaaacagcuguaugcauaaaaagaauacuugcuaaccuauuagcucuuauuacagaggaguccaaaucugguaagaaaagaaacuagacacgaugcauuuuuuuuuacacuguguauguaauucugugaggaacuuauuagaugcuacaugacucacacacacacacacacacacacacacacacacacacacacacgccaacacacauaaaagcccuggagccacaugcacgugugcguuaucuccaugguaauccagagcauuggcugaucucuacaaauuggggugggggugugguccagccauaguccugcagagucagggugcuuuggcugggggaaauuuggucagaagacaacuaaaaugucugacuaauccuacuacccaguggggucccuggggacuccaaacagauggagaaauggcugugucuagggagcuggggaggaaggcaggcgagcugcugagaggugaaaaguccugggguuugggcuucaaggagaacucugaaguggaucauccuuagguaagaagcuuauuagaggaauuguuaaugccacagacagacaggcagaaagaggaugacagacaaacucugcguugggcucugaugagaguucugccgaauaaaucuggccguuuauguguuggggagugucucuccuuauuuuaaucaaauuuaauuaguuaauuaaucaauuuuuaaguuuuccagacaggguuauccuguguagcccuggcuauccuggaacucacucuguagaccaggcuggccucgaacucacagagauccaccuguuuuugccucacaagagcugggauugaagguggguagcaccaucagcaggugggaaugucucuucuuguaggcucagggaaaguggaaguuuuguuacggugcugagauuaaagccauuagugcuacuaugccugguuuauuagggcuuccuuguuacagggucuguggccauaugugcuauaccuggcuugcaaaugcauucuaaguuaccaggggucuugcucucaagcuucuucaggauaccggacuuaucaucacccggcucuccacauuccuuuaagucagucccagccaggccagugccagcugguccucguagaagaaaaugaaugacaggaauacaauugguuacagcuaccaucuguuucuggcauccaguuacuauuuccuuuauacaacauuuaccucuuugcggugauggcuaagggcagggcccauccuauagaugagagaaccaaggcuuagaacaacagacaguuaggagaacaguuccguggaacccacuuuggugggaugcagcuggcccugacuccccaaccacucugacagcagaggggcuuuuguuuuuguggcuuggggguguugcccgcuggacuccucacccacgcccucaagcugaacaccugcgcuggugagaagaagggaggcagggggcuggccuuaggacaaacaagagguagaucccugaugugcaggcauccaaguucucagugagaagcaaggagaaagccagggcuucuccucacuccuccgauagggcuugaaggauagacucuggcauccuuccagcccagaucugaaacuguuuuaacaaucugcucacacuuccggggacccacauggcuucccaccuccaggggacuuguucuccugccagacuuaaagcaccgaauagcuacucguauucaaccugacagccauagauauuaagagucuaauucaaucguuauaucuuuucuguagacacaaaggagccacggucuugcggcaccucagggcuggcucgcuugugcgcucucucucucucucucucucucucucucucucucuccuguuuaagcaugcuggggaugcacacacaugauacaguuuaaggagggauggaacaugcugguguuccuucgguacuuacuaaacaauguaagaagucuuugcuaguucucaacaccagcagagagccgugaggcaccuaggcacuagguuugaaggggugggucuaaccucccccagaauaugaugcugaacagaugggcaauggcuuugcagucagggagccaucaauugaacagaagaaaagccaagauccugucagggaugggcugaggggcugcucuguuaaggagaaucacauugcuauaagggcuuugaauguaaccccgagccaccgcuucccauuccaucuucaggggaagacgcggcuugcaagcgagagcauaaacuuugaacuugucugugcacauuaguauggcuagcuugcgaaagcucacagcggaacgcgguagacgggaugaggaagacgugccacggggaaacccauuccauaaccuuucaccacgcgugaaauuuacugugaauggaauuuccaaaaguccauguuggcuucugauuuaaaacuauuagaucuggugucuggagaacaccuccauuacaauaaauacaucauuauggcauaugcuaauuacauaauuucaaccaauccaugaaaaaugcaucuccacaucgguguccuggaucggggcuggcguggggggggggguggguucuaguuagcggcagagcuucaggagagagcucaagcaucaauuggcuaaccucaucuuggccugggacaggaaggaaggcaccagagccacguaggugaacaaauguggaucccucugcuuaugggauguggguguggucuccagucugugauaugucauagaggaguuaccuguaauuuauggauaugaauauaaaaacagugugacaugcacuuagguauuucuucaucuugacaguacgccaccaugaaguccuucuuuccaggaaacagagagaaaggccacgcacuuacuaauagcaacuagacggaaaaguccguaggguguuguucuucacaacuccuuaucuagauucuuuguauguguguggugcauguguguauacauauucacaugggugcaggucagugcgugugcaacagugcuuguguuuguauauauauauuuuucccaaagguucuuagauuguauguuuauauauauauauauauauauauauauauauauauauauauauauauauacaugcauguauauguucacaaaagcagagacuagaggugucagauucugcaagaguugggaucauaggugaugauaagcaacuuugaugugggcacuggaaacugaacucgucaucugcaagagcagcauaaaccacuuaacugcuaagccaauucuccagcccacacacacacacacacacacacacacacacacacacacggaugcuuugucugaguguaugucugagcaccaugugugugcaaugccugcagaggccagaaaagggcauacgaucccccuggaacugcaguuacaaaagauuauuagcugccaugugggugcuaggaaucacacucagguccucuggaagagcagccagugcuuuuaacugcugagccauuucuccaacccuccuucuuguauuuuguggcaaggucuuuuaugggaguccagaggucaaugaucuggcuaguuuggaaaaccagcuucuucccugggguugcaaggggcugcaacacccacugagcauuuauuuggacacuagggauccuugcucuguuucuaagccccacggagcaggcauuuugccugcugauuucucacccauauucccagcgugcagcccagugugugucuuguucuuaucucuucugugcucuuggaccucacaaaauauucauaaggcugguuccuauuacauacuaaauuacugauuacugaacaaauaugcuuggguuuggggagagaaaacacacucucuauaucuacugggcucugcauucaccaugucugguauuugaagucauccagauugcaaaugaggaagaggguggcaagcccagagguugucauucguccacuacacugcagaucauauaggaagcuugggccugggguggggaccugggaagaacagggaggucuucagagggcaucaccaagccaucagcugagcugaaguaauuaugccaacugccucaagcugggaaggagaaaaaaauuuuuuuggagggagcuguuccccccgcccgcccauaccaguucagcugcugagcaagcagaguuugguaugaauaaacucuaugggcacgaggaguccagggcuuccuuuuaaaucaguuccuagaaggcaaggaaccaguauaucauagugagacaaucauuuauaaugggaccauuauuaggagccaagauauaaaaauuguacaugaaacagccuuauaagcagguucagugcguggcugauuaaccucccuggucuaccgggggcugaacggcucaggggagugguaaugagauguggaaaucauuugccucgaggucacagguuuggagccggacgugugagaagaaggccuaauugcuacucaugggugacuugucggugugcuugguggagacacucggauggggguucaaaucuugguccaaacccgaacuggcugugggguuucuguucuggccacagaggcuccaaagccucagauucuugagucagaagaauagcucagggcugauucuguccagccagauaaauauaagcaugcacucgacuucugaggugucuugggcaaggggcucaaaugugaaaaagguguucauuuguguuucuuacgcaguguuacaaguucaagaagcuggacuuguggcuucguuggaagaaugcuugcuuaacauccucagcacugcaugaagccauaugucugcaagcccagcguguuggagacggagcuaguaagaccagcagucaaggucauccgaagcugcauauagguucagaugccagccugggcuaugggagacccuaccucaaacaacaauaaaagugacagacaaaauaaaaggaguuucagacucgagaguguuucugauuuuggguuagaaaagaaaauacuauaauauuguaagcaacaguuuacaugcaggagacugaaugcuaacucuaaccuguaaacauauauuagagaagagggagaaagauaaugaguucaaggcuggccugaaccacacauccaaacccuccuccccauuaaagcaaacacacacacacacacacacacacacacacacacacacacacaaacacacacagucaacauaaaggggaagguacuacugaaugaugaacuugaagcucuggguucaaaucccaucuaugacucuucagguuaggugugagguuucaagaugaucaggccacacccuccugugauagcagccuguuacagcucuuggaagagaaauggcaagacuccaggauguugaccagucucacuucucagaucugaguuuuccagucuagggacaucugagggccucagguacaaugacaaugaccccucucuagacauggcucuccucccccaugccuuggagucccacauucuuccuucaaaccuuucccucuauccaggaaucugggacagcuuggucuccuucaacacaauccuucuccuuucucugagaccaauaagaagagacacacucacacgccuuuaaucccaggaaggaggcagaggcaggcagauuccugugaguuugagaccaaucuggucuacagagcaaguuccaggacagucaaggccaugcaaagaaacccggucaaaaacaaacaaacaaacaaaaaaccaaaucaaaccuaaaaauaaauaaauagauagauaguuuagaagaagacgaugaagagaaggaagaggaaguggaagacauggaggaagaggaggaggaagaggagggagaagaggaggagggggaggaggaagaggaggaaaagaggaggagggggaagaagaggaggagauacucccaaacacauacaucaucagaucuguggggcagaagucucaucaaagcccaacccaugcaucugucugucugucugucugucugucugucugucuguggcacuaacaacucuucaaauaagcaucuuaccuaaaaagauaaucuacuucaguauccuccuugaagcccaaacgcaggcccuuucaccucuuuguucccucccucauagacuuccucaaccuugaaauaggaaauaaauaccaucuugacaacacaggaugcugcaggauggauguucacaaaucacauuauccugacuuguaauugugugugugcccgcaagcgcgugcuggcccaccauucauucaacuuuuuguugagaauggagagaaauuacggcuuaucugggggacaggcgaucuaccaugaguucucacaccccaucuggcagagcagucugguguuagcucucagauacacugaggcugcuuuucucuucuccucccgcccauccgcgcuucccaaggacuucaggcacuugaugaaagagcaaacuaauccucuccucggugucugugaucaagaucuauuugguagcccacuccucugacuccgccugugcggagaaaccauuucagcuccccgcucauuugaguguugagcugagaucuugcagcugcuugcugccaaaccugaaagcagaaauuaauuucaaugacccaggccgaguggaggggaacgcugucagguaauuaguguuccucuuuugcuacucagggccuaucgccgccguguguuaauccauacacaaauugaggcauucucggagucgccugagauuuucggggcuuuuuuuaaguaccucuugcucggguuaacccagagccuggcaucuucauggaggggggauagaggcucccuuucuucugugucuggccagcagagagcacaccccugaguucuauggucucuuuccuuucgauugagccugccuugaugaaguagugcucagagauaagggggggaggcguuggaggggguuccuauuccugccacuuuauuaaugaaaaaggcccuaauauugauagcccugacaucacaaguauaacaauuagaggcuuuguccuccaaggcuucuaauuuaaaaaggagcccuucucuaucugggaagagcccuguggauauuuuacacuccucucucauugaguuuuggguuuuucugccuuucccuuugggaaaaucccuuaagagggauuuuagacuugaaaagacaacaaacaaacacacacacacacacacacacacacacacacacacagagagagagagagagagagagagagagagagagaaacuuguauggaugauuuuuuuucuccuuuaggagucauucuaaaauccaaagguaaggaaagguguuagaggagaccccugcucagaaagcacagccuguacccugcagugguaccccgaaacaccucugaacuugauguuuuuaaaccugaaggaaguggggaucagaaaggguaccaacauggaccauacccaugaggggcuuccuagcaccucucugaagggcucucuaguguagguccccacugcuguggcuaugggggcuuuugcaugugacgcaaaauagugaucagcucagaaaagucccgcgccuccgguccuucagacccaaagcccuucucuaguaggcaucuaggauaccaaagcccagaggucagauaguaccagcagggaagaaggcaggugaaauggacaaugugguuacugggcuggucacagcgccaccuacaggaggagccuguaggugccaccccgucaagguugcgugcuagaacccuagcucagagcacccaugcugaagaucagaaagcugaauuuggaagugaaauguuuccuugaggguguuaggagagcgcaggcuugugacuucugagaugcucuccacggaccugcugagagucacccccagaguucugacuuuuggagacucacacuuuaauccaggguucaagcaguauccaacuccugucucagccucccagaggagaggcugaaggugaacuugaaccucccaccccgccccucccccuccguccaaggucuguuuuuagagcugcgaguaccuuggacucauggaggucccccugauggaugccaugacucaaagcuuuuuuuuucuuuuuuuaaauuaauaccuaauacaucuuuaccucguggccuugguguaaacgaaaaugaagucacuguuugacagcuuaacauucuuacucuuguaucuggagugugucuugagugguggagucacccaacaauguacugaauuuaagaaggaaacccaauguaucccccccccccucaaaaacaaaaacacccaaaaaauccucuuuuuugauuuuuccaauggccauaaggucccugcucugccuuggcccugaccacacagcucaaucggagaaaaccacuguguuucuggaacccagggcaacuguccuuagaacuaacaggaguuuacucaguuugcuaaugaaccgucaugugaccuugaacaggaucaugugaguaugcucucucucucucucucucucucucucucacacacacacacacacacacacacacacacacacacacacacacacauuaccuuucacaagcuuugguuuucucauguacagaaugacaggauaauuccgaccccacagauuugaugggaggguccuacaaaaugaucuauggggacuguuggaaccagggccucccaucugccacguugaugcccugccugaaguuccguggguuggagcaggugacgacagaaggccuccaggggccuuggggcucucagcugaaccggcucucgguucccagucccuauuccacucccaccguaccacccaauaaacaacaaauacgcacaucggacagcaggcugguucuucagccucagucugucuaccacuaaaauggguuuucuauuuagcccagggcugcuagaagcugauaaaggacaagaagccugcuacagcaggaaauuaacucuccaccaccucuccagaggaacuccagaguucuuuuacaguccuuucacuauggaggcggugaguaggaagagagaggaaacaaaaaagcugcccaguuccaguucugaugcacuuuauuguaacuggauucgcuccagugcccugccccccuccucccuccccccucuccccuccagccugcauuggggcaccuggaaaagucauggccauccaucuggugucaaguggcaccaaucucugcauucugugagagucaauugcaauuaacagggccauucaggaaacggcagguacagcccagacaaaggcagcccagacagaucuuaucagagcccaaggccggcaggacugucccuuucugaagcugccugccugggagaaaacccuggaagaaaggaaggaaggaaggaaggaaggaaggaaggaaggaaggaaggaaggaaggaaggaagaugggaaaggacagugagucauaaggaggaggcagcgagauucaagaaaagcaagccagacuccagcaagcucuugggcucagacacugacaaaccccagccaccaggggccuucagcaagucacuccacccuugccagccagcuucagagcugcagguggcccaucuauuaauagggacuacaaacggcaccuuccucaucuugaaacugucuagaggagacaugcugagggcgguguuuacuguaaaggaucaggagagcuugagaguggugggagagcucuggagagcgagcgugccuguguguguguguguguguguguguguguguguauuagcagagcaggugucuuggagagaagccacauaccacacaggcacugggugagccugcuggaugccaccuguuccacccuguccacuugggccacagggaauccucugcccaugcagaagaaaaaaagcucuagaaagcagccagucuuccauuuagggaaucuggugacuagccugccugcaccaucagggggaaggggcugaucgccauagggcaacaaggaggaucagguagaaucugguggcagugguaggcacucaaggcaugugauucacuuucugucagcccacauuccucgguacccuucagggccaggggaguaagcucaagcccaguagguaccuaacuagggccagaggaagaaugggcccccgaccaggccuuggcucugacugcgugaagcaguuaucacaggguggccuggagguugaaggccuucugcacccuuuucuguggagaggguggggcaugucuuccccguuuuacuuuccaggcuaaguggccuguucuugucaccgucugucguugggcacuuauuuugcaaggaugcuuugaauuucagaaauauggaguuuuuaaaaauccaccaauuaucauuuuucggugugucuuuguguguaagaauguuugugugugugugcacaagugccggugcaugugaacgucuaugcacaugcauguggaggucagaggucaaucuuuggugcucauucucaggccaugagccuccuuuuucuucugagacagggucucucgcuggcuuuuaacuugucuaguaggcuaggcuggcugcccaugaucccucugagccuccuauccgcaccucccuaugcugcccuuacagccacaccacccuuggguucuggaugucaaccacuguuuccccaguuuccauuaaucagaaagguuaaagggagucucagagcaggaguaaagagguucccuuccaguaagcaaaaggagcuggggugaucgggugaggggugggggaggugggggugggggguggggagcagccaccacauuuucuaacaggaagagaaagaaaccacagaagcaaaacaucauugaaucgggagccuguuuauuccaaagaacaggagcagagacuaugccccaacuggaugccucuauuguaaucaucagcucucagugucugaugcuuaagcauauugauauaucagguuuggugacaagguauuucgugcugagguuucugaggugucuaguggagccagugauguguaguaggaagucaacaacccuuagcucccuccucuugcauucuguguuaucgaagcuuucaucugagcuggagagcggcugauuguaucaacagcaacauggauuucauuuaauaucuaucuucuauugacauggaaccaccgacucuuaauagcagggaccuguucgaggcaccuuaaaauugcagcucgagugcagacuucucuccuaggaccucaggguggugugcagggggaaguagggacggggaacuguccacccaccuuugcaguggcugggugaguuacagaauuauauuaccaguacaauuaggucaggguuuccucugcauugccacagcuaccuuugagcccugugugacacaagguguuuuccucugugaccuggcuuccaaggcaucuaaacugggcuucacugaggccauauagaaaagcuaacaccagagugcucucucucucucucucucucucucucucucuuucucucucucucucucucucucaugugauagccagugcuugucaugacagagggaagaagauaauaauauuaaugaucuugauguugaccaugucaaggcugacuguaccacauucuuccuaucaggcguagaaggagguggucccugggacagggcuuaagauuuuagcauucaaguucagugucauuccuccuugggcuuccugagggacagacuacagguacaggcaggcuuccauccuacaggcacagaacuugggguggggauggggucuacacugaaaaggucauacacauuuaauucugggggcucccgagccagauuccagcaagucugggaucuguuugucucuaaaccagggguuccaugaaaagagcuacgguuuuggcagcagauguacuuaagugucacaucugacuuucuagugccccauguaacacuagaugaggcuuccugucuguaaggugggguuucccuuacagcaagggaaaccacaguaccccgggaacaugcugucuuacucccuacugcucuggguagcuuugccuccuuucugaauacacacauugagcccuuaucucucacugccauacaagccuaugcuccugagcuucugacugggugggccaacugcugggccucaggcuugucuccucuggacaguguucaugagugagacccacauaccccacaaggguuucagguugcuggcuaauuuguugccacauaucccuaaugccaauucagacacacacacacacacacacacacacacacacacacacacacaucccuguugucccacuccgagagauaucauuucugcugcccgagugagggagccggugaaggagacgaacaccuucaguagaaagcccuuuccaagcuuggggauuuuuaagguccacuugauugcuuguuuguuugugacagacucucuuuauuuagcccaggauagccuugaacuuuugauuugugacaagcuaccugucauaugcuaagcagacugucugcucuccgcugacagcuauuuaucuuaccccuaaucuccugggcacugcauuuggaaggaaaggccucagagacuccugggacucucugguaauggaaaaaacuuccccuccaaauguaaagaaggucgcuggugcagaaggaugagacuucaugugcagucacacccaccgugcuaucuaugggaacauuagcccgcacaacacggccuuaaaccacgguggcuagcuagcaaaagcuccaagaccucuucuugucuuauaugguguuagacuaccaaggggcauguggcccuuuggcugaagcagcuagaacuguucucagccacaggaagccugaaaagagggccacaagagugacccuccugcucuccugaggugaccuacaccugaaugaagaaggaaaugaguucuacucccagccccacuccccugucugaugcacaugggagcucaacccaggcugacagcagcuaccagcccugcagaaaucucuuuaugcaucacaggagggagagaagaaagagggcggcuaacucauccucgcacuucacagcaugcaggaggcugcagguugcuuucuagagcugugggccuugcggcaagcuguuuaggaaaagcaggggacuuuguaguggcuucacaggggccagcggcuuauuggcuucacucguuagaaaccugcccuugucaguguguguguuguaucugugaaaugggggugcgcaaaacuggcucccucccugauaagauucuuuuuuuccuuugcacgcuugguacugauuagguuaaaauagggcagagagggaaggcagagaagcugucuggcggugagucaccuaggagacacauagacgaauccaggagcugggggucuggguggggauuaaaaaaaaaaaaggcaaaagaggacuagagaguuggugcaguggagaguugugcaagcaugaggacuggaguuccaaucuccagcacccaucuaaaaagggcugggcauugcuguguauauuccuguaacccagcacugggaggugaaggaaggcugucccugagaguacacaccagccuugcaucccaccugaaaggaucagcucccgccucagggggagacccucucaaugugccagacuuucugcuaugcuucugugcgcacaugcacagguaugccaaccugcacacucaaaugcacgcagugcacacacacacacaccacgcguacacacucaugcuaugguggaaacaguggggccggcugcuucuugcucccaccaauguagcuuuuccagcaugcgucccuuugaacugugaacccaaagagaaacuuccccugguaagcugauguugggucacaucauauugaccagaaaggcaaacgcuacagagcucagucagggccugggaacacgguguguguccacuguguagaacagaaugacucaggcuaucauggagaugccaggcaacaccacagcagacuauauacagggaaucacugcaaagggguggguagguuaaggaagccaggagcaaaauuccaacagcgccucucccagaaugacuuuacugccccagcaaggaugcguaaggacccauugaguccugacagccggugaugcuccaagagaaacaguagcugaggauucuucuccuggaggcuggucauauaggaagcacuuuuggauguggggccaaaucccagccuccaggaaggacggguguucugcacaaaccguguguuuaggguuaaauaggcaaggucuaacaagaccuggaaauggugagaccgcgacccccaccucucccagaauccaaguuuuccaauguccaccgagaacuacaucugagcagaugaggugcuguugccugggcggugauacuacuuccagcugggguagcaagagggggcgcacaccugcaucuuguacucauucaacuagucucauaccucacaggcgucucacuggaggugggcagucuacagaucagucuaaaaccccaccucugcccacgugcauccgagucugucuaguaggaggagaaagacaaugaggcaggguggggagaacuaaaguuggggguuaagacaagagguaaggaaggggcgcugugaacgggaaaauuaagaagugaauggcccaacugaacccuaagauaugagaaagagcaagagagagaggacaguugacagagcagucugaaaaggcccaguggguggcacaagaagaggaggugcccccccccgccccccccccaagcugggccugggcuuugacuuuucuuuugcugaagagauaagaaaacgugacaaggacacuggagcgccugacaggacagagaggaggucagacuucagaccucagcggaggcgggaggggaugcaggaggaggggacgcuaacucugcagauaaacaguuccccccucacuuuggagaggagaugccucagggagaaggaagucucuuuaguauuucccaacccaccccucuuagaagaaaaaaaaaaaaaaagguacucaagagaaagaaaaacuuccugguuuuggccuuuaaaaugguacuagaaguccaaggggggagaagucuaacauaggaaaagcaagcgcggugcccuuugaaaaguuuuaauuuuauuuuaacuuugcuaaaucuacuuacacucacauuuggaaauauguaugcacgauaaaacacugcaguucuggucuauuggguuaaaaacccacuuuuuggaauggguucaagggaauacuuauauaaaaguccuuggaacggaaagcaauuccguagauaaaacagaacagcaacauccuccaaaucugccccuugcaagauaaaugcacagugaggagggguccggaggcuucgcuaaugggggauucauucgugacagccagccucuuaagcucucagggaaccagcuggaaaggggagcggccgggcuacuccuccccugccucagcguucacacuuucuccaagggucucuucuucuuuccaugauuuacugagaaccaauaaacucagcuccccgcccccacccccaauuagaaacagugaaauuccauuccagcagggugcucacaaugcacgcaaggggcagccgugauguuuauucugugaaguucuagacaaagagagcuuuaaaaaaaaaauaauaaagaagcuggaauaacuccaacaacaaccauuuucugggcuuuuucuggguaauuauccuugcguggagaggcauacaaaggaggagggaaacauggcucuccccccucagaagcgggcacugaguucggagggugaguuugagccacuggcgugagacagaaaaagagccaguaaggaaguaggccuccuuccauccugccuccaaguucuugacuuaaguuccuaccuugacuucugucugagauugugaacugggaguuauaagaugaaaggacuccccuccucccgccauguugcuuuuggucagaacauucucuccaaggagcagaaaagcuagcuacaacaguuuggagaagcuucuggaagcauuggccaagaagaaaggcuuacagcccuuucuccccuuccuuucgugaagggaauggacccagcucugcugaaggauagcuaugaaccauccugggaaaguucguaagccuagaguuguggcuguccguugagucccucuucgcagguccuggagccaaguguccauuaugccucucuccaaggauacacggcagcuugucaggagugcacucugaacaggcaaggguuaagacagaaaaugaggcugaugaugugagguggcuagcgcccagucuaaaggaagaaaggaacauuggcuuucuggagucugaccacgaagaaaggcuuacagccauuucucuccuuccuuucuugaagggaauggacccagcucugcugaaggauagcuaugaaccauccugggaaaguucguaagccuagaguugugacugucagaacacucguguugacuaaggcuguuagaagucacguuagaaucccacaucaaaauaaaauaggugcugugguguagcucaguguuaaagugcuugucugacauguaugaggggcuggguucaaaaucgacagaagaggaagaggaaaaggagguccauuuaccagucacccacuuuccuuucuguauuuaugucuuuuaaucauuuauuuaauuauuuggcacagaaucuccccaagauuccccccugaaguugcuuauuucuuuucuucuuccaauucuucgucuuucuucaggccccaguagccacccagucauuaucucuuuuucucugagucgggcucucaucuuuucuucuuguuccuccucggcgguuccaagauuagcaagagauuguuccaugauuagcacggggucacuguagaccucuggguugcagcuggggcuaccguucagaaaacugccaaggagacaaacccccauuaugaagaagauugccagaguguggggaagggagggacuuggucacaccaagcaaccagcucagagacucagaugucuuugccuccucugguaccuaagagaccaggcuguguggccuggccgguacucuugcaaauacacaagagaagaaaacugacccagaaagugaaguacucaacgagagaauucaccuacgcuacuuauuauccuggugggguuguuuuauuuuaguucauuuuugacaggguaucccuguguagccccagcugcucaugaguucaggagccuucugucucaguuccgaggguuaggaucacagguaugcccgaucauacauggcuucuagagggagagauuugauaguuguuauuguuaccuuauuuauguauuuauuuguuuguuugcaugcuaugggguguauaugaaggucagaagacaacucagagcauucuguucccuccucccaccaaguacaucccaggaaucaaacuuggaucuucagacuuggcggcaagcaccuuuauccacugaucucucucuacagcccuaggaggagguuuauagaggcaaaacaaauaggcugagauuacaauauugaucugguggcuggggaggggggucaggauggcagggugaggguaggaauucaaaacaaaaauggaaacaaaaacuaaaaucacaucccacuguaaagagcuguuggcuaaaucccauggaggaacaaaaagggagucuguggccugcagucugaggugucaccucaguggucuguccucucgcaucugaguugcuaaggguuccuuccaauggccugaugguucacacucucaguagcaaguugguauaaggucugagacuaggcacuuagggggucaacugggagcguuugguuguccuuuagcagagagagaauuaggagaaucaguagccuauuggggacucuuagaagagaucaggcucccucuuacagauuucagagagaggaggaugucccuccgccaugcaguuaaaguuagcacauagcgcaggucuguagucagguugucucugauuccuaggcagcauggaagggacaacguuuagacuuuuaguuagcaucugugucaccugugaccccuaauugcuuagggucugucuuagucaggguuucuguuccugcacaaaacauugugaccaagaagcaaguuggggaggaaaggguuuauucagcuuacauuuccacauugcuguucaucaccaaaggaugucgggacuggaacucacacaggucaggaagcaggagcugaugcagaggccauggagggauguuccuuacuggcuugcuuccccuggcuugcuuggcuugcucucuuagagagcccaagacuaccagcccagggauggcacugcccacaaugggccuuccccucucgaucaccaacugagaaaaugccccacaguuggaucuccuggaggcauuuccccaacugaagcuccuuucucugugauaacuccagccugugucaaguugacgcacaaaaccagccaggacagggucucagguaaccugagcauuguugagcuuucuaugguaaagaaaucaaaguucacagacagaaucuuaguggggcaccugccauuuuccuggcagcgaugggaauaacagagucaucugugaggguagggucugcucuaggugaaccuggccugaguagcuucuagucugcuccuaaggguuaguaggcaaggacaaccuggagccauccacagaccugacccucccaugccguguaaguggcagcacgugggagcggcugccuauaaguacaugcuuugucucccaggaacacucuuguucuagagucugaggccaaacucugagcugacaggcccucugagagucugcgcugggggugucuaugaugcagccuuuuaggggaaaugagaggggcuugugaguaugccuaccgggugagcacgcccuuuuauaacccugccagcacuccgaguugccuucgcacgaugcccauuccacucgggcgaaaagacucaagccagaaauuacacagggaaugguaccaucccagucuccccugcacuuuucugcacuaaauaauuuucaguuggggugucagagaaagacagaggagagacgcauuauguucaugaaaggccaccuuaagagaauuguucugugaugaaagcgagggguucccccuaccccaccucuuuuggcaucccgacuugccauagaaaugagugauuuucugaaacucugccaaguuagauggguucagcaugcuauuagauuagucuguuuauacagaaacagccaaaaauaggaaccacagagaagcuauuaaagcuauuguccuguggggggaagaucuggaugguuuccucacugcaagaggggaacaaggucuggcuuuguauuaaggugaugaagaaguuaccauacucuaaagccuugucucagugaugacaaagaaagaagccaucagggcuaggugcagccucaucaggccuuaccugcugcaaaugcacuuuuuuuuuuuuuuuuuuuuuuuuuuuuuuuuauuacguagagcccaggggcuuaucaacagggugcugauuccaggcagggaaaaguaaaagugggaaauaaauaaauaaauaaauaaaugagacaagcugucagaagauuccguguguaauuccgaguucucauccgcucucuaguugcuccuugagcuggugggaaucaugugaccucuugggucagugagaguccagcugagagcugagacggagcugaguucugcaagcgaguuggggugagucuacuucccucaucuauaaagugggcggucccucagauaucacaaagucaccucauuucuccucagcaggucucaaggugaccugggaaggcuagaccaucacccaucucacgugagauuuugaaaccuuaacacccacccuggugacauaccucuaccuccaucaaggccacaccuccuaauccuucccaaacaguuccaccagcugaaggccaaguauuuaaauaugugugccuauggggggguggggucaugcuuauuccaaccacccugguauccauguuguguaugcgcgcuagucacucaugcuggcaauuucaguuauuaauuaggucugcuacuaugagugucacaguccagauguucccguaacauuuauccuauguaauaaaggccccaaggcaaaguguaaaugaugcugguaauuuugcuauaguguauuauuacaauucucuuucaucauucauuuuugcuuuuaauuucuuaugguaccugaguuacugacuauacguuaucauaagcaugauguacaggcagaaauaggauacaugguguuguaccauuugcaauuucaagcaucugguagguaucuuggaauguucucacagagaaggggagugaauaccaaagguuuugggguuuuuuugguuuuuuuuguuuuguuuugguuuuguuuauuuggguuucuguuguuguuguuuuguuuuguuuuuuugagaucauuguuugauaccugugaaacuuaaagcuuacucugcagccaagugccauagaaaggcaguauccaucuguaauguagaaugaauuccucucaaugcuguuuaaugcaagacaagacugccuggguucucaccugggcaggaaaaucagugucugccggggcuaucgucucaucagaggcaugauggucugaccacacaguauccacaauauucucuuauacuguggucuugguuuuuaaagauaaggaguggcugcauccugagaguguucaucucaucaauagaucaaucccuugauggauuucuaauauuuuaucauuuuugggaaauggauaaaaaacagaugguaccuggguaucugggcagaugccuuuaaucccaguacuugggggcagaggaagaaaaaucucuacaaauuugaggccagccuggucuauggcuugaguuucagggcagacaggacuacgcagagaaacccugucucaauuaaaaaauaaaaauaaaaaaaaacagaugggguuuagcuagaaggaggucacuggugaagguucccugggggcuggaccugguaggaaccuccucugucaaguccacagggccagccaucauggauaggaccuucugaaaucuuacgccaacacaauccuucccuccaucaggugguuuaagguucucagacacggcaaugaaacaauauuuaacacagggcaguaagcaucauugcagcccaguucccaccguacucauuucacuaugguuauaggacugacgucuccugucuuucugaagucacucucgcuccccagaagccacaacacaggugggcucucacaacagggcagccugcuucuucccagccagaggaagaguggcgcuuaucucaggugcucuuuuaaggcuuuucaccguuuucaauaucugucugauuuagggcuuuccuuacaucugagaggucccggcucuuuggugagucaggaaguggcccuucaucucuuucuuacuuugcaggugagaauaagucucuaggggagaggaccacacaagcuuuagagcagaagaugggacaugaagggggcaucaucguaaaguaugggcagaaucacuucauugugaacaacagcuuauaaauacacugcaaggaaaaagagguaagaaaaaaaagucuugaugggcgugggggccacaccuuuaaucacauagcuugggaguuagaggcagguagauuucugugaguucaaggccagacuggucugcauaucaaguucacacuuagaguuacacaacuggggggggggggcuggaaaggggagagggagagggagaggaagaaagagagagaaagaaagaaagagagagaaagagagaacgagcugucucaaacaaaacaaacaaacaaaacaaaaugucacguccuauauuuaucccaaauaguucuggcauuucaagauuuuccucgaauuaucagcuguguggguauucuguguuaaauauacaauuuuuaaucaugagugugcuuaaaaauguauguagcacuugaagucuaagcaaucaaaaucuuuguuuagucaguaaguuacaaaagccugucacacugacaucaccaagaaaacuagagaaaggacaaagacaaugacagaagggguuaggccacaugagacucaguugaaacugcacugagaccccauuucaccccaggcagagggacagucaugaaguaaacacgaacaagugcuggccagaauguggauauaggggacucauacaguugggaaggugugacaaucagaacggagguuccucaaagucuaauaauccaucuaccaucugacgcagcggcaccacaacugaaguggaaacuucugguuuguuuggaaagucaauuaugugugcuggggcagaggggugaaaagaugucuugcuaaagcagacacgugaaagaauguuuuccugaagcagacacaggugaaaggauguuuugauauagcagacacaugaaaggacucuugaugaaggaguauaaauaugaccucacagacagugagagagagcacugguuugguuugcuucaccuugcuauucuacacuaaugacaugcguguauugauucgccuuacauuguguuguugagcucagcuuguggaaucgccaccguugagagaaacuggccaaagaacuucuggugaggucccuguagcagcuugccaguuccauagccuugccucuggcccguuggugagcuuggcugcuucuuuagggcugaacuauagcaguuguuccuuuguggcgucugucugaccagaggaccggacugcagcugcuaaguuggguuugguguuugcuaugggacugaacugcugacaaagaagauugagcuugcccccccccaaaaaaaaaccuauugcuaaacaggucuaccucccucauauccuaauaacuuuucuccaucacuaccucugcugggugguaggcaagagaagauguuggauguuuauuaaaaauaggcugcaaaaaaauauaugcccaccgucaacucaucccagagaugcuugcgaguuuaccucagcaucugucacuguagcuaaauuuuggaaccaaauaggugcucaccaauaggggaauggacaaagaaaacaugguuuauaugcacagugcagucuucucccagaaaacaggaaaaacaauaacuuguuuguuguuugcagggaaauggguaccaguagagauuaugacauuucaugaaauaagccagucucagaaagacgaguguuggaugcuuucucucauuuggggaucuuagguuugauacagagccaugaacuuguguaugaacauaugacaugaagguagaugggcaauuguugaggagaccaaagggauccaacagaaggggcagaauggguuuucagggggacuauacucccuguauaucaucuguuuaaauguacaaaaaucuucuguguaacccaggaccaaguacaauucaugaauacccauuaggacauuauaaaacaugcaaagucaccaggcaaauauugaaagauggcauuacaagagggaugugagcgggcaaaggaauaaaaggagaugaaaaaguuaaaaaaaaaaaaagaaaaccaagggaaaggagagaaagccaguaggggagagcugaugggacagagaauggagauggggaagaagagaggaggaaggagggaggugaaagggugcaauuacagaugguuggggagacgcaugaacagcaaucgcgaucagauaaugcggacucaguuaacuguaauaaaaugccccuuaggucccaugccacugagcugagcccaguggccucagggccauuagcucuaaugcuuuacagguccuguuaucucacaggagugagugcaacuuggcuaguaucugggcucuccuuuaccuggccacuaaaaccauacaucuucagaggaacguggugguggaccaugggaagagaggaagaagagacaggcuggaguccaaaacucugcccuggguucggcuucacuaguaagguugcuguacuuggaaauuuugaugcuccgaaaauuacaaugaaauacgggagcugcuuuguucuucagaaacaugaucuggguaaauaaauugcucaggaacaaaaucccaaccaagugaauguggugccuggugacccacacaugauaaauggaggaaggaacaaccuggagaggaaauccguuuccaaaaauaugucuucgcaguagugauauuuauaaauuugacacacugggaaaguggagcuggcuaaagaugauuucuaugcaaauaugcauuuuccaacaccaguguaugaaaaaaaaauuccaaacauauuucuugcaaaucaacucuugcacagggugagagacgcaggaaguacacugauaaauauuaaagcacgaggccaaauguaaaccugguacgggacuagaguccucagugaggugauggacagaaugggaaaugucucauacugccugauaucuacucuauagucgggacaccugacagagucaccuguccuaauaauaugguuguugucccccuuuaggcuaaaagagucagggccucgaaugauccaagaauccuauuucuuucauguugauauagaacauucuagacaaggagugucugcugauggaaaaucaugaaaaccauucagucuauucugaggcuccaucuaaggaucacacacccugaggugccugggaugaggcccugggccuguccucugggcaaaugucugaucccaggguccagugaacacagcccaaggucccuacaugagggcaaguuuucagcucccucauugcuagaugcccaagacuucacgccauucuguguuccucuaagucagccuccccgugcuagcucacacugcccuggguguccugugugcacuaguagugauagaugcucuucugcacuggacagaagaggaagaugagacugacagccacgaaucugcccuucccauguuaugugauggacagggaguggagcugcaucugaaggagugaaggccacugagagaguucuaggucuauaaucccaguauuugggaggccaaaguaggaggauuaugaggagccugggcuagacugaggauuauuguuccaggaacaaagaaacaaacaucuggauaaagagaaggcagagagagggguguuggguuuuguuucgacuuauuuacccaacauuuauguucgcaaagggaaccaagaaucugaggcuaggaacuacagaacaguuagaaguggacacacaaaaggcugcuaggcuacugaaaaauugccaacuguccuccauuacauggagugcuccaguaaggaaaggauguucaauuccugcuccuccuguuuguauuucacuuggguaaagaguugagaaacauagugcuuugaggugacagcagcccagauaagagcuugguucacauagccacguucaggcucaaucuuccucuaacuuggacuucuuaggugagugaagagacacguaggacccagcugaguuaucagggaaaaggcucucuccugacuguugagucaaugaugagagcaggucccagggaagcuaccccaagccucuucucucugagagccuuacuuuuggcagaguggggagggggaaggcuugccugguguuuacaauguacacguuacagggcuacagcaacucgggcuuugucaccaacuugcauacugaucuugcucugaucucacaagcugaaucacauauccuagcaucucauguucaucuuagcaucccagcacugccuaaugcuauuguauuugggcauagggccuugaaagagaugguucgaguaaaaugaggucacuggggugaagccaaaucuagucugacugcuguccuuucaaaagggggagauugcaucacagacaaauggaaggacuacuuuguggagauaccaggagaagauggguaaaguucuuaggaaaaacuaauaccuugaucuccaugcugaaagaaaacauauuucuauuuugcugcuugcuuugauagccugaguggaccaauauaaacccugaggugagaacagcugggucacuuuccauggcagauggaaggucuccaaaagcaagagccuuaggguaagagacacagggacuuuagccuaguggagcccuuuguccucaaaugaggcacuucacacuccccagacuccgaagaguguggagagucacagucuuuauauauuauaagagucugcuauacagaugaguucugugcacauaaaaaggugccaaacaaagacagauugauguuuugauugacaggaaugucaaaauacaauaagacagguucauucuaccauccacacaguuaugaacugagauccugggguacaggaggcacugugauguugguacucgugaacaagaagucuauggugguccagaggaaauaggacacacacacacacaaacacacacacacacacacacacacagagacagagagagagagacagacagacagagacagagagagagagagagagagagagagagagagagagggagagagagagagagagagagagagagaucaugguacugggcaugagcugggacccauggagaacuaaaggugacaggaagauucauauuuuggccauggggauuuucuccagcccugucagaauauacacagauucaacaguagagaaggccacagaggcagucucaccuggcccucuaacucccaauauaauucaauauaguugaaggugaccuuaaauaucuuacuccccugccuccaccuuauaaggcugggcuuauaggcuugaggcaugggccaccgcauuggcuuccuguaggguugaggacuggacagaguuguguaugcuaggcuaauccuuuaccagcugaguucuacuuccaacccugugaccaccauucuaauugggacugaucagucuacuuagagaacaguacagugguaaucguuuggcuguguauacguuagaaaaguuugucacgguccugccacccacuccaguuuuaguucaacuuggaucauguccacuaaucucacugaggucugccucuccuucacccauggguccuaugcuaaagucuuaacucugcacagaugaagguauuaagaggaagggcuuuggaagguaaugaguucaugaggguagagccuuuggggauggggauggggaagagcaccuucauacacuacucugagaggguucucuuuccccccacucugugaggacacggcgcgaaugagcaucuacagaccagaagcgggcagacggcuuuucagcuucuaggucuaugagguauggcuuuguguugauuuuaagucaucagucuaaggcauaguuauacuaauugcaaaggaaaugguaaaugaguguaugugcaugugugugugugugugugugugugugucuaugcaugcauguguauauauguguguaugugagugcaugugugguuauguguguaugugcauguaugccuauguguauguucaugcaugcauguguaugugugugcgcaugcacacacacacacacauggguauaugcauauacaaauaccaggagaaaggaaaggauaacugucaucaaugcauuccucauacaagcgacaaagaauucgauggagaugggaagaggcuaagguaagguucuuuucguccuuuaaacauuggucuuauuucucaccggguguaugucugagugucucugugugggugugugcucaugugugcggguguaugucugagugucucugugugggugugugcucaugugugcggguguaugucugagugucucugugugggugugugcucaugugugcggguguaugucugagugucucugugugggugugugcucaugugugcggguguaugucugagugucucugugugggugugugcucauaugugcggguguaugucugagugucucugugugggugugugcucaugugugcggguguaugucugagugucucugugugggugugugcucaugugugcaggugcccuuggaggcuggaggcaucacagccucaggaggugagguuacuugugguugggagccaccagacaugauauuaauuaauugguagggacugaauucgcauucucagcagcucagguccuuuguaagagcagugcaugcucuugacugcuaagccaucccugcugcccucuaagguaauguucuugaagauuaucuucuugguuuccuuagguggcaauuucuccauuuuauucaaugacuacuuuugugccaacuguacacucgguacggggacucgagauauagaguguauguagccugggagcuccuauuuaugucuuuaugaguggcuauauuccaugaaacauugaggaguccauaugguccuccaauaaaacuauugcuuagcuagcgaucauccgaaaucguaggaauaugcguguuucauuuuaaaauuuaaaacugcuacaaaugaucuaacacauagaccccagaguccccagacagagaacgcacucccugcuucggaauuacuagccauuagccuuauauuccuugggcgagauuggggcaagaauauaugaaagccucggcccagacugagagaguauuaaauaugucuugacugauuaaauugagcaucucaaggagccauaggaaggaaaaaucuaaacacgaauuuaacagacaacuaugucagaaugaagauggaagucggugguaaaggauuugcuuaggugugggagaugcuucagggaagagacagcugaaguacuucagccacugucucacgggccucgguauccaagaagaugagaucccuggaguugggcuaaaauaggcaauuuucaucugccaggcaccuuugucuuccaccccacccccaccccccacgucccagagaugcuaccuugaaagcaggagagugaaaucgauauguacugagcccauucuccagugcuggcuucagcaaugacagagaaggccucaguaagacacaugauauuaauuagcuagcccguguaguccaggcgacccugucaccucuacuucaggcagagcuuaggagaugccucagggagucagagccaaauacaaccauuccagaucaaagcaaagguguguucgggaugagacaagccagguuuuacuaacacugacauaguagaucacagacccccaagcuuuuucccuuuuuaaccucagaaaucagcccacccaccugugcagucuaugccuugaaaagaauuaagagcccugcugggggagguuagagcccacagauaucaucuccacagggaagaaaagcaaggcuagcuugucccucuugcaauaaaagguaaguuuaagguccuauccagcacuuggcuccaugcauguucuauggcacgugggugaugccacacuggaucacauggugguucccacuacccccugcaaagcuaugaaagucagguauccugcuucguucagggaacuucucuaagggcuugcucucuccugcucccucaggucaccccauaauaucgguguguagacugaaauuucuacucuuuucacuucaaacugucccuucuaacacuuccaguccaaggauucaucauggccuccuuugacugggaggcuugcucuucuaaugagacccauucuuaagguaauuggucucagcuuccuuuccacugaaccugccagcucuccauucuucuguaucuuacaauguaaacaacuauauauggauaaaauaacuccgucuucgcaauuccuguggcuuugugcgucuaucuuuccacaauucuaaagccaaagaggacucuaugaaccccaagaaacucucucuauaggaagauguuugaauaaccauuugguaccaaacacuaucuaguguggaauucauuuugacacagagauauucugcacucaauacuuaauugcaagaugcugucucuagggaugugaaauuauacaaacucaggaaagagcuauacaggaaauaaugaaagccuuaugggucaguaguugcuguccugaccacuaggcucuacuggguuauccaacggcagccaugagcaaacugugggcaaagggacauagauagucacacuguuauauacuaauaaaacuuuaucuggauggacaguauucaguccagaauugauuugagagucccacacaugcucuuguaucugguuguauacaaaaauaugaagcauguugcugucccccaaauuuaaaguuuucuggguuaugaaauaugccuggccccaagaguuuuagacaagaaacuaggacuccuagccugcccauaacuuucucaaauggcaauacuaccugggaacugagugguccaacuugugagcugaugggagacaucaggcauucaaacuacacuagaaggacauguggcacccgauugguuugggcugucugucuucaguaaaccuuguccuggaaacucgaggaugccauccccaagccauucuauaccucucuucucaggaagcuacaucccccgacuccuucucuacacaugccacuggcuucagucaauagagagagggaaaagcagguccacacucugucucaaauccaaacuguuccuuuguggucuaaccccuguuagacccuucccaaacagcagcuccugauggaaaagacaggaugggaguuaggguuccuuugcugggacccaaauaccaaucaacuuaaugggagggguaccuguuuuggcccccaguuuugggaggugucagucuguccuggguggguagggaagagcugcucccgugcuggcagugaggaagcagagaaagaggggaggcugccucucuaaguaucccccucccacucccacucugauuacucuauccaggcuuaaggaaccuugccauccauauccaagggucuccuccuguacucugaugucucaggaagcuccuucaugguuguaucugcuaggcacuugccaacuccaucuuguugacaaucaagauuaaucaucaaagguggguacugucccucucacauacuagaauaaagaucauucaggaagaagaagccagacaagaccagcuuucacacgacauacaucccaaaugagaaggaaauguaggcuguugaaagcacacugagacccaagacaauuuguccugaauaugaagcaugccaaagaugaaauauauagauucacacacuauauuagccagcuuugcaaaucacuuuuuaucuaucuaucuaucuaucuaucuaucuaucuaucuaucuaucuaucuaucuaucuaucaaugugagaugggagucucacuaugugguccuguggaacuuggaauucucuauuuagaccaggcugaccuugaaugcauagagacugccuguuucugccucccaagugcugggaucaaaggugugcuugccaaucacuuuuccuaaauacuuugccaaaauaauccuccaaaauugaggauaagccuccuggucaaacuuaguccugggcugucaguagauauauuuauuuagaauauguagggaagggggguggacaggcuagucucugggaacucauacuccacacaccaggacuuaguuacuauaacagaaacacugacuaauucccuuaugguagacaauuuauucauuucaaauaaagagcgucuuuuaccaucccaucaucaaccucucccauucuuuucauuauuauuuaucuaauuguguugacagaggccuuaaaauaaagagccaggcuaaugucaccaauauugguaaauaaaugagaagcagaugucucucaccaaagguccugcagaagaucacaauccauucccugcccaagggcaaacccacccaugguuguguuuucaauaagcaaaucucuuaauuaaauaaugaacaacuugcuauuaugcuuucuuuggugaccacacacacacacacacacacacacacacaugcggaggggauacacauuuaaucaccaaauucaauuaaauaacauauaauugaaauuguucuucaugauacaacuuugccuggcuccugcaugguuaaaaaaaaauuaaacaaaugagaaacauggguauggaaugaugcuguucucagaguccugugugcgacgagacacugugcccugccuaucguuaauacuguuugacuuguuacuauacuuggaaauagaaaugaaugauauugauugacagugacaaggaccucacagagggggcuugcucucaaaucugcacuuuuaguaauaucagguuuauaucccugguccugguauagagcuugauuaagauagauccacguuagaucucugauuguaauucucacacugaaucuagaaaccaggugcuccuaucaguauuuguuagguuuugggggcggggcugggguucauuuuaggauaaggggaaacagguauagggugucagaacucacagucaauaaaugcacagaaggauuauuuuucaagcagaauuguaaaauuaauacauccagguaagacagcuuccuucccaccugaacacuacagcuugaaagcgaugauauuguaggugaccuuuuaucuuuuaaauaagaaccgagcgacuuguucaaaggcagauuuguucucccuuugauagaagaagaaauaguuaccuccuuuaguauaccaccuucaauauuccuacacaugaauaguaaugaaauugaaucuuuuuucccccccuccauggauagguuuuguggaaaaauuaaaugccacaucuaaccuucuaguguacuucauaucucugggaagaauuaugaaaaggaggguaaaaggaaucuuuaucacaaacugaauuaacgcacaaaguacuccauuuggaagguauaucaagcgaauccauuaaaaacccuucaaaggcaccaagcggggacaccuugaaaaugaagcggggaccuugccacagaccagcaaagaaaccuugcugaagcagcagucuuuccagagagaucgcaaucggacauucagcggauucgcagagcuaccucuugcuaaauaaaggucguuugcgucacugguacuggggguggggguggaagggggguggaggccgaggggaggugcagaucauuuagguucuagcaccccccccucccguguaugcacacauacgaacaaagccuccaucagaaacugaggcgcaagagucggaaaggguugggaugccagguggacagaaaucagcaagaaaaaguagcggagauaaucagguuagggauaugauuuacguccccgcgauacaucuugcacugcuccaggcccaucuaccucuuuuauuuucuugacuaaacuguaugcuuugcuggcucagacuuacaaagcgaggcaaaacccaaacuuguacccagauacaggcuaagcuuuaagaaugagucugaccagaggcagccaggcugaccugaggacacucgauccaaaagaacacaggaaccuacaaauaaacaaaacaaaacaacaacaaaaaaagccuaaccaaccaaccaaaaaaacccaaacaaauaaaaaaaaaaucaugucagaacuuugccuagaaaauagaaauauuccuuuaaacugaguguucuucagcucuucugguggaaauucugacuuguuucucuuucuuuucccugaagaagaagaagaagaagaagaagaagggggaaaaaugugccagcaccagcuuccccucaaaaaaugacauuaucaaagacaaauucaacaacagaacaagacaaaaaaaaaaaaaggcucggaugguuuacuuccaaggugaaagcagugaaauauuggcagggagccugggcacugauaggcguucaaaccuggcugucuucacuaaauacaauccuugggcacgggagggccuucugaaaacagaccuccagugauggcugcugggcgaaugggcccacaggacaaggaggggguugaaauaccucuuagcaauggauucacuuuuuuccacccauuauggaaaaauuggggcggggggaggcccagaugugaggaugccaaagauguucuauuuucaugucauuaaaaaaaaaaaaaaaguaaagauuuuauuguugguaauagcauguagagcacacaguuacagcggucagacgauucauacgcccagaucuugaaaugaagaccauuuaccauuugugacuucuauaaaggcuaaagaugaagaggagaaaagccaucccaggccagauggcccuggagggcaggcgaccccggcuuuggucuuccugguuccagagucaucuaagggagaggcuggaagugggaaagguccccgcacuucagugaaggcuguucccuuugagaccaacuuacaggaagacagagggguucuggccugccuuugacccuuccacauuaugggucugcucgggucuaacccgagaauuuaucucacuuaacucuuucuguguguuucugcacagagaagcucucggagccucuggaggacagguggaaacgaccuagccuagccuagccuuugaagaggugaccuggacucuagcugacuugccuagggcaagaacauaggcuaaaguuacagaauuauuuagcuauggcauuccggggauuucuaguaguguuauaaacuggauucauauaaaagaagguuuugaaagaaaaggaaacaggauggacccugucacucuaccauacacaucggcaaccccuuagaauccaaugucacagccauguuaccaucccgguaugguaucagcuugggucugaggggucaccugcuugaaggcuguucacucaguucaagacaagcguucacacugagacccuuucggcugcuucgggcacuaggccuugcuagacuguagaccucauuaccaacuaaaacauccgcaccuuuccagggccacaaaugcaugcaaaaguaaagcuuuucuuuacaggacuccacuuuucuccacucgaaggcaaagaaagaggagagagaagccaagaauguuuuucauaucaauauccgacgagaccaccacucuuuagacuuuuaaauuauguuuauuuguagauguguauguuggggguggacacgugccauagcauguaugugggaagucagaggacaguuugggggagucuuuuuucucccccuaccaucgaguaggucccagggacaaacuccacuuaguaggcuucacagaaaacaucuuuccccgcuagaccgucuugauggcucaagggagucacuguugauagauguuauauaguuguguugcagaaaccaggcauggcggugcucaccuuuaaucucaacacucaagaggcagaggcaggaugaucucugugaguucaaggccagcuuggcuaucagagugaguuccaggacauccaaggcuacagggugagaccuuacuuuaaagaaaaaaaauaaauaaauaaauaaaaagaaagcauuugaacacuacuuuuuagauuguuuaguauauuuuauaaaauauaacaaauuucaaacaaauuaguaugauuuuuuuuuuugguauguauauaugugagaggguguugcuauaguacucaggcuggccucuaacuaccagcaugcugagauuacaaaugugagccaccacauuaguauauaugauuuuagaacggggucuuaaauguguuccuagucgcuguauuuauuucauguuguauuacuuuauaucuuaacuacuuaauaacuaaaaccguuuacucuucugccugguccccauucucaacaccuuuccacagccuucccacgaggacacuggcugcuuugagggagaacacuauucaguuugccaggucccggguagacagacaaaaacaaacacaauccauucugcccauuaguccugcaccaaauggccacuggacacaguuaaucugccacggcuaccgcugcggacaaggaaggacaauaucuccaauuguuuccucuacccagcaagcccugccgguggaaugcucagguagccccuuauuuucagcaugggcccacaugcuuauccucaacaagugggcuauugauuuuugccuguuuucagaacagccugggguuuucugaaugacaauggcagccccuacuuaaaaaaaaaaaggaagaaagaaaagaaaaagaaucccucgcuucggggaaauacucuuucuuucacucugccaaacacgcugccucuguuugucuggauccauucaugaauucaacuggaugcugcuaauuuccagcuuuuuuucccccccaccuugccuuuucggagucuagcauacuuuuagccuuuuaaugcugagaggucaagaggacucggcuuuguuccggggggcuccuaugaagggggugagaaauuuccugacaucaggggaugguauaacaggaugcgauuuuucuuuuuuccuuuucuuucucugucucuccucuuuccuucuuccucgacaaucaguuuguaagagacauguagcgccacacucaaagacuccaaaggcagaagagauucauguguacuuguauaugggacaaaggguguccuuucuacaaaccuaaagagaaaugauuuagagacuauauacaugcuuaaaugcucccaccuuuucuaaaagacuggagaauggaaaaucagaagacuaugauacaagccagacagagucgacaugcguuuuguguuugccguuacuuaagauguuuaugugaccauaauagcucaggugccaaucuuaacuccauacaagaaaucccagugacugguuguggacauuuacucuuaaguauaccaguguaccagugaacaaugucuuuaaucugccaggccauuccucugagaagaguguaucuccuuacaagaagguaccugacgguaagaguuugaggacuucugcccagccagccagagcggcccacccagggccacagugcugaguccacaggaaagaguggguacuuccacuucuuuccccacacacccacaccugcacacggaaaacagagcaaggugaugaccaagcgcugcacacucacuccaucgggaugagggcuuucgcagggccccugaguaacucagccuggacaaaccaagguagcugggcauuugcauaaaauaaagggugcuggaagagagccccccccaccccccaccccugccccacacaugcugguacaaggugccagcacgaggauucugggcugugcuaucauuucuuaaaaagguuuuauaggaauuguuuaaagggccaccaauguggcucaguggguucagaggcuugucaccaagccuggcaauauggguucagucccagauccugcauggugggaggggagaacccacucucucaaguuugucaucuaaucuccacacaugagccaugguguaacacuuguguguguaugugugugugugugcacacacauauacacacaauagaaaaacaaauguaaucaaauguuuuuuguuuuuuuuuuaaagugacaauagauuagucuuauaagggaugggaguggcuacuuuuaaagcagggacacaguuuggacuguuuguucuguucaguacaaugguaagaggagacuggcauacucgggauuagccuugcuucccuuucacugaaaaugggagaccggagggggugcucccuggaggugaccccucucuugugucgugagcauaagauuuuguuuugauggcaaaguauggugggcuggaagucaagucacaaguauagauuagguacagggacacgggcugagaagaugggccuugggaggcugcauuggccaggcaagcaucuguacuuuucccuuuugucucuuagagguuuuacaaagaaaacaaaaucagaaugucucaaagggaaaaagaagacaggaauagaaugggaagggagggaggaggagagaagggaggagggaaugagugggaagggggaaggaggcagaggacugggaaaagagggaggccagaagcagcuaacuuguacuauauagugcuggagagagaaagauacauaacacuaaauaaucacuuuauauagaucggaccgcguaugagauguuagcuaguuuauuuaguuacucucuuagcuaagagucagggcaauguugucaucgggagccuugggcuggagagauggcaguucucuccucucuccuuuccucagcagggagcugagcauacauaggcucagggagguuugcugagcgaagagccuuguucccacaagauggaaguguacacagggcuggucugaaggaggaugcuccugaggacucgugggcagcaauaugguggggaaaauaaaggugucccagagugucaccucuggcacacacgugugacaaagugucaccucuggcacacaugugugaaguacugcuggguccagguccagccaggugcagaaacaccuggguucguuucagcuuguuucuuuaaacauuuuauauuauuguuguuguuguuguuguuguuguuagcgugugugaugccuauggaggucagagaacaacuuuauggaguugguucccucuuccacuuucaccuggguccuaggaauugagcuuugggucaucagguguguguggcauggcccuguacccauuaacugagcugucucaggagauuuuuguugcuuuuguuugcuuguauuuuuuagacagagucauacuauguagucuaggcuggccccaaauuuguaauucccagacuccugaauaaugggauuccacacaugccucaccaugcuugguucuaguguuugaaggugccaacgggcauucagucggguggaaagcagggggggucacuccuuugaccccguccaaacuccacaggguccaagcaguuaagccacagaaggguuuucaguuuuagcuucuucucuaggucuagacccucuuuuuaauuugucaagcuucccgguccucucaaagucugcagguaaggcucauacaaggacaaccuuugagcaggcacagagccgcugccuucaucuccaagucaccggcuggaucggaucuaagauuuaaaacucugagcuucagaugccagugaaaauaauaguucuguucccgaaaugcaccgcauagugagggccgaccuguccgugagugaugggguugggggcucggagcggggaacacaagacacagagcaugaagucaggaggaacgugaugaacugagauugguaauaaagggacugaggucguagcuggaugaggcucgcucguacggaagaaugcucaccuaacauucaggaagaagcccgagguucaacgcuuaauguagcauaaacuaagugugauggccauaccagcgugaggucagcccugguucuccaugagcuugccucaagaccaggagaagacaggcugaccgacccagcugucuaacucccccccuuucacaaucugaaaacgguguguggcugagaguguuaaaucucugguggcagccaagaacgcauaaagguucucauccgggagaagaggagacaaaugaaagcgauucagcaucaaggagugaaaaguacaccggggucagaccgcaucacaccaccuccacaucacagguuaccaagguacaggacccggggaauugucucuauaagccucugucuucucagcucugaaaaggauacugggcauccacaagauacuggggauccacaagauaaaaacagugugacccagggcuggagagauggaccgggagguaagagccuggcuacuccugcggaggacuagaguucaguucccagcacccacaucagagggcucacaacccccuggaacuguggcucuggagcacuugacccugcuuccuguuuccuccaacacccugggggggaagggagggagggggagagagaaaggggagggagggggagagggaaagggaaggaagggagggagggaagggagggaggggaagggagggggaagggggagaacgaauaagagagccccaucccacacaaauaaaaaaaaaucuuuuaaaaugucacaggccacacuuuaccuuucuugggggcgguuagagcucccgcuccaccacuuguugauaacaugaugauucucagagccaguaucuucuugaaagaaaaagagagagagagagagagagagagaggaagaaagaaaaaaagaagccuagcaggaagcacacgucugccugagaucucaauuuaucuuuugcaugcuaagggauguaguuccucacccagugccuuucauugucaagcccagaagaucuaccuagcagagacuguguggauaaaauaggaauggggaaaucccauggaaacagauacuauccgcaguaccucugacuaaaauaaugauucucuuccugugguugguucaaaccggugcauuaaacuccaaggaauugcuuucaaauaagacucuaauuucagggacccaaggaagccagcauuuuaauaagauauuucauuguuaucccgaauacaaaaccauuguuugccugacucuguaauuuaucguuagacagacacugagcuauuacuguagcaaaaaaugaaacaugcaaugaucucgcuaauaaaacaauuggaucauaaggcaagacggagcuaggcgcuuuaaacagagcugaauuccccccggguggcgaucugcauaggcuaauauucccaguuggaauuucaccuuucucuacucuuccgagaagacagucauugcaguagccugcuaacaauaccuguaaggucuccccaacuuaauccuuuguuccuccugaagaaaaaggcugcuugcugguucugaguauucccccucuacacaccccaacaauucacacaugcacauguucuuauuugguaguaacagcuucuugauuuacaugaggaaguauauauuuugcacaccacagacaaagcuauucguuccccuauaaaaagauguuuguuuacaaaggugggggagagguguggauguugacuuagaaaugacauggcucauccucccccauuucucuuccucuguguucagucaaggagcaaagaggaguuaucccuuaacauuuuuuucucuucuacucugccagggaaaacuccucagcugaggcggcaucucccuuggauccuugaaacccgccuuuuuucuaauucccaagaggagaagggcucaguucccaucuguugaaaacuaggagguggauauuaggugguccagucucaaaggcggagaggguaggcgggauucagagaggcuccgcccaucccucugcuuagaguggcagaaggcaguggcugucuaugguaauuccccaaguccugauugccugaucugucaagugggagccuucacaucuauuuccuauguauucagcagaaacugaaugaccugaacacccacacagcgaggcugauggucacauccaguggagauucuagaagcauguccuucucuauccccaagucugcccacggcagccuauacccgucccuccccgcccccgcccccucccccucccccccagcacugugauggcuucaaggcaggacagacuccuccccaaaacaccagagagaggcucauaguaccccacagcgauuuauucuuugaagguccucauucuuuguaggucaacuccauggagucgcugcacagagagaguggacagacuagcugcauggauacugcagauucuccgcccccucuuuagaccuugccuaaacaaaaugaaggugcuggucccuaggggaggucaccugcugcccuuuugccccugucuuuccuuccgggagcauagacuuuuggccucugcagggcugaaaauaaugaagucaggggcugcugagaugguuuggcaugcaaaagugaguguggcucagaacugacagccugaguucuauccccagaagccgcacagaaaucugggugugggagcacacaucuguaauccugcacacaucuguaauccuaccaccucuaaggggacaugggggacagaugagaggcagaaacuggauuaucuaggagcucuagcagaaacagaaacuggagacugacagaccccgccucacuaagagaacccacccuugcacucuguccucugaccuccauucgugugcacaggcacacaaaagaaaugaagcaaacaaauaaauaugaagcaagaaacaggaacaaaugagaggccgguauuaaagugggcggacgucacaugcaaauccugagccuaggagacaggcugccuucccaagcucucucccucucucccuucuucaacccagggcccugcagauucuaagaacaugccccagcacugagauguaaccucugcucaacauuucuuuccuaacacagcaacuacagcaacacggggcuggagcugcagcuguaacccuugccugggaacccaauauccaacuucuuugacccacuuauagagugaccuccaggagacugcuacgucgccgccguucagcagcugucacgcacagccaguuuuuuccuggggauggacauuauucugagaacacucguggaccgaggcccccuuaagaaguuucagcauccuccccguuacuacggagacucaguggccccugccucacugucuacacugggcacuuccuaacacagaugucuagggacgugcccuugugcaccugucucaaggugcucuucugacacucaggagcagguaauggucauugacagggcuggguuuugcugcauuucugguaagacuugugucagggacgauuagauggugagggcugggaaggaggugaugucccucucuggagaccgugucuacacacaacuggggucaguuuagugaaaaacaccggucagagcggcugugugauugaacugacuggcaauuccccagccagggcaggcagccuugggcuaugcggggagcaaggcagccagcccuuugcuuccuuuucauuuaaaacacaucucaaaguaccagacuagagguagagauucaguucaaugucuuuggauugauugauuaauuuaaagccccugagagaucccgucgguucacagauaaagccagacaggccgagaauuuuccugucuuccucaaagggggaacauuucaaccgcagcccccuaauuggagaugauuuacauuuuugucuugaucucugcauugggaaagaggagaaauugucaucagcaaccacugaaaccuggcugagcauagcuuuccgguugcauccgguguccacgcuauugggcgaucuaauauuguccaaacguggaguagugucugagaaccaccaagcaggaccuggauguugacuuagggauccaacgagcguuggaagcaaaauacuaacucugccgaacuccaacuguccaagcaacuagcugcaauuccugaggccucggcugccaugagagcaaacagggauaugagugagcucuugcgaucaagcuccaugugagaaagaugucccacgcaagguaccaaugaaggcuggggagacaacugaguugguaaagcugacuugaguguaaucuccagaacugaugccuaaaagaaaucuugcauggcuucuugcuuauuacuccugcaucagggagucagagauaggcagcuuccgggggcuuacugaucagcuacuuggugaacucugggccaauggggggggggggaauguacaauaccaaaggugaucuugugguauagcuuccauguguauguaaguacacacacauguauaauuacaucugcaugaauaaacacacguuuucucccucucucucucucucucucucucucucucucucucagucacacacacacacacacaaaagauaccagugaucauggaaguaaguaugagagagccaagagcagucucaccaaacagcaccaggacuccagggcugacgugagucucacgagugccugagagcuccucccagauauuccacagccuccuagaucuuaauugcuucuacauucuccuggagaggugccuccauuuuguuuaguguggugaugccggaagacaaugaaugcccuucucaaacgauugccuguuggcaauuacgaaacacaccaaacucugaaucacauagucucugaugcaaucucccuucaauguggcuucaccaaggccuacggacgugcucuaagucucuccccuaagggggaucucucauccuguaaagagaucucuggcuauuugcuaaacuacauaaagcaagaagaaccauggcagggguggugguggagaggcagagaguaaguuaguaauaccuuacaaauucaauuugcauucuuuccucgauguuaacccaaucugaaugagcuuucccaaaauaagccagcauuugaaauccuccugcaugauagauggccuuacacauuuaaaaacaccgucccuuuaauaaacuaacccguacaaugcgcucguaaaugguucuagaauauucugauagcaaaauauuuucuguuucugggccagaacuggacauuucuucuugggaauaugauguuugaaaaucaguuccuccuauuauagauuuuccccucagcuuguagaaaauccaugauucccuaaacauuggucuuugaaagcacauugacuaaaaucuucaugcuuaauucaugaagcgcagucuggagauuaguggagcuggacauagaccgggaauacuuuaucauauucuaauaagcagagguugaaaauugcauuucuaaagcuacaguauuaaagggcacaccgcaaaacaugacccaaacauaacucaguaguuuuacagugccugaaaaggcuuugauaugauaaaguaugcugacggugagaauaaacacaacuagaaauuuuugaauuuaaaaaggagaaaaaaaggaggggggcaugugaaacuuggugaacauuugguauauuuauggaaaauauacauauuauaaacucauauauugugauucuuauaaacaagcacggacgacugagucacacagcggaagaucauuguaacgccacaguguaagagcucagaaaggcuaaaaccaugagagaugggagaaagguaaauaaagcgugcauaaugagguuaauuuaaagggugccagaaaagucuuucuuaaaauaggucacugcagaaaauaaugugcacgguagggucuagaggaagaaugcuggagguacauccgggugccucuuagaaaacuguaaaguguaaaaggcugcccuaauacuggcagcaaccaucuacaaaaauguuaaaaauaaaaaaaauucaaccaggguauccaaccacauaaaucagcaguguauauaauaguacgugcagugcuugacagacacaauuggggcuaauaguaucugauagauggguggguggguggauagauggauggauggauacccaagagagugugaaagcaauuggaacaggaauggagggauggaggucagauggacggacacacgagggagugagaaaccaauagaaacaggcagauggauggauggaaggaaggaaggaaggaaggaaggaaggaaggaaggaaggaagaggauggacgaacacauggauaauggaucauggaaaugggcccuaucucuucuagagcucaaggggguuuugcuuuuccccacugagagcuugcuaagucccaaagugcaucagcggcuccugaaucugcgagccuugggagaacaaggagcaagaauucagagcagaaggggguccugcauguugaggacucaagggauuugucuuuuaaaagcagcuccacagcucagagguggauagcaguugguuuagugagaaaggugucagaggcagcaggggugagggguggggugcuuugagauuggauugaugcuguguggaauccccauuccucaaagcuggcagucaucacugcugagaucagagcagaaagaucagaggcgccggccuccugcugagcccaugauuuuauuuugaugggugugcauuccccauguucucugcauucaaguuaauaaagcagguuuucuccuccccuuagauaacucccaacugaaucucuaugcggacuucuaauggcauggucugagcuuucgcccuaaaugggcccugccaucaggaaguucaguagcuuugucaaccugcccuucaguuggccugucccuccucaucucugugcccccauuaauauugacuuagagguuauuuuuaacagcuaagaggcacccagcuauuccugccaugggccccucugccuccccugggucagacacccagucucgauaccuggcaggcagcaggcagcacagaccuuccucuguguauaauacguucucaaaaggcugugacccugacaagugacccuugggaaaaacaagacucaucagcagacccuggccauguagauuucauguuuauuacaagaaacuaaugaacagacaagaaugucaguauccaagcauauagaucccucaagacaacuguagcuaugguuuucacuucacagucugugcuugcacgaaacaaugaaguccacucuauuguccuauacauaugccguaugcaaguacagaaaaacugauuuuaaaaaggaggagaagccgggcgugguggcacacgccuuuaaucccagcacucgggaggcagaggcagguggauuucugaguucgaggccagccuggucuacaaagugaguuccaggacagccagggcuacacagagaaaccugucucaaaaaaaaaaaaaaaaaaaaaaaaaaaagaaagaaagaaaaggaggagaaagaauaaagaaugaaaaacuacucauauuccccaaauuaggaccaucaccugccccaaugcaaacacucuccgucuauacacgaccagcuucgaacacggaaguguagaguuuuuuccucuacagccuucagggauuugucagcagcgacacaaggaaccacccgacaucuacuugggcuggguuaacugcgucaagcuuccucacuggcuggucagguggagauggcucuccccugcucaaugcgaaggacacuauucaucucugcuagggagaccaaguggagaggaagaucaauugagaaccucacacuugaggugagccuuggacacagccagagaaaggcccggaagaacacauuuccugcaacaaccuggccugccuguuugugacagggucccagcagaaguugucugcaguaugcaggauggaggagggaggcuugugacugccaccuggguguauggcaggagacaaggagaaggagaagacugcaaagcacaucuguauauuggaggcgcucugguucuacucuggguggcugagcuccuguggcaggcccaucuguaucauuucccccuacauccagccuccugaugaagcaucccucccccccaaacccucucuggcuccccgggcacuagcucuuuugcacuggccuuugacagcaaagcugggaggaugccgugaaaggcaaguacagcuucccugagagaccagcucuucuuuccuuaauuaucauccuuuucuugcaagaugcaucggcugcuauuuaaauaaacaaugggggauuuggaaugggagaaacuaugaaaaugaaguugcuuuaauuuacaucucaagggaccgggggucuuguggaguucugugaaugccauauaaauaaauaaacacuuuaaaugagugucaaguugaggacagccuaugaguuguaaaggggacaaaggagccaaggguggccugugaguauuagaucuuguacugggcaugugauaucuggggcuccuuuaaaagcaggagacagaaaugcagugggaauaucaacccccuaugggaacaggaaggaaaggagaugggauauacuagaaugguagcagguuguggcaaguauaagauuuggacuuucuggaugggagcgggggugagggguaucagggucagcuucacacagcaagcaaaaaacaggcugaaaggcuuagagagucuguccuuaggcuucuuuuuuuccagggucagguaaugcucggagcggucagguuuucaccauaguugauacaaaaggaugcgaugguuugggguuuugcugcuguggucgaucacggaggaggaggagagucuggggaaaucucggcaacugacuuugcaugcugugugggguaaaaugaauccuugaauauagagaugcccauggguuaguuucauaugugggguuaaaaaggccccaaggaugccaagagauaaagccgaggacagguuaaaggaugggcauuaauaagacacaggaagggcauguugggaagugacuuuauaaagcucuugcuggggacuuuaugagcacugucggaucucaucaucagauugauauuuucccauuuggugggagaggagacugagacuuccacaggguuucugauuucacagcuggacagagcaaugggcuucaggggcagcuccacuucuccgcugcuaggggagaaaugcagggacgucauuuguuugcagcuuaagagaaaaacgaaugggcuggugaucccaagggcuccaauugucucugggccuccuucaccuuugcuggcucugucugguucucuuucuaugcaggucacauuuauuuauuuauuuauuuauuuauuuauuuauuuauuuuucugcaguggguagccuuuuccuguggugccugggaagacaguacagcaucgaaguggcaggaugugagcuguguagggcacaggugugccaaagcgccucuaccgacugcaggacgagucccuggaaggacuugguaucauggcuccuuguacgcucacaggcuugcuguagggacugagagcugcuucuggucauccuuaggccucuuccuauagcgaaggcuggcaggaagaguugugcuuuugugcuucauggucugguaucuugucacaaggaaggagacgggugugucucgaaagagaacagaaugcuggaaacagguaugugaguggcaagaaagaugugcuggacugauacaauguuaguuauaauaauuaauaagccaggaccagugagguggcuagugaguaaacacacauuuacaagccuaauggcuugaguuccacucagaaacucauacaaaaauagaaauagccucauugauuugucuucugaccucuauacguacacgguggcucaugggcccgagugcagacagugugcacucauuuauaacaaugaauaaaucuuuuaaaauuacaauaaaaauccaauaaagggaauuccaaaagaaucaggaugggcaguguggaaugccggugagaugcagagucuaagcccgcuggggccagaugagcgcuacugggaauuuacugcuacauucagaugcuugcuuagcauucacauaaaccugaguccaauccucaguacacguauaugggugugaacacccauaccuguaauccugcacccagaaggaagaggcaggaagaucagguguucaaggucaugcuacuccuguagcaaguuugggaccagccuggauacacgaggcccugccuugaaaucacaaaaaggcaggauggagagugcuguaaaacaugugucccauaagcgugaagaccugaacucaguucccagaucccucacacaaagcaggaaauggggucguguguuuaugaucugagcucuggggaaaucagagacuacaggauuccuggagcuugcugagcagacagccuaaccuaauugaugcacugguggaaggccaaagggaggagggacaccuaagguuggucucugaccuccauguguacauaugcacacaugcaccuauacaugcuuguacacccaaauagaaaggaaggaaagaaggaaggaaggaaggaaggaaggaaggaaggaaggaaggaaggaaggaagaaaggaagaaagaaagaaagaaagaaagaaagaaagaaagaagaaaggaaggaaggaagagagaaagaaagaaagagagagagagagagagagagagagagagagagagagagagagagaggagaaggaaggaaggaaggaagaaacaaaccaaacaaccaaccccggacuauuacagucagauccuuauaccagcaggcacauguacuuccuggcacauaccuggcccgggccauguaagccaggccuccuuuccaacucuagugguaacaaaggcagaaacacaagacaaggagucucugugucucccuccucaucuuccccccuuauauugguucccugacucccugcaaaccagagaugagaacuaccuccacgcccuaagcacgugaaugcucccacucuugucccuucugaagugugcauaaucucgcagcuauaauaaauucaggagcucucagaaaaacaaaacaaaacaaaacaaaacaaaaaaaaacccugcauuuaguucucuaucauuaagcguuggcuugcaugguuagccuuaccugaaaccccagccugcagcagaaaacacccauuuuccauaagugaacuagaaucugaccucugaacagccaaaauguacugaaaugaaacagaaauacauucauuuggcgagaggcucccucgacuaacauuuuuuuuuuuuuugguaaugccacacggcuccccauucucacauaugagcaucauauauuguaauacggaacagcuauugacuggcgcugaggugaauacccacacauauugaccuuggagguaaauauugacggagacaaagguaaaaucaaugcuuaccuugagggauaauaaaucuggauaucuauugaaauaagaagucgaucggcauauuguuauaaacacuuacgguuaucgucacuugcgugcgugcguuuguacacuggguggccgguggcuggucucuagaagaauggagccagacgugccuucuccucagcguaauuacaggcaccucaguuuggucggccacauucggcuugugagguugauaacucuaggcauuccucucuguaggaguuuaaccugcaucuccagaaagcuucuagaauuguuugcauuuggauaauucagacucuucucucaauaacgggaaagacugacaugugagcuccccgauccggguugguaagccuggccuuugcgagcucacgugacucguuagcuuuccaaagaugaauccagaacucggcugugggccgucgagaugguucagcagguuuagaacucaagacucuuugaaaccuggagucuugaguucaagucuuggaacucacguaaagguaggaggagagaaccagcuacauagaguugcccucuaaccuccauacgugcaccaugugaugacauacaaacauacaucccuaccccaacacauacaauaguaaauaaaacuuaaaguugucugguguugacuuuggaaugagucuuccacaccagugucuugcuaaggagacucaaccuggucuccuggggauagagguaaaggucagagaacggggaaggcagaauguaggaggaaggagaccaaaaggcucaggacgagccuccacaggacgauggugagagccgaguccucaguagcacugaguaccauccugccugagggcagguccagagagauguggugugucggaaggcuucagggaaacacuccccuguucacaugaggccagaaggcgcuuccuccauccacgggcugucugaugacagugcugggcacagcuacagcagugaauaacccaccacagaggcagaagcugaugcuaucugcucuguucuuugaccgugccaacucucuccugcagcugaguggcacaugcugucccacuaugggggaggagcccugagcgcugggcugguguuugacugcacuuugguucaccucagcgcaccagagcagguguucugguuuauacguuucauaugcgguaagacaccacacugggaaugccaaggguuugggcagcgacugguacucuguagauucgggugggaagcugcuuucuuaaacugcuucucugaaggcagagcaggcccaccuuucaccugaggcuuccaugaggaucuggaaguccuguacugcagaugaaucccacgagaacuagugcucaucuucuccacuuggucuuccaauuccuucaggcaaugucuagggcccuguccccuccuuacucucuucagaagccucagguuuugagaccuugcccugaauggcaaacuuuuucuguaggcuuuaacuucucuagacauagcuacaagaguaccugccuaugucucucuacccugggcucugccauccaucaacacacuuggcgcuauguguuuuucuccucuaaccugcuccuuggaaagucccaccuaccuccccagcagggacagcccaauuuagucuucaaaaagcaucucaacugacaguaaaguugagggcugcugccugagcucuuugugauccucauuuauauccuccacaggacuuccagagaauauuacacacucuaauguguaauauauaguauguagauauacauacauauacauacauacauacauauauacacauauacauacauauauacauacacacauauauauacauacauauacaugaggagaggaggaggaagaggaggaggaagaggaggaggaagagaaggagaagaaagaaaagagaagagaagagaagagaagagaagagaagagaagagaagagaagagaagagaagaaaagaaucuacaugcucgcuaguugccauaagaaacacuagucacaaacaccaucaaacuugaguguucaaauacaguugguagcaggcugggcaguagugaugcacgccuuuaauccuagcacucaggaggcagaggcaggaggaucucugugaguucaaggccagccuggucuacaaauugauuccaggacagccaggguuacacagagaaacauuuccuugaaaaaccagaguggggaggaguguaauuggcagccaaagagauucagauaaaggcaggagaggcccauggguaucugacgaggccggcauuagguggcugccuuggauggugugcgugucuaggcaagguggcaaugcucuccggaagagccuugugcacugccuacugagcaguacaggaaaaaaggaagaaguuaaucacuuucugggaaagccaauucuucuuccuccaccccaccccacccuuuuguuucuccuccaaucccacuuucacaaucacuaccaucaucaacaucaucaacaccaucagcaucaccaccacaaucugcaaauguagggaauccuggacuuuuccaaagaguccuuucuggauuuagcucuuuauguguagcaccauguucggcuacaaagugaugccggcaggcccagugagauggcucuaaauaaagucacuugccacccagcuagaugaccugagcuuaaucccugcaacccauaugcccacauguuagaaggaaagaaacgauuccaaacuuguccccagaccuucccaggcacacuauguugugcaaugacccacccacaaaccuacauacauaccuuuuguuguuguuuuaauuuuaaggggcauuucugaggcaggagagaugauucacugaguuaaagcacuuaccaucaagacuaauaaccugucaucugaccuguacacauggcaugacccccacuaauacauaggugaauggaauaaaugaaaugacgcuagaugaacucccaacauuggcucaguguuggcaucaggaccacccaaaccuaugauaucauauaggugacagugcgaccaacagaccuguugucaagaugacagcuaccauguucccagaauacacuuggcucaccucccacuuuuaccugcauuaugucauuuuccauauaaguaaggagaacgccccucccucucucuccucuccucucucuucuuucugcugccgccuugucucucccucccaauaaaaccucuucacagggaacugucuuggccuagugugcuguugagaggcgacccgccauucuaacgcaucacucagcacacaugccuggcauuagauagcacccgggaaacccaggaguugaucagaguaaacaucccauaaagaccaaagacucuuaaguucucugccucaaaggggucauccucacagaaagugaacuaagcguuccuccaugcggcuuugcuaacuuaggcgauucgaccaaggagagaauuucaccaucuguacggagcaccuuggggcgacuucaaaacugacgucuggggcucaggaaauggcuccgugaguagaggcucuugcugcacaaaccugaugaccuggguucaaaaccugcaacucacacaagaaggaagagaacucacuccugaaaguuguccucuagcaguaagugagcacaugcgcucucucucucucucucucucucucucucucucucucucucacacacacacacacacacacacacacacacacacacacaaacacacacacaauaacaccaauauaaaaacuauaaagaaaauaacccucagcuaucaaaaagaucagauuuuucuguugcacaggggcuugugacagcaaggcuuucuaggaugcagaguagccccaucccguccccuggguucagaauaagcauuugccagugggcauccucaagagguauggugccaauuuuacaaaauggcccgaaucuucauuaucuguacucaaagccccaggagucaggccuccuguuugccaagugcccaaccuguucaguuuaggacuauugucauguggagagugcuucagggcuuccucaggagcugcccuggagacuuccuuuuacccaguccccuggucaauccugaccauacccuguaccagcacaaggcccgcaggcaucccugcaaaaaggcuaggguggugcaacagcccuugggugggcaggcaaaguuccccaauguucaguucauuucuaguauagcuucggcaacugcaaaugagcagcuuaagucccuuguaaacacucuugccuuuuccaagaagggaggcaacugugugugugugugugugugugugugugcuggggguggagugcuugauucacauaaccgugggcaaagagcaggauauugauacuaccuaagagacuuaauguuuccugacagccaugguuuggcucucguugggacccaucccacaucuaacaggagggagauguugaucagagauggcgaacaguucaagacugacuccacugcccagacugugcucacaccucgccauguccaaggcagggcaauggccgucgaccgagcagcucucgaguugggcccuuccuugacucugcuucccauuuccaguaccccggaaugucccgaguguccagugccaaagacagugacauuucuucuggucaaccucucuguuuacaguaaucgaggcaaggcggugagcggcccaggaugccgccgagugaucgcuuguuuuuugagauaaucaauaagacacuuaucuugaaagauucaugcaaguuuggaaucaauuaugaaugggaugaugauaaaacucgauaggagaguugcuguauggguuguuuuucaaacucuuaucugagaguugggcuccauuuuguguugguuucucugaaaugucauaaaaauuuuacgacgugcgcuaacuacauuacaucauuaccaaauagcgagauuuccacaugccuuaguggggauuuuucaaacucgcacuguagagucuugggaugguauccugaagaauuacaagugugggcagagcuuccaucaagaggaaggagagaugaggugugguauuuagggagcccaaaaugcaccugaucugaaaggaaugugucccugcugauaggcagaugucccuggguauaucauuuggcuauauuauauuuaacuuuucucgaucaaaauuccccaugucaaaaagcacagugguaucuucacccuggcacucuagaagaaaacaaaacaaaacaaaaacaaagauuauccuaggccuaguauauucccaaaugcacagaaggccgucaggaagugucauucauuccuaaugccauaacuccggcuggugcaccaugaauaaauuauugaauauuucaucccauauuuucuaacuuuugugcaugugugugagugcaguguugcaguauggagacaggaucuaccuuuauaguucaggcugaccuugaacucacgagcuugcuaucaucucccaaaugcugggaauacaggcguauggcaccaacauacccagccugguuucucacuuguaaccuggagagcaggaacuguacagcgcaaggcuguugaggaaguaaauucaauacugagcagcacagcaucugauauagcaaccgagagaugggauggcgugccagcuugcauucagcaggaggaacaaaauggaagagccggagaucugcuccauguauaaggaaggacacagaggccuggggggacuugacucaggucacuggaacagugacaucaugaggagguugugacacgugguccagacaggugggaaggcuugcagcuagaaucgggugcacaagacaagacaauccaggaguggaggaauaaugugaggucaguggacguagcgagaguauucaugacaacaggggauuugccuuggucuggggggguggaggcagggaaaggacagggacugggucucuaggagccaacuguagucaagugacuugaaaggaaccaaaugacucaaggacuuucggugaccgccaugggaaagagaagcggaagacagagaguacugagagccuccuugggggcugacuggcuaacagcaauucucuguugccaucaaaacuccaaauuggcagcggaggguggggguugggggguuggcacaugcacggacucagcuuuggaacgggaguccaaggcggugugggucaacuccuccacuaaaaggcucacccucgugugggacagaacagaaggcaccaagggccccagcuuucuggucagcagccagggcaccgauccccauucagcacgggauccuccccaguacagaagcacuucuccuccuggcccuaaauagagcucgcagaugacauuucguggaccacacuguugaagccgucccuguggucagaaauagccccgggguggucagacccacagccucggaaaucggacacuauauuuaguucacgcagacacggcugaaggauuucuuuuuuacguucagguuuugaguagcagaucuguaacugccuuugcauagucccagggcuuaggccugaggagaauggggccaagcagccaggucaacccagcuuugccacuccagucucagccacccucagggcauaucaguuguuggagaaaccaucaguuugguugaggcaggaggagaacucccucaguuuuacucugugcuauggcugauguguaccugauacacagacacuguguguucagccucacggaugggcacguguguguacgcccacggauucacaucauccaaggugauggauacgcagagugccggaagacuaccaccccgcccccaggcggugaucacuaccuuuuagcaaggugagcucuguucugaugaagccaggccugcguuugacuuuuauacaagcagugucaaugacuagauaacucaugucaagcaucuagcagcacaccugccaccauauacugggccguauccugggcucuuguuggaugcuggguucagaauaaucuuucuguuuaauccugaaugugaacccagcagagaagccaugguaucccugcuugacuaaagaggagcugggagccaaccaaguuuaaauggugaaacccaggacccugagcacagagaugagcauacuagggcucacgaccuaagagugcagaugccaguuucucggcaaacaugaacucuuugguuuguuuguuuguuuguuuguuuguuuguuuguuuucucagugcaggggcugaacccagaguaucgcucaggucagauaggugcuuuacuguuaacacuauuuccagcucgaaaaguuagagcagucugcaugguuucauucaaguuuuggccgugcuagagauugaacaugggaucuggagcaugauaggcaaaugaucgaccacugagauacauuccuugcuucaguuauuuucauuuucguuuauucauacaugcaugcguauaagcauugagagcuguccucuaccugacauguggaggucagaggacagcuugucuugugugugcugcuuuacuccuuccaccauguggguccuggagauuaaacucugaucaucaggguugguauauagagucuuuacccgcugaaccaucucgcuggcuacccuauuaguuuugucacaccauccauggcaacaaacauuaggcuaggcgcagcaauuguguuacuugcucuucucaaggcugugagaaaaauaugugggaagaucaacuuaaggaagggguucuuuucgcucucagguugaggguauagucagucauggcgggggaagucauggcagcaggagcgcgaggaagccggucacauggcacccauagucagcacugagaaugagacggaugucagugcucagcucacuuucuuccacuuggcccaggaucccagccgccugggagagcguagcccacauuugcgauaggcuuuuccaccuuaggucacugaaccuagacauuuccucacaagcaucccagcagguuugucuccugggugagucuauuuccucucaaauugacggucaauacuagccaucacaaugagaacgugauaacgaugcuaccaggccucacauugaugcugaggaaaccaaguugaucaagccaggccgggcccuugacuucauggaucuuaaacucuggugcagaagauagaaaagaaacaguuuuagcugaauccugcgaccacagagggagggauaugcuacugugggcuucugugaauguggaagcucgggcaacguucagagaacaagcagacaagcaggcugggaaccuuuagcaaugucacacagccgugaugugaaggagccucacgcauuugcccgcuaggcaugcaguacuaacugguuuugcucuaaggaagcucaagugcaucugcaguagacgccucaaaaauagccuuucaaaggcagcuuugcccuugacucuugcuucugcaugucaaaagcacucaacucagagccucuggauuaccaauccuaccucuagggaugcaggucccaagcccuuccccuaugcucccacaucgaauuaucaugccgucauucagguagcaccaucuugggagggaggauguacaccucugacacuugcagccucuccuaggagcuccuucccaguacacauugccacacagccugcaaucugcagucuauuucguaacaagagauucugcugcaggaaacagauaaaucucuucugaguagagagccauuaggaggacauuuauuggaagacaucauaguggccccugaucugacacugggcagccugaguucuacaauggcuccauaaagcaggacugaggucaucagaauuacccugagagaccaacuugcgcuuugaagccagcguugccuguaccgggcagggagggacccaugcuagcucuggcccuggcucugccugcuccuguuguugagccacggggcccagcagcugucugggcguggagacuaggauauuagaaaacacacauuuuuuucccaaacauuuagaagaugcuccaaggaaaagacucacaagaacaaauauuucaaggguaaaggacccacuuccucugacuccugucucacucaagagcucugugcagagauaagagcacugaauuccugcuuuucucccucgcaggagaauaguuuaaaugugcauucgguguacaaugaaugcugacgauugugacaucucuagggcagggacuugcuuuuuccuccaucuuaaccuucccuuccuccucuucuuuccagcuuuuauuuauuuuauuuuacauguauacguuuuuuuuuucuuuuccccucucaugaaugacuguguaccacacgagggccggguucccacaauggccauaaaugcauccuauccccuggaguuacaugugguuauaaaucagcacaugggugcuggaagagccccaaucguucuuaaccacggagccaucucucuagcccaagggcaggaccagauguuuucaucaucucuguguuucgacacccgcagaguucaggcacacaggaaguccucaguacaucagugaaagggccuaacacaagugaccuggggaagacuaggucacagggacauuuugcaaacaauugcacgaacagaaaugacccagaugaaguacgucuagugaccaacauaaagacccuccuaugaacuaguucacuaugaagcacagggucaugugcuuugcugcuuaaugauuaaagacgaaacagacacccaggugagacugagauucuacugacaaacaaauaauggaccaaugauauuucuguaaaaucaucauuggucaacagagaaucagaaacaaacaacauccaguugcacgccccauaacccccacuacucaaaaggccgagaaaggagguuuacaaguucaaggcucucuugacuagaauaugugaaguuugagcaucaguucccaauacuaccaauggaaagagaaaagagagagagagagagagagagacagagagagagacagagagagagacagagagagagacagacaaagagagagagagaaaauaccagacaccuaagauaguagaugguuuuuguuuagcuaaauguuuuaaaucacccgccccuauggcaccugugugcauucucauuccguguguaugauguauauggguguauguguuauuguauaugugaacauguguguccaugcacauauauguaccuguauguagaggccagagcucaguguugggagucuuccccucugccuuucaguuuuugagagucucucgaugaaccuggagcucacuagcucaucaagaccagcuggcccaugagcaccagagacuuuaucucucugccuccucagagcacaucuucacaacugcaggacaauggcuucauugacagagccacccucccaguuccccaaauuuuuagaaaggucuuuacacaccgaagucaaguguauguaaguaaguugggcaacaacugacgugggaaugugacuuuuggaaaaauaacucuugacaccuaagaagacacaaaucuauccuauugauggggugcguacuuugcuacagugccgucuauguuaauauaauuucuaucuacacucaacagcaaccucaagugacaagcauggccuagcggagcagcaauggcuguccaaaguauagaucucacuucauuuucuaccuucaccugacacgcucuggccagguauugaccacugagaggcguucuucuggccguaaaugcgaucaauaacucacucaaguggaacauacaacuguacauuuucugcuuauaaagagccauggauaaucagcgcugauuauagcucagagagaccaaagacacucgagugcgugcugucccuucucggaggacuaaccugaagaugaucuuugccuugccuacaaaugaaauauuuaaaacauuguuuugauggcccgagguaugccugacauauuugucgauuuuucgcagaugcgaggagugauuagauuugggggucaguugcgauaaggucaucuggagaccacgcauuuuaauuucaaauucgggacgacaaacccgauaagcaaaacuuuaugaaauaaaaggauaugaaaucaacuuacgugacuaguugguaugggaagaacuuuuguauuaaguccuguuaucuaaaggggaccugguauuacaagagagaauuucccugacaaauaaccuugaugugcuaaggcacagacaguaugcugcugggaaggacuuccguucauggcagccuggguucucuguggggagaacaaauggggcaagguguuuauuggucaagaacauauucauagggcuggagagguggcucaguggauaaagaccuuauuacccaaaagugaagaccuugaacuuguaccuaaagaacccauggaaagcuaggccuuuuaggaagcaucuauaauugcagcgcuccuagacgagaugggaagcggagacuggcaaauccucacacucagggccagcucgcccgguggacacagcagcaaacaacagaggccuagucucaaguugggugagaaagcugaagaccagcgcucaaggucauccucuggccucuaugcauauauaugcaguagccugcaagugcccccaccauacgugggacacccgccccucccgcaggucacuugauagucuagacagaucaucgccauuaaggucugagguggcacggccagcagguagguagugacaacuccaaaggguuaaacugugaagacaaugagauggccuagaagugcuuaaaacucaauuaaaguaaaaccagccccuguuagcucuccacagccagauuuaaggcucguccuguauuaucuauucauaggaaaaccggugcagcaauugaauauugaauuaugcuaacccacuuucugagcucuagaagacgcuggcuuccagcccgaugaauacaauggccacaugcuugagacuuuuaauuaucuaauuaauguagugucaguuuugcaauuaguucaaaugaccauauguaacuuuuuuuucuuuuuaagauuggaguuguaaauauuuuuuaaaaaaaaacaauacuuguuauauguugcauuaaaaaauuaccagccaggcaucagguggcgcacaccuuuaaucccagcacucgggaggcagaggcaggggaauuucugaguucgaggccagccuggucugcaaagugaguucuaggacagccagggcuauacagagaaacccugucuugaaaaaccaaaaaaaaaaaaaaaaaaaaaaaaaaaaaauuaccaauacagcguuuaauuaagaaaagauauauauauuuuuaagucaucaaacccauucaaacccauuguaacagggccaagggcugauuucucaugaccgguucauugauacccuuuagaaacuuuauuaaauugcagguaagagaaagaaucgccaccuggaugggcagauagcagagaaauaggcuacaaagaguguuugaaggaggaaggacauggagaugugggagcauccguuaggaauccacucaagugagagccaucauaaacgaacagcauuagaaagugggcagucguucuaaaccaccucacauagggccaguccuuuccuucuccucaccgaccacuucacucuucauggggcaggcuuugaacuuuaaauccuucacucucugccucucucucucucucucucucucucucucucucucucucucucuuucucucuguggggcagagaguguuacuaacagcugagcuuuuggcugaaaacgcuaaugugguagaaaaugcuuaggcuaaagaagucauuucugugccacuugcuccguccuucuguuugguucucuguccacaauggguuggucagggugcaggggguggagugucggggguugaggggguggaagguucaauggggggaaaguucugaugggcaggaguucacauggaaauuuagaggugaucaggaucagccugcaacugguucucaacccugauaaaguuccuucauaaacagaaucgacaacuuuugcuuucaaaagggcuugcaaaguaauggagaaggagacacacacacacacacacacacacacacacacacacacagagagagagagagagagagagagagagagagagagagagagagagagagagaaacagaccgagacagagagacagacaaaagaacagagaggaagcaacccuugucccuccugggcuugcuugguuuccuuugcauguuucccucccacagguggcaucuguagguuaagaaugaaguggugggggcuggagagauggcucagcaguuaagagcacugacugcucuuccagagguccugaguucaaaucccagcaaccacaugguggcucacaaccaucuguaaugagaucugaugcccucuucuggugugucuaaagucagcuacaguguacuuaaaauacacaaauaaaucuuuuuuuuuuuuuuuaaagagagaaugaaauggugaccccuccucuuggcugcagagacucuuuccagcaacuucauuucuaacaggaaagaagcguuuguuucucucaagucuucccauguuccaggaaucccuaugucagacaugaagaugaagccccuuuaccucaguucugaagcuaccuugcaagguagaugucauuuguauaccaacacugagaagguuggacggucguuauuucccaaccccugccucuaucugucccagcuggagauaaaggugaccucugagcuccuguccccuuuaaccauucuaacagagugacguucugugugaccaccacacuuggcauuuuauguggguccucagaaucaaacucaggcccucgugccuggagagcaagcauuuugcuuuugcugacuguuccguugcuguggagaccaagaccaaggcaucuuuaauacaacagaagacuuuaacugaggcuugcuuauaguuucagaguguagccucuuaucaucgugguggggagcaaggcugcagucaagcaagcauagugcuggagauguaacugagagcuacaucccauuuggcuagcaggcaggagagacgcugagccuggcaaggggccauugaaaacuccaagcccauuucuaguaccauaccuccucuaacaaggccaucccuccuaaccaucaacuggggaucaagcaugcgaacauaugagcauauggggccauucucauucacacugauaaagccgcacuccaaguuauauaaguuuuaaacacauccaagaaacuagaaaaagaaaacccacacaagacugcaaaugggagauaugauaugauagggcagaggggaaaccaaccagaacccccuggguagaaauccaugaagggccaggacauacgaaugggcaugauauaauauuauuuauuauuauauuauuccaucucuugugguggcaguggggucucuggaaaagaagacagcucacaaggaauuguaaggcuaacuagagcugucacagggcucccagacacauuguggcuguccuuccaggaagauauggcucagucccccucaaguacacagacccaggugccaccagcauggcuguguucauugucauuuguuuaugcaucaugcugaucuguuucuaaaggaccccccgguggaguggcugaugcuaugaaaacgaaggcaaaccagccuguaccaacuguaccaacugucaccuucaccccugcucacaaagcauuaucaagggccagggaaguacacaggugccauacaaggucauagucucauuucuugucuuucagugggagucuggaugaauuucuuucaucccauuuauaacaauugcccaacugccuuucuguauguuugagucuuucugccucuguaaauuuggaauauguaucgauguacuauauauacauguugcguuuagcuuguuauucauacauauuuauaguacauaaauauaaaauugaaugugaguagaguaagcuaaugguauaagauuauuucuaauuacacaaaaaggcaucaacaacaugguaauuggugcacauuaccuugugugggagugagacguuaucagaggcuggagagaugucucagccaguaaaaugauuguggugaaagcacgggccuggguucucucuacagaacccaugucaaagaaggagaguguggugguaaguacuuauaaccauagcaccgagcagugggaagaugcuguucucuaagccuggcuggcccgcuagccuugccggccugcuagccuggccuauuugggaagcuguaggccauggagacucuguuuucaauaagcaagagagacagcacuuguggaguaacacccaagguggacuucuggccuccacgugcacauggaaaggccuaccacccccacacaggcaagugugcacacacagguagauacgugugcccccagcucucaccauuaugacacuucaucacugauguuuggaaguucugagauggacacuugccucagaacacacuagaagaaaguccacuagcacccuucggcggccggugccuccgaaucagaaaaauauguacaaaggaaacagacacaaaggcgcauccguuacugcauggcagagaaaggucuucuggggcaggaaguucuuugccaaguuuaccuuuuaaccccaucuuuuaaaaauuauauucauguauguguggguguguguguuggggugugugggugugggugcacaugugugucauggugcacauggcagagguugaaguagagcuugcaggagucagaucucuccuuccucguguugacccuggaaucaaacuccaggccucaagcuuggcggcaagccccuuucccuagugauccaucucaccggcccgccaaggggaaccuuugaaccagggaaagccaagugggugguuuuuugugacuuuggacaaacagaggaggcaucaccuccggcggaaaaguuggacggacucgaaacugggagggagccuugcaaaggugucucgggacgacgucacacauuuucccucacagaggcagagggcauugaaguuucuuuuaaaaauucauaccggagaaucauucuccgcaaccgugagaggggaacugucagccagcauucccaauucaauauuauauugugcuucaagaaaaagauuuccauauauucuagauuaaaaaaagccucauaaauaaaugauaauccagugcaugcucugaaaaaugaaaaaauaauuuuguguuugcauuuuaguccgcagaguaaaauuuaaucucucuuuuaauacagcauguuuuauauaaagagguaaaaagauguaaccuuaugaaaauugauuuuuuuuuuacauguuuaaaaauguccuccacuguauuuaucuaggcauuuucuaucugugaggcgagggagccaccaccgucugauaacuucaccggguuuggcugcaaaguaaauagaauuacuguaguuugagucaaugaauuuuuuuuucuuuuuacuauuaaaaaucaucaaauaaaaugaucagaugaaggccuuagggguguuuggguuccagaaccccaucaaggucugcgacaguccccaacacacaguaggcagaugcacggcuuagggagagcaaccggaagcacaaaaccuuggcaccaagcaaggccccaaaccucaggaccugaggacgugguagcauaagaagaccacuggguguuugugccaucgguuuagaaucccacuguuuccuggccuucuuggugaccuagggaugaaccuuagagaggcagggcugccaccuacagcucugugcccagggcugggcaggaaaugggcagcuguacuuugcuguaacaaaauaccugguaaauacaacuuaagggaaggagggcuuauuuucgcuaggaugccaaggggacacuucccucgugguggggcaaguguggcagagggagcaugaggcuaucuggucauagagcaagaauagggccagcgucuauugccuaaagcuucuacaaccuugguaaaccaaaccacgccguauuaauuaucccauguaacuugucuuucucguauguuguaggauguguuuaaaagaucugucuguguugauuccggcuauagaaauucauucagucucagagcugucuacugcuguaccuggaggauauguaugccaacgccguuucccccguuuuacugaggguggacacugaggaguuuugauuuucuugccauuucaaauacuucgcuacagcauccauaaucuuaaucuauuccacugaccgcauuaucugucgcuuauuaccuacuucauuagcuaacaccaacgauuuuccacaauggcaacacuugcugacaaccucucccuuacaguggaagaugccugacucuccacaccucuuccacucuuguaauugcuagacuauugaauauguucccguucugguguuuguggacuaguuuauuauugacauuagcuuugcuuugcagggccuucagacugaugaguuugggcaugguuuuaacaguaggaugcacuuuucgggacaccuggaauucaaagagaggcaccggugcuaucuacagcucaacauaguagauuacaaccaucgccagggaaguuauuaaugaaguuaaaugauuugcauccaaacaagguacacuaaaagguaauaccagcaacgagugagcaaaggguacaguauguauaucaaggccagaggccuccaucaggugucucccccaauuguucuccaccuauuuuugaggcagggucucuugcagaagcugcaguuggccauugagcuagacuggcuggccaguaaacccgagggacccuucugucugucucugccucucuagcccugggaucacaaguguccaccaccacaccuggcuuuucaggugagugccgggaaucugaacucaguacccucaugccugcaccaaacuacuucaccaucugugccacgaccuguaucuuugaaucgcuauauagcugaccagguccacaagccccuccuggucgcuugugugcucuguccuuaccagaagccuccacuacagaaacugcuugggcaucaaucaacgaaucauagguuuucuccucauucuucuauccacuugggcauuuggggggaggguaaugggggugugugaaccugucagucacuggcucuucaggauggaaacccucccugaccacaaaugaaauucagagacguagcauagagagccucaagugacaagaggaagagauggacauuaaagaccuagauggaucaggcuagcggcaggagucuauggauaggcuucaugacauuaugaauacaguuucucaccugcucaagaggagacgcuguggucaaugugggaaggauggaagguucgggaugagggagaggccucuuggaaaugaaaauguucacuaaugacauuaguauggcuauugcaggagguguucauuuuccugcucacugagaguuuaauaaaaauguuaugucuccuccauagaacugugauuaaucagccugcuauugagaacgugccgcgauucucucucaacaaagcaauuuucaaaauuugaaaagguguaaauuuaaugcaaauugcuucauaaucauauauguacaaaacggagcugacaacgccgcaguuaggagaagaagcauuaacauuuuacauuuucuccaccgccgcccccaccuucucccagcugcuccuccaaagguaugguauaaauuagaagacacagccgauggacgagcacgcuggggaaugggggguggagacagaaacaguaauucuugcgacaaacucaacgguaguugucugggcuggaaaggcgaaguaaaacagaaaguuccagaaaugaaaaagauguggcuuuaaugcgacgacaacaggucgaccaguuuaacuggaaaccagagaggcuugggagaggggagaaggcagugaucggcuuucucacgugcgugggauguagaguuacacauauauaaucacauauacauguuacacauacagacuagggugggagguaaggugaaccguuugggggaggaggaacacagguaggauggagacccaauaggggaggaaguauuggggcaaacacggaagaugccauaauaacaccgaaaggucugucacaugacuggcauuguggugcuucccuagaacgucagcaauaaaggcaggaggagcaggaacucaaggcucaucucuacuauaaagugaguuggaagcuauccuugccuacaugagacccugugucaaaacgaguauguuauauguauauuuguauauguauauuacuuauaaaauaugcgcacuuucuguaucuaacuuuucugguugggagcaacauuuuuuuucuaaagagagucauguuuucgcucacguugcucccucuucaauaguccccagaucucuuggcauuucagaccguguuuugcaagagugagcauuccacggcucccccagagauuugcuccacccucuuggacuggaccagucucggaggcagacaccaggugcauccaaucucacuacuuggagugucugcuacaagccagagggacaagccaaggccaguuacacagcuuuucccagggcuggugggaggugaaaguaagaccucgggugugaacgugagaguguaaggagugguggcggcuuccacugacagccuuuaaagcugauaugaaucaaguagagaaacaagcaaagaaaacacacguggaaacacugguauugaucuuaugcuaacaggugguuauccugucauuuaagggaguagugucuggggcucaggauauggugcaguuaguacagaguuuucugugcaaauacaaagcugaguucaagcucuggaacuugaacuugggcaaaacacuugaauagugcagcaccaguuauuccauugcugggauucaaagacaggagaaucauaggguuuagcuggucggucagcuuuguagauuugacaauccccaggucccggagaaagacucuuguuuuaaggaggggaagaaaaccaagauagagggcucgaaugcaaugauaccugaagcugucucuggcuucauacaugcacauacaugugcacgcacacccaugcauacccaugcacacacaugcaaacaccuauaccuauauacagacccacacacauaagaaagguuucagcuguucugguuuuuuuaaaaucuguaauagaaaauaacugcucuaguuucaucucugcagcugggaugaaacaccacuacaaaagaacaaaugggagaaagguuuuacccuagcucacagcuccagguuacaguuccgucacaacagggaagucaagcugucaggaaccuuaaacaacuagucacaucauauccacagucaggaacauauauauauauauauacacacauacacacaugcauguauugucacucacuugcucauguucaguucaauuucucuaaguacaguuaaagacucucugccuagggaauguuguugcccacaguggacuuggucuucacacaucagcugacuuaauuaagauagucccccauagacaaguccacaaaccaacucaaugcagauaauuccucauugaaacucucuucccaggugauucuagguugugucaagcugauaauuaaaacuaucuaucacauggucccacacccaugagucuaugggcggcacaaauugaacucagugagauauaaaagaaagaaagaaagaaaaggaggacguaaacugggggugggggugggcucuggaaggaguugauggagaaguugagggggggaugaccgcaaucaaaauacauuguauaucugaauggcauucucgaagaauuaauaaaaacauauuuaaaaccacaacaauguuaacuuuuguauauuaaaguaauucugaaagauuuaaucucaccaugcuccuugcaucugguagcuuucaugguacuagcucugcugggccuaagauugaauggggcuguucauuucccauuaaauacaacgaggaaucaacuucauggacccccugaugagccacuggaaagcauugcuguuuccucugaagugggauguacugcaggcuggccacaggauuccuugggacugguuaugggccuggcggaggcugcucugcugaaggcuuggcugguaaauguccuucccugcaggacuucacuggucccucuuccuuccuuccuuccuuccuucuuuccuuccuuccuuucuuucuuucuuucuuucuuucuuucuuucuuucuuucuuccucucuuccucucuuccucuuucuuccucucuuccucuuucuuccucucuuccucucuuucucucuuccuuccuuccuuccuuucuuugauggaugaggaagcaaucugcuccucauccauccacucacugcccaucuuccucuccccgacaggaacacaaggaggaaguaggaagcuccacuucggggccuguccuccuggggauuguggccuggaaguugugggagagggauggaucccaggcaggcagagugcaccccucuccugcuucagagcauuuaccugccuccaaaggccauaaugacgaagagcucuggcaccaaaggcuucauuugaugcuaaggaugcuuaggauggccuaagauuguugugugaggagguggcaccgcagguaaggugcuugcuucauauguguaaggaccacaguuuagagcccuagcagcagcaucaaggccagauguggcagagugcagcugcaguugcaucgcaagggaaacaaagacagggggauccccgggccuccuggaucagccagucuaggucccguguccagcauaagacuccaacuaaggugguuggcaaugaaggaagacaucucaugucaacaugugugacaguuucacagggcaucugcaaagggcccaguugaauacaauaaggaggaggaagcaguuggcuccuugcuuccuguucccuuguuccccuccuugcacccuuagcaacuucuacuguguaggaaauuauccgcaaacauaagacagcugccaggauuuagccuccgguuccaccaggucugcagugagagcuuagcaggcuucggggaggaggcagcuccauuuuuaaguccuggcuguugcuuuguggugccugguaggcucguucaucagagcuuuagauggguuucaaguggagcguggggaagagcaccaauacagaaagagcugucuucccuucuuccuuguugcuuuuugggggaggugggguuggggguggagugggacagaaacaaugucuuucaaccuauguagcccaguugacucggaacuuuuaauuuccucucgcguacaagaauuacagauguuugccaccaacaucucaagacaccuuucauguucucaccagaaucaugcuugcucucuguugguuagggccauggagggguguccaggacucuuuagggcaagcuaucacuccacagucaaggauauucccaugaugaagaggggugagaaccggagggccacuuuuagucagccuugagucuuaacuaugggugcuccugugucccugauauuugucaaccaggguagaacuggagcuaguucuuaaguccaagggagacuggcaagucugaucacuaaucaauucucuuagauagcuugguaugucuacucgcucuaaaggcauguggguggaugagagccuuugguuucagaguucggcuugaaguucuuuuucaauagaaagaugcccacauguccgcacgugcauccugaauacagaacauccuugugcucucucucgcaugaauccauauuguucaauucaggucuuuccagcuugucaguuguauuccccaacaacuuccugccucccagaaauggcgauugcuucugaaguauucaaaguguuaaaaggaaauaaauaaauaaggaaagagggauagcugcaaaagggcagcguuuaucccacacggagaaacggacaaguagaccgggagaggcauugucagagugguuuuuuuuuuuuuuuuuuuuugcaaauggcauuuucagcaauauaaauuaugauuuauuuucccauguaaucaucuugauugcagacauccuuuuggagaaaucgcaccgcucuuggcuagcuuuuuaaagccccagaagacaacuuucaauucugauuaguauguauggugggaaaucagauacauuauauuuagcuugaaguguggagugcagagagcucaaagaaagaaagauagaaggagaaauggggguggugggggugguggagaaaacaucuguaauccuucucugaaggaucuggaggcacgcaguagggugagaagcaagaggagcuguugaguguaugggguugucuuccuguaauuaaccaauuguggcuccuugucagggacucacaugcugugagguuuuacaugggaggacuuugagcccugcucuuguguuaggaugcugaagauucagcuuccacccacacggucuucccugcgccaguggucacgaugccaagcucauccacuuaaggugagucggcugaagaucugugcacuuagaugaacuaaaaaggcauguggggacucaccggguccaggcaucuguuaaaaagcuaugcauggugccagaucuuuaugaugggaggccaugauacaucuuccacgggccaccugcuggggcggggcaaguggaaugccugagcagacauuuugguguugcaaaaaggcuuugucugugaacucaguccagagaugugccaucaauuugcaaagcaaacugcaaaacugucacauguuuuaaguaagcuuagacuuuguguguguguguguguguguguguguguguuggggggcacuguguucauggcucuccuuggucacaggcuccucugggucccauggggggggggcacaccuagcgugaggaacuuccaagcucagacucacucuuuggaugccucgagcauucccuccaggcccggcugcuccuguauuggaauagaacaaaggagaggcaccuccccuccugggugugaguaaaggggugugggauggguguaucaguuuucauacugaugucaccuggcugcacuggggguucaagcauaauugugggggaagggguguucuaagaugaaaccguaucucagcagagcacugugcaaggcugacaugguagaggucacaugccagaccucuccaggcuuauuuuuuuucuccugccucacauuguucugugccuaaccagcacagcugaaagggaaacugggaggguaucuguggaaagccugucugcuaccacagggcuaacaagugacaaccacucacucgauggucccggcaauccuccaugucaugauuccaaguggggaacucuguggcacagagaagacagcguguugaauucagccauugaagagacccaccguguacacaugggcuucucccaggcauugaucugucagugcauuuauucuaaacagauuuuacauaugcuaucgaaagcuccaaacucggugcccaagucacguaagucccucuauuuguguucagacagcagcgucgagaaagugagggagauucaaaccucaaagggacuucaucugugggucgcugcugcuucuccuggggugucaagggacacggguggguggccuccgguagcagacggcagccaccugcuaugacugaagaggaaccucaagccucagucuuguagcuuuaagggacuaaauucugccaacaccuugaacgaacguggcaguggauuucccuccaguguccgcagacaggagugcagcuccagcugaugccccacggucuuccugagguucagagaugauaacacagcuauaaugggcccuuacuuucgaccuauagaacugcagccauugauaugggcuagaguugccaaguguaugcugauuuguuacacagggauggcgcacacacaaacagagcagaaagcaagaacuccagcuuaaagaacccuaaguagaacuucucuucugccuuuuuuuuuuuuaaauauuuuuauuagcuuucacaaucacuguuccuauagagcauaaaacccuaaucgccacagcucugguuuuuuuuaguuagaaaagguugguuccaaaacaauacuuaucacuguuauuuuccuugacaguggugauaugcuaggcaggcgugaguucaggcuaguaguagcuagugaaauuccuuucccaugccaaguguuagauaaaaucagaaaucaacauccucauauaccaacaguauugaggauuuaggcuacaaaaagaauaugcuuucuucuauguuacuauguccaaaggaucucugcaauggauauuuguacguaaaaauaucaucccaccuccuauaaucugucaaacuacagagagaagggaaaaaggaguggauuuguaaguuccuucuuauacccaaaguauaccagagagagagagagagagagagagagagagagagagagagagagggagagggagagggagagagagagagagagcaccacucacucauuucugugaagcaauguaacagcaaacuccugagaucugaguuauuucagacaaacagaaaaauguagcuuugggaggaagcugggaacuggcccuccugcauuagacuguaagccagggcauacacugaggaaacagagaagguugggugagacuuguggucuaugucuguuugcuccgggucugugagauggguggggugaggaccuuccuguuuauguucacaugacuaaagcccuuaguuagaacaccccaucaagaaacucaugccggaaguggguuucccucgaggggagcaguucaagaaagaaaaaaaaaagggaaagcuacguggaauacacaaaacgcucacacaugacuaauugugccuuuugcugaccacacugcucccagaguccuugauuccugacauaugugacaagugaugcuagauccaaggugaugcaaggguccuggugaggaaggggaagugggugaagucauuuccacucauucauugucuggagaaugucuuccacagcugacgacacugcucuugacacccaccccaccauucugcugacagucgcacuauuccuaaacauuccuggugaugaucuuucccaugacgggaggaucuacaguaggcugggucuugggagccgucaggagacuuuugcucuaucuccuggcuccuccucuaccacuuuccuucucccaugcugggcuccugccagacucaacuguaucucuuggcacacacaugcucaggguggcaguguaugaugcccagcaggcuaguaaacagauaucacaugguccuaugacuugagaggguacuguggggacuacagaggaugccaacuugccugacucagucuggaggaggaagaggaggaaaaggaggaggaggaagaggaggaagaggaggagaaggaagaggaggaagaggcggaaggggaggaagaagaggaaaaggaagaggaggaggaagaggagaagaggaagaggaggaagaagaggaggaagaagaagaaagaccugcagcuagcuuuggauagaacauuccaggcagagagaugcaccaauccauacaaagaccuguuaacaagacugaauguuuaggaaugggcagagucaguguguaaucuucuacuuggaaaagcagucgaugugggugcuggucuugggauauucucucuucuauguccuccccucuaucaaacccaguaccucacacaugcuagccaccaagauauaguccucggccuucgucuauuucuuacuaggaacaauuucuuucuuucauuuuuauuguaaucuguggcaacauguaaaugugcugccaaccuugaaccguaagauagugcaaaacaauauguguaugacacuggcccaauucuucugaaacaugaacgguggcuauggugggcaccgagacucaagcccgggucaggccagucucuccugacucaaaucaccaugggcucaguacuacuuauacucuuuguuauagcuuacaauuauacucuccugccugcacgguuaagauggcaccuaagauaaaugaaccaccucuaauaagggacgagagccuuccaucacggaaggucccugaccauuccggaggcucugaccccacgagaacuuugcucuucacaagucaggguuggucaccaaauccuguugccuuccacugacccauacauagacuuacugccugugagccgugugugaccgaccgguuacuacccaucuccauuucuccuuguugggauccucuuucucuccaaaggaggaggggaaaaaauaccauguuuaucuccaaccuccccgagucugaugugcaauacgcuggcauuugcugguaaagcauaaaauuauaaggagggccuaauugacccuccugugucuuugaaaaagccugucuguggucucuaauugacccucuagguaccuauggaacaaugaaugaaucuucgagaaauaauggagggcgaugauuaauagccugggccuggcuggaccucuggcucucgcagcucuccccuuccuccccuccgcgacacucgauucccuggauuuuauaagcagcgauuuauuauuaucgcugaauaauaaauauccugcagucaacacuggagagaucagagacgucaugguucugcagggacagggauaacguuuguggaagcuggcaucuccauuuuucuccuuuuggcaucucucagaagaggccuccuguggccuccgagguugaacuaaaaaaaagcaagagauggcuccaguuccuaggacaauugccacagauguaaggcacucuagaauugcaggggguuuuguucuuaguccaaagagcaaaguuugccccugcugagggagggggggggcaaaaguaacaauaauaaaacugauaauaaaauaaaugguauuaaugugaugagaaguguguaaaaggccugccuccacauuaucuucauaaguacaugaggaacaucggaaguguaggcagugcuacugaccccauucuucaggugaauaaacugaggugaauaaacgaaaggaggucaucucccugaaguugcgaguccagaugucugccuugccgugcucuccaccacugccuuccuaccauucaacagugaugugccaguguguaauucuaaagacaaacauauugagaugugggcaagcaaaugcggaagauuagcuuuuccuuucuuaugguuuggcugagaaaugccuccuuucccagacaguguagaagaacacauuuaauuuuagaacuguacaugucuccaaggagauccaacaaaccacaggauugguuuuauuuuuuuucaauucauagcaauaagugugcuuguaacuaaaauuauuuaauagggggaaaggaggacuugggacguagguccacggcuguaagccuggcauggggcagguugggcaggggcauggaggacaguuugguguuggccauugcuauguagcaggaccuuguccuaaaccaacuuaaaacaaagcauaugaacaaaaaggcaaggggaggggaaacaagggaaacaaaaagccaggaaagggucucuucuuaagucuccuacaucccugcugaugucccccuuucccuggggaccuuaaguggcaagccaucuucaggccacaccacuuugugggcccccuuuucuucuuggucaaugcucugugggaagcagaugccugcucaacaaaaaauuagggcuuuggugauaaguauaguuucugugagaggaguggaugucuccagggcccugcugcucucccguccccucucccccaccucaucuucagaaagcaccgggucacugugcagagucaggugcuccuggugagcacgggauuucugggagccaagugugccagcgagauucgcaaccacagaaggcuuaguaaucuagccaccggggcuccaugcgcagguugccuucagucaccucugcggucucuuuggacaguaugguuuuacagaccgaacaagauugucuuggaagugauuuuuuguucaaagacagguggugcaugugugucucccuuccuggaucccaaagaaaaccugcauggagacagaugguguugcauaaaucaggcagcggugcgcaggaagagauggcuuuaucaggggggcacauaagaauauucuggguaggaaagcucacuuaugaggugcauguauagucuacauauauuccaccuugacuuauauccaguccuaccuauguauguauuauggcugcgaacccaucagccagaguuacuucggcuuaucagguuuauggacucagcagugagaaccccaagaaccuccaucuucuucucccaugggguggucaggcccucccuccuccacuccugcuaaagccugggguaacacauuggccuccauugcuuuccugcagugugacaagaagacgcuacaaguauuuguuucaaaccgagauccacugucuucugaagcaaagcuucucagagagccugagggaaacgcucccaucaccucaaagcccccacccccacccccaggagguuacuggacuccaccucucuagaugcuucacuggaagcuaaacuaaguucagcuaaggggaaaacggaaacuccuaaacuccuguguuccaauuucagucaggcagaaguucuccacacagccuguggagguuacugcugcuaauuugacaaucuaaaaucacugggagaugggacuccagggaguaucagucggggauggucuucacuguguucacugagguuggaaguccugcccacugugggcggugucacucccuagcugcaauccuaaaguguguaaguggagaauggagaaagagcugagugacauaguaggcagccaucucucuuuccuuccugauucuggaugccaugugaccaaccacuucaaguuccuuguccuaauggacucuucccuaggaacugugagccagaauaaaccucguccuccuaaguuacuguuucccucauuuuaucacagcaguaggaaaaacauaaacacacaaacaaacaaucugaagauacacccauauuccacaacaccagcgaggaccaccaagucggcaugcuggauaaggccuuggcugaucugccuacccuucucuuccuacacucaccugaacguaggaagccacuuucuguccuaagauuaagugggagcuugucuuguuguacacuuccuuccccucucucuauuggggacggccugacucucuuaaaucaucaccccagcucccagucaggucucccuucuuuaccaagaccucagucaguuccuagacauggcaaaucaauuacccagauacaagccaauucucauucaggguuuucccaggggaaccauucagcucuucuucggggcucucacauucagcccacugucuguccaucugcccuuuuagccuauguccagguacuaaccaaucacacacacaagcccuguaucccagagaccaaugacaucacccaaaccagggaauccuaagccugcuugcucugucuugucccuccuucuuguggaaaccacagugacggcccuuucucacaucuuccuucugcauuucccuguguggcucuugcggcuugaaaagaccguuggucuguguguggaacuguguauugaacaaaccauacauggggaucagagguauccauuaaaaaaagauagguguggugacucaggcuugucauuccagugugggggaggaagagacagauuugucggauugacugggugacuaucuccuuaaaccagucaugccaauguucuagugagagacugccucaaauaaacaagguuaucuguggaagaaaaccaagcuggucuucuggccuccauuugcauacccauccacaggcguaucacaaguaucacagaaugaaagacaaagucacaccaggcccuucuuaaguagccauagcuaaucaggaagcaggggccauugggaccuuccucccaaugguccaagauuaguggacuuccaggcccucucugucaccucucugaccacacucgcuuacucaggauugucagccgaagggcgauuccuucauuuaacugacaguaaccaucccauguggaguuaguuuauaaaacuguaucaggcuauaaacagaauuucacuguucccuuuuaaaauaacuguggaugcugcuuagcugcacuaagguucagacaccguggaaggugcagaugugucuccuucucuccuggaucccaaauaaacuugcgugccaacagauggcucccuguaagucggaugauaguguacagagcaagauggcuccauuagaaggaugcuacaaacagaaucuuuugagggaagaaaaaggugaaacaaauucagcuuuaacugcagauauuuaugguuggauuuuuggaguccgcacaaggagugacugcaucuuugagugacacccccggugacauuucuauauuugccauuuuuauaauugcccuaaacuggauuacauaaggccauuuuugugcacgcauuaauauacaauauacccagggcauaauccgcuguaccugguuuccauacccuuuauccugccucuuuccagugcccuuuguuuccccuggacagcuuuacuuccugucauuuguaaauacagaauuuuauggaucucuaacugagaagaacacagcaccuuugucuuccugagacugacaaugcacuuaauaugaucaucuccagcuacauuuuuuguccuccaaaugaaaaucuuuauggcugaaaaaaaaaaaaucccaucaugcauuaugcaauggacacuuugguuauuucuauaacuuagccacugugaauagugcuaugaucaacaaugauguaaguaucuccgcauccgugauacguugacuccguuuccuuccguaaggaacuggaggcaauguaccagaagagaggugagucaggaugaaggagagaauggcuagaccccuccaugaacaggcacggaaggccccuuuccaacccaguuuucagcaucccccugcuguagcugccuucuccaacugggaaccacauccuucuggccaauccacuucagugcuuguuuuaucaauaaaguuuuacugucacaugcuccugacaguuugccgauguguugucagugguugcacucacugugcccugugguuuccuagcacugccagacaccuugggggccccaaagcccaacguucaccaucaagccgugauagcgcuuauggauccuguuccagccugaagcuuggugucugugcuucccaaaugcuugugucuacuuuguuguucugucugugacaauaaugggauguccagaaagaggauuuugguaacaauauacgggcauuauucauuugggcuuagaguagaaaaaaaagugacgucgaagaacauuucagacucaaaacuuguguuugaaaucaggauuaaaacuaaaccagccagguucauucaaccucaaauggaucaugugucuugaggauagucccauggcuauagaagaaaacaaaacaaaacagaacaaaacaaaacaaaacaaaacagaacagaacaaaacaaaacggaccuugcuucauuuuuucuuuucucuccucccuccccucucuuuccuugcuucucucauucuccucuuccucuuccuuuuagcucuucgcuuucucucucucucucuuuuuuuucugauccacucugccuuuuauuacaguguccagucagaaacaaauucaaugaagauggacugucucauacaugcagucucugacauguacuccacaagguaugucauggacuuuugugugagguggaucacauaggacucuccuucggcuccuaagcuugaugcucacauguagugauucuacaaaaguagccuuacuucgucgccacaaaagcugccuuuugggcuaauggcuucgucuccuaacgagggcucuuggaugggaugcucaggagugcccaagugucccacuccuugccaagugggugauuuaagagaugggcacaauucuagauggcgugagcaacaguucaucuguuaaucugaaacggauucagcuucucugaagcgagcaucaugacuuaaugggaaaccgcgaggagauuaaaggggggacugcauuaccacgaauaaggcggaaaagugauauucugucuaaacagcuguugaguguaacugacuagaacaaauauauuaacagaagcucgggguagauucaaucaggucgaacgcugcuccccagaauuuacucugaaauaagcuuuauguaccugggaugugacgaaugaaucuguucacgacuggcugcaaagcuauucacaugcagauuuuaauucugccucugacucuguagagguuccauugucccacccauugucccaccacuaagccccagccaccccuuccgaaaacaaaugcuguguaccuccacaaaucgcaaaucacggucaugugugcacuagugggucaaggccccgcccucuacuuucacuucaaaaaaaaaaaaaaaaaaaaaagaaucaguucaaauuuguacgaucauaguguccagaagucugggcucuaucgugcuggcuaauccaucagucagaaauaucaguucaggagcauaagugaggagagcaacuagacaguuaggauagaagccugauauucucucucucucucucucucucucucucucucucacacacacacacacacacacacacacacacaacuaagagcacauuaacuuacaauuaagcuguggugguaaugaggucauggcauaugacaagcucaugggcugcagucaaaaggcaaauauugaaaugaaggcguuuauuuuccgaccagcaaaccugaaccgaaccauuacaauaaaugccauuagcaaucuaguuacugggcaggauaauuucaucuuugaaauuaauugaguaaauuggaaugaccuggaauccuuuuuguugccagcggacggaacaacauggcaugaaaggcaaacucauuuuguagucaacuggcccguuggcuccuugacagccguggucaaguugauggaagucaaagguaaaaauaugguucauccaaugaggcagucaugugcucuugaggaguuugcaaaacaaaaccaaaaaguauuaaauaauaauaauaaaaaaaccucugaaauauuuucuuccuaaguccugggcaagaugccuuuggguuggcauccguaugauguaugaacaucucugugacucaggaagucuggaauguccccauguccauacugccuuuucuaggcccucuggauuauuuuagcaguugugauuaauuucaugcaugacaguuggacgaaauaugaucuuaguuucuuaacacaacugacaguuaagaaacuaaguagacagagcuugagccauggaaaccuuuaaaguaccaagauauagaaauaugucccauauaucucuucucaaacuucuauauugaagucuaaacagccgugugauagcaucaaggucuuuggggcaggauucauagauagcgacagggacucaucagugguuuuaugccuaugaugguuaauacugaugucaaaauuugauggauuuaaaaacaggcaguaggccucugggcaugucugugauaguuucuggacuagguuaacucaagcaggaagacccacccugaacuaacauugcacgggccagugucccaaaaaaaaaacaaaacaaaacaaaaaaaccccaaaaaguagacauagaguugaaugagugucagcuuucauuucugucugcguccugacuauaguugguacuuaagguugacaccuggccucgacagacacacacuaacaggugugcaugugcacaaacacauggauaccaugcaagcacacccauggcauacucaaacaacacaaaguaugagagaaaucggggaugugugccaaccggccagaugaugaccgugugcgacucauaaucaccuguacagcaaagagggagacaucccagaagaaaucacauuugcuagcaaggugaucuugggcuugagucccuaggaugcugagauaauaaacauagaagucuagagccucucuguuuguggcauuuuauuauaguagucccggggaauucacacaguaccugguccagaauguggcuuccaaggccagucaguagcuaccuuggguucacgggccuugcucgccucuugcuuuacauaaggacaaugagauggguuggcguauguaagcauggguggaggauauggggcuuuuuaacacacgugaaugcaaaugcuguauggcauaaagaaaagagaacaagaaaagcugaauguaagaagaugacucuuacauuuuggaggcagggaauggacaugaauuaugaaagaaaauagaaagaugcuuguuuuucuagcccuaauuccaucaaggacuuccuugauuuugauaguggacacaugcauagaauauauucaugcugaaaguauaaaauuucacagcuugugucuuaaugccaauuguaaaugguauagcaguccauugaguuguguaaaccuuggguauggguaauuuuagugugugauguuuuuauauagcugcaaggcuuuuuuuuuaaauaauauaguuuacaaauuuuaauuuuuuuugaaaaucaugaaucaagaagacaugcuccaagaagcuccaggguagaaagccaugcugguuacacaagugacugcuuccucagaagcaaaaaucaaaaccaaggccucaugcaugcugcaccugggccugcgcuucaugaaaacacuucuucuuccgggaaacuucugaccucugacaucaugcuguccagggaagaaagucacugccuauucaaccacccuccccuguccuggagggagaucugcucuuugcaggagaggagaacacgucagugacuucuaagucuacuuugccuucagaucucaaugaaagcugaauucccaguuagccuacuauauucuagaaauaaucccucccccuuuguaugugguguguauguguguguguguguguguguguguauguguguauguguguguguguacauauuuaugugcaugugcccguguauugggugcacuuguaugcauguauauguuuauguggaggucagagguuaaagucacgucucuuucuucauuucaucuuguuuucuugagagaaggccuuucauuaaacuuggaagucgccgauuugacuagacuggcaagccggcaagcuagggauacucuggccccugccuccccagcacuggaauuacaaacacacaguaccaaacccaauccucucccaugggcucuggggauccaacucacaucuucagggugcaaggcaagcacuuagcucgucgagccaccuccucagaucuauaaucccauucucaauaaucucgcugggcacggagguacaggaaaauggucuggauugucacgcagcccugcagcugcaccugaguucuucagccuaggaccucuuugacuuugcuagucacuuacuuccgucaaccacuguuuccgcaucugccuagccggaaccaucugcuuaguaagaaaggccgagauggagccuacaucaaaagguuggggacuaguaaguaccugcuucaacaugcuccauaaagugcccucaaugaaucguuguuuagauugcauuguaauaagaggcuuguauuauaucauuaauaacaaauggaaugaaagcuuauugagaaauguccaguguuuaccauuagaacuagagugaauauuaguguccuuuucuuuacuuucuuaccaaaugauugguuccuauacuugauuuuuauucacugaagauuaagagccuugccaggcaguagugguacaugccauuaauccccagauacaaaggcaagaggaucucuaaguucaaggccagccuggucuacagagugagcucuaugacagccagggcuaaacagaggaacccugucuugaaaaaccauaaaaaaagaagaagaaaaaaagaagagaaaagagagaagagaaaagaaaagaaaagaaaaaaaagaaaagaaaaaggagaguuugugcuagauguuuaaccaaacauauaaguauuuugagucacagacaccuuaacgguagaaaacaggcaucucuacuugcucaggcuucucucauuguaacaacccccauucacuaccaccacaggcuuucaaagccaggguuguaagcacagauuaccuuucauuacacugcccuaauaacaaccccuucuuugacaaguaauucagggaaggcuguggaaacgggcagcauggugaugauuaaagcuucaacuguccuugacacaaagaaacaggguuucugaguuacaaacagcaagacaggguagcuaccaggcgccaggcuauauauaacccuaugaggcauucaacacccaucgacagaucaugaggguaugcuaaggggauaugguccuuuacaauccacagagcauggcagguaaggucuggggacccacggacucgaggaaguaggacauuugagaucccuuaauucagggagcagugcuggguugagauucuuauauugcaugccauuugggauuugaaguguucaccauagcacuugguagaugcaugcuuugcagccaacacaauguuccuaugggguuaucugggcuucuguuuauagugcagguuaaagcugcaguggccaagcuacuguccuuuggccuugucauccacuuugucauaucaaccuauaugccagucucucccggaccugaggugcaacccuguaguaaaggugcaggaugugacgucuuguuuucuuccccccugugaccauagagaggucuuacaucagagucccuggagacaccagucaagucuagccaauaggcagcugagaggcugagagccagugacauaggacaccucagauuaaagcacuuuguagcuguugugacgcccucuaguggcaaucagggacacuuguaccagaugacacaauggaaaucagccuguguccccgaggaacccuggggacacuggauggagagcuaugacaucgguaagaaaaaaagcauucccacaacccccuauucuacccacuacacacacacacacacacacacacacacacacacacacacacaugcagguaugcacacaugcacacccuuaaaccgagaaguaaauguuaucucuuguuucuuuuguccugucucauuuugcuacuuguucugguuacagaacaaaauuggacuaauguccucaggggucagacugugacgacucccagccccucaucuggguuuuuaacugggaggcugaagguuuucccugcauuaagaaacaaaggcagaaaacaaaagcacucggggcuuauuaucucugcuuccuguagaaaugccuucccugaauuaucauuugacaucaugccaguuuagaagguugauguaggaaccauuuacucacaaaguauugcugagucuuuuauaaaaaauaaaaaccaaaaaccaaaaacugggcauacaccugccuuuuggauuaccuaaggccucauguagccuucugccaagguccaacuccaaggcaaauuuccaccuuugcagacgggcuuuugcuaccucaguuuugcuccaugacaauugcaagcaacaugguuuuccugagugcuuggacucuaaggauuccuaccaaaauucaaaggcugaaugagcgagagagugaguuuagaccuggcaacauccacugugguacugugcagaacgccuuucuucuccuucauucagauuccuugugauauucuucaucuuuccagccggaggaacacaggcccuaucacgcccuacagagucagguuccccucuucauucgaguuuccacagcuaggucccaggagaucaagcaucgucaagugagugucuuuggcaggugaugucugcucuuuuacaauuggugucugugggagcucgggaggucuaggagggaugaugugaggaaacccaucaggaucaaaucuggauugaagacuagcucugcccaauucccaucacgagaauccuccauuuggagacacccucuggugucaagcaagauaccagaccauggaaauaggcucaccagcccuuggcuaagucuacauucauuuuucauauuauaaaaguaacccuugcuuccagugggaggagcgaaggacaaaggaagggcacaggaaaagcucuagcuaaacucuagccuggcacauucaggugccauacguguacauaggccagugacguguaucccugggagacaaguguuucuuuuuuuaacuguccccuuacagaaggaaaacaggaugcugucaaaccacagagucgacgucacaucacaugggcaaugagugauagagacagauuugaaccugggucuaucugaccaaguucauuagguaacuacagacauuuguuuuauuggauauuuucuuuauuuacauuucaaauguuauccccuuuccugguuuccccucagaaaaacaucuguccccauccccuccccccuccuccugcucaccaccacacccauuccugcuuccuggcccuagcuuuccccacacucuggggcaaagagcauucauagaucaaagggccucuccuuccauugaugucggacuaggccauccucugcugcauaugcagcuggagccaugagucccaccaugugugcuuuggucccugggagcucugggggguacuggcuaguucauauuguuguucguccuauggggcuacagacauuuugcuggguuucuuuuguuccaguuuuaaaauaauuucuuuacugaucuaguaauuaauuaauuaauuaauuaauuuaucuauuuuaugugcauggguguuuugcccacauauaugucuuugcaccacaugcaugaauuaugagcaguuaugagccauuauguagguucugggaaucaaaccugagaccucuggaaaagcagucagugcucuaagccaucucucugacccucauguguuucuuucugcagcuuuuucuacgcaugccuguauauacauaccugugcacaaauauauauacacacauauauuuauauauauaaauaacuacauauauuguguguauauauguguauuuaguucagaaucuuguacuaugcauauacguguauuaguauaaugauuuuaaugugguacaugcauuuucauaaacugcuuuuuacauucaaaauguaaacuauuaauauauguuacuucucugaauaucucucuuaauuuagagugugugucuguguacauauacacacgaaccacacucacauauucagggaggucagaggacaacuuguaggacuugguucuucacacaugugggucccagggacugaacucaggccaucuggauugccagcaggcuccacuaagccaucccaccagcccuucccugaauagucuuaaugcccuucaaaaguuuaaauuaaggggcuggagagauggggcauugauuuaguaacuagcauccacugccuguaacuccagcuucagggcauguauuuacuucuggcuuccauggcuaccuaugcacuuacacgcacauacccacacacagauuuauacauccuugagaauaaaauaaauguuuugaaauuuuucauuuuaucuacacuccuucaauucaauagauagcuauacuuaacagugaggaguacacaucuuauaaaaaaaaaaaaaagcccuccacuuuguaaaacaaggaaaugcuuagaagacucagaggaaacacagugcauaggaagggacuacuauaaagcagccccgagugcagccaccacaugcagccacagccacagccacauuccuguucccugguuugacaccuagagcaagcaucagcucuaaugaacauuuggcaaaaugacaucucauuuguguguaaagaaggaagcugaucccuucuccuuugcccccaaauuccugcuuuuuuaugaaucucagacaagcucacauguagggacagaugaaucugcaaucagaaaaugggucugcauaucaccaauggugauauguggggaagucugggccaggcagcgcgacuguacgauucugcccaaggcuaagcaucaagcauacauuuccauguggaacacccggguuccugaguccguuuucacugcccccaacccccaacagcacgacuauucaguucugugauguuuuguucuuacuaauaaugucuaaacauaccggcucccauccacccauucacugagacagauggcaaauaccgacccugaccgcagggcagagaaacugcaggaaaaacaggaaugcaggguguaguucgauauucuaggugagcugauguguagcuuaguaugccucugggugugugugcgcgugugcaugcgugugaguuaguaacggaagugggaauuccuuguauaugaaugaaagagggguguuauacauuuauuuauauuggauccgauccuguuuccaaggagagaguaaacuguuuaacggggaacaugguccagcucggauacaaccucuuuggagugugguucauuggucgguucgccuuacuuguggaccuucgcauuagucaugaucagcugcuugucuuuagacaaaacacacucuuuggugagguguguguacguguuuccuuucuuagaagcugguucaagagcagcguagucgccugcuuaagaaucaccugaccacccauggaggcgggguucggagaccccggauacgcacccucccccaaaaaaaaccaucuuugggucagaagcccuucguuuguccacaagaauuaacuagacgcuuuacaggggacuccaugucugcuugguauagaagcagaucagcggcucucguggacaagagacggauuuugaaaaguuccauccuaaccucucgccuucaguuacucaggagguuucuuucuggaaccucugcaagaguuuccgcgaaggucgccuauaggaaggggcuggcggguguccgguugaaugauuucagugaauucucacaaaacccccucacgaguagagccgaguuggcucacuguggggauuuucaucuguguacuguguugcugaacaccgcagugcacuuacgaguguauuaauuuccccagcaccuacugggugccaagcaaagagaagccuagcagaaaacggaacgaagcagcucugugcauccauaaagggcuaugagaaaggcaggugugggaucugaggggcaaagaaaugacagugcaaaauuauaacucuugccacgugccauuucuguggucacuaaaaugcauuguuagcaaagauccuuuaccuggguggcucgcagccaggcaagggcacgcacagcuuugcuggcuguucaaagugacuguuucagguaaugggagaauggcaauagaauaaauguauaaacaagauaaguuuucagaugcaucucauagguacuauucagguccaaaaugaauagaaauaaacaauccuccaauaucaggugacauauuuuaugugcuucccuaccaagcguuuuuuuuuugggggggguugggggagguaguggaaagaaaaugccccuaaaucaggggacgaggguauuagaaauaagaucaacccggguccuuuaacaaucaaauuuaugacuaguaaaggguuaugaaaaauucuaucuccaugucggacguggggaaggcaaagucuuuggaggguuaucgugauaaacugcgagcccccgcagugagugcgaagagcggaaugagugguucaagaguucagaacgggaguguugcgaagguguucuguuaaagaggagggcagccaccgacaaaggcagagaaaggucauccuuacagccgcuccaucuucauuacaggaggaaaaccccguggccacggugcagccacccagcccagacgugcauaccaugaagccaguuaggucucagcaacaaauuaaaauccuaaacaaaugucauguguagaguguucacagcugagccuauauauugcuaccugggcuucucaaagaaacacuagccacuccaaauaaauggguacugacaccccuccauucuucccccccacacacauacuuuuuggugugagugauagauuaauuaaagauuauaaucuaucuuccuuggaaggccagaggagggacuuguaaucaggaacuuaauuuucucucggguaacugccgaacuugagugugcucucccaaauaaaauaguccuaccccuccccauuuucucagcuugcaccuccaagguuggagaaagacagugauugugauuugcccuguaacucaccccucaucuuucagaccucggggaagugggagaaaggugaauuucauuuccugauuaucagcaagucuauagagagauaggccaaagcugcugaaaugggaaagcaggcccaacuggcuugcgcugaccuuccucgaaagguaaggccaauggugugccuccaacacaggcagaggguucugacccucugcaaucaccugcccgacaaauccagacagcaucagcuacaucugccagcuuccccacaggccagcagggacccucuggucuacccuuccagcaacugugggaguggggaccaagaaucugacuucagugcuugacauaacucaccuccccgcccucaagcccuuggaggagcccagaagaucgugaguuggaucccagacauuggaugguuggagauugacuuuuaaaguuauuuagaucuucaaaauaaaaacaaaaacaucacuaguaagcuucaacccuuacaaucuuauucauccccauucuaaauaacuuuaaaagucccacagucuuuacauauucuuaaaauuucaaucucuuuaaaauauccaucucuuuuaaaauccaaagucuuuuuacaauuaaaagucucuuaacugugggcuucacuaaaacaguuucuuccuucaagagggaaaauaucagggcacagucacaaucaaaagcaaaagucaaucuccaaccguccaaugucugggauccaacucacgaucuucugggcuccuccaagggcuugggucacuucuccagccaggcccuuuguagcacacgcgucauccucuaggcuccagaugccuguacuccacugcuacugcagucuuggccagcaggugagauuucaaaggugggcugacuucgaguugcaaacgguaaggcugagcauggcaaugaggccaaaguggacugcaggaugcaagagaaaaugcugaagcccaaauaauggugggaaggguaaaaugaguucaggguuguagugcccauuccugucugucagcuugauuauaucuggaaugaacuacaauccagaauuggaaggcucaccagugauccuaaucuggagacugagagauacaaguuccugaccuggaucuuggccuuggagaucuugaggcauaguggcuaugaauuccagaagauuaaggcaggaagaucucugaguucaaggucaucugggauuaaaggcguggcgauauacaccuuuaaucugggucacgccuucugcuggagaccuacauuaaggacauuggaagaaggaagauuuacucucuucucuucuucaccugcuugccuugugggacugagcaacugcuagauccuuggacuuccauccacagcugcugcugaucauugucgggagucggacuacagacuguaagucaucaacaaauucccuuacuauauagagacuacccauaagcucugugacucuagagaacccugacuaauacaagggucaauguucugauagcagguaucacuggugagagucggugagaaaacaaacuccucauaaggacaggaccugaugcgcucaugaacucacgaacgcuguggcugccugcgagaggcaaagccagugaauacuccagcaaggauagggaaagggggaucguggguccccaccuccagcugcggacuacucacaguugacagcuucuggggaagagagacgguuuucuuuagaaguauauauguucuaccacaauccaguggauggccucacaugggagaaugcauaggcaacaaaaacuggacucaguguguuauuaaaaaaaauggacauaaagcuaaaaggguugggguggagcugggaggaguagggauggauaugaucgaaagagauuguuauggguauauggaauuaucaaauaauuaauaaaauguuauauuuuuuaaaaagaaaaugagcuacacacacacacauacacacacacacacaaacacucacacacuuaggagacauuucugaggauguggccuuuacuugcccgccaagaaauauaugucggauaucaauggcuggcuccaaggauuaagucagacaacagaugaguggacagagaacagacagaccuaacugggagagagagaaauggggagggagggcgguugaaauuagcauaccaaagacuuggccuugaggccagcguacacuaaaugucuaguaagugauuguagagaugcaccuuuggguuuuaugaauugauacaaggaagagaaagauaauccaccuaagcaagcaggagccgauggcuucuuuuccuucccacugugacuauuggccucugagaccccaauccagcaagcugaauggaaguaucuccaugcuuacuugcuguacacauaugugguggugguggugguggugguggugguuccauauugagacucauggaagaauucaguagccaugagcacagcccuaucugcaagggggacauaaagggguaggagcaagcuauggcaaaaacugucaagugacuguuccacaucucagacccaggucagagcaugcucaaagcuaaauacuuguggacuggcaggcaacguugcagucaaaggcugcuugggagccagcuacuccaguguccucaaggcaggucccagucucuuagagugucugaaaacacuggcccacggcagguuacccuggagacucaucucuacuuuauacccaggaaaacugggcucuagcaaguucuaugcucugcuauagcucuaaaguacuagagucggauucccuccaguccuuuucccgacucccgugggaacagagauuguagaauucuugagugcaucuugggacagagaccacuggcuuucugaucucccacauucaaaguaucaaacuaugagccuaggaaggcauccuuuaaacagcgacuucagaggucagaggcaucggacacaaucaaaaucuuacuugguggagggcuuaaauaucuucuuuccugacucuuuccagaaaccaaaccuuacccagccccagcaccaccagagcgaguaguuggagcugaguugcagacagggaagacaaagcaggcugauucccauacaacugucuccugggccacggagaccuaaccuaguguagucccccacuacgaaucacucaucucugcugcaagaggcagaaccaccaggugacauucucucaccaaagagaucuagugucugucccuaguccccaugccugguacaggagaugggugggggaaagagacagcagcgggagaagcagcgggagaggucugcaggcuucaugguacaaagcagcuugcgguggaaacccguaaccucaacaacucgggaggcugaggcaggaggaucacagacucaaggccugacugggcuuuggagugugaucaaggacagucucaaaagcuugagagagcucggggacacagcucugugguggaguacuacucccuaacgcacacggcucgagucugauucccuguauacaagucgaagaagagagaaaggggaaacugauaagcggggcauuagcccuaaacauaacaauuuucaggaaaauuaugauuuaaaagcccagaguugggacaaucugcccacaaguaggccauucauuaucuuucuguuucagcuaaguuuccuccgaaggcugcgucuugggguucacguuccaagcucucugcauucagagcuuccugacauaaaacacauccucuauauaaucucauggucaugaacucugcacuccccgccccccacuauaaugggccaaaggcaugaacccaaauaaaacuucccuucccuggacuaauccgauaagguguuuuauggaagcaaugagagguugucucaacugagucccuagauacaaaaccaaaacaagcaaaauauaaaacgaaacauaaaauaaaacaaaggggacucaaggaccauaggcaaaugguuuggugugacagcuaaccuccaccagguuaugugaggacaugucugagcgggucacggggcaucgcgguugcugagcggcugacuccuccuccggggugugagaaagcccagagucuaggaacuccaaguuucccugcuggguugacuuuuagaguccaagcuccagagcugcugauacacaaacagcucuuucuuuucacucucuucagagccgucacuaaaguucacucuugcaagccaaauuaaaaaaaaauuaauaaauuacaacuuucaaagaauguuaaaaagcccaugggcgucuaagaagugcuuagaagaaacaacaaaguauuaagcccgagacaaauggguuuacuguguguuuacugcaauguugacuuagcaucccccgguacagggucuccuacccccacuuaccgcggcuuuguaugauaauagcggcauuaauuuuaaaauaaucaugaaucaaucauggacucugacucuuguuuuuacuggcaacaaaacacucuaauuagcaccuuggaugcuuugcagauaggcaccgggugacagcagucuucuguuuaauuucuccuaauuacccacaguaaaugagguugaaggagagcuagcgccauguuauaagcccugucaacuugucccaggacauacacaccuugaaccuucccacacuggacguacagagcuccguaaccuagacggugcugacguuuagggguacagggauguccuguauacaguaguaucaaaccuagccuugaucuccauccaaugggugauggcuggagcuucugccccuagucccuuuucgcuccagacacugccaaauauuaagcgaaagccaaaucacccaacugagaaccgcuagacaaacaagucuucacaccaagccaucauaaagaccaaaugucaucacacauauugcuuuaaaagguugucuucagagacacuacgaggcugaaacggauguaauuggagauaguuaaaacugauuaagggacacggaucaaaucuaagagacgcaccuggcaucagcuucaaagaagagcgagcugauucagaaucaucuaguugcacggagccucccauuccuauaaagcguaggggucucuaaagcauccacccaggguguguucugcuguaugcuuaagcuguuuugugccaaacacuccaggaggagagagguucaagugcagaccugccuuaaagucacccugcaagaagaacagaucaugugcgcacuacacuggauagcagcagcuuuccugcuacacaugcaauucgggguucuguccucuuaggaggcauugguaggggaugccacacuauggcagugagcuuuucuggucaacaaggguugguccagggugguaugagaccacgucugcacuucaggaacuggugccaugcuggaagucaugcuuguuuguguaagucugagcuugcacacuggagucuggcagaacaauggagcuggccccuaugcuuagaacaucaccuguccuucugacucucccaacuccccuaccacucaccagauuccuugacguagauggaagcaaagagccauucuucaaggcugggggagggaggcaggcagugucaggagugguccuccacuccuuccucugccgcagugcaguuacggucugagcauccucuacuccaauguggacacccaaggccauguuaacaaccagggcugugugcuaugccugcacugaaauacucuugacaaaggucuuucaucaaaauuacagaagcgggagcugcugauuggaugucgcaggcagaugggucgugugcuucgcaaccauaaacuacgguguccaaaucagaugguauaaaaccaugccucuguguuuuccaucuccauuuaggagggaaaauuuauauucaguaccuucuuaaaauagcccaugccucccuaaagcuccuaaagaaggcucugguuaggccaccgcgauucccugccaagagcacggaggacggacggggauggagagggucagggaggaggaaugagaugauguagccuuggaggcucagggcagccacaucaucauuuuacuccaagacaccauuguccccuagaaacaggacaaugagagaacacauuguuggcagcuucccgggcccccucuccccuacaaaaccgagucaccacagucuauuucaggaaucaauacagaccaaaauguaagggcuauuucucacaggaaaaucuuuuccaguuggcucuggauugucaccagagaguaaagagcugguauuuuaaacuucuuuuuauuacauuuuaaauauuauccguuacaugcugcuaauaauucaucagcuaaaagacaaauaugaacuuucugguucauuaaaucuuacuaauuaagcuggauuuuaauggaagaagguuaaaaaugaagugccuugugggagaaaaggacauaucuaaccaccaaaagauagaaauccccauuaugacuccaacaucagccuaccaacaauaccagcagcccuauaauaacaauggcaacuguaucgagaaccagggaggcgcguggacugacucgagcccucgagagucuuaggaagggaugcuuugcaggaugacacacgugugcuuuaucugcugcggaguugauagccaggcaaauuggaauugccaggaugugaugauggcuuccgagagacaccugagaacacagccuugaguguagagcuuaagcugagccacacgggucacgcaccacgcgccaugggccacgcaccacacaccaaugcaauauccagggaagguagaagagcgcaccccugcugcuucuuuaaaugugcuauguucuuaccuggaauuucguggcccccaaacuccugcugcuggcuguacucugagccuuccccacuccccaaucccgcauuccccuccucccuugagagccugggucuccuucaaggaaucuucgagcagcugguuccucugcccuaggcucaccuucccauaaaucagaagccucuaguggacaucgggagugaggguaaacagcacaucuuucuaauacagucagcccacggagugauaaagccauuuccauccagccuguacuacaccguaggaaauaaagucuuuucaggagaauaaaagugauggauaacccccccacacacacacacacacccacacacacacaaacacacacccacacccgcacacaucagacuguauagugagaaucaaaaucccaccauccagacagagaaugcaugaauuuagaauucacaaagagucggacgagggucgcuucuaagcccgugaccuucagcccuucaaauguuuaugauucgguaauuaccggauggcaagguaacugauagcuacucugccuccucugcuauagaaccauuucaauaaagaccagggugagcuggcuuuaagcaauugagugacgcagggacccaggucauggcuguucacugaguaaccucaaauuuacauagaguggcacacacguuauauaccauaacguucauauuuauguucuuugcuuuuuacaaaaggcuuuaucaugauuuaucuccaucgucaucaucaucaucacugucaccaccacuacuauguucuaagauacuacucaaggaagaauguugcuugcuuuuuguugggaccgugauggacuuucacccuaccauaccccucggugcugaagcuggacucuauauaucccaaggcucacacagucuccgaaguugcaguccgccccgucuguuuuaaccuaagcuugugagagcaucucuucugcucaauuaguguugcugcagaauaccauuuccuccuguggcugauaaaauauuaaucaaaaacaggaacugagcaauuucucgggguggaugucuucuaaugguaauacagggcggcaaagagagaucuagaggucguuuaacagugacugaggaggcaggggagagugacaugggacuagggagauggcaagagcagcccaagggucaggagaguuguugccacccaacacgggagagaaccggaggcccgcauaccgugguuccugccaggccagaggaacggucuaaauaaaggauggguuuuguugcugccaaagaaugacaaagacaccaggauguuggcuguuuguguuuuuaaucugaacuucauucuucugccccuuguggguuucaugacugcgcuuccugccuuaguaaauaaaggccauacagcagagaugggugaaucucaacuguccugaguuugugaugucuguuuucuguuuccuucugucucuucccuccauggccaugcacaggggagugaaaagaacacagcuucagguaaacccaacaugggagcacaacuggguuccgucaaaucgcuucuucuccccgacccuggacuuccugaaucgccccuacaacugucguucuccccgucgagaaccaaaagcauguuaacaccuuggaagaccuaggugaacgcuuuccacacuccauuacccgacccugcccccacaagcauaugugcucucacagggccacagagacuuauucccaaauaggcugaugccaccaagaaugcuccuuuuuaaaucagugacugacuacuaucugauacuuugagaaauccagcugugggaaagagcuaagcaacccaaccugagaacccaguaucacuaaugcuuaccuuagaugauaagauacacgccuuuuuucguuagugccauuucagauguucaaguggaaaaaucuaugccaaagucccaaacucugauaacaccagaaucuggaacucuggcccucaguauuggcuacaacggacuuuccauuuguucucgugcaauacgggggcaaguguaaagcauuuugagaacgccuaugaagucagaaacuggcacagcauacucccuaaagagggcaaauguguguuuagaauuuaacuuagaaagaugagcggguuuacaucacugacggguguguaugucuggucucucccucaugaguaaaacuguccacccaacaaaggauggagccuaaauauauagguagucuucuauaauauagcuagauguuagcagcaccagauuggucuacaccuuugaucguuuucugccuucuccacaucccuccuccuuucugacucuuucuuaggacagcccaucaccgccuacucccucacagugaaacacuggguugaaaagcagagacgauccacgagaugaccacugaggcuucgcuaagguucccuggcaucaauaaucaaguugugcgagugagccacccaaggucuggaggcaaggcugucaauucuucacuguguacucacacgcagugugcuuccuugccggcugcuucuagaaccagccgucuccuugguccugccaacccgucuuccacgaggugccuauuuguccaagcaucacugcccuggcgcucucugugccuuuuaugugugaaucacggugaagcacaaacccaucaaucuucuaucccaugccaucaaggagccucucccuggacucaggaagcugaacuucagggacuuuggauaaaaaggaagucucucuaagaagacugggccuggugagggcaaaccccuucacucugcaugaguggcagaugcagagauucacgaugccgucuuggcauucugucccgcacagggaacaccacuaccauccacugcccucccacccaugucccauucucuggacaauccuacuugcccauguugcauuuguauuugucuuucuuggcaugauauuuuuuuguucugcccaagcaccagcaagauuaaggaguccccucucugcucuguacgugcggaaucagcgagcagagccuaggaauuaccaccugcuuccucauccucaaaaaaauggaauugaaagucuucgagacauuaaaaccaauuaauacugugaaaugcugcucaaauuacccucuuuaauguguguccucuuaauuaccaucugcuuuuacaucuaaaaacuucacucccaguguuccugucaugauuuuuggcucuucucacuacaguccauuagaaugauaaaaagccauuuuaaaaguuuaaagucuggcuuagcgaucccacaccugggaacacgccccaucggggaaucaaagcaucagucuagacugggcaagggugcugacuacaucacuauucauggccugcacagagggagaaaccucagacaccaagugaaagcccaacagacucuacuugggggauggauguggaaucaggauauaaucacggcaaggaauacuguucuccugcuuacgagaagagcaaaauucaaaucuuuaugcauagacagacccuacauuuuauaucaagcaggugcgugggggagggacucauaaaagcccuaucuuaaugcauucacacugccauaacaaaaugucaugcacaugcauacuccgccagggacuagaaguacaaggucaaagugcaguagauuuggugucuauuuggucuacucuaaggguguggaaggcaccuccucacuucaugugguaggagaggugaggaucuuucucguacuucuuuuaaaaaauuguagguuuucuuugagaauuucauauauauguuugaucacauuuaccggccacucccugcuucccacuguucugaaauuucccccaggucuccccgaaauauuacauccuugauccaugguccacugaguggaacggguauugccuguaagaaugaacaaaccaccuggacccguauccccaaggaaaaugaacucccuccaccccagcucaacugccaagaaccccucagcuaggggaggggaggggauuucaagugucccuucccuuccggggugaaauguugacugguuagauuggguaaaucuuguccaggcaaccauagguacuaugaaugccugauguaauggcuccgucauauccagaagacaucuuuuugucccagucugcucugacuuccgucucuuacaauagucacacucccuaauccaguguguuccaugagccuuauggggagggaaucuaugacgacucuacccuaugacucaaugacauccuaaagacacccccaugugaauugggauuucaacccaucauucugaauaauggaaauaaacauuccaaucauaguaaauucuaaguauauguauaccacacacacacacacacacacacucacacacacacuugugugugcacaagaguguuucauauacauauaccuauaugugauauaugcauucuacacagaauaggaacaaacacgaaguguggaggaagcagauugcuguguuuuaucccacauagagggguuugaaauggacaaggcaggaagagugaaaagacuggccacaacaggugaccgaagugguuaucagaauaccgcacugcuaacaggagaaacaaaccuccaagaccuggguaucccucacugugucucagaugcccagccccugagcaaugaagcaugagcgcuuuuaaaccucauucuugggcaacuaugacuccuguuccacagaagagacaguggcgcacggaucaaggucaggaccacuuguacuucagaugcuucagagagugucucugucucucccuaaccauccaaugacaaccucaaaccagaacaacagcucagccaaaaugagauuuacaacuuggccaggaguaaacagugugagagauccagcucaggauacgugagaacuuccugagauuuucuguauggcgcacuccaccuuugcuaggccuacagaaaagcaugccuauagcaccacaggauaguuguggaugcucugguacagaacugaaacgcuacuuuacgcucagugaagucacacgcaaggcaccugugacuuggagcuaagggagaucccagcccugguagggagcagacaccguugggcggaauggaggccuucagagggagagggcacacuugcugugaggcugggaacuuuuauauguggcuggcccauuucccaggacauuccucggcgccugguacauagcugacguuucuacgguuuucuuaaauaaauggaaucugggcaccuugugaauaugccuuguugauauuaaaacugugaguuucuacuuguguagaaaugaaacaacacggccaaaauuacucccgggggaacuguguaugcuuuacguaaagauaacuuuaauaacggcagauauaaaccagcaacaacugccacauacuaaaguccaauuaaaaggcaccaugccaggcccuuuaaggacguauuucacguuacucuugcaggauaccaagaagaugcuagagcccuugggcaagagccaaggaauggcuccaagaaaugggggccccaagaauuuaauauccuaguugaaggaugucuagcuaguggcaagcgcacuggauacaaaggcgggguggucccuuaucuguccacuccaucucuguguguaccuaaguguucacucacugaugaggagaagauuaaaaaguacagcauccugaucaauuucagaggagccuguaauccagcaacccagcguccuggggagggcuggggacuuggauaggcguauuaauaccaggggauauuucaguguuggccuucucuggaccacaacacgacaguuacaggaucgaaacccaaccguauccucaucucugcuagaucccauaaugauucagcagacauucauuaagacaccauuaugauaucaugucaaaauacauauacuggguagggcaagacgugugcacuuaaagcacagcucaaaacaauucuaguucuggcaauuuucaguggcucauccuauuccaccucuguggauacuuacacuaggagaccaagaacagugugugcacggggguggggggugaggggagggucgggggcaucgugugugcaugugugugauacuaguuuagcagggagaagguaggguauucaguuacaucugauacauauuuugucagaguaaaaguaauucaauagcagaugagguguuccacguuacgucagauucgggaguaucauucacgcuacuauaaaucugaucuaagaguuuaauacuagaagauaucugguucauauuugaaggacggccaccccgguuuccuaaauaagaaaugcauguaggauuugcguaugugugugaagcuuuaaaauauacacauagaaagccaauagauaauguaguguaaaucaaaucaaguucaccaccacuggggaggaggaaagauggcuucuuacaaaucagacccauguguccagaaagauggcaagagcaaaggcagcagaauacagagugaguccucaucuguggcuuguacucagcuacagauggcaucgugcgccuggucuucaaguucuaggauggagccauggccuccucuccuguccaggcguucaaugccuugacauggauuuuuuuuuaauagucuaaauuuuaaaauauugaaaugaaguagccucaagaaaguguuuauguuuaaauuauguuaaguaaguauucuuucagcuagacauuugccuauucauauaugugugugugacuccuguuucgcagaagagacaguacacacacacacacauacacauagauacgugcauauauacauaauugacuggggagggagcuugaagggauuauagaggugguuuauguccaaaagagagaaggauugugcuuaaggaacaagagaaucggcaggcuaagccuaaugacauuguuaacauuucaagucuauacaaggacuccacgcucacagcaugcucccgaauguccccaaaccuccaaacacgagaguugaaaauagcuacgcaauugcaaugcauugugaaguagccauagugagguguaucaugcaguuacaagaaggcaggugauggcugugucccuugaccuggagggaaucggggagacaagcagugagaaucaguuuauggcgcauggacagggcagagaauagguucagcacagaugaacauuaggggagggagaagagcaagaaugacaaggaggggccuccgguggccuuuaccuguaggcccuggccagccaggauggcuagcuuggagacugugggauggggcagguuuuguccuugaauauuggcauguaguccuuggcucugagaaguacauuugcuccuuuaauugugagaagauguuaauugaagagagaggggaagaaaaagaagaggaagaggaggaagaggaagaacaggaggaagaggcagagaaugaaguagaggaggaagaagaggagaaagagaaggaggaagaggagggggaggaaaggagaaagagaggaagagaggaagagaggaagagaggagagaaacaaaaaacaaaagagcuugcuggucaaaggccacacuccaucaggagucuuucaacuuugccaacuuggccaaacuggggcacucugacauugugucacaggaaugugcugacuuauuagggaagaacacuuucuccaaagccaccuucccagaagaaugagggccgcaagugcugagccugcagaggagccaggcggagccggcaggugcuaaggcaggugcggaagccacucagacagagaccgcgaugccagaaagcugacaggaauuuuccaguucucuaagcuccaagagcagaugaacaggggggucugcgggucugcugaggcucccgcagagaagcccaggcccugugcaggucacccacugcccccgggguccucuuaagggaggugaccacagagcaaguuacuagaggugaauaagcaagcaagaagagcuuucugcccaucuacgcguuguuuucaaacagaaugcagcuuagcuugccuggcaugcagggagcuccuacuagauucuucuguccuuaccaaaacuuguaucuuaaucccccucccaaugugccaucuuguuuuucaauaaaagugacauucacuacagaaaaugaucaauaacagaaaaaacaauguguuucccccauuuuugagcgugugcguguacaugugugugcguguguaaguauguacuugcaugcuauaucuggaggccuaaagaugucaggaaccccucuuccaccuucuucauuaaggcaaggucucucaaucaaacccagagcuaucccagauggucuugcuaccuagcuugcccuggggaucccugccuucugagggugaaauuccagaagggccaucaugguccauccaggaguuacacggauccuggggaacccaaacuccuguccucacuuuaaucacugagccaucucuagccccaaggggaaaaaaaugaauggcaaaaugccuguuauucccacaccacagauuauagcugacuuacuagcgucauaucccuggcucguccacagcaggggcacaucagagcugucuagucagugacugcgaagaggaaggaagcagauagaucacccagggugauauuaucuaugucuaucuccguucuauuccugcauuuuuauacagccuggcaacccccuauacucuguuccuuuuaaauugcugguuucgcuuaauaauauauaacaagacuuccacugauauucggggcacuggggccucucuauuugguccugggacaagcagugaugcagugcacuuaguuggucagacaguggcuacugguggcaaguggcagcucgggaggguggucacauuuucucuaacugugccagagaagccauggggaggucagcgucacuuugacuuuuuuuuuuuucuaucuuacuaaauggcuuauaccaccauaucuccuuguguguaauucuaugcauacuuguacaugcauaugaauucuuccagaugaauuaauagugcaaauacgccaaggagaaaaaugugacagaucuuuuagugaacucauaugcugguccuggacaaggguaugcacacacacacauacacacacacacacacacacacacacacacacacacacacguucucaagcacacauacuccguugcagcuguugcacguaauuaaugugcuaauuauacauaauuaucuaauuacuaaaagaaggagucaaagcaagugcgguagugaagauaucaaagucugcuccuucuagaauguucuacggcuugggcugucuugcugaacuggaaagucacgcugccugcgccccacucccugagggcucugugcagagagauacccagggaccacugcgaacugggugacacggcaucauccauuuucaggagagguuuguuuaugaacaucacacggaauagcguuguauuccuugcagugcugugggacccaggaccuguaacagguccgugggcaugaagagguuuccaaacuccuguucucaagaauguaggugguuauaucaguuugaacggcagcauucuccuggacccuaggugguuugucugaggcuggcucugauaagcacacaggaaauucuccuccuccuccuccuccuccuccuccuccucaucaucaucaucaucaucaucaucaucaucaccaucacaggugugcagugguaagugaacggcuacagaaaacuaucugggacauguugucaguccuugccuguaacugagguaggugacaaugaccuggugagcacugaaguucugaaaagcuuucucucuugaauccuuuuccccaccugcccaucuguaaaggucagggggagccacggcaacccaggccagacgacugcaaucccccaugggccauccagauaacugcuguccccuacagaccguucagaugacugccaucuccuauagacgguucacucaucuuaacaugaagcuuuucacugagcccaaaggaaacacuuuacaguaaggagacggagacacugggaagccucagacuugauggaacacaaggaccacagcgcucuacacaggcuauagauacacugucucaccccugccuucugggaguaaauuacucucucucuguuucucuuucugucucugucucucucucucucuccccucuuucucucucucuuucccucucucucucugcacauauaugugcauauaugauauacauauauauauacauauguguauauaucuguacauauguguauguauauauacauacauauauauauauauauauauuuacacagugagauguauacauagauguguguauacacacacauaucuaucuaucuaucuaucuaucuaucuaucuaucuaucuaucuaucuaucuauugaggugggagacucuauagagcaggcuggccuugaacucacuauacagcccaggcuagaugcaaauuuaaccuucuucugccccaguaucuugacugcugggaucaagggcaucccucaccaugcccuguccaaauaauuuaaucuuguggccagucccgaucccaggacagauucauucccuaucugaagagaauggcuggccaagccacauguucaccucuucgagguguaauuuguugauuugacaacucauaguccugccuuuccccaaaacaugauucaaagcacccccacacccuuuagugcuaccaacagggcacaauggaccaugacaagcagaaggaaagaaaacacaagccagcuggagccucggaaggcgcaugcuccuuacuuuuacuauuuaacuuuaccuuuuaauccugggccguaaaaacuguccuaauaaaagauccauaaauaucucuggaaugcgcagccaagaggcuuugauggcccaggagcauaugcuaagcuccccuucucucucuucugucgggauaaguacugggcugccggagggggcaggcuggguggaaggaaaaauccaaauugccuaggaugaacaauuauccauauguauauauuauaauuacauauaauauaaaauauuauauaaauauagauuauguaaacuauaucauacugcauuacuuaacacaugacuauauaugagaauacagccgcagccuaggagacucaguauauucugauucacaaaucucuuuuccuauaguuucacucuucagagagcaagggcuccauuuauauuuguuaagugaauaaaugaaugaacaaaugaaugaaugaaugaaugggcuugauuagaauauuguucuuuuuaaaaauaaaguguuagauuuauuuuauuuucuguguuuggcaguuuugccugcacauauguaugugcaccacaugcaugccuggggcccugucauaagaggguaucagauccccuggaacugaggucucagacggucaugaaccaccacgcagguucugagaaccacaccuagguccucuguaagagcgagaagugcucuuaaccacugagucaucucuccagccucaaacaguguuccuuuaaguucuauuucuaauuaugcauuggcucuuaaguaaauacaauuaccaaauaauuaagaauuagauaugggcuuucuugaacacauuuaauuuuccuuaagaaugccucccuuccucuuucucucucucccuuuuuuaguuaggagcacagaagauuuuauuuuccuaccagcuucuuccaaguuuaaauucuggaaauaagccugcguuuuuaauaaccuuaucauuagagcaucuuucuguaugaacuguucacgaggaguggccuuuauaaugugauauagaaaugcaaguuuauaggaguuugccauuuaaacuacuaaagacaugccuuuucaucuauuucuaugggcucuucuucccuuuugccaaugcacacuaugcugagagaauucugcagggccaccuuccuugucgugauaucgugacuaccacgacgcccagggcugugcagaugcaaguuauaucugugaacugcagagucuuagacagaacccgcucccugugaugcgguguuucugacagucacugaucuugucagcguacguacucuuccuuuuuguguggacaguggaguccugagagcccaucuuccccauuuccagggcaagauugugggagagcaggagcugugcaacccagcacuaagcauaaccugucauaaacggcacgcggugcuuaguauucagaacaagacaucucugucucauucucgaagacccuuuugacaaaagccaucucgcagcugccaggaguaucgaguccagcugaggacaaacuucaagaugaaccugaaaucaauuggccaucaaauuuucaugccucucccagacuaucuguggcauuuuaauuacaagcacccucggcggggggugcuacagauauugacacuuggcuccuacaauaaacuuuauuggcaaccucugucugcaugcaggacuugccuagaauaacaagaaauguaugagaagcaggaguggagugcaauugcucaaaaucaccccccuccccuccccugaaaggggacuaggcauuacuuggcacgagcgauaggacaaggaaugaucugaguuggauaaaugacuggguguggagagaugggucaguggcaaagcacgugccacaagggugaggggcugaguuuagcuuuaagaaacccauggagagccaaaugugagagcacauguuuauacucccaguggauggugcugaguugggagguagagacaggagacucccuagaaagcucaccagccaccagaaagcugguggacguuaaggagggccaauaucugagguugacuugugcucuccacaugugcacucuguggcacauacguccuugcacacaugaagagguaagcaugcacacacaggcacaugugcacagacaaugugcacuuaaucuucagauuacacgugcugccauguccuaggaguccuaggguaccugccuauggcacagcagagugucaucuugcuuucuucuguaugggaugaguauugcugaaauacaucauuccccagcccuucaaaggacagaauggaccaaaggccauaggcuugaguuaagggaauggaaucacucacugcugguggucgggcagucuguguguuggguugguagacaucuaucuacuucaggagcaagagaagccagccucugacauuuccucgcuuuggccccggcuguuagaugggcuguaaauaucaagaggaagucaaggagaccuugugauucgccagccacaaaggauccuugcucugugaaaaguaaggacuuuagaacugcaggcuugaagcugagcacuccucagcagggaguggggguggggaguugggacaaagguuacagcauuguugugucucccagugucacagacgcucaggcacaauccugcagcugccugauacggacccaauauucugauaaauauaacaacuggcuuucugaaaacaagagagagcguaugaacagguacacggggcugucacacacucucuagugcaaaggacaacugguguggccuuuaucaguaagagacaugcaaaacuguuuguuacaaaugccacacagccaacugaggcucaagggaagcuuuuauugauuugugacaaacacuuguauccagagcugagcuauggcccagccuggggagcaagugacaaccccucugaguguggcuugaugauucagagugaaucacuuagugugaacacugagacauguacucuggcauuccacacauucuuccauugugcgagugaauucuucgcuggauuggauaagucaguuuuuaauucgguguucugugcguucaugauguaauagguacagguauguuaguuagccuacaaccuauucugcaaugggaacauuguaaccacuuucuccauuaagaccacauagauaaagcaaucuugcuucccuguguagguuuugcccauuccuguggggcaaauaugccugccauggcugcucucaagacaucaaggcaauauccuuaaacacagggucugauuguguuuacaucuuuccacuauuuggaacgcaauggaccucggaagucucuuuaccaaccuuucaacuuuaggacaugauuuugccaucuacagaguucucgguagagaaccacgaccuugagucacgaaacaaaauuuucaaaaaaacgguaucuucaaacacucgaagugggcguuugaguuuguuuugggaagcauuuacaucuauccuuggcccagcuugaccccgcggccacaagcuggacuuggcuacaaaagcacugguaauggucagaugugguuucaagaaaagaaaaaugcaggaagcacagagcucugauauuaauugaauaacucaguuacugcauagccccagggccauguagggagagaguucccuucagagugaacauagugggcauuauacaaaaguacacaaguagacacacacacacacacaccaggagauucugccaacaaaccccuguguugucaucuuacagacagggacccuuugaaacacaggcuggugaucaaugccugaaauacaacagcagaagauuaucagaaaguuguaucuggaagaguugguaggcccacaaagaaagugggaagaauagaccccacuauagagaguagucaacugcaguccccguugacagggcuaucaauagacggccuccccacuagcuuuugucuacuccuuagaggguuuugcuuuguuuuguuuuaauaagaaacaaucacggagcuggagagauggcugaaugguuagagcacucucugcuccugcagagguucgguucccaacaccgcauuggagaauuuacagugagccguaucucaagcuucagagaaucugcccccucgacugguaccucaugugcacauacccacacauaggcacauauaugugcacauacuuaaaaguuaaauaaguauuuuuaaaugagaaaaaaaucgcaaucuucuugugaauuauuugcuaucauuacaaaggcaaaaacaauauugauucaucaagcugagacugcucucucucucucuaggcagcccacagaggaggaggaagaagaagaggaggaggaggaggaggagcagcagcaggagcagcagcagcagcagcagcagccgccuccuccgccaucaccuccgugcaucaugucucaauuccaugacaccacaugcgguuucugcaugcuuuccacaugcaguaucaggagacaucauuugugcaggcuugacuagggagggacaggaccacggcaggaugcuggugcagccccagauaggauguccacugaaacacagaugccaugugccuguuuccucaaggauaagggacccgaugugacccgcugggggcuuguuugcagggaucugcaaaaccucacaucagagacacacagauuuaaugagcugagcacacuagccaucuuccaaagcacucccaggagagggugcagcugggacacaucuacaagacgggaaccagaguacccuggcacuuguccgagacggggccuguugguugccuuugccaguuguaucugugccccccccccccccacgauggucaguugcucuaaauaaauauccgugguuccugggcauaacucagacuuugcauuuaaaauuagaucuauaguggcuuggccaaaauuugugugugagugugugugugcacucgagagugugcgugugugcgugcaugcgcgcgauggguauguagcugccugcagaggccagaggagcaugucagaguucuuggagcuagaguuacaggugguuaugugcugccuacuacgggagcuggaaagcaaacgugggucauuuaaaagaagagcaaugagcacucuugaugcugagccaccucucccgucuuugcuuuuucuucaguacgguuuuauauuugugugcauuuguaguguguauauguaugcgugugcacgugauguucacaccaauuccccacagagucaacauuagaugucuuccucuacuacucucuauacaugccuuccccuaccccuuugauucaguaugcgccauuucagcucaguuggcugccagggacccuaggaucugucucuaucucuaccuagguuuccucagcuggagccaagugcucagccuucuuaaguggguucuggagaucugaccucagguucucaugcuuauucagcaaacaauuuaccugcugagccaccuccccaauccuuucaaaauuaauuuauauucagauauuauuaccguuacuuguuccuuuaaacagagcagcacacagagaaaucgcuaguguucucuucuaucagaacacgggcugguccagccuacacauuugcucaugguuggguggacagguagcaagcaaugcuaucugggcugaccucuucaucugagaucaccuugucuucguuagaagaaucuugcuucuccuguguguuccacagugguacagaacagacagggcccgagucuuacuguagaacaggccucugguaaguuauaauuaaucagcuucaaccuucuaacaggagccagcuggugaacgugacauugcuggaacuggacagguguggcagugagacacacggucccuugccggucacaggguauuccaguagguggguaggacuggggagauucugagcgcccaccucugaggacuggacagaguaaaauaaaaaaagagugaaagauucccuuucauuuuuuucuucuucucuuucucagguuaauaugaaauuuuaggagcacaggagcgagacuuccggcucgacagagcggcuaagucaccgagccgacuuuucucugaagcaaaagcgauguacaauguugaugugugccaagaacucacuugggcauggggccaagagaaugcggccugucagucguccgugggggaacgagagagcagggaguccaagcacauuuggagagaugccuuacaguucugaggcagccuuuucacguccacagaagcccugccccccccccccccacccaaacucgaaaccucuuguuucuggcucugggaggcagcuguuggcgaagacauaccucuuuggcaaaccaacgucauccucaagcagacccuguggugugaggggucuggaaggggccaggccaaggugguaaaccuuccuaccagaucaucucuugucucuugcauucagccaaggcaaugugcucugcagagccaacccuugccugucucagaaucaugacuugcuugugacuaaguagaggcugaaucggcacccugaucccccacacccccccacaccccccagagcccuggaguccccuccacaccccccccccagcccuggaguccccuccacccgcucuuuacaaaaucaguucaucuggguaauuuuuaaagcgcagcacgugggccagcuggaauuguuugccucuuccuggccaaauguuuggggcgccuuccagccuucagucuacaugcugugugugugugcuagcaagaucuggaaggcacguccaggacugggaaggaggguguugcugaccgcaggacccgccaacuucccuaggcaggaaugagaaagaagccugcucuuuuuaggcaagccacugucaggcaacacugucaggcagugauucucugggcuuggauauuaaugcucacauucacuggcuucugagcuaaaccccccaucccagauccuuaaaaagagaagaugauuuuccagggaaaggaguguguguguguguguguguguguguguguguguguguguguguguguguaugugugugugugugugugugugugagcuuauuuaugcugcucuuauccagaacagggcugauaggaaagucacuggacaagggucugccuggcaggaugcugccugccuuccuucuagaaagcaggcuacuuagauaaggugcaguaguggcagaagucgccuugaacacuuggcaaguguguucauuuagaaggaaauaauacaaagagaagggcagaauauucugucugccuccucccuccagccacggggaagguagauaauuagacuucauuuacaauccagagcuuucaaaaauaagaccuguguugguuauuuauuuauuuauuuuuaaagaucuuuuaacuuugaaguucuggagauuggggcgggaagcugccuugugugaaaugugccuggccuauuguacuugggggagucggaaaaaaaaaaaaaaaaaaaaaaaaaaaacggggacaauaauagcccuucacggaggagacgggauuguguucaacacaccauuuaucuccuuuuggacacaaaagcauaugugcaaauauguccauuuauacauucuucuucugggggccugugacucuuccaagucauuauucauauuaauuaauguguguuugguuuauaaacugcugggcuuaagaacucaaguugaaauguucuaggaaagucaauaccccagcacugccugugacaggguaggggugagggguggggguggagcuaaugggcuggauccagccuuccaauagggugacaggagcuuuacacaucugggacaaggcaaaaggcccugugaagggccuuauauuugcugucuggagaccggcauccauucuuccacccuccuggauccacagagagcuucucaggauaaacugggucauaguucauaaauucugaguguccaaggaaggggggaaaaugauaguauuacugaaacacaguccacacaauucuguuuucuggaauggcccagcucucugggccuguuaaaggcaguucaucagcaaagcacuuugcauuagagccaggaaagggagcuggguaaagaggcaugaaaaaaaaaauaccagaagauguuugugaauacuuuccaaaaauuccaggaagacauaugcguuucaagacauggaucucgcuaauaaacauuaggucauaaaauaauucaguguacauguguggguuuuagagaacacucucugaaagaauuuuucuggaaaaaaauaaaagcaaccuugcuguucacuguuuuaaaacucccuccccccccccccaaagagcuauuuccaaauacaaccuagagauacauuuuauuucaguuucccacagaugugucucuccacaccugcuauucugguuauuuauuaaccaugucuaguuuuguaguuucuagcuuuuacaucuuuaaagucauuaaaacucaacaagagaauuaaucacaaaagaaaucuaucaaauaccggugccaagcacuuuuuuccccucccugacugacaucuuuaaaauguauuuuaagguuauuuauuucaucacacccagggaauaaaaaaauaauaacuugcaagccuccaaguucagagaaagcauaaaaaugugauuuacuauuuauuauacaguuaggcacaugcacauuauacauugcauguuaaucuccagcgagcuaaguuuaacaaacuugacaacacuaccgcuugcuagugcggagaaagaguugacaucuguuugcguccagauaggauuccuucuguguauuuucugguaaacggauagaagaccggcuguuuaaaugggcagccgaaccacagugcccccugguggagaaacaguaaaugcgugcacuucucacaagauuuuagagacaccuaauuguuacagugugaaaaaaaguuucaaagaaagaaaaaaaaaagcagauaggaagaguucaguccaugcguguuuuaauagauggagaguaaagaguugcauuaaauucuucaaaaucaccuugaucagacaugguguuugacaacgaagaauuaaacaugcauguacccagaagaguugguauuuggagucgaauugagagucgcauuugcagucaaacagagagucgcagaguauauguauuuuaaaacuaaauuuaucccaguggaucaucgggcagauacacacagguggacuuacuuucugaaugcacuaugaaaacgcaagagagcagaucccagauuuuaccagggaccaaaggacuccaucuucccaucaugcccuuagcaagcgccuccgauaagcagcuuacagggaauuuccucgggucagacauaaauagacagucucagguucccuuaauccgggcgcacaucgcuugcaaguuaggccucauaaaucucaaacccagucgaagcgcacgaaacgaaauguucuuagaaggcgcagauacauuaaaugagagcuucggcaccauggacucauuaaucacgcaaacaauacugacggccucgcgcugaucuuaaaggagccccuccuuuucucuggaaacacccucccuucaccucuggccaccuugggaaggagagaagaagucgggaauggaugagcgccccucgcuccuucauugacggagaagcaacaucgguaaugguucaaggucgcucgcaccucaguuguggagugaaaagagccacaguuuccagcguugcuaaucacguuuugcuuccgauguaaaguauuucaagauaucugucagauggagaugauacugacaaggugaaaguucacgggggcggagguaaacaugcucaccaggugaugaacggacaaacaggacauggaugcaucccuaccaucgaauagcauucaaaaauaaaauaaaacaaaacaaaauaaaauaaaauaaaauaaaaugguauuaguagaagcuguuaacaagaaaaauuugaaaucaggauaccaagugaaugaaaacacacagaacaccauggacacuauaacuccauuuuuccgaggugcccacagcaggcaaguccuuacagacaggaaggaaauuaaccacugccuagggccguguguguguguguguguguguguguguguguguguguggugugauugaggugucuaaggaugcaggaugauuuuuagagcuaauuagauguucugagguuguagauguacuaaagcaacuggaucacacacaccuuacauggauggcuuacauggcaaaaguguucuguauccauucagcugguaagauaaaggaggccauggaaggcuaggggcggauggcucugcaaaguuccagggcaagucacauuucccugauuaaaggaggagaacaaaaaaaaaaugaacuaaccaaaucacaagaguaaacaaauaaacaccaagacgaagcggggugcagugcuggucucuggagaccuggguucagcagggcccuggauuuacuuuuccaaaggguucucacucagcuuuccuucuuucagaucggcagcuagugaugaaaauucugauuaaagcggguuucacccugacugcuuuccucuccugcuccccagcucccuggagauccggaugcaauuauccuggagcaucgcugcucuauaagaaguccccaggugacucugauguccagcugaaccugaggaccacuguuggggggggggggguugugagccagccuaacaccuagaauacggucagaaggcaaagcuggcugagaucagcagccggcuuccuaguucucagagaauaucuccuccucaucccuuuagguuacgcugaagguauggccgaguuuucacugguugucugugggccacuguggaaggcaggaugucgucagugaaauuuaccaaaaccugcaaugaaauuuaccaaaacccccauaguguuuccacugacagagauaucagaaccaagugccugccuucuuaccacacacagguaucauuccaaaaacaccuuugauuuuguuuucaacuguguguguguguguguguguguguguguguguguguguguauacacgcacacacauacacauccuuguauauguucaaggaagucauucuuguucagaccuagaguuuuaugugaauuaaauggggucuucaaccagugccauguaggaaucuccuuuuccuacuccacauuacugcugcugaguagcugaggauauuguguccccaccuucaccccagccaggccucgaguucccagggcuggguuucaauccaagcuaaccaugugccccacccaggagugguaccugcauugcuuuacugugccgagaaaaccaaaacccaaaacaacaacaacaacaacaaaaacaacaaaaaaccccacaaugucuuuuacuuucuuuccuuucccccuccuuccuuuuggaacaucuaugaggccagaaaauaucgaccccucacagggcccagcacaacgcuguuguaacacucucucugggucuguaccgaucaaugacaauuuuggaaaacauugccugaauaauucaucacagaagaaaaaaaaagugcuuuuggaugauaugauauugguggggcuuccagcacaaacauacauguguuccugggcagcccguccagcuggaagacagcuccaagucauugggauggcacccaagucauugggauggagcccccuguuuuguaaaacauuaugagccauguacccacucccaggcaugggaagacaugcccgggccucagccagguguuccagcagcaugugccuggcacaucuugccacuguuugggccaugagggaaguguuacugugguugacucuauguggccauaugcagccuugcaacacuaacaaaaaagacagacaaaaaaaaaaaaaacagauagaaaggaaagaauaauuaaaaaacaaaacaaaacaagggacaauggggggaagauagggggaaaugcuagcuacguucugcacagaggaaaacugaacgacuccgggaaaauucaauguaaucucagcaguggagauggagacuuagaaccugugucaaaugcuuuuguuucauucuggagccucacaccccacccccaacccccugcaaugagcagccugggccuugggagugcugcagugguggauauaaguauuaacaucccugggcuggcagaauucugcaucucgcagguaugcuugcugggaugcaggcucauacccuagccucauauuccaaagccaucagcacuaccaggaucugcucuugucuuuucuguuuauagucaagcugcucuguuuaucuuuuccugugcgcggcaaccaaauuucaauuggcuuuucucucagcucccuuuuauuuuuuuuuuccuuuuuguaauugauuuuuuuuaagccaaaugcgccaugcauuuacuuaugauguuaugcgugcacguauauaguuuuaugugugcaccucucaauccugguuagaccaacccacaagagccuaagcauaacaccaggagauagacagugaggaggggccacagcaggaggcccacauucucagcuucugagacacaaaggccuuccagggugugcucucuggccuguuggugcugagucccagguuugcuacaggggcugcagcagaaagacacaugaacuugcaggacuacugcaucaugaccucauagcagcugugguggcagguagaagaccugcacaagguccggccaaucagccucccugcagacauagggaaggggcucaggaggccaucccccuagcugagaugcuuagagaagguaacggcugcugaagaaagagaguuuucuugagcauacggccucugguagguugcccauacuccaguggaugggcccacauccacgcacacauggauggguaaaacugauuggacucaguggguggcgcacgccuuuaaucucagcacuugggaggcagagacaggcggauuucugaguucgaggccagccuggucuacagagugaguuccaggacagccaggacuauacagagaaacccugucuugaaaaaccaaaauaaaaacaaaaaccccaaaaaacaaaaacaaacaaacaaaaauaaaaaacaaccccaagaaguugggaggcauaugugagaggucuggggguaguugggggggaaggguaaauauaaucuaaauacacuguacucauguaugagacuggugaaugauaaugaaaaauggucuuaacuuuggaggagaacaagucuaggagguuaagacaaucagauacuuggagaucaccauguggugggaggagucucuaaaggagguuagugaaggacacaggagaccccacagccagugccauggacccaauguggaagacagcaaaggcaccauggucccugacauggaagugaguccccaggggaccaggaugaucacguguccagaggagcugucuaaggagaaagcagagagguggacaggagguguuuacaaagagaccaguggagagccaggcuccccgugggcuagccccaucuggagagacuaccaaguucucugccaccauuuuucguauggaaaaagaaaggccuggaugguuuggauacuuaugaaaacucaguuuuaaucaaagucaguuaaguuaauuauugacucaacugggaugaaauuugaauaagaucacuuuugccuuaagccaaacuauuaagaagccucagauaguuaauagacugaaagcccgcagaauuauuucuuuagccuuuauaauauuccagacucaaucauuauugcgccggucucucaguguccaggaaggcaaggucacccaggugguuccauuuauaguuaagcacaaagaaaggguuccccauaacacuaacgucacucucaugcuaaaucuuuacagaccaauguccccuugcuucuagucaccuuugugagagacucuugcugagaccugguucccuucacucucauaugagcucugaauggccugugacaaaccucgcuaauuugagaggcucgaagagguaagaaugaaccacagaacguguuaagccucucagagucuccuuucccaccccaucccaugguaacaguauuaaugcucucuuaaaaaugccagaaagaacgaggggagggagagggagauaggagaacugacugagaauagauuacaacaaacuuuguucuaagaugccaucacggggccgucgagaugcucagcagguaaaggugccugcugccaaguuggacagagcagaauucaaucuucggaguccacacgguggagaaaauggagucccacaacuuguccucugacugcuaagugcacacuuggguauauguguccuccuacaacguauauauacacuacaaauacauuuuaaaaauuaaaugccauuaugauacugauaguuuauaugcugauuuaaaauuuuaacuuuaauuaaacauuuucuuuucaaauuccccucagaauauuggucucuuaaauuaauuaucuggaagucugguaucucuuucuaagccacaaaccgggcucucacccagccacagucccaccaaggcaagucugagcucccacacuugccuugagccccaaggaacauguauuuauuaagcugcgggagaccaagggguagauaugccauuucuguccucaggccagucauagaaagcuagucacuguuaucaccucccccaaaacagauucugaggccucacgagcagggagccugugacuuaacucagagccuuuguuccuucacuguccugguggccggaagcuguguagcuauggcccugaaggaagagaccagucuagucuacuucaguccaaauagcuucccaucuacagcacgccaacucuucuguugggagcauacacaccucucugggcacuuaaaagacaaggugacuguccuugaauuugagaggguggacacaggaggggucaggacagaggggaguauaaacgaugugagcacaggaaguucucaacacaacagcagugagucagcccauugcuuuguuugcugaccugagagccucccccccaucccccaugaaaucucuggucaugagaaguaaauucaacgaucuuuauuuucaaucuuaugaaaauaaucuauguuaacuugagaggaaaaaggaaaaaaaaacaugcuugguuuaaaguaaaaccuaaucacuucaucacaaauuagugcaguggccaagcgucaucggaggagucucucuuuguagauggcagagaauauggagacccacggccgaucaagggucaacugcugagagcucguccauuauggcagaaagccgggggacauaaugugacagccacgggggacgaguggcuacaaaggaaccagugugccuugggcacagcugagcaguugcacguuaaggacucacagcaguugagacaauacaagcugaccugcacagguucacgcuggacaaaaauuccagcgcggagagaagguacucacaaagcccuagcaaaggagcuauguauggccuguugauagcuccugggaagaauguccauucucuuuaggagguguggccccugguggucagaucaccaucuggugaaggccaaauauccaagggucgaugugucguauaaauuguacuugguagguuuuaagaaaaaggaggguguaaagcuggguggguagggaaguagauggaucuaggagggaugggggagggguaaaugagauaaaaauugcauuguaugaaacucucaaugaacuaauaaaaauaagaaaaaagaaacuguuucuuugucuauggcuuucuaccuagacagacuccccggggcagagacucaaucagcacucuauuccccaucuuuuuagaucuccuuuaagggcgggggguuggccugcaaaauuaugcuucucaguuuuaaaaauguagaucgauggcucaucuccacuucccguccaaggggccugaccuccaggcucagccacagaacaagcgcauccguuccucugauggugggagaccggguggcagucgaguacccaaggaggaagccgguagccucucucaggaugagccugaagcccucugaauggccugucacuguacgauggacaucaaccuccugucugccuccuacucaauugacagcccuuccuccggcuauaggaucuugacuguaauuacaggaaaggccauaccauaaggaugggggggagggguaauugacagagagcuccacguaaagucuccaggaccgauggccccggccucacguugcugcugcuucuuaaacacaagaccaaugcauaauccauuaagccagggccacgcaaacccaggagauggggcuucugcacucugggcacuugugagacucacagaggcagccccuggcucaacgacccagcucgaccgagugccgccauacaaauuaccuuccagaggcacaauuuugcuguuguugcuguugguuuugcucacagcuuuguguugguguuacguuuauguaucaacccauccaaaaugcggaggggaagacagcauuugcaggcuuugaucugaacuuuagccuagcuucuggccacugcuauacaaguggagaauccauagguacuugggaagagguagccaccguuaacuuucucaagugaaggcaaagaucaggggcuggugagacagcuuagucagucaagggcucgccaggcaggcguaaggacaguaguaugauucccuggcauccaggcuaaaaagcugagugcagagacaacacacacuuauauaaugccaggacucagguguuauacggagaccagcaguauagcuaaaucagcaaaccacaugugcacugagacacuccaucucaaaggcuaagggggagcaccaaagaagacacaugaggaugcccucuggccuacacacacaugugcacauacauguguacuugaacaaagcugauguaaucccauaucaugcacuggaucagaacauggccccagaugguuaaaacaaacaaacaaacaaacaaacaaacaaacaaacaaacaaacauugccccugucuguuccuggucuugcuguguacuuucgaucucaggauucccaacucuaaaacugaguaaugugguauucggagagaccugacaugcuauauauucauaagagcugggcaagaaucagauaaacaucauaugcgugaauuaugguggguuucagucuuaucuguuuaaucacaaccuguaguaagaggaaugauuuuccuccaauuucucaaagauucuuuguaaaaugacuggcacucuggacaucuggaauggcucaaagcaagugccccugugagcuguaacacagauggggccacggaucagcuacaugggaugcacauucaucaacccgugugugcagaaaucaaaguccaaugaaaugaaaagguaagcuugcuaccgaagugagcacugcaaggcaaggcaaggcaaggcaaugcaaugcaaugcaaugcaaugcaaugcaaugcaacgcaagaagagaagagaagagaagagaagagaagagaagagaagagaagagaagagaagagaagagaagagaagagaagaggagagaaaaggagagaaaagaaaagaaaagaaaagaaaagaaaagaaaagaagagaaaagaaaagaaaagaaaagaaaagaaaagaaaagaaaagaaaagaaaaaaagccuucuauggaagcuucugaaccagaggccagagcaaugcuggcgccagucaucacauagagacccuuaccauagacugugcuucggagagugagugucuaacccguggaggcagcgcccagcagaaagcaccaguuauucccaucuauuacuggugggaaguuuuucuagaagaaaacuucucccugggagaaggcugaccuccaacagcagaagaccacggagaauaaaauaccaaaggccauuggcuaagaggccccguuuguucucugcacaaagaaccaggcggcuuucaucggagugucccuuuggacauggaggacauagauagguugcuugcugaacauggaggaaaacgugagaacccacaucuguaaccacagcaccagagagcagagacaagcagauucuggaucccaggggacagcuggccaggggaccuggcugaaaugacaagcugcaguucagugagaccccgccucaaaauauaagguggagaagugauugagagcguuaccagaugccaaccucaggccuccucaggaucgaacacaggugagugcacacacacacacacacacacacacacacacgcauacguacacacucacacauacacacacacacacacacacacacacacacacacgcauacgcacacacucacacaggaugucacuuugcuaggaugauaaggaggaaugucucccauacuaaauaagcacuauagguagugacuccuuggauuaguagucuggauggcugaauaguuagugauguccuucuugguaucccauguuccacuugggauauggaagcauuuacccugggaacccauuguucccaugcccaucccccaagcacuucacacaccgggcaaugggcuacugguaggucauaagaagauaccugacgauggggauuaaaaaaaaaaaaaaaaagacaaagccaauucauucgcauucugauuggguggugcauacucucucagaaccaguuacuuccuggauaacuuuguuaagacaauuugagucacucaggacauguaagcgguacaauaaauuucucugagcuaacacagggacaaaauuuaaguauacauccagucucccuugacagugaagagauggagaucuuguaaauaacuccugggggccgguccuagucuucguccuuaaggucaaagaugucucugaucggggccauggucuuacaugccaaggagccaacauucugacugcuacccgcgauccaucucauguguacggaauguugaauauucuaacucacuguggagugcauguugcaucuagaugaggagggcaaggcuaggaggccacaggaacggguuuaguugcuaaagaguuacugaggugguuucuccaguaggccacgccgcagaccaacuugcccacucacuggugaauauaaaagaugacucaauuggaaggcacacacauaaacacacccucaugauuaaggccucauccaacuucuacuggucucugguuccagccuuaagccuucaucccaucagcuagucacaaguugacugguucaaagaugcuuuuuaauguucagauuuucugguggugugagccgauauuuccuaaucagauaagauucugugacuuacugaauccuuauucuccauugaaaagaagauaccaagaaauaguaggccucguauuuccacaacagugugaaaggacagauaacuaaaugcaacaacuguucaaugaacgcccacggggucaugggcuaggacugcaaauggccacaccaugcuguccaauaggccucuauuuuacuggcuagaugggauacagaugagacuaggaugcugggagaaggaggaaggaggucacuaacaggcuaagugagggaaggucucgucaagauuuuguggguaagccgacacugagaacuauauuuugguauauccaagauguuuacacuuuaggcaaguguaacgacauaccaggaggcagacagacaggagccucagggauagaugaccauggugagcccaguucauuguucuuaaagcgguaagucagucaugaaggcagacacggagguggggguggggagaaagguagaguggacgacagucagggcuauuccauaagcaugggugcuguggugacuuugguauggauguauuucauguuugguuuuaugaagcucugcucaugagggcaucccuucagacaguuaugugggaugcucucugcucucugcucaugagggcaucccuucagacagcuaugcgggaugcucucugaguugauucuuacgcuggacgguuaguaacuuagcuuggagaagggaagguagaaucuccuggcuuagacuaagaugaguucugucggaucauauguuuggaaacucgguccccauucagucaaacuuuucgggaaggaugaggagguguggccccacuagggaaagugugucccuggggccaggcuuuggguuuucaaaagacucaugccauucccaguguugcucucugccuccugcuuguggaucaauaugugagugcucaccuggucccugccacagugccuuugcucugucacauggggucuaacccugugaaaccagaaggccaugguguuuuuccacaacagaaaacugucuaauaugggaaggggauuggggacucugcagagucaccauacacagagagccaaguuaaagucuggcuuguugcaggucagagaacuuggagcacagaggcuagguauccaacuaggugcuuugcaauucuaaagaggacaaucaagcaaaagugagggccaagugugcccccccucaaaaaaaaaaaggucaaaagguguccugucuccuuucuacucgguucagcaaacugaaggugugacauuagcccaguguugaaauagcaggguucaugaccuccuugugaaagguguaaauaauuuuggaggcuguguagcaauggccagaagagaauuccaucaccagagagcuucacuguuagaagaagccugaccaauggcugcagacgaaggcagccacauaaaugaccagaugcauggccagcacuugaggucaauuaagauaaauuaugaugccuuaaagcuuguguggcccccaguuacucaaaaucacaagccaaacugagcuccacaguugaguucuacccaauuaugucugauggccaugggaaccaauacuaucaccuagcaauuuaccuuccauagccuugauuaagaaggaaaauucaacuacaaauacaagccagcccaacccaauccaaaagaaaggaagagccaacaaaaaaccaacaacaacaccguaaccaaaaaaaaaaaaaaaauccaaaaccauucucccccgaaucugaacaaaucauuuaguguaaaaaaauaaacagaaguagaaauugucucuaauaaacuaauauuagucucccuggaggguuaauuaugucgcucaguauuuuaagaagauuguaaauugccaguuucaacagauguucuuuuaaaagaauugguuaucugggaaauggcgggucuuuguuagugcuuaccccaguggaauauaaacacuaaaauugucccacuaucugucaggccuggcacccccuccccaauuguuacccacaccaagauacacccugugguuaucaucagcaagaggcaaguauuccagcuggcacugugaggccagcaagcuguagggguuuccaaggccagcuuagaccauuccaauaucacguugcguccccuuccuucugcgauaacccucagcuccagaccuuagcuuauggucaucucuauucugcuuuacugggaagaggaagacuaggugaucagaacuuucuagaaauacaagccuugccugaauucaguuuaagugcuugaacauggaaaauacacaugacuugcaugcauacacacauaugugaauccuucacaggaacugaugaaaauguaagucuuacugguaaagugcuuaaaagaaaaaauaaaaaauaaaaaaggaagaggguugggcacagucaguaaagcccuugccuugcagauggcacaccugagugugguugguccucaggacccacauaaaauaaaagcuggguauggugcuauggaccugcaauccuagcacugaggugucagagacaggcagaucccuguggauugauggccagccaaucucaccuauuucaugagcuccggggcaaugauccucuuucaaaaacugaaugacacccaagggccuacauauacacauacaugcauguacauauauaugauagcacaugcauccgugcacacacacaugcacaugacaugcaugcauccacacacacaugcacaugacaugcaugcauccacacacacaugcacaugacauuacaugcaugcaucugcacacccaugcauaggaaagacaaucgcuugucacccucuuguuuucucccaguugucacuggcacugaagugcaggucagcgggcgaacaaagcacaguuucuacuugaauauucgaccaagagaagagagagaagacuccagacauggcaguucauuauucuaaacaggaggaccucggcugaccuggguuguagaggaaacauauguucuuguguuccagcuggugguaggugucuggcugccaaccucacuugaccuaacucuucauuaucaucccaguuagacucacuucacagauagggaaacugaggcugaaggagauuaaugacccccgccgccgaaagccuaacagaaucagcuuucacuauugaucuccugguaacgagcacaaaaucccauugcagauggagagggaggcguguaacugcugaugcugacucuuucugaaggggccuguuugcccugggauuccagacgaucugcggagaccaggccacucaagguccucccaggcagggaggcacaagcccagggcccuugacugauggaaugucuuaacuggaaauaaaacccaaagugaaguauacuccacuuucaacugggaagcagccacguagcagaacuauggacgacguucuaauggcuuacuucauauuugaucuuuuaugauagcgcguguguaugugugugcaugcauauuuuuggugguggaggucagaggacaauccugggugucuuuccucuggcaccuuucacuuauuguuucagguggggucuccuauuggucuggaaugucaauacguugacugggcuaguuggcuagcaagcgcccaucuauuucugucuaucucaccaucacugaaacugcaagcaugggucacugccucuggcuuuuaugugcaaucugaggauggaacucagguccucaauagcugagucccucccuaguuauuauuuagguucaugucgcacuauuccucuauggauccaccaggaugcucaauugacacgaauggaaaccaagacucuuagaaccaaugucauauacccagagucacauaggaccuguguggccuacaggaguaucccaggaucacugucaguccaguacaucauauacaguauuuccagugaugucugguaagcacggagucccaacagugcccuccaccgcaguuccagaggauccaggaucaacugccugagggcaagaagagaacucagugaaaacuuaaggucagcccuucaugguuuggaaagugggcuugagggugauauaugggugagggguggcauugcucuaagaacacaaauaugaucacaccaccuaaaaaugagcugugcaaaauugguaucauggaucagcaaggacuugaacagucauggaauaacauggcaucucacuucuggacucucugagugccaacaccagaguggcuaaagagcuuucucccaguaaaggccuaucucccauggucccuccauccacauccaaauguaccaggaauacuccuaccuuuccaagaucacacugcccaguuccuagggagauacacccacuuacuacuuuguguagaaacuggcauguggccacagcaugcaacagccuagagcacugguucucaaccuaugggucuccaccccacaggggcugccuaucagauauuuauauugcaauucauaauggcagcaaaaauuccaguugugaggucgcaaugaaaauaauuuuauggcugggugugucaccacaacaugaggaccaguauuuaaaggucacagcauuaggaagauugagaaccacugaccuaaaaagaauaaaauucucaccuccaccuacuugggggauggauccagaugacccugaggcacaggcaacagugacuguuuagaaacguccuuuuuccucugguccaggcccagauuaagaaguugaccuaagaccgggcaguaguggcgcaugccuuuaaucccaacaccugggaggcagaggcagguggauuucugaguucgaggccagccuggucuacagagugaguucuaggacaguuucaguguucuggggucuggagauccugugagccaguugcagggagggauaacugcaaguggagaggcaaucccauagccccuugcccacaugcuugaagcacuaaguccuuaccuucuagaacugcuuccuggccaagacaaugcugacucugcccacucccaagggauuuauggagagacgcauuuaauuauugccacugggggcgggggggggggaguugcuauucaugucuaaguggugcaggguagggguguuagcaaacuccuuccaacguacaagucagacagccacccagcaauaggacgcaguuuccagugucaguaaggaaggaccaaggcugagcauccccagucaguccugaauggaugaggccugccuuugaacuuccuagaucaugguucucauguccaaaugcuaugcacaaacagggcuuuaaugaguagauuccuucaaauaugugggcuggaccuuaauggaucccauuaguucaggcuaacaggagaaaugcagcacggggcagacaauucccagaggcugaacucuguugaugaaccugcuucaucagggagggaaaccagcagacccuggcauuagacauucaggaaacccagcaccugucuauaucaacacguucacaaugaagaaagaaaagaaaggggaaaaaaaaacccaaaaagggauaaauuauuuaucagcauaaauauuaaaagaaaauugcaaaacacagucuggugucacccagcuguuguuacggaaucaucuuguuauggcuucuggcaaaaugcuguuguucuuaauaucagggcgacagaauugucgggaaugugccgcacaggguaaaugcgucugccugcaguugagggcacucagcagcuuugccaacuggcucgucauacccacguggaaaaccgugcaaagacaccccauuaggaaauaggaagagauggagaacugcaccagagccuaagauacaaucuacguucacacuugggugugcugcagguagagccaaaccgcccaggaaagcccgccgcuccauuuucaaaacuuucaugaacuaguuaguagauaucuagacuguuaaauacuaauuaugugggucagcgagauggcuugguggguaaaggugcuugcaguuaaacuggaagacauugaguuugauccccuggacccagcucauagaaagagugaacugauuccuucaaguuguucucuaaucuccaccugugcccugaggcacaugcacgcacaugagcgagcauauaugugugugcacgcaugcacacacacacacacacaaauguaaaaaaaaaauauauauacauauauacauauauauauauauauguaauacguuuugcaaaugaaugauuaaggaacaaaggauacaaagaugagaguuugucaaaacuuaacaccuguggguaauucuaguaugcuugauugcaauauauacucuaggucuugcugacaugcauuguaucuguauagcagaacuccuacugugcacguacuggugugagacugcaccaguuuuugcaacuuuacauucaaugaccuuauguuggcagccugaaaucagccagggccaugggcauuuauaccccaguaagaaacacacuccccacaccugugcuggcacacugucacuaccaacacccaccaagaaaucagguguguggcaacagcauccacaagagaccuugcuucccaaugaaaugcucaugauuccaaguuuagaaaacuccugucagcagccacacgggcuccgagggaaccacgaaguuuuaauaaaucugugcgauaauaauuaaacacuguaaauaauucaucuacugaaggucccugacugguccuucaugccuuuguagaaaagugaaccaugcugacauucugaguaaggcuggcagaagacgagcacgcaggacugguggggaagcggguuugcucaauaauguaugaagucccauacugggaaggggggacccucaggaaagaggcucuguggcaaucugucuuucaucuggagccgaccuuggggccgaggugcugcccugaauccgaggcacaauggcuggcuugugagcagauauccuucaugcggagagcagcacucuugagacacgagacuaaacagacccacgcugcgagacaggguccccucgcugcuacugagagaucacaguauacauuaaucuagcagguugcugaauaacauuuugaagggggaauuacaaaguugagcaaucccaucgggaggccaagugacucucccaccaaagggauccaguuguuauagaagcucuguguguguguguauguguguguguguguguguguguguguguguguuagggcgugggggcuaucuugaagagucuguacccaagaacaaaccagaaacacagcaaaucaaggaguugggugugccuuaguugaaugagcuaaaauuucacaucuauuacccaaacuauugcuuuuaacuagcuugcaguugggcuagaagggcauguggcuugaagaaacuauguuuguggagucaggggucauagacaaacuguauuuuugcaaacuaauuuugcaaaggaguuuaaauugcuuuaaaauuaguuuauaggacagcgcaaagcaccugcccucaagcuucacagccugaguucauuuuccggaauccaggguggaaggagaaaaaccuacuuaugaacguugugcucggaccuccacacgggugucauggugugugcaugaccacauaauacauacauacacacacaauaauaacauacuugaaaauaguauauuaauuaagagagacauagaacacauugccuccagccccauguauagaggcgagaggccgccugcugaugagggagccagguggaaagccugcacacugguucgggguauucaaugacagcaagacccugaacaacugcucuguguuugugggcaccacuguauggcugaguagagcguaccuuacucuguuuacaagcugcguggagccaggagaaaagagucaugcacggagagccgccaugauggagcugcuggagaaagggagugugaaagacagucuuccuucacuucacgcucaagaacgcggcuuucagaauagaauggccauugugagcacagucacuugcuccugaggaucucgggucuauucccugcagcucguuuucggcaggagacugaugggaaggugagaagcugcccccgggagcucagccugcauccgcucucggucuccaugcaaacaccauuguuucccagccugauuauuauuaaauuguaauguggacccagccucugcuuaagcacccgcgaugauuagacuacaagucaauuguggguaacacgcagauauaaaugcggcuaauaaguuuuacuguaaugauuaaucaauuuaugaauacauuauuuaagcuaauagcucagguaggguaucuuaaacaaguuacagagcgcaucgaccaauucaaacuccagcugccggaucaauaacaaacuguaaguaaacucuggggggguaagcacacuagcaaaaaaacaaaaaaaaaaaaaaaaaaaacaaaaaaaaaaacaaaaaaaaaacgcaaacaaaagagucuuagaggaagaaugaagaaaacauacaauacuuucaauuugaagacagaugcacaauacuuuaacauaugccaaagauuaaagggaaaagauuacaaaauuauaucacugcaaauuuuguugcugugacaaauuaaaagcaguucauaccagaaacacacacaggugcagaccggugagcacacaggcaccaugcauugacagugauguugauucuuuaaaguaaugaagccuugggcucaugucacugucuguuuaucuauagcugucccuuuaaugggaaaggaaaaaaaaaguaugcucaaaaaguaggaccagcaaauuuuacugaacgggagccaucuuccagcacagucaagggacaccugcucuucuccagccagacaucuccccuggugccaaccaaccacagcgaguuuuguaacaaagcaaaccuuuauaucauaaugcugucccauaacuuuuuuuuaaauuagggcuaauuaaugugaguuuaauaaauaaaccaaaaagggccuuaauuuccaaaggugggcuauuucaucagagcuucaagcgauggugcauuuuaaaaaauuaauuaguaucuugugcgaucggccacacguuauugaauaaguaacagcggcuaagugaaacagaugaaauauugguaagcgaugcagccacaguauaaguaugugcagugggucagagguuaaucccuauugauuuuccaagucugcguacagcaccgcugggaaagaccgguucaguuggcaaucagcuagcacaaauacauuauaaaucuuacuguccgccuccacugaccacugucacuuacuucaguugcuaaagaccauuaaaaaaaaaaaacuacccaaaaggggagaggaggaauucuacccacuuuaaacaaaaaaguaaaccuugagggaguccccgauacuggacaaaacuuuuggggugagcauugcucaacacagaggccccucuucccguggagcuggcuucucucccggaaggcagaaacuacuaugucaugcucuucaggauaaauccauuucaaagagucaacacagacuauuguucccuuaagcuucgacagcaaacucaaaggaauuccaaaaugccuuucccauuugaaggucuggagagaaagggaagaagccggaucuuuucauugggauuguuuaaagcaccuacagguugguuuugcacuauagagcucaaccuuugagcuacuaaacaugaagcugaaugcgaagcccuucccacgcagggagacgcacuucuaggugcuauuuuuauaaagugguccccaacacgcguaagcuucauucccugcagacuuaagacacccgcccccaucucuggaaauaacuugaccacauguauaguuaugacuucccuucuuuacugagaccguaucauggaucuucuguguaccuggcacucuugauagauucaggauauggaugaacaagauggguccuccccaccccauccacaaagagagagagagagagagagagagagagagagagagagagagagagagagagagagagagagagagagagagauacaacacagucccgggaaguguguuggugcuggcaggcagucugucauuuaccaauggugugacauccagcuggccaucagaccucccugaaacuuaauuuccuugcuuacaaguguacagcaauacuauuauuugcaacuuaaaaaaacuuaaaagcacuugauacagggauaaauauucagggaguguugguuauuaaaaaguuauuugaugccgagcaagaacaugagugaaguuuuucgaccucuucuuuguaggugggauugugacauugugggguacgaaguggcagaauauccauugucccaugccacacgggcagaggucuccugucccccaggucaccacuucugagaaacagcauggugaaggacaugcuugcaaauuacucuguggagcuuuuuaaaagugcccucaaaaagcauaaggaagcaaacuguuaucagaaaugcagauguuggcuggcucagcgugaaccaggccaggagacauggagaacucuuuggguaaagauuggguccuuucugcauggagacugcaggauuuuacuuuaagacucaagcccuaaaaggaugcauggggaaagguucacggguagguguuauaucuacauacaaaugcagcuuuguuggcauuuccauggcauguguguacgugcacacacacacacacacacacacacacacacacacacacacugcaaucuacgcauacccucugcucuaagcagaagauaugacauucuugaaauggcuagaguauuuuagggggaaacucuuaucuucaucuuuuucagaacucuaucagcuagcuucaguguacucuuguguuaauguuggaaugcauuugagggggaaaauaaagcuuucaagaccuuuaaauugaggguugggggcuggggacaacuguccugaguuaaugacaaaucacacccagcaaaaucucccccaaagcaauucucuccgccauuuuaugccaugacccuauuccuuacagaagcuugccuuugaugguguccaggucuccugggggaaguguuucaaguuuuucgggguagauagggcagaaucacaaacagaccuggaaagacuaccaagucuaucuacaauccccgaggcuccaggcugaucucaauugcuagcuuucaucaguuggaaaaaucuuaagggcacauagggcuccggaaaccuacuuacuuauuuacaaauuaagagcauggaucauucuguuggcuucugucucuaggcauggccuagagucacaaugaugcucaucuuuuaaaaacgggauacauuuuauuuauuuauuuauuuauuuauuuauuuauuuacuagcuuagacuuagugaagauuguguguguguguauguauguauguguguguugugcaugugugacacauauacaacacacacacacacacacacacacagagagagagagagagagagagagagagagagagagagacuuucuucuaagauccaaucaaauugcaaugucuuuaccuugaaccaacugaaaggcucaugugaagaacuggcuguguaagucuacccuuuucuuacagcuugccuggguuucuguacuggguaccuccugaugugcuggucuggucucugugaagaagucuuuccaagccccucuuuaguuugugaggagguuucauuugaaacaaaacuaucuauaucucaacccauuucacacucauacacauccccuggcaccaacagaauuacagacauuucuaaaaaaacaacccacuaaaguccauggagaguggggaaggagugguggcucugccauggacccuucgccuggggucuauccacgugacaagcugauuuugcaguaccuuacacagcuuacacacacagcuccugaccaucagaggccucacacgucaacauauuuguccuguauccaugaagaauacagucuuuuaauugggaaucaacaugcagucacugagagucgauggccugaacugucugaguuggaguccaaacucugcuaacuccuugcuggguguauuugcuucuucgccuauaaaauacgcaccguaacaguacagccucauaggauacucaaaaaagaugugcaugaaacacaggcgaagcaaaugaaagcgucugugccaccugcugaaugugcccauauuuccaauacugaauggaagagguugauggauaaaugugauguauacccuaggagacauagaagcuuuguuugaaaugguccauagugcccagccacauggcuaugggacacgugacacaggacuaagcaacugaauuucuaauuuuaauuagugugcguauaaacagccacauguuacaaugaccaccauacuggaagacaaagcucuucuuuuucuuuuuuuuauugguuauuuuacuuauuuacauuucaaauauuaugaagacaaaguucuugaggguauacuguucuaauacuggauggcugaccauccauuagccuauuggaaggauguguggcagcuccuauaaggguaggcucugccuucagccucaugguccucuugccucacagugggaagauucauuauuguugccuuuggcuucucugugccagaagcggguaggaaacaagauggcacuaaugggucagcauuacaagaagcuucuaauauaaggcgagcucuacuugggcuuucuuucucgauuugggucuagaaucccagaugaaucuggccucuaaccauggccuugcaucccaggccagauauugccuuuguauuuggugcccggagauggugccucaucuccaguaugcauauggacaauccuauaugcauagaauucuaugguggauaugcugacuggcccagacuuuccugugacaggggccacaugauucucaggagacaacaaaaccaaaggcugucucuggcagggaucuggugugucuuaucucaguuguguuguaaagcaguaccugucucaacaguuuuaugccacaaagagacgucccucuaaaaucuucaucuccauagcacuugguauuaugauaccccaugcaauauuaaguuauaaaguagaaaguccauagaaacuauaguuaagagguuaacaauuagacugcaagauuaaaaugaaagacuucacaaaaugcaucuucucucgggcugagauaggccuuuauuucuucugucuauuagaauuacugacaaaagacugucuucuccacacauaaugagaucccugaagacauugacugaccuaaauucauaucuauauggauuugcugacugaagugguaccugauucacaguagguauuugauguguauuggaugauuggaugauggauggauggauggauggauggauggagaggucaauggguugggagaagagauagaagggugucagaaugcugagagugggauggguagauaguagauuggugcaccaaugaauacauggaugauggauggauggauggauggauggauggauggaugggaaaaggaaggguguuggagucaugguagauggaaggauagguggacagagguuugagugagaaaccauaauggcagguggguauaucgauagauggguagauggauagguggguagauggauagaugaguggauagauagauggguagguggguagaugaacugaugggcagauggacagauggguagauggacagauggguagauggacagauggauagauggacagauggauagauggacagauggauagauggacagaugaauagauggguagguauguagaugggcagauggauauauggguagauagguggguagauggacagaugggucaauggauagauggguagauggauagaugaauagguggguaaauggauaggaggguagauggauagguggguagauggacagaugaguagauggauagauggguggauggauagauggguauauggacagauggacagacggauagaugggauggauggagcuguguagugcuagagaaaucuucaguccaaauaaagagaaaagagaacuuucaauacuuucccugcuuccuaagaguuuuucugguuuuuuggauauggcuagacuaguaagcccuacuuauauuuuaggaaggcuggauagcuaagccugugacuccauggucgugggcaucugccccauugaugaugacaaccuaggguuucuguggaauguggaaaugaaaggagaaagaaacucaugaugggaccaucauggcaaacuuucaaacauuggagauaaauuaaugaaauuacauuaugaaaucagcuaacccagggagggcuuguccaugagaaggggaaagaaagagaagaggaaaaaaaaaaaaaaaaaaaaaggaagaagaaaagaaaaaaaagagagacuaaccaaaaaaaaaaaaaaauccuuauuaccaaagccagcugucucuuuugaacugcuagauugcugagcacaugcccuaugcauauucauaggcgcugcaggaaauuaaacaccuuuggaacuggcacuaaaacucccccaccagccaacgcagugaaccaauaacucaacagcccccuuguggccuggaagaauuaaugcaucuuccauaggugggaaggcucuuuuugggguggggaucagaccuagagggugggcauggagcccuggaagaggagggaguagcugcccaagcauuuuuuacacauguuagaugagccccccccccaccaucuucuuguguggagugagggccguaugucacuguuauccuucuuccuuugcagagucugagaaagaacccccuacguggcacaugcucccuaucaaccuaaccugcuuaaaguagaagcagaucaaauaagcccaguauuuccauuuaaaaacaucauuuaggagaauuuuacgcugucggagaagauggauacacuguguuuguuuucuacauuaaugagcuauaaaaagaauggaauaggccauaaauacaguauuuuguaauagccuuuacuaaaaacgcuacuacuuguguuuaucauuuauauccuuguauacaaccucaaaauugauuacacuuuaaaccguacauaacuugcuguguuuuucauuucaugcuacaccacaaacauuuuuauaacucgguuaauauauuccauauuuuguguucuuauugauuaugaauauuucuuuaggggauuuuauugcuuuuaaaauaacaaauguuagguauuaaaaaauagaaaaacccauugcaggcuuccuauucuucucuccccugguaauucuaacacauacauuuuaguacaagcauagcuggguaucuuuuccuuaucuuuuaugcucccucaugcugacauuaaaaaucccucugagaaccacagaagaaucagacuuucccaaggaaaccuuccauugaguggguuugaacugcauuuauaauccuuuccuuccacaauuaaaaaauuaaaguaccgaaagaucaaagagauuagaguccguaacaugaugggcuuacaucaaguauauauuaucuuuccuaauugccauuucacuuuauaggcuaaaauaugauuuauaucugugauaagauuuuacuauuaauuaucaaauugaaaaaaaaauaaaaucucacauuacaaauucucugcuggaaauuaguuuuauuauuuuuucccauaaucccaucagaggcgcuguaagugcagugcggcaugaacccuuuaauuuuuccaguuaguuuuaagcaagcccagaggugagguuuaauaaggaucaauggcacuuuaucugggacagggccucuucacagcaugcaaauuacacaguaacacuuaaaaaaagaaauagauuuaauuaaaaaaaaaaggagaaccacaggcucuggaaauucaauuaaaggauuuaugcaaagguuugcgagguuuuuauaugcaguuacugcuuacauaaugagcuuuucauauuaaaaaucaauagguaaucuagacuagaagaucauccccuuaaauacauuuuugaaaucaauuugaaaaauaguccaucaacugcugggacugcucuagcugcuucgauuacacuaaaagcaauauuuagauuguaagacgugcuauggaauaucuaugcuuggauauggcuuucaagggcucuuagacuucugagugccucagaugaucaccuaguaacucaagauuguguuaaaugcauaaaugauuuauuuaauuaggagcagaaacccacagauacaacucugcugcauuccaaaugguuaaauggaagggggucggugggggaggggggagagaaagaagaaggaagcaagugaagaaggaaacagagggaggggaggggcaggagaggagaggaaacaggagucaaaguagggaaauggggcugagaaggaagaaagggaaaagggaaggagggagggugaaugaaagggggcggagggacagaagagaaaaaaaggggagggagaugaagaaaaagggauggagggacaauggaaggaaagaggagggagaaguagaggcaugguacuggagcggggagggagagagcaaagacuuuucuaaauuagucuuugcuaucucaauugccuauugugugcuggcuacuuagcccuuggagauaugcauuucgcuuuaaaacucauuuaggucuucaacugaggaagcaauuagcuagcuuauaauuuaagcagacuuuccauccuccgugauaaugggagacaggucuugaaauaaaagacaaaaaccgauucucagguuacaugggcaaauccacaccaccugucuuauuuuuaccuggauuugguaauaccagggacauucacuguguuuaccggaguguauucuuggcaaaccaggacacaggcaucugaacagaggacagucccggggaagggcaggaagaauguacaccacccaacuucccucauuaccucacaaaauaccuauuuguucaacacuucucaugacuccaguuaucuuugguuaauguuagucuccuucaaacaggccaaaaucuaucuuagaaccaagcgacagcuuaauccuucuuuccuguauguauguguguguguguguguguguguguauguauguacacauacauacauacauacaugaaggaaggauguauguaugguaugcauguauguauguauguauccaccuuccaccagcuccugucucagccacagcagcaucugagaaagguuaccgguaucuccucccugguuaauauggaaggcaagacaacacagggacauaugucccuggcucucaguucucaggaaagauggagggaaacaaaucaguagcagcuucaaacauggaggaacggacagagccuacaaugcaguuucuggaaauaccucauuagcgaguuggcuuuuccccuacauguacugacagauguauugagggagguucucaggcccaauuaacuggcauuagcuuuacccagcauuuacauacacaaugugagcuucucuagauaccauggcgucuauagcaauaaacucaaaagagccaggaugcuuguauaagccuauagguaucucugcauggauguauuuuaagaauuuugcacauauaaggaaaagauaauaagcgagaggcugggcauuauaaugcaauacugacugacagcuucacgguccuaaaagaagccagagacacagacggagcgacggggaauggaugacuaauuacauucgaggcacagaacaggaagagugguggcuuuggcagccagggaggaaacaggcugcauccugccaggugaccacgaucaggguaauaaggauauucuacaauugauuguggugguuacugcccggcucugugaauacacuaaaagccauugacagguaugcacauuugucugauugaaugguaugugacucauaucucaauaaaacugcuaugaaaagugagguaagguuuaugaacuguagguggauucugggauaguuuuaaggaauaugacaaaauaacucaaacguggauaaagaggggauggaccacugugaggacaggaaaaaaaggcaaucuuucuuuuccauuuaaaucuuuuuuuuuuaaagguacucuucucuccuucucuacaaaauaccuucucuugggaucauggucaaggaugcuuuaggguaaaaugugcaaacagacgguggcggcccuucugaagaaaggugcuccaguggaaaucugcaggggcuuuagacggcacgagaccagggcuuucccauccugggguagugugaucaaaaugucaaguaggaaauuguuuuguaaccgugcgagagggguugguaauggaaguuugaacaacauuaacacuuaaaauuucagcagaaccauuucaauccauaaauguaugaaagucauuuuacggugugcuuaacagucgggaccaagggcuguuauaaaagaagaugcucacggagucacuucccucucuguuaucuuauuaucacauuuaaaucucucgguaaaagugggcucgauagggaacuuuauuacacauuccaagauuauucauucugcagagaauuucccagaggaguuaacagauaaaaagggagcacccuccccugucaccccuaaauuaauccugcgacuauagagucugggaugguggcccuccugucucgggaaucuuaaaggucacucuucccagccugcugaaggccacuccuugcaugcaguacccuugacuaacaccuuggccaaugcucgcuuugcaaaggccugggaauaaagaggagggcaaaggggaaaagucaagggugggaacuuggugaagagcauuuaaaauaaaauaaaauaaaauaaaaaauagaaauaauauuaaaaaugggucacaauuugcugacuugcuaaacacaugcacagcacacucaaaauaaauaaauaaauaaauaaauaaauguaaaacaauucauuuugauugagauuggugguacacaccuuuaauuccagcauucagaaggcagaaucagacggauaucuguggguucaaggccagccuauauaguaaauuccaggucagcuauagagagauccugccagaggcgggggugggggugggggcagacgacauagagagagacagagacacagagagaauagggagagaaagggagaaggaaagaaggaagaaaagagaagaaagggggaaaagcgggaaucuguuuuguuuuguuuuguuuuuuuauggccaagagaaccugaucaauagugugguaaacacccccaccuucccacaguuugcugaaggagaaggggccccaaagcaaacacaaucucugcucacagugaguaaguacucuuugccugaaaagggucuuaaguaaacauuuccagcuuugggggccaaaccacaucaguuacaacuauuuacuucugcugcuacaaugcugcuguagcccagggacagacaaggcuguguuccaauauaacuuuacuccauuuuccugugguucuggagaucaaacccugggccgagcacgugcuaggcaagcaaucacccucccacagagcuacaguccuguaccacagucaaacuugauuagagauauuccaaugugaaucucauauauuuaucauauauuaaaaguuacugguuuccuuuuaaaauauuuugagccauuuuaaaauauaaaaugagcucuugauuuucaagcugcacagagagaggcaaugggucagaguuggcccaggagcuagguagaccaguaaucccucugcaugcuugguuuauggugauggugccuucucugagaacaaaauggccccauuuucuccaaauauauaaacuuagugauauacauucuaaguuguaugcucucaacugaacaguaaguucagcauguuucucugggcagaaaguggcucuaaacuuucugaauguuuucuuuggaaacaguuaucaaggucuuuucucuuauuuacaaauaagcagaaguuuccagaauuggugacccuggcacaugcaauacuagagacacauggcauuggcuucugagauacaaagcaggucacguucccucuggcccuggucauaaucccgucgucaaugcauugaggaaugugaaugcaacaugcagucaaaucugugugcuugcaccucugaggggcuggggcuagaaacagaaauacacacagacgugaguauuuacaggguuggcuuccccucucuccaucaauccucuggccuuuguaagcaaagcugcuaggaauagccguggccacgauuagcccaugaucucugucuaacuggaauggcuuuacugacguaacuacaauaucugaauuguacacauuucugcauuaagcaaguaacaggcaggugcgauggcuugauggguaaagcccuugccgugaaagucugaggaccugauuuugauccccagaagucaagauaaaaagccaguugugguggagcacaucuguaaccucagcaucccuauugggaaaugggagacagagacaggaaaaccaccuagaaucuugcaggcugguauaggguauacagcaggaccagugacaugcugccaugagguagaagaauagaacuaaguuuggaagguuguucucugaacuccaugagcgaaccacaugugcauuugggaagauggguaugcaugugcauacacacacacacacacacauauauguacacauauauguguguguguguguauauauauauauauauguauauauguauguauguauauauacacauauauacaugcauauauauaacuuuuaaaaccuaaagugucuuuauaauauuugauauauguauguguagagucaaaagaugacacagauuaucugcaaugauuuuaauaaauggaaaaaaauguuuacaaauugauuccuuuaaaagagcuacaacuuucuuuccuguaggacaucugcaccuugaggguauuuacaacguuccuucuuggauguuacuauugugauccucgguguccaugaaugcugcuucugcugaggauguggcugggauggagaguuguaagaccucagccagcuucguucagaccaagcgauggucaaggacuccuucucuuuuuaucauccgaccaauguggcccaaauagagauuucuaggcaauuacuauaauaucagugugucuugguacaaagucgaagaggaacaugagacaagaguagcaggaacggugaaagguucacgcagcacuuuagguuucaugcaugaucaacaguucugagaucaacaugacccaaaaccacccaagggggaaauguguuggagagcaagacacaaagagggaggaagcacuuuguaaguuguaacuggcaauguuguggaagcacuguacuggaucauucccucgcugaagcaaaacuucauuacucuuugaggaugccuagcuagacaagcgaggugaggggugaccgucacauucccacagugcucucagacucugggcaccuacacugcaaguagcacugaccucauaauuugugguucaugaauugucaggagggggaaagcagauaaagaaacauggcugacuguuaugcagaugcuaagaauggccaguagcucuccagugugaaggcuguucugucauuucuuugaauucugucacucuuggguuaggucaugaaaucaagaaaauagcagcagauggaaacugaaucuguauuccugguuggaagaaauugagaacaaaaccacuagccacaccuuucuaauucuccuggaaagcagaaaaccuaaugcagaaguucuuauagauccucguacacuuguuuggcccagaucuuuccauauggccaucccauguugccaggagcucuaugaaguaucuuguuucccagccaagccaggagaaacuaggcaagaacauuuaauaugaugggcgguaagagaggagcuaacaaggcugaagucauggaaggcauggauacuuguucguuaucuauggcuguuuuagaguuaaauguacaaacaacuugagugaaaauaaaaaaagagaaucaagaguccaaagugauuuccaacaaacacuaguccuucugccagagcuaagaccugcaguguccacuucuucuugggugcauagcuaaaaccauauuuucuggccuccuauaauggaaagaaauucaccucuccuacauuuauuaguucccccaaaugguccccucccuccauaacuguauguguucuugcuuccagcacuaaacucauacccucauacagacaagcaggacagcgguggaagcaaugaguggagggaugcagagcaacaagauggcaggagccuggguccauaggaugccauugugaaggcagcuucuuagaaauccaaaagaguaacucugacccucccggaaacaauaaauagacucuguaugugaaccuguaugcaugugugggcuuguuugacgcugccuuuauuaagacaucaaccuaaaauguggacauugcagaguucccgagaauauuauccccauaucaauguuaaucuggaccgcacauguugguuugcuuuaacugcgucaagcaaacacccagaggagcaucucuagguguggcccagcaucggcucaccugaucugugguucauccaccugcaagaacagucuucuuggggaaaacauggccaagccuggaugcccacaguauaaggcaaguccacacauucuuccuuacugggaggaaggcaugucuuggcagccuguuccauuuuuaagauucaguuuuccagaucucuuuacuaaaccucuugcaucaaaaggcccgcugcacacccaggauagcuucuaggggaaguuagcuucauguugaaugggugauuuacggugcugccaucacacugcauuagggagccugccaucuuaauugaaaaccucgucucuuuuuuuugcuccuuuucucuuugccuuuagccccuuuccaagagcuggugucagcuaacacauuuuauaacuuaagaguuugguuuuucuuuuuuuauuagguacccagacccgcauuuccuuguuugcccccuucuuaaugugcaaaaagcuguggaagggacgugucuuuacaguagcaguccuuaaauauuuuacaaguagaaauuuuagugggugguuaggaggcuaaaugacucuucuagggagagggcguauacaucccugaggguuuacguaacacagugacagugacuccaugccacuuacaacccaggcugcucgcaucugccucugaaaucuaggacugaguggcauuugagcauucacaacagaguaaggccagcaagacugcacaguugugaaagcaaagccaacccccaacccuccaucaacaaucagcacagaggagccaguuagaaucaguagagagaaagacgcagaaccagggagcuucacuauugaaaguccuugagggguggcaggugaugagaguggccuuagugaccucaagagaaaaacccagaacagaucuguuacacggagaaaucagaacauguauugcugcugugcccauucucguuggaggaaaccucggugcuuacaguaaacagagccaccaucacuuuguagaugaggagacugaugcucaaaccagcucagcaacgcauccuaggcagaugagcaauauaauaagcagcaaaccacacuuguacucacaugugccuuauuccaaauuuuguuccuguuuuuuucuucuacuuaccagaguguucuuucuuucuuagaagcugggauggguugaagucucaaucccucccuucucuucucucuccuauuaucaucucucguccucuccaucuccuacccccgcucccauggagcuaggugucucacuuugccacacaagauauucuccaaugaguuugugugacauaguccucuuaaguccugagcagcugggacuguugagcacagcagugaauucagcuucaagaugucuuugaagaggacugaaugagugccaugagcuggcccugugagggacugccuuauacuggccguggagaacaaaaggagggguuuagaaacuugguuugcaguuggcuggccagugccuucucugcagaguuaccucuuuggucauguaaggggacggguaggaggaggaugcaguguggucagcuaguaggcaccuugguagaagcauuaccuuugggggucucguguuugugucccuauggaguuuaaagaagaggaagggcagaguggaacuguguuccuacaucaaaggaguagaaugcagucuagaaaacagaagcuacaaaaagagguagaaggacuggcaagauggcucagaggguaagggccccugaauuugguccuuccucaugguggaaagagagaacugaacuccacgucauccuccagaccgauuagauaaauaaauaauagagguaauaauaaaacauaagccuuggacaaaugaauaucuguuguccauggaguuccgaggcaccuagaggacagaaacauuucccuaggcagugagcgcagauucugagaaaggagauugugaauugguaccauagaaaagaggugagaaauuuugucuuuaaacagaaaggaggucccucaaauuuagaacucaauggucuaaacagguauuagagaaacaaaaacucugaaaacaccaccacccuggcaugguggcucacaccacuugagaagcagaggcagguggaucucugugaauuugaggucagccuggccugcagagcacuuuucaggacaacuagggccacacacagaaauccugaauugaaaagccaaaagagagagacaguggggagaggagaaaguaaaagaggaggaggagggaggggagaaggagaggggagaggggagaggggagaggggagaggggagaggggagaggggagaggggagaggggagaggggagaggggagaggggagaggagagaggagagaggagagaggagagaggaaagagggaagaagaguggaaaagagaggaaaagagggaaaaggggaaaaagagggaaaaagagggaaggggagaagggagaggagaagagaggagaggagaggagaggagaggagaggagaggagaggagaggagaggagaggagaggagaggagaggagaggagaggagaggagaggagaggagaggagaggagaggagaggagaggagaggaacaacgugccaaagaagccggagugacucaagccacagaguuuacauucaugugcuaucccaaaugaaugcccugucuagcauauucuaguccugccauaguuacagugaaguauguucuucuaaauuccuggaccgcaggcaggaagcaccagcgcuccuuuacgcuuuuauaaguacuaauuucaucccuuucuuccuuacaauuccgaacagaggggaacagacauuaauuaagcagggcuuuaucucccucuacccuaaugaaagccaaguuccgcuuauauuuuuccuaagauuuuucuuccacuuaaugaagacauuauccucgaguuuucaaagucauuuuacaaaagagcauucaagagacauuaaagucaguuuaaaugaagaagucuuuuugaaguuaauaaacaauaaaagaacaaugaaaagagacccuuugauccuguguuaguccaaaggcuuuaauuucuguuuuaaucuaguagaugaguaagaauuguguucagauaucccacaccucuggaauacacuaagcuuaaacugcaagcgcuuuauaagucucuuaugauauccuugcaugugugcacagaugcaauguauauguguauauauauauauguauauauauauauauauauauggaugacuauauaucaauauauauucauguauaugugugccccauaagugugcauaaucuauaucuuauuaacauagauacaaaacauucaaaaaucuuuugucaggaaaggaaaaagacguuucaaaaauuauuucuagucuacuucuuugaaaauuaaaaaaaaagagagagagagagaagaaaauggaaucguuggcuuugaaauucacaguaagaucaaaguccauaaugcacauagauuuuuuucaagguauacauuauuaauaccacaggcaaacacauaacuaaucaauagaguggucaagagauaagacaggcgagugucucugcggcugcgcgaagcaccgugugggaugggugccguguuugucucugcucgccaggcaucauccgaaguccaaccauuucucagccgugcugucacaguuggacuguucauugcagauggaaaaggggaaauaaacagcugaacacggccucuucaucagaacauuucucuuuaggcuccccacccuguugcaggggcaaaauucuuaaaacuuaaaauuaaccauuuugaagcaucugauuuuguggcguguuaguacacucaaggaugcauguagucaacauugcuaucugacucuaaaugucccugucacccucugaggagaccucagacccauuagcagccuucccguauccccuuuccccauggccucuggacaccacucugaucugaauucuggucucucuggauuugacugcucuggacagucugccuaagugggaucacauauggggugaccuccugggucuggggugauguccucuucuaaaacaacaaagcccaacaaaaaacaacucucauucuauaaauuaccuaacagaaaaaaaaaaaaacaaaucuauguaacagaauaugcuuucuuuaaaacaaaaacaaaacuguuuguauugcuuauacugaggaugcccucucaugagggacauuacuuaugagguuaaauauaggaaguuuagaaauucaccugccauggagugugcaaauggggucugagagcaaauagguuguauagguggaaaauacagccauaguccaggaaucaucagauuaagagauccuggguacacagacgucauuuuuaaaagggauauuagauuuaggggucauaaaaccaauaguucuguauauguuuguguguauguguguaauauguguacacguuaggaaggggugugcauacucacaggcuuccagagauaagagaagcauguugaguguccugcucugucgcuccugccuuagucuucugagacagggucucucacugaacuuggaccugaguuggcagccagcaagccccagagauccuccugccucugucucgucucauagcugcuguaguuacaggcauguauacggcuccugccuggcuuuuuauauaagaguuggacaucugaagucaugugcucuugcuugcaaagggagcauucuucuccaccagacaaucuucauacccccugccccaaacugaugguuccuuaauaagugcacucucagaaccacugcgggacacugcucugcucggucuguaggucuauaugauuuccaaccauguuggaagaaacguaagacgugcuaagacauggaacacuugcugcuuuuccucucucagucauuucucuuuuuuucuuuuucuuuuuuuuucuuuuuuuuuuuuuuuuuuuuuguuuguuuuuuuucgagacaggguuucucuguguagcccuggcuguccuggaacucacucuguagaccaggcggcuggccucgaacucagaaaucugccugccucugccucccaagugcugggauuaaaggcgugcgccaccacgcccagcuucuugggcauuucuugaggaaucaacaugaccaucuagcugaaaggaggguugcaaugucugucucucagaaugcauggggaaccccugggaagugaggccuccaagcaaggggcauacuucccuaccgauggauuaaaaagaaaacacaguuggguuccaguccaaacccugguucuucucuaacagagcggccagacuucagcuauaccaaccagucagucaaugcgggggccuugaaggacuagaaggagacuagauaagaugugggcacaugggaagcacugggcacauuacagacauuugucacuacugcuccaagucugccagucuuugugguaaggugcuuuguguuuaaaaaugggaaagagauucccuugcugggcaacugguagguaaggugcauccaggccuguuauaucauuuccugucccaggcauccagauauggcuuauccuacuuaaaccgauguaagugacaagcuacgccuuuccuuuuacaaagguuuacaggcgugcuugucuaaucuagugacaagagaggcgacaaggagccaauacaaaugaccagccauggauuuaucaauaaugagagcuucucagccugucuagacgacccuggaaccucauaugaaguaaaaacaaacuaacaaacaacacccacuucacgccacaucucacggggacgucuccugccugugucaacaugaacaugcaccccuugcuuugcaaugguggcccuugucaacugccuugcauuucacgaagcaucuuaagaauagcuucaacugucuuuaccaaggauggacaccaucuauauauacacugugaggacacccccagcacguauccugggcaacauuaacgcauagguucccaucccucuggccugugcagucuguguuuucuaucuggcaaagcaagagcaaaugcauuacugcagcagggagcagcauugucgaggugcaaguaccuuggcaggaaagccagccuccaaaucagugugcaaccaugacacagugcccggaaagagacagggucaaagucccuccaaggugguaggcaaaggauacugugguagcauccuggguggggacaggcauagguagccaagaaaaacccugggguuggggacaagacccaaggaagcagucacagcuggccgggaugccaucaguaugguccuuccagugcccucugccucauuucucagagcuaaucaaggggaacagaacuaguccuggguggcggggcgaguuuacaacaacugacaguaacuauaacacacgccaguuuguauuaagauguuaucacaccuuucccaguucuaaucaccaauuaugacucuauuacuccuucuuggcaguucaucugcuccugccuccgcuaagggcgacuuagagacggaccucugaucucccaguuccacuucagugagcgcucagcacggcggcugucaucugcagacacugaagaggggaggcauugcuuuggcucagauaacuguaccugaccuuacaacaauuuacuaagggaaauaccugccuaauaguggcugugagcaccguuuccuuuaugcuugccacugcgccgcaaauuagcgacaacaggauaaaucuauggccggcucacuagacacuucauuaaaucacuguucuccugccuuguagcacgcuaauagaaucacagcccucguuagcuacugaauaaaagaucaaucacggacuuugaaagcucuugcuaccagcuuccagaggaaacaaggaagggugagagggggagaggagagagcaagagaagagagagagagagagagagagagagagagagagagagagagagagagagagauuuaggaucaucucugagauccugaauggcccucacugcaagcugcuucaauuaccuuuuccacaacugacuccaagcccaauacucagaggaacuuguuaagcccgcuuccaagagcagagcucuaauauaugacugcgagaaccuggucaaaaguucauaaugugcauauguaaaaagguacuaaauugccugagggcuaaaaccagaggaguuuaauuguagcaaaaugcugcaaauggccugcagaggguccuucuguggggaugcugcuggcuccgggcugauugaaguauggaacauaaaagccuuacaacaauauuuccuuacaugccggggaggcugccagcaguugguacugcaugaauguuacggugcaagaaaaacauuuuccaccccuaaaauaaauagaguauuaaaaacugccccgacccauaauuccaaagcuugauggaaggaaggaaaaaaaaaaaaaaaggagggucccugcgauaauaaauaagguauaauucacagggcauguuccauccacuccuaggguguauuuacauggggcacaugcaaugaauucaggaaaggguuuuugguauggggauggcuaagauuucugaaaacaguacuggguugaaauaacagcagcuccuggcugccuugcccaucucuagguuauacagaucugugugggaagcccugugaugggaccugcuugguuugucuuuauuucuucuugcauuaaaugagcccuggaguggucgccuagccuacuacuggcuucucugaauuuguuucuuguuuguauguagugcucucuaacuuucuuucucaucuugcucuuucagacauuauuaaccaccuuuucauuuggguaaauggaaggacagaggcuguugacagggaaugcugggagaaccccaggcaggcacagagcacuagaggagauagaaugaauucugcacacaaacuaagaguuugaauucuaaugucgaaguacuccagaguuacgaaaguuagcauuuuagcauucuuacagagugaaggguguuguuuuaauugggcuucaggaaauaaaucaaacaugggauucuuuagcaucaggauagcaccaagcuuccagcagugacuugauaggcuaaucgccaccaacacagguggacagccacuaaucagaaauaaacauggagaacagaguggacagcagcugugacgugaagucagucgggaagugagauggccaacacucaugccucccuugcugucugaaggcccugcuucucaaaccuugcccuccaaggaaaacacuuccaaauuuucucuugagaaccacccaguauuugcccucauaacaccacaauugaaagcuucuauuuacagggucuccagaauggcucaagguccaccccaccuugcuacaguaucggagugguccagaauauucuauugugccacacguuuaauacgugguuauaucuaacgcucauuuaaauuuguaaaagaaaagacgaagcaggcgacaagucacgccugccauaggccacaccugcuuucucccgguaaaaugguggguaagcaggaaagucaggcuugugcugauuucuguugaguucuauguccagggaagagauggaguggucagaaacggccugaugauugcaucccagaaggcaagacggggcucauuccugccacacagcuccuuccuuauuccuggccacagaggaucccaaaugccagaggcacaagucccucucucuucagccggaaugucacacugcugcgaguccagcuacauggugcacacagagccugcagucagagauggacuggugggagcccaggccuacacggggaggcuaugccaaggcagacauugagggacggcauccgggcccagauacuucaaucugauuaucugcuccaucaucuagcauccaucucugggaugaaggcaggucauugggagccuugauucccugacuuguaaacuggguauaauaauucauaaucuuauguugauggaagguaaacagaauggcuuauuuagaaacaauucuugguccguggucugccaacucaacaaaggcuucuucucuauauuuuauuaccuauaugccaaugagaaaugaugcuaagaacacucacugagaacaguccagacuaagcaauuccaaagcauccaugcagauuucaaugcgauuuuaagggaaaacacuuagacacuaugaaacagcauauuccaggaaugcccaaguuacccaacacuggaggccaaucugggcauggagacggaugggauggauauaaugugaucacgcacauuaauauucauggucacaggcuggcggugacccagaccagcauaagcaugaagaugccuuguaauucuuugcuuucacccuuagccaacuccuucgaaacaacaggagaucccaagcugcaacaccagaauucacagggcauuauuuucuucccuagguuaugggcugugguauguauuuacaauucugcugugcugcaaauacuccaucuccuccccaccugcuguaugaaaaaauuuuuuaaagaacucauuaaaauaauaauaaugacugugccaagugacaccagagaacaaagucacacagguaaggcauuuguggggggcagugauagacuggguuuuuaauucuuccugaaaaugcugcucuuuaauaucacgaauaaaaggcugagcugaaaugaugaugaugaugaugauaauaauaauaauaaauugcccuggauuuaagaccaucagcaaaaaugccccaauguccagugacugagcugcauggcagauuugccuuaagggacacuaagagaaacagccuguggugggguuaccuucccaagaaacacgcagucuggcuuuaugaauacccucccgucugcaucacugagcgucuagcucuuggcacaucccacaaggaugaaguccuacacacucacuggcugaccuugagcagcugaagacggcgaucacacuugauuaaagacgaggaggucucgguacugaguggcugcuuuucuauaggaaaauuauucuugaauuacagaaaaagacauaaugagacauuuuucuaucuuacauuuuuccuuugcucucuccuacuuucuuaauuauauaugacaauaaaaauauguccacagggcaagcauauuuuauaugacuucuuaauauuuacuugggaaacucuaagcuccaccauucuccucaaaguguggcacaaacacgaacacuuuaguauugggcccugauaguguuggagauuucuguacuagauugauacaaaacaaauaaaagaagaaaauaauaugcaaauauaaaaaauuauaaauaaaacaauaaauguccuuugcugggagucuggagagucgguucaguaguuaggagcauuggcugcucuuccagaggaccuacguucucaucccagcaucccacaugguggcuugcagugguucauaaucuucaguuacgggggaugugaugaccucuuuugaccucugcggacaccaggcaugcacacagugcacauaugugcauugagagagaacacuacacuagauauguaaaauauuuuuuuaauccauccuggaacuaagagggugaaaguccuucuaaacacaaacagucagggcagcuaaggaaaugcucaaggauucggagcugaaguuugguuaaggcauugaccaaacagauaaaaauuaggauggggaagcaguuccuuguuuucuaacuguaauguuugugggucauuaggaugaauugaaaugcaaauagguagaugguguuauucuuaaaggucuaaaccagaaggcaaguuccuagaacauucauuggcaaaaguaacaguccucaucaauggcacacacacacacacacacacacacacacacacacacacacacagggguagggggacaggagggcagaagggagggagggagagggagagaggccaaauggauacaacuaaaccauagauaugccuuuaagacucuaugagacucgguucggaguuaaagaaaacacagaagcaggaacaggugacgugacagaaaccauccguagccacaguguauggcgaggaggaugaagguggauagacaggauaaaccaguaaaagguagaaguauggaccagugugugugugcacacgugugugugugugugugugugcacacgugugugcguguuucuauuccccagacccaauaagaauacacuaauguuuucaucaccuacuccucccugaauucaacuucuccaagcuaaucccacccucaaaauuacacacagaugaaaccugguuccaccuauggaaauccacugguaugggugugagcuuauacauauguauucuuaugcaugugcucaauugcaaauauaggcacacauauauuuuaaugucagauugccuucacagcgugaaugcuaaaauuuauuguuuuuaguucgaaugaacacugagcuuuaaauggggggaggggagaguaaauggaaggccguucuguuugaauaugaaauggacaccgauaugagggaagaaugagagccagaaugcagcucucgggucacagcugcugaggacaggucauacaccuuuaucuccugagacuuuguuuuuuguuuguuugguuauuuuuuuucuccuacaaacaaggagaggagaaccccaacauggaaaaccacuugugcuguugggguccccauaaaugcuaacgaagcaggcacuucacgaaagugccuguuagacucucaugguuuuguucuugggaauaaaacaucacguguggggaauuaaagacaacaaugauacuaagucaagaaaagaugcagcuagaggccggcucagcaguuacgcaugcguacugcucucccacaguacuggaguugagauccuagccccacaucuggcggcuuacaucccccucuaacuuuagccccgagaaggcccaaagcucucucuucuggucucugugggcagccacauacacaugcacacaaauacauacaaacacauacgcaugcauaaggcaacacaaaaaaaccaugaaauaaauaaauaauaaaaauagaggaagaaaagauucugaaccacugacugcuagcuuugauggaauucaccuuugugugaauaugacgcaucucacagugacacuugcuaaugcucuuuacucaaaggcugguaagaagauguuccucugagagaauaaaacaacuaacugagccaacaggaaacuuucugugcuguaucugcugaggagcuuugguggaagaucccauccugagagccuuaacaggagaucuaagaaaagguguggaaaugccuguuacugaugacagugacacaaggaaacaaaagguucaggcgagcacaugaaaagugcauguaugcacacacgugcacucagagggaaugcuacaagucagccagaacauacuucgagucccuuguauacaguggagauuaauauuguaggauggguacacacugugugauguuucaacauccaauaaaccaucccuccgguaguaucaccuaccgcagugccugcagaaauguugccagaccacgaggaacaugcaucuuuuuuuuucuccaaacaaugcaagcuaaucuucccaggggcgaucugucaaugccaggagugcuaauuugauagcuccgucaucagauggcaucgagaauuucauuacauauuuuaagucacgcuaacaugguuugcuaaugcuggaauucacuaaaaggccacggcuauuuaaauaacaaacggccacaauaaugguauacauauuaaaaaaaaaugacauguguugucuucuacaaauccucuuccuggggucuuacaucauuagcuaauagucaucaacacaaagaucuaucaagacguuuuagagagggcagagucacaugugaagucauuauuuguagaaauuaacaauauaccuauccaauggaagaauauacauuaaauuacauuagaauaauguugugugcuagauccaucagauauucuucagguuagagaaauuuaauucuacugcauaaaaaacagaagacagaaaaauauuuaguuaagcaauaaaucacacuuaaagaucggcuaucuuccuuccugguuaauuuacagccacacgagcacauguacagaucaacaaauacauucacaaacgagcauaucccacaugaaccugcccaccuagugcuuguggucacacuaugcuacaaaaucuuguuccaucuacaguuacuccugagugucaugggcgcugguucucccacuucugugccuucaaugcacaaugccucuuauauuugugcagacuguggagucgccuugggcaaagcuauuagcccauuccagcuccucugacaguauuggauacuaucuuuugaguggugguauacaccagucauccaagcacaugggugacacaggcaggagauucuuaaguuggaggccagcuacaaggugaggcuauaccucuaacaucaagaaaagaaagaggauauuaucuucaaagaaucaaaagucagaaaugccuuaacuccuggcacauagcaggugcucaauaaaagguggcuaacuuaaaaauucagccacacacacuguccccucugcuguaaaaucucuguccucaaagucauuaaccugacucuguguccucacugucaccacccccacuguccucaacaccaacaagagcgaagaccccaaauccuucacaaagccuuuggugguaucuguuaccuauaccucugugguggcuggugcucucaauuuagaaucaccuagaagaccaaccugugggugcaauuccaaaagaucaaagugaccaucauuuacaugaugccaccugauugucaucucagggcuggggaaguggagacaggaggaucccugggacucgcugccuaauugaugagcuccaggccaaugagagaugucucaaaagguucacagccuaucugagcauaagcuuccaggucaaaagccaggccaggcuuaaguuuuuuuuaccugucucaaacaaacacagaacaccaaucaaaugcugguauuaugagucacuuccuaaauuucugaagacagaaaugguuuuccuagagucucuaguuuauagagcacacucuaucauuauacgaucucuuuugcuuaauguggccaacacaaaugaagauuccaaaagaagacaucaugauaaagugacuugcggucuguauggagagauccuuggccagugguacacaccuuucaucccagcacucaggaggcagagguaggugagucucugugaguuuggaggccagccugcuuuacacagcuccccaaaacucgaaguuaaacacacuaaagacucacucgcaaaugggcagagagauaagcacuccccaaagcaaauccuguugaaaggucaucaucaaaaggaaggggugugguugguccucugagacaucccuugcaauuagggaugaaagggcacucugcccccacaaagcuucaacuccuuccugaaauacacagcauccuugacaacuguugucugugaucuggaccaucaugaaaggccacugugguggcacaauuuggagcaaaugaacaguucaaguugugccagguggcccagguuugagccucgccuucaccucugacaaccuccaggugcccaaugucuucucuguuucacggcacacagaaaggccucccgggauccagucagaaccuggagccuccuucagguucaagguccaugcacagcccuuucugcuccaucugacucccaucuuaaccaaauggagauaaacacacuccaccccccucucccaucuaccuuggagaccugagaagcagucagaugcuggaaagaugcuugguacagucaguccuaguaaaggcaaggugaugguauugucucccagaacuucuuaaucagccacaacucucaggggacccucugcuacaaugaauuaacaauucaauuacacgugggaaaccugcaguggucagguagagcuggaguucaguuucugauggguuuuguuuguuuguuuuggcuuuggaucuaaaaaggccuccaucauccugggggccaaagaugaacccaagggaaccucucccugcccuggugaagggagggaaaaggagacacgcccagguauccugcaccagugacuucgaaucagggagcccaggagaauggguguaucccuugcaagcagaagaguccugccagcuuuuuccugggccuuggaacaaaaggagagagaggaagaaagcuuacuggagaacauaauccucccgaagcaaggaaggaugcuguaguuguuuucuuuugaacaucuucgcaaacccuuaucggguuaacggugagaucucaaacacgcuaauuucauuagcuccgucuuuuauuauagcugcugagaaucaacaugggggaucagugacacaaggcccacacaggagccaagcgucgauacucaacucaggagaggaaaaacagacuuaccauguucaccugccuaagaauauuaaaauaucaaaaagguuuucgaguuccccgguuuuuauggcuuuuuuuuuuucuuucccuuuaaagagugagaauacuaugaaaacauuaugcugggcucagcaguugauggacgguauuuuuuuuggaucuagcaaauaugcuuuuuauaacuuuucuccaaaacgaggaacuuuguagcucaaguuacuuggacacugacgcuguuuuuucucccucccccacuuuucugaucagucagaaggguuuucucucuguucuucaaauaaauaagaucccccagcugaacaaacaccauauauucucggggauggcuuugacuucucaaagagcauuucacuuucucucucucucucucuuucucaaaauguaaaugauucaauagacuuaaagagaccacaucacaggaaacucaagaagccaauguuggucaugggauuaacccccuggcugaugcacgagggaggagaaagccuccacucaaccgaaaugacuugauauuucuugagaaugcugaagaugacuggauaagauauuuuguuaggcaaagcaauggguagguauaggcaauggagaagaaaaaaaaagaaaccuuuaacauuuaaaauccaacuuacuuuuucugaaaaaaaguaaagagcaauaaaaaauaaauaaaguuuuuuuuuucuuuacuuaguucuuuguucaaauaguacagcagcccugaacaguaacaacugaucuuagagaggguacugggccuugagaagcagaaucguacuccuuacgggcuugagagcgacuggcaagaucuaucuaguuuuacuaaaagaaauuaaguuucugugcaauuuuuaaauuccuauccgacgucagcaaugugaguuucuuugggaagagaaagcuggcugucaguuaaauaauaaagcaaugcaagacgguccacaucuuugcacuugggaugcaauuugggauagacacccaaugucugcauccuucuagacuucuuauuaaggggcucugucuuaucucccaccacaaagcggaaaugcauaaacauacauaggaaaggaacugggugccucggacaccucucucggcccuggaagugguacaggcagacgacaggaagggugugaucagcgggagugggaggcgugacagaagcauuggcaacaaguaccauggcuucagacaaggagcucugggucagggccugugagggcucuggccacgggaguacaguaacaaggacgagagagagagagagagagagagagagagagagagagagagagagagagagagagagagagagagagagagagagagaaaaucaaaccacuuaaggaaacucacacaguagugggugggcugcaagauauuucccgaugcgcacucuccccuuccuccuaaccccagcacgcgaaucccuggacucauaucuaacaaacaauauagaaggugucagaccgucugcaggggguguuuuuuugccuggcuaggggacaauggagcccuguguaguccucacaauuuauaccacugucuuucccuucccucggugcacaaugugucuaaagaguucuguguuccauacuugacucacuguucaguucacugagauacuaucagcuugucuguaagguuggacgcuauguaaauggcgaagacucuaaacuuccacuagugagaccagagaugaagugguaaacccuuagccggcuccuauagaacauaccuuucuuacugcgagagaacagaguuguucugaaaacaaauuggaacucggguuugagucuucucuauugguguuagaaaaacaucaccucacaccucacgggcaggggugaagggggaggggaaucaauguauccagcaaguuauacagagauuggugcuuguggaagaacauuccggaaaaucgugggacaacgcaagcucugugcauuuguuuaaucgugcuggccuccagcaucuaaacugcauugaggccaaaaauuacuagaaagaaguaugaaauuggagaaaaggaagcugagggggagaggaucaaaggcagccagggcuugaguagagaaucgaggggagggcaaggacgaggugcggaggggcggcgcuacccaacugccagugggucugugggagaaaagagagggagauaaagcugguggcuuucaaaucuuggcuaaauguucauuaaaugauuugucacacacauuaagggcagacgguugcuuuucuccucucggguguucauucaggaacaaagacuugaaacgcuauaaugaagagagagagacagagagacagagagacagagacagagagacagacagagagagagacagagagacagagacagaggcaaacagacagagagagagagagagggagagaaagagagagagagagaaggagagggagagggagggagagagggagagagagagagagagagagagagagagagagagagagagagagagaaagaaagccagucagccuguagaacucggaaguaugcucacacaaauuaaccuucauuaaauagacagagagaauuucuccuuaaaguugagguguguuggcaguagggaccaagcaauuggcccccaaaagguugaaacugaccuaaggcccuuaacuccagcaugacgggagaucaggcggcugcaaugucauccuuagcaacacaggcuacucggagucugccaggacuacccaagaccuugucucaaaaacuaaguaugugaguuguacaccuuuuccuuagccacuuccuugcccuggguguuuuucuuuuaaaugccaggaaaagucuccucaggcuuccauuugagucuacucugaccccaguuuuccccagaucaucuaguaaccacuaagggaaccccuccaaauuccaaauuccaguaacaugaccaucuaucacagacauggaaguggaaaugggugagaauagauuuuaaguucuuaacaugaauacacacacacacacacacacacauauacauacucacacauacacauacauacauguacacacacagauacauauaucuguguguauacauguaucuguauauauaccaacauagacauacaacacaauacacaaacacauauagacaaacaugcacgcacauacacauaauaaacaaacauggauauauauacauguauacacauauacauacacaaaacaaacauauacauauguauaacauacacauacacacgcgcacacacacacacacacacacacacacacacacacacacacacaucaauaaccaagggagucagcaaauauguucaucagggcaaaccauucaccguauguguuuauaccaaaaagagacgggguuguauuuaucaaucacacacccacaaaacugaguugaagcugugauguauggagaaaaggcacagcaacugcccaucaaguguuguggcuuggcugugaggugucucaacaguccaucccuggcuuguggcacuugaugguagguuuuggagcccuggggaagggauuacagcccaucccuacuuccagucaaguucuguuuccaccauagaagaaacagcugucccacgcuuacucugccauggaacagaguuugccaccaugccaucuagguuaaucacagugauguggaccgaagauaacacagcgaguuuccauaugcagcugacaugaaaccuucacaaggccagauucucacaacagggcagugaugguuaucaaguaucuauaaaugcuugcugcccuucauuuccucagugcaguccauaaguccauaaggugggcacaaguccugguauuucacgagagucuuaaugaagguaggaaacuugcucaugaguuaggacagaggggagcugguauuucuagagucgccuaacucuagaauauucccuaacaguucuagagcucuccagaucucaaaaugaauaaucuuccuuccaaacaugcuuuucugagggaauccauugcuguggcuuggagccaagugccugggggcuuuuggcucugacccuagcuacccuggauacgcugaggcugugagaccuggccucaccauuucuuacacacucugaacugcaauccuuccccaccucagggagacuagcggcaaagagcccacuacugacccuccugcauaagcacacagcauucuuuccuuuacaaugacguacaguguugccauguuugaauaucaaaugaaagcacacagggacucucuucugaggucacagcuguggaaagguugggaacuagaacuguuuggacccuggcccuuuagucagaguggagccugugcuuuugaggggcuccggguacuuccugaauuucuuuuuuuuuuuuuuuaugacaucaugugacaaaacccuuguucuaaucugagagaccuggaaugcuuccggggagagcagaguggauaagagcggaaaagauggaauauucuagaaugaaaaauuuauuaggaaagaacgcauggcugggcugacuagagcuggggcuggucauguggaaccgagaacccagguacccucugauuaauucucauauguucucguggccacacuguggguagacagucuaagccacuggauggcugauucuucuauuuuacaaaaagucacuucuguguuuuguuagccucccaucauccauccgccaggaacagggacgaucgacuuaauuucggagagugggagcagggaaagaugacucacagagcagcucagagucagaauccucuucuuauggagaaagagcuaagggguggagaaugauacggccccacuuugcuuucagaauguguucaggacgcagugaucaccacuccugcagccacuucggaagcaugaagugaaagccgagacagccuugaaaggcacuucccacuugagggaccaagcauaccucuggaugccucaggguuacagaaucuacgaaaaaaauuaaagaagacccccuagaucuuauuccaaccaucuuuccaugugaauuaggagcucacagcucauagucaccgcacggauacagacauuugacccaaggcagguugaauuauuacaaaacgacugaagagaagcaggggaacgaaacuuuaaaacaacugccuaaagauuccaaguucuuggcucuugugaaacccgccacaugcccgggccuugggacuaagcaaacgccacacacuuuaaagcucugggcagaauggaaagcugacuaaugagcccuaagcuaauaaugaucaccuucagguaagaaggcugcagggagguagcccucuguaagaggagagcugagccucuggagaagccguggugagaaagcucauguguggcccggccgcagagguccccaaagucuacuuuccugccauaccucggcuugggggaacacagaaaucagcgaauuccacccaugcuuggaaggcucaaaauacugugaucaacaaggaauauggguuuccauguugcaggguguguuuucuuuucucaacugaaaagaaagaaagaaagaaagaaagaaagaaagaaagaaagaaagaaagaaaaaaagaaagaaagaaagaaagaaagaaagaaagaaagagagagagagagagagagagagggagggagggagggagggagggagggagggagggagagagagagagagagagagagagagagagagagagagagagagagaaacuggaaagucccuguuaguccugucucuccuuguauggggcacgccaauauaccaauaaggauucagacaugagguggguccuugaaugcaccuucagaguagccagcuacaggccuuugagggauguauuuuguuaaaaauaguaauuuaaagaacaaaucaacauuuauuaggcccuucauuaugcuuuaaaguuguacgacuauaaaucaccaggccgcggguuauccaagggcagaguuacccagcuuggcacugcguaagguuaggagaacgcuauguugugcuuucucugcuuguaauuuauagcucugcaacgggaccuagcauugcaggcccauccauuagccggguagccacacaucuguuagggcuccuuacaauggcagccuuuucauggcuacaggaagagaaacccaauccuuucagaagaucuacaaacucaagccauuuuaaaaaaaaaaagugaacugauaugaaaacacaguucccuaaaacaucugcuaagcucuuguuaccccaacacaugauauucuuuccgacaguuaccugccaacacaaauauuugguugcuccaaacacccuucaaggcacgugacugugcucaacuugaaauuuacacucggagccauagagggcuggcuuggcccugagaccucuggcaaggagguuguuuaccagcguucaaaacuaauguggaaaaaaaaagaggggagugggucaagaaggugcugucaaaugcuuuaaagaggaaacauaacgacacaaucagacacacauggcaggggcgcuacgguguguuugacuaaggaaauggagcuggaaggaguuggcgaaggcucuggaggcgaggauggcauuuucuugaacaggcuagguaggcuuuuccuggcacagaugcaauucauucugacccugcagaaguguugugagggaaaaauaaaacaggcagauagauaccugaggugucucgaggucaggugcaaguugccaaggugccccucagcugagagcuucgaagcucucaaacgagacagcacacaccaauagccauaaccacccugguaaaucucuuacgccguuagguaacagcacaggucagguuuauacugauaugaugucauuugcacaccuugccguaucauguaugcuaacaucuggcacacacauuacuauacauaaaacgcaguuuagaggcagaggugucaacacaaaacuccuuggugaugugacuucaucaugcgaacacucucagcaaacuuugguuuccuuuaagacauuuuagggacugcuacugguaaaaaaaaaaaaucuugguuuaaacaacauuuaaaacagcguauuuccauuuugcucauucuuuuuauguuaucauaaauucgaggcgggaggaauaaucaccucucccagaacuccuaggacacuuguccuguggcccucuggaggaagagggcggcagagacaugaccuugccgguagggggcacugugcuaagaauuaguccccgugaguuucucauuagugauuauuauacugcaggaugcccaaaugcaaaaauuaauuaauuucaaagugauaaugcauuuacagcaacaauuagaaacguauaacuguaaaagggcaacauuuaaaagacauauuacauuuaauaaaguugcacgagagcauccaauuguaaaauuacugaucugcaacaauaguccuuaaagagccacuuaaaauagcccgacuccaugaagggugaccuaauuacgguaacuaaaaucaccauagucacagcgagucacagcaaauaaagaagggacguugauauuaaaacacugcuguuuaaugcuuacaggggcuggcugcagggaggaggggggcugggcuuccugagcgccaggcagggugguauuucuucuuuccugggccuuguacaauggagaguauacccaagcuaugcccaugccacagggaagaaugcuuuuagcaaggugagauggggaaggaacucugaaggacaaauggaguccuagccuagagaaguauaugggcgucuucucuucuccuuucuccugggcucccucugcucuccucccucaucaugagcucccuccuccuggaacuccauauuccuuccuccaaaacucccuccucccuccucuugagcuccauccucccgucugaagaacccaacaauauggaacucaauggcaaaguaccaccggccauuuagacaggucacugauaucaaagaggaccuaaacaagacucugugccccacgauguuguuaaucucuacaccuaggguuggaauccuggcacucagaaugcucgccaggccuacauagugagacccuggcucaaaaacaaccacauacaaacaaagaaaaacagucaacagccguagcuaaugugugcugaugagauaucaaguccugcuuccuaguuaaucaggaauaggagaauggaaacucgcagucacuaggguugccucgagaccagauagauaggucugaggccaccgccucagguucuccuacgccauuuuccugucuugccaggaaucuuacuccuggagugaucaagguagagacagagacaucaaccuccuccuauacccaccagcagauucccuauuuaucauacuaaaaucacuauagucacagcaaauagaauuauuucacuuauuaucaauuuuagcccauguccccuguuauaucugucaucuacauugaggcacgagaacuuucuacacucagguacugcucacagaaucgaaagaaacuaaggacaagggaaaaaaaaggugcuauacacagcacccuguacaugacauguaugacuacugaaacugaaacugaacagaauucagaauuuccccagcuguacaacauauaucaaggucucaauuacuauauguggacaauggccagauggugaccacuagacaaauccucuguucuggaguccguuauuugagguauaacguggcaggauaggaugcuugagacaaauucccuaccuugucuugauggccacaggaaacacuggaacuugauuaggagaaaugcuaaggagagccaguuguucuacugugccaggcagccgauggcuguccuugccaccaccagaaggauagcuggacuuauaugccuaaagacccaauuuugaucauuuaaaaaaacagcaccaguaacugccaaggaucuauaaguucaaaggaaaauacuuuuauuauuuaucucauguguguauuuguggaacauucauauguauguauguauguauguauguaugugugugguggugugcacaccaauggguucauguauauaaauccgcugcaggauauuugaccacaucauaaaacccaagauugugcuguuuacuagaaaacgcuauuucuaguggugguguggcucagccugaguacacaccuuuaaucccucuagcuggaauacagacaagccuuuaguggacaccuuuaaucuuaaacaaugaaagcaaaguuaguuaaaguaccaugccugaaagcgaugucuaguugaguggcagacaaagugacaaaucagaaaaagauuugacagaacagacuauggccaacucucacaagaaaagagaggaaagggaaagcuacuuugggggcagugcaaagaaagaaagaagacaggaggcaguuuuaccagacaguuguacagagucagauugcagagagagaacaagcuagacacaggugaagacagaacgagccagaggaugagaaggagccagaagauuagagcagaaugacacggucaauaugaggccaagcagagcacuucaguaggacaccaagagaauccagauugaaucagccuacagggaaaggaauuugagccagagcucagaaagaacaagucagaggucagcggauucagcagcaagucucagaggcugaaaacauucuaggccuagauaggauuguacagagguuagaagcuuccaggacgagguauagguuagcagacagaggcaguaagacucagagaugacaauuacuucaggcaaauaaaaguuauuuuuacauaugucugagguagauguuggguucuucuuuuaacacccucuacuguaucuaugagcuaucuaucuaucuaucuaucuaucuaucuaucuaucuaucuaucuaucuaucuaccuaucagcagacuucucacugcaccuggaacuucaggcccugagagauccaaucauggaacccuaacauugagguugcaaacacauaaagcuacucccagcuuucaucugucuucugggggucugaaucuaguucuuaauucuuguucagaacacgcuuaucccacuaagccauuucccuggccccgagcucagaagggcgacugaccgaggaugcugugcaacaugcacuucuauauucaaguaacacugggcuaauggauucacagaaaagcuuucacacaccauugauaaaacaaccgacaaauauguaaaaccuucauauucagcuuugugaauacuucaguucuaaccgcagcggugagauuccuccaagagauuugucuucagggauaugaaggauaaaccacacucuagccacaaagccuucuccaggaaggagcuauacccagaccuccauuauaagaagcaucuagaacauccgauacaaaaaccucacugaaccaagaagaaaagugccuacuaacacucccgaauccacauuugcaacuaacacacagcacacguagcaaguucuauuuugcaguaguuugugaaucaaagcagaaaucacauugagagaaaacaaaccauuauugugucccucaccccaaaccuccaagguuuucagguguucuccaccuaacacugacaaccagcaucuauuauccaagccaagacuaugguagagcaacagacacaaucuaaacgugacggaaguauugaagagcuuuugcuaaugaaugaacaggcuagaugcuguguacucaaucccaggcccaccacagccggugacaaugacaucacaacuagacaugugggucuggguuuccaggcccuucugugacggcgacugaaggcaucugggcgguuccagaagccgcacacuuaccauggacuuggugaacggccuggccaaggugaacagcagcuuguacacccaugaguugcgauggauggcugaguacaucauguucccagggugcacugcguuggaugugaccccgcgcggggagaggcgacggugcaguucauuggagaagaggauauugcagaguuuagaucuguuauaagccagcauggcccaguagucgcuccucgguggagacaggcggcugaggucaaguuucccggaggagucauuaauaucuguaaaucuaggaaacaaagagcaugaaguggagcaccaacgauucggcuucucacagggcuuugggguuuguuugaagucugaccgaccuauagggaucugaucuagaguaccucacaaucauguccccuaaaugcagauggugacuuaacacacggccaauuacuuugauccaacgaggaaggagaaaccuacacccacaacuucaguaggcaaaauaaacccaagguucacugaaccuccaaauauauacuucaagccuguagcugcaaucaaaaagcucaggcagggcagucacccugaacuuggggcuagccugugcuaucaugaguuccaacuaggcugaguuucaaugaaagguaugaaaucaaaagucgaaauaucucucucucauucucucucucucauucucucucucucucucucucucucucucucucucucucucucucucugugugugugugugugugugugugugugugugugugugugcacucaagaucuucaaccaucuucaaggauaauuaaauagaaacaagcuuuagauaaaaggugacugcauuggggaaacaacaucacauuccuaaccuuuggcaggguuuuccugauuauuuuagccaaauguaagagaucuguguguuuccauuugagcauccaaguuaauacagacgagccaucuugccucuaagacucuuuuccagauuaaaaauuaaugaucauaaaaggguuguaaccuuggugaggugccaucagaagucuuucguguguaaaaauuaaauguaaacaaagccagaaacggguucuggcugagucuaccauuuuuugaguacaggcauggcauggauacucacaaaucaaaguaacuaagugauguuuuauaauagagucugacagagccauuaaacaccagcugugugcuucaguuauaccugccuuucucuuagucagaaaaggaagaaaaauaaauaaaaaggaaacugucuuacaaaacacagaucguaagaaacaaccaagaaagaauguucuagauauuaucauaguuguuuaagguuccuccacacuuggcuucauuauguuaacuuugcgcauuguagaggacccugguuugucuugauacuacugugaagaaauaacaugaccagaaggaaaagguuuuauuuggauuaugcucaucaucuuaacacuguucauuaucaaacaggaacucacacagggcaggaaccugcuggcaggagcugaaguggaggccauggaguagagcuacuuacuggcuugcucaggcugcuuuucuauacaauacagaacuaccaccacaaugggcugggcccuccccgaccagucacuaauuaagaaaaugcucuacagucuugccuacaaccccagcuucuggagguguguucucuccuuccucuccgugauuuuggcuugugucaguugauauaaaacuaugcagcguaauuaacaauuugucaacacacacuguuaagccacuuccuuuccuuucucauucauccccaagaucucacaagaaaaacacaaauaacuuuaaguuucacagucuuuagaaauacagucuccucaaaaauucaaugucucauuuaaaagccauaauccccccuaaaauuuagccauucaucuacgggcuccugcagaaccaaaacaaaguuaaauacucccuuacuucaagagccaagaagcagggcacagucacaaucugaacaaagcaaaaccaaauuccaacaguauaaauaacucgguauccaauauaugacauucacucucuaucuucuaggcuccuccaaggggcuugggucacaucucagacuccacccucugcaacacacacagcuugucuucuaggcuccagcuagguauucgaauguccagacaauggaggacauuucucauucaagccagcacaguguagugggagucacaucccugcaaguuaauuaccccucucccaggacucagugacacccacgucagaugcugaaugcugagauucugcaaccggcaaaguguaugucaccaagggaauggcagugacaaauggcaagugucccuugccaaaaaaaaaagaaaaaaucugggucugagucucacuuuauaaaguuaacgcugcccgugaggaucaccaucucaaaguucuggguuacacauuugcaggcaguggcuccugguguuaggauggggucccagcuucaugacugcggcucacugggcucauguauacuaucuauugcuucuuuacugcugcagaugagacauugggccucacugaccagaggcucugggaggucccacuaguuuaugcugccaguuuuuaacaaaguggggagggcugggcacauuucaauguccauccaaucagaagugaaggaggauccagggaugggaaccaucgcuccggcuguucaagaggcagcaaggcagcuagcucuucaaggacaaccacucugacuuccaguugagagucuggcaaagccaaggaaggucugagcagugucucugucauccacagaggccagcugacaccugcucuccagacacugaguggcccugaggagucccugucuucuaugucccacgucucuguuuaagccgaaacaauucuuaauuccaaagauaagauaaugagaauggauuugcacagacaucagcuaguauguuugaggagcaggaauaagcuugcaugggaaauucugcauguguguaacuacguguaugguguguguuugugaugaagcguacauauguggcugcgugggggcacacuuaugaugggguggcuuuucucuaugauugcauggauugugugugacugggauauaugucucucugugggcucugaguggcuuccugugguugugugugugacuguguaugugacaaaauguguggcugugcaugugacagugugcgugugaggguaugguacugugggugagauaauauaacuuugugguucuaugugguuuucuuuuuccgauugugcaugauuuuauguguguuuaugagucugagaguuuacauaugugagguugcugggugggguacgauuguauguggaacuauguaugaugguguguaucuacaugugugugguuuugugugugauauucuacacauauaagacuguggggagggauugaguguagaacucaaguugugagugguugugugaggucccaugugcauguauguagcuguaugugugcgacugucccuggcuguacauaccucugucuccucaugcugcuggggccuuugggaacagugcaacugguacucuguucuucucauucuauuuuaauuguuaucugaaaaauuuccacauugaggaggccaaauucccuuuucauuaugauauauuuuagacaggcagaaacucaauucacuugcucagacuccagauaaguauguaaaacacaguggagagagagagagagagagagagagagagagagagagagagagaaggcuaauaaauauuucgcuggagggcauccaguaugauauuuucugcaaacauaggacuuuauuuuuccccuaacagggggucuugacuccaacgaagagauuccgccaagguuuauggagguaauuagagagcaacacuguguuuuacaguuugguuuaggcuccgggcccuucugccaugauccaguguugucugugugccuggcacccaugcuugcucucuggagcacagggauaccacaagagagugauaaacaguuuggcuuguaggaauuaauauuuuguauaauguuaauaagaagaaaguggacagcgagagccagucagcacacccaugcaggccuuucucacacacauuagucaggccuugcuagaaauagcaacggaucucauucagaccaaggucuuuccuuccagacgcaucuugaaaaugaaacuaggauguggaucuccaaguaggcagaaauuacacugugguuccagugagaacaaaggcgucccaggaaaacagcauccaagauggagcuguacagagggaagggagcagcugacaccuccacaccgucucccauuaaauaccagcucauuuaaacauaucccguggugcccuccacaucugguaagcgauuguggcuggcagauuuauuucuaaagcucucucuccugccugcccccaugguagccuccuucauugcuuuugggggggggggggcucccuuucuuucacaaacccggugugauuugcaaagauaagccuggccagauuuuguuacugccuaauuacuagauguuucgugucuucccgggcgggggaggauuauuacgcgagcuucucuuucauugaagccaucauaaauuuaaacuggcaagaguaaaucugucugcggcgugucacuuacaccguaagccccuguguuugggagugauaaaggguucaagcuaacccuuggcuggucucucucuucaaagucccagggguuacauuuuauggaagaaugauuaaagagagagagagaaagagagagagagagagagagagagagagagagagagagagagagagagagagagaaagacugcauucugggucaccaaaacauuucaggacuuaagauggagaagaagaggaagaaaauaguuuguuuauuuauuuauuuauuuguaccggcuacuuuaccaagaaggcaaagcuccuucuacccccaacaaccaagaacacagggaagugaaggaagucucccucacaagcuguaaaucuugccuccgaagccccgaaaauccuuugucuuuccucagcacuucagagaguuguuuauccaacucccgcacaaauauguugaaaacacggugauguuuucagaugucuuuuuugucgacugaauagucuaauggcaaucagaaagcaacgccaucugauguguaaauugaaauucuaaccgaaagaggcauggccagauuuccaauccgcacuaacuacaguccuuuccuuucugcaauuacgcugcuaaugucugcauugaauucccuaauuucucauuauaaaacaauuggauuucaucucucggcccuuaacugcguuguuuccccugcuagaaaaaccgccgcucuccucucagugagacuuugaaguuguugaauuacaaaucaauaaaggucgugcuauucagauuuaaucaauuauuauuccaucucugagugaaaucaaugaggaaccugagguauaauuguaaaaucacucuauauugcucuagacagccccccccccaacaauuccccaggaucacacaccuggaaggaucuagaaaaauuaaugaagccaggcuguguacacucauguuucucauagugagauuggucaaaaguaguauuguuaaaagauuuauuugugugugugugugugugugugugguugcugguguugguggagaccaaaagaggguguugcauccucuacagauggagucacaggugguugugagucaccuggccuagugucuagggacugaacuuguaagagcuuuuaaauguugagcccuuucuucagccucagcacccugaagggaauuucagguggcacaaaugaagggacagguggaagauaugaagucaaauucaaacccaccugugggacucggaagagaccacgaugacacgggcgggggaugagcggcacagaacauccugcaggaguuggacaagguagaaaugucccaggugguucaccugaaagguugucuccaggccauccuucgugaggccccagggcagagcaaacgucccugcauuacacacaagcacgugaagagaccugcacgaggaaaugcaugacaucaggcacaaaucgaugauauacauacaaucacuuaggaacaacccauuucucuggguugucaagaugccaaccagugagaaacgagacaaggcgggauguuacauugcucugaaugggcugugacuuuggggugccagcaacaagaaguucccaggacgcaagacacccaugcuaacccagaaucauacaggguaugucaggaugagggugguucgcuggcguugagacacacugucucugguuaacgguuaacugugcuuucuaauacaaacaauuacuacugcuuuuauguucaaucaaaauaguccacaaauacacaccaggggucuuuugauuuccuuucuuuaggacacugauacacuacaagaaaaacugacacuggggccuaaugcuuaguggauacuaaauaaauggaucaaagagaauauggucuguuuacagagccggucacagaguauuucaauacauuugucuuagagauggaggcauaagucgguggaacacuugccuaguauaaauuuagacuuggguucuauccucagcaccaaauaaaucaagcauguguguaacccugagacccgggaggugggggcaggagaaucaggaguucagggucaucucagacugugaagugauuuccaggcuaucuuuggguaaaagagagccuaaucucaaugucugucuguguguguguguguguguguguguguguguguguguguguguguguaucuuccuuugggauuaaaucugaaccuguuagaaauaagcccggggauaagaggaggugugcuaugaauaaaaauuuaacaguaaauguaacccuuucauuuggaugaaagcccuaaauccgaauaagauauauuuuuacuucaaagaaacucuaaugaacagcuaugacacaaugagggaaucuucaggacccucuacuguauccguaaucaaaacauaaaagcaacaaaccagaaguuaacugccccauggaguaggaugcguggaaaugguaagaagcugacagcccaaucgcaaguaaauccacuuuguuuuggaaucuguuaugaagcaaaauauauaauaggauuguguacaugucagugggauagagcgaaccagaauggcagauggggaagcugagaaaagcuaaugacugugcgccaccuuaggaagccaggagaacaggaggaggcucccccagccaggccaggaguaacccuguagauaccugggcuucagucuuuggacucccagcccuaggagagacuaugaaucuguugcuuuaaaccacccauguugcgguacucuaccuuaggaaagcaacagugaauccagaggaucccagaccuucccagaugaacugaggcaagggucagcaugugugacaaugugugucauagagcuuucuccaagaaagggaaagcccacccaggcgugguggcucccagcagucaucucaguacuaaaggagcucgaggcaggugcccaagauggggcacacagugaacucuaggccagccuggcauacauagugcaauccugucucaagaaacccaagccaaggcuguggagauggcuuagggaauaaagacacuacuggcuaccaaccuggaugaccugagucccauuccccagacccacagggugaaaagauagagcaaacuccugcaagcugacuucccaccuccacaccccagccuuggcacccacccacauauacacagacacaccuucugagggaagacacacaaauaaaugaauacaugugauaauaacauggagucaaaacaaaaccagaagcaggaaaaaaaugagacuucuccauaugcagucacugaguaagaaaauaaagacuggcaagaggucuggaggggaugguuaaacuuguuuuuccuucuagguguuugcuagugcuuccuguuuucuaauccugagaugugacugacguccauaaaacucauuugagcgcauaguccagggguuuucguguguucuggguugaauauguauggguugcauccuaucaccacauuucuaccuuuacaguaacuguaaguacuagaaagcaacucguuagcuguugguaauuacauggugaccacccauaugcacuuucuacucuauggauuugucuaacacaaucaucgcauggagccaagauaacaugugauccuuugugaccgucaucuuugacuaggcacaauguuuugagguuucaugcugucugaaaaauggacgcugcccacccuccuaagccugagaccucucugcuggaugcacagaugacaucuuuuuguccuuugcuacuuugaugggaucuggguuacugcaguguugggcuaaugugaauacugcuggaacaggcauugcuuugccaggucuucuggagacguauuuguuuauuucuugaguauguacuugcaaauggaacuguuggcucacagcauaaugcuguguuuaacuucuggggaggaaucaaacugccguccaaagugagacacgucccccacauccccaccaaccgugcauucauuacacucccccaccuugugguaauucuggcacucucgcugugugucucucucuuucuuucuuuuuucucucucucuuuuuucuuccuuucuuucuuuuuuuccuucuuucuuucucucucccuuucuuuuuucaucuauucuuuucaaauuauuuuuaaaauaucuuuagauuauaauagaauuguauuuacccccuucucucucuuucccccuaagccuucccauaugccguuccuuuucaaauucauggccucuucuuucauuaauuguuguuauguagacacacacacacuaaauacacaaauacaaccucuucaggcugaguuuacauaauguuacuuacuuauaggcauguuuucagggcugcccauuuaguauaguuaacuggugugcucuuccuuggggaagacaguuucucccagccucugcauuccuuaguugcuugugggucuuuuuguaggacugaggccugacaguccuuuacucauccauguuagcaugucuauugcugguguucuuguucagcucauauuuagacagucccacugguaagacuuuauggguguagcuucuaguuacucccuuauccccuggcucuuccgaucuuucugccuccccuucuacaaugaucccugagucuccccagcaaauccaagugaugacuucacugugauuugcaucugaauuucauuccuggcuaagugauacugagaaucucuuaugugcucauuggcagcuagcauauuuucgugggagaaauauguguucagcauuuaugcccucuuuggagcuagcagguuuaucuucuuauuguugaauuuugaauuuucuuuauauaugauggaugagcccuuucaagauauuuucaaauaucuuucucauuuuguuuuguuuuuaauuccucuuuugucccuugugcuuucuggguuggaccuaucgaaucauuauuuauucuaauaucauaaagauauucugauaccauauuuuccuucugggauguaguaauuugagcuuuuauauuuaggccacuaauuccuguuuagcucacuuuuguauauggugcaggaaagcgaugugacuucauuccuucaugguggacacccacagguucuggaaccauuuauggaaaagacuaaucuuuacucacugaguuauuccagcaacgagguuugaaaaaucagccacauaaggguuuaauucuggaaucccagugcuauucaguuccccaugauccauggucaugacacgucacacuguuaaauuacugaaaauggggagcuucacacuuuguuucaaaccucaguuugucuguccagugccuuuuucauucucacgugaaguucacaaccaaaacuccaggucugaggaaaacugaauucacaguauagaucagucugaagguauagaaggaauuucauggggguuucugccucucucuagcccguauagauccugaauaauaaaaccacacagacaccuggugguuuuacuaauaagcuguucacucuaugcugggcagguucugagcuauauuaauccuuccaugcuguuaaaacccacaugaaugccccaugacuugacaacuuaguaucucccgggcagcuucugcuagaguuggcuguccucagggugaacuucuccuggccacauguuccugguccacccugcccaauggcgaacuucuucuccaccuccucuugcucuuacccuccuggucccuccccuggaucucaagucccaccuucuucucucuccagcaaagucaguguccaauaggcgauuacuggggagcauucuuuacagcacauuggucaguacaaugcccaugcccagacuguaaccugaccuugggacacagaucucagcaucugaauacagggcacccaagaucaauuccaacacugagggcuacugaugucuacaccacauccuaccuuccaauccaugaacaugggcuaucuucacauucaucugagugcucuuuaaucucuucuaacaauauuucauacauucauaacucuugauuuuuacauuuaugaacauuuguaugugucaaaacggcuucucuauuuuauuuuucugcucuuacugcaagcagaaugauuuucucuaauuccuuuggagcgguaucauugcuccuacacggaagcaaaauggcuucugcauguugagcagucaccucacaaucggguugaacuuggcugcgaguugucacccuuuccaauuugaguuccuaagaugcaaagugauucauucugcaaggaaggcaguuuugauuuuuuuuuuucuuccuuucuaguuuggauggguucuggcugcuaacaccccugucccauuuuuggauguuagggagacaucauccaagcuuucgguguaaauauaucagugguggacuuucuauaggucccauuaauuucuauaggcaccauuaauuucuauagguaccauuaaugaggugauggaauagccugaguaugguuuuuagucaacaaaguguacugaacuauuuacaaaugauguuucuguauccauccagauggcucuauauucuauauucuccugguuucuauuucuuucauugauuaauuucugaauauuuaccacugagucccuagagagucagucaguagauaauccuuuuguuuguacauuauuucauuugguuggcuggugcuuuguugaagauuuugugucuguuccugugugacgcugguccgucgguuucuucugaagacuuugauuuugacaucuagcuaacacugccuucuuauaggaauuuggaagcauucccuucuugcccauguucuuggcaaggugauaaagaacugauagucaaguuugguucagugcuugggggggaaagcaugcacagcacagcuagagagaaguauaucugauaaaucacauuuuuaaguauucaugaaaucucauuaucauggggcaaucuggaucuuguuaggagaucacggcauuuguuucuguugcuugaucuguuuuccaacuugucaccacuuaaaaauaagcguggugaaaugauuguggucagcuggguuugucccggauaacuucuuucuuauacauggugugcaucauggcugucauuaaacagcuccaaauggugccauuccuuucugaagacuggauuugagggcucugaggcagcagcucccugcuguaugcaucagccuugcuuuacaccaaaguagagcaaagucugugccugagaggcuuacgagcaaagcagacucuuuggaaaacgugacauuagaggaagggcagacacacaagcguauuauuacaucugagcucauuuuuuauuauaacucuaacauuuggucaauucuccaagcuguuuucucccccaugccccuggccuugggaugguccgguuaacauccacugagaauugggguacacaggucauuuaacuuucaugaaaacuuuggguggcguucauucuuguugcuauuguucagucaggauagguuugugcauuacacuauuauagaauuaauaacauaauuagaggcaacuuuccugagguugggauucaaagauuugagucaacaaaaguaaaccaguaaacaaaugacuggauaagaacaaggcaaaagaugauuccaguucgaauguagaaugccacccacagcuucgggguugugaauuuaggcaucagcagcagccauauuggaacacugaaguggaaacuucuauuuucuuuggaaaguuaguuauaucaaauaauguuuuucuggggcacacaggugaaaggauguauugcuaaagcaaauaugugaaagacuauuuuucugaagcagacacagguaaagggauauuuugauauagcaaacauguauaaggacgacugaugaaggaguauaaauauaaccccauggacagugggagacaagcacugagcauugguuugguuugcuccgccuugcuauucuuugauaaugacacacauauauugguuugacuuacauagaguuguugagcucaacuuguguuaacgcugacauugagaaaaacuugcccaagaauggcuagugagcuuccugcagcuugcugcuuccacauccucgccucaggccaguuggcaaacuuggggguuucuucaggguugaacuacagcugccuggugucggcuugcugaaaggacuggauuguagcuguugguucgcgccuggugucugcccgucuagaggacuggucugcagcugcugaaucauauuugauguuugcuaugggacugaacugcugcccaagaagaucaagcugaacagguccacauccccauauccuaauaaguuuucuccuccacuaccucugcuggguggugggcuagagaagagguugaacccuuauuaaauguggcaaaaaauguaggccuacagagcauggagcauuuggggcacagagccuaacuggcauaaaugagugcuggguguggguccucaaggcuuaaacaaccuggcccugcuucaaugcccauccugugcuuccugcuggccacacggggcccagcuacaaguaacauggauugaacugcucccccugccccugcuccugcuccugccaugccuucucugccuuuauggacuauaaucccaugaagagcaaguccacauaaauccuucacccuucacauugcuuccgucagguguuuuugucacagcuacaaguaacuaauauaauauucaagccaggauggauagguggaaguguuggcauucuagccuagggcaguuacuuucuuagcagguucaugacccauuggugaacccauguaaacccguuuccuccccuuagaaacugggaacagaagaccggagcuugcaaguuggcgaugagcacagcccagcaucugaccagccggugguaucucuacaccauugcccuuuggccacaaaaagaaaaccugagucugugacugcuugucuuuuagaugcuuugaggcagagugaccauggugaccuucaguggccguggguccucuucuaggcaccguuggucaugccguguucccaagcauggaaaccuacuggagaccuuagucuggaugcacagcggaugugggggacacauuagcucucccauuuccauucucaucauuaauguuuaauugcacaacaccagaggcaggcuauguaccuagcaccgaaaccuugucaccucuauuaauuaaaacaggcuuauggaauaugaaaccauaaugugcuugccuucuuuuuuccuaaauuaugaggguaccuaauuggcuuguacaaaaggaaaaguauucuuuuagcuuuccuuuaaugagguuuuuauuauucaaaugguaacauuucacucgauuuuaacuaaaagccacggcgauucaaacgcgccuuggaugaugaauauuuacaggccaucaaagaaaaggcuagaucaaacuagaaagauggggugggaauaaagacaguaucaauggagcccagagcaaagucaggaucaaacugugaagaagggauggaaguaaagaccaaucuagggagcccagaacagauauuaucagucagcaccuuaagggggauuucacccucaccugggcucugaccugggaagggugauggggguggaaagggccaccauccaugugcagcacuggagauuacgacaaggagaaacccaucgccugcucucuggucugcucauggagaaacugcccacuucucugccugauggguagacccaugcaaggcaucaagcuccugcgaugguguugaaaggcggcagcccccugcccccucuacauggcaagcagugugucaccaaaggaccauacaacaauuccuccacuucccugguagguggaguccuaaugaugaaccaguggguagcucuguagguacccuucagagugaccagagugaggcuucuugaccaugcagccaggcucucucaguagccgaguuuaacugguuuguucuccuaaaaggagagcugguagaggcagugaguggaaaggaugggguccuguccagaggcuggugcuaaccagauaaggaacggcugagcugagcuuucgauccucagagcccugccugucccaauuucaggcauucucucucuauugucucauuccugcugugcauuaacgucaucaaacccugcagacagggcuggggagagaccagcucaguugggaaagugauugcuacguagacuuggggaauggacuuauauucuuauaacccaugucucaggggaaacagagccauaguccccgguuucuaauccccagaucugggcaggcagagacaggaguacccucuccccuccccaaggcuugcuggccggccagccuagccuacucggugacuuccaggucugugccucaaaaagaauguggugcugucuucuagaggugaccuguccauuguacucaugaacuaugugcaacuaugguuacaugaacagaagcucagacaacacuccaacaggcaacgcuaaguggaaucauagguaacaaacacaggacaccaugggcagagcuggacagguucugggauguccacgaaaaauaggagaggauuguuagaguagauaugaucaagauacauuguauaugugagugaaaaugccagagaugaaguaaaggauguuuaaaaaacugaacagagccugaggaacgacaccuaaggcuguccuccaaccuccacauucucacacacauuaaacuggaggaaaaucacuggaggagaaacaaagaaagacagagaggcuagagggcuaaaaagacagagacaccugagguuagagagcagguuugcguuguaacagacaacccucugucugcuuacccacuuuaguuuuccaaugcauguguccguucucuuucacugcccgccauacaccagcuauugccaagugaaugcuguccccgcacuauguggacccuuccagcucugcccauuucacguuuugccacacucuuguccucccaggggcuauucugaagucucaugaacucuugaccauuucuuuacccuugaugcucagcuugaagcuuagugggcucucuuuucaaugguucuuauaggcuuugucuacaccuuugaccaggucaacccaauaagaccaauagaaagucaagaagaaagaggaggaggggggaggaggaaggagagcaagagaaggaggaagagggggaagaagagcaagagaaggaggaagagggggaagaagaggaaaaggaggaagagggggaagaagaaaaggaagaacaggaagaggacgaggaggaagagaaggaggaagagaaggaggaagaggagggggaagaagaggaagaggagggagaggaggaagaggaagaggagggggaagagggggaagaggaagaggaggaagaggaggaggaggaaugggggaggaggaggaggaauggggaggaggaggaggaaugggggaggaggaggaagaggaagaggaggaggaggaggaggaggaggaggaggaggacaaugaugacaagguuguuggacuuaauugccaauaaacagcagcacagaacuggaaaucuggauacccaagaaauuccuggcuuuuaaguccucaaugaaggucaaacuaccagggauggugauucuugaguagagccaaucccaucauuacguaucgucaacacauccacuucccuucucaacuauuuccuagugccuaggaacaagugagccacacauagcucacccccacauuuacuguaaugaccaguuucucaggcgcagccuguccuggggggcuauucccacaccucuucacacuuucuaccaugagucauaguccgucugugccacuagacagcaaugcccaggaggagguaagucuguucucagagggcauggcaugcagugagagcuaagccuuggggcuacagagauggcucaaugguuaggagcacucacugcucuuccagaggaucagugguccauucccagcacccgcacuagguagcucauaacucuucagaacuccagcuauaggggaccagacaggcaccuauacacaugagcauauaaccacacagacagacagacacacacacacacacacacacacacaaucauaauaaaaaaugagccuuuaaaagcaaguaagcugaacguaugcaucggaacuaaugcuauauucuuuaugacauuuggucccugcagcauuauauaggcaucuuuggcaauauauuaccuaaaaaugauuuaaguuggugaguacaaauggccaaauaugacagucauuuaugcucugaagacaagacugauacaucaugauuccaggaacacaagaagacccagaaugucaacugugagaaaggaagaagaauggggcuuuaaaggagucucagagcagcaggggccaccaccaugaggaggugucacagugacguugugaagaugaaauagcaugccugacagaugaauugcgguguucuagguuaagaaguacccuucuagaugaugcuggaguugugacuuugcagggucccauuucagaacaaacgaaagaaugaccuagauggaacacccggcaagaggaaauauauuccacuuccuucuagaaacagaaugucagaccaucugggguacugcucaagugagcuacaagaauucauacuauuuggaaauacugugaaauuugaugcaaaggacauauggagccguguuccauuaagaaacccauuuggaagucuuacuuugugacuagcaguguguucugccagagaaggaaggggugaggacuguauaguauuacaagguggguccuggcuuaaauuaacaucgaugguuugcucugaauucaugauaggcagcagcaacuuggccacaguaguuaccuucuagagcugccuccacccaguugaaauucuccaugcuucuggacccugcccagaccacagcuaugcaguggacaggccauggguacaguucaugaggauuuaggggaaaauaugagaaagauuauuuuuuaaaaauuauauuguauaaugcauuggguauauauguaacuggcuugucagaacugcaguuuaaaggauggucuuacaaaagauuucuuucaagucuugguagcacuaaguccuauauacuacgauacagaagcauugauuuuauaauaauccagauaugacguucaauugauuuaauuugagaagaguugcauuguaacagaagugcuacuaaggguguuauuuagaaagaacaagcaaguaccgaauaucuuuuauacaagucuuccaugggaaaugaugggcaguuuauugaggggcgacugagaagcacagucucuauuuuagaaguaugugugugugugugugugugugugugugugugugugugugugguaauuuuuucacgagagaauucucuugauugauguaauuccagaaagccagagagguuaagcuaugugacacagaaaacguguucuucagccuggguuugccucucaucgggcaaggggaacuuagaaguaguaauacacugaguugcagcugugucuccuguaaaagcgaugggcuauacccagugugucugcuauuuaugagaagugaaaaacuucuacacacgggaucugcagagauggaucaauuguuaauagugccuacugcucuuccagaggaccuuaguucaguuccuaacaccgcacaaucaggacacucacaaaugccuaguaacuccagcuccucgggaauccaguggccucuuuuuggccuccuggggcacuggacaucuguguuccuucuggccccagacacauacacauacacauaauaaauaaugauuaaaguaaguccuaaggacaaccauguacaaugucucugcguugaccuuaauggggaaguugccuaaagcaggcaacuaacauuuugcccagcgucuuguuucuuauacccgggacucuccacuuugggaagaugguacccaccaagaaugcaugcacacaaaauacauacacacuugcucuccacauucccuagauuguuccaaguucccucacuuggagucucuguaagauucucucuauagauagggaaggaaagaaagcaggcaaaaggggccauuacccauaauaccaagaccagcuuggguggucaacgcucaucagcugugcuuaggguggggcauggcccuaaagacaucaagaaccugcuggacaccacaggccauuaacacaauaauuagccaggaguggauucugcugucacaauaacuuaguuacacuuaauuacuauuuucuuuuuguuucagcuggaauagagaaaacaauccaggcaaucaccaggaggagagcaaagcucuggcucuguccccuggagaccgacgggaauuuuucauuucaugcaccauuugcaacuucuuagaguagauucuggaacgucaguacauuagcagaaaaugaaaacacucuuguuuuggugauuuucucaaauuuuugccuccuguccauuaucuugauuggauuuuucccaucccaucaucuuaagucccagcagugagaucgcaaucgcauugauucucagacaggggugucaagcacaguggcacccacaucuuccccaacacgcuuuucuaggggaaaaggcaucgauuugauaauugcgcacuuaggcagauuggcauaguaguagcuacagugcaggccggacucucuggugcagauucuagcaauuuccaaaccugcccuaggcacuuaagcacuuuacuguccuguguuccugcuuccagggaauauuuuauaaaauggaaaaucaaugauuugcagaauauggagaaguagggagggaagggugaggaacagcagccuggaccacucacaucaucucacacacacauuugaacacaacuuccagaaacuggggagaaaggcagugucaucaagccucucuugguagacccccauggguuccuagggacaaaggaauugugaugucuuccuaaagaauuuuacuuacgguaugaaaaucacuugggaggccacaauggacagcgguagauuccacaacucaacucacaguacacaaauaucauuaguauuagguaagagggagggcgcuaguggaugaagcacacugggcuggugugauucagugcagagcaacauuuccccaugagccccaucuuccuuauagccacaguggaccugaaagccccgaaaauaauaccagcgucuccucuuuuccagguaaauugcaaccuuuaagcauuucacuuuauugacaaguguguagaauaaaaggaauggccaaauaacuagauggcccggacaugcauuaacaucccccccuaaaaguacguuuuguggauauaaagcaauauugagcauaaugauccauuauuuauaaauuccaggcgacaccaccuuggauggauaaauucugguagaaauucauaagacaggaacacucauguauuuauuuauuuuuaaaaaaacauuuauagaauaguugaaaacuauugguugaugauuucauuagcaugaugcaaagagaauauauuuaauacacacucugaaguucucuugugggcagaggggagaauuuuaauaaggagccacagaggugaaccuguauggauaauagggaaagaaauaguguguauaccauguacugaagcacauggucaagacggucaaguccaacaguacaggaccucaugcauuuuguacauuuuccucgccaaugacgacucuccccucuguuuugccuagagauauauggagcuauaauagaguucagaaagccccugacagcuaugugcugccauucagaccugggagauuccauguuaugauaaaaauuaauggacucugauauccucugggacucugcaggcucugggaauaucuaaugacgaaauacagccaugccagagagcagcauguguccgggcagucgacgauggguuuguaggugccucccuuaucacccaccagguucaaaguggcugaacuagcaccagugccaaaagggagccagcacggaaugguuagaauugucuccgguguccagagaagaucaaugaagaaaaacacuuuauaaaacaaugaagugggauucagccagacaccuuauugggauuuuucccccugggaauacuuguauucaccacagggaggacaucaauaauagaacacuggaaggauucuacucaaaucuugcuuggugaaccaaugaguuuagcugggguuccuuacaggagcauaggcauuuaucggaggcuagacaauuaaaaaaaaaagucggucaccccauguuuauacccugggggaagggguggagcuuuggaugcucucucacccaauaaccaggaaccacuuaguauccuggggagcguguuagaaccuugagaggccaaacaucagugggugcagcaguuccugggaguucaaguuaggcaaaagccacauagaauauggcaacaugccucucacaacacaagaagacaucaucagucuuagucaaggcuuguauuccugcacgaagcaaguuggggaggaaaggguuuacucagcugacacuuccaucaccaaaggaagucaggacuggaacucaagcaggucaggaagcaggagcugaugcagaggccauggagggauguuacuuacuggcuugcuuccgcuggcuugcucagcuugcuuucuuggacuaccagccuagggauggcaccacccacaaugggcccucccacccgugaucacuaauugagaaaaugcuuacagcuggaucucauggaggcauuuucucaagggaugccuuucucugugauaacuccugcuuaugucaaguugacacacagaaccagccaauaaaacaucuaaucuaccuugggaggaagaggaaaaugacagcaaguaggaagggacaaaaacaaacaauauacaaaagaaaggagcggaagaaacacaguagaugagggccgaagggaggcuaugcugucuucucaccuucauagguacuucuagaagagacaugaauugucauuaagcucaucauauauguauaugcccuccuuccauggaaaugugaagucugaagaaguugcacaaaaaaacgcacacaaucacaagauguagcuguccuuccaucacucagaaggccccagaaggaauagggcauucccaaugaaggccagaauaagcuaggauugauaaguaauagacaacagcagguggcuccugccugucugucugcccagggcucacuugcucauucgcucgcucacucacucgcacacuucccagccacauucuaguucccccugaccaccaauggaagggcuccuuagaacucuugcuacuuccacaccagggagugguuucaccuccguggcuauguuaaaagguuguggaaccuuuagaucuugggaccuaccuggcagacugaggucacugugcauauaggcauuaaagguuauagccaugccugguucuggcucaagccccucuucauggucugucauaaugugagaugcuaugaccacaagcacccaacugcuucaggugcaggcaccccaaccugccuucuaugacauaagacuaccuuuaacuaugagccaaaaugaacccuucauucuuuagcugcuucugucaguaaaaacagcuaccaugagagcccugucccaucguguggggcuagccaucagagccccgucgugcagggcuagcuaggcaagcauccuaggcuuccuugcucugagccccuagagccucuggcagcagaagucauggaggaaugcuggcucaagcugggccgaugcuuagcuaauccuuguauccagagcagcaccaccuguucauggaauggcaccauccagucagcugggccuuccuacaucaaugaacaaucaagcuaauuccucccucuucacccccaaaacgcacacacacacacacacacacacacacacacaccagucugacuugagaaauccaauugcucuccuuucucagaugacucugagcugucaaauugacaaagcuaauaggggcuucuucuuucaauugucuacccaucuaucuauacccaagggccacagggcagaacggcuaaggguggcacugguauauucauguuucuuaaggauuccuagaugguucuauagcagccaaguggaagaauggcugcauccgucucuucagacuuuacagaacgaccguaagcaauccaggcacugcuguccuuugagguuagagacauucugcucacugugacuuccagaagcuaccauuugucaauguaccuguuacacacuccugggacaaccagauauaucuugcugccuguuucuggucaucaguguguggguuaugccaacuugagugugccuaugggcuuguucugagacaagcuagcuagccugucugguaccuuuuucuuaucacgaaucagucggcugcuacacuagagcgccaggucaaguagugaagugaagaacuggggcuacuaauugagaagacccguuugugcuuuugagagacaagguuccgaaucgaugcuuccaaaugaagaauagaaagcacgcacaacacucaaaacagggcggcacaucugcacauggaaucuuccuuggggacuuucgggaggcagcaccggguagcacagccgauugauuucaagugcacauucaaguuuuuagguuaacaagaauuaacuucucaacaacugacugaggaugaaaguugcucccuuguuauucagauguguuuaagcacggugucucaaugugucaguuauguaaacguggaauccugaccugacaaugggguuggaaagaacuguauaaggggaagaacucacauggcauucaugagccacucuaggagcacacggcucaaaaacagaugcuagagugcauucgcgcaggucucacauaaaucuagggcuccucgagugacccaauauuaacacugucauggauuugcugcaaagcuggcaggcuagguggucuccuuaagggucaaagaacagguuucaugggcugagcugugccuggcugguggcaacacaggguccguggccagaucagggagcuucgacucuuugaugcagcuacauugccacagauuccuaggggggcaccuuuaguuuguuugucuaaaauaaucauggcaaguacgauuccuuuuuaaaagcaguuucugaggcuaaauagauggcagagugguuaagaggaccugcugcucuugcagaggacaugaguuuguuucccugcacacaugacaggcagcucacaacugccuauaacuucaguuagaggagccaacccucucugcuagagccuaagagcuccugaaauugugaacagaaaucuccacucccauccucacauauacacauaauuuuuuuaaaaagaucuuuaauggccauuucccaagauguagacacauuccaucuuaacacugcacgaggcacgagggggauaauucguucaagaacacugaaugguagaaaaucggugccuuaaaagucaaguuuggaaaugcagaugguguuagaacccagcaaugggcaaguagagauaguaggaucaagcccggccuggacuaucaaaaacaugguuucaaaaagaggcccccaaauuaacaaacaaaaaaugaauuuucuccaaaugaguccauaugccuucaguuugucauccuccuccccucccauccauccauccauccauccaugcauccauucguccauccauccauccauccauccauccauccaucaacugcucuguacuuaccguaaggcagugauggauacgacagaagacgagaaugagauagacaaagaugaggauucuguacugacugaacaccagacaccaggcggaauauugugagaagaguaugcuaucucacccucucaaugacccuagagugcuuugacugucucuccucauauucauccaugaacugacuugaggaucacaaagacagaguaaccugccaaggucuucauaggcaacagaauaaagacacagaaugaagucagagacaaaucugagaaugaugccucuggucccuggggcuuggugaaacaauagcaaccaaaagucaacacagaaaacaggaaacaucccagaguauugccugggaugacuggguguguuguugaugcucuaagacagugguacucaaccugugggucaugaccccuuugaggagggggugucacauaucagauauuuauauugcgauucacaacagcagcaaaauuacaguuaugaaggagcaacagaauaauguugugguugguguccccauaacacgagggacugugucaaagggucucagcauuaggaagguugagaacagcugaucucagaaaugagcuguugauacagaaguggagcuaaggggaaaggaaggaggugggaggcucuguagaaacccauggucaugcccugcgcagacaggcagguaugagggggcaguaugagguaauggcuagagccagcgugcagagccuagggauguuucuacgagugugagauacagaggcauagguuugggguggggggaaucaauaaagacacaagaaauuagagccggucucugagaccugagcagacaacaucaguaagcauagaggcuguaccucagucagcaggauggcccugagucaguuggagucagagcugaguuugcaugugaauauaaugguucuguuucagagguguacauagcaaaaugacccuuuggucuuccucugucuaccgauaagcaucauuuugaagacagguagggacuggggggaaaugaacacugacauuuggaguaaauguauaccuucaaugguaaaugaaagcaaauagcugccguuucugcuuaaggggacuccaaggagaggcaccuccuaaacauuuggaagaaaauagucuggguaccuuaauugaggggccgagccucugcucugaugggccuguuuaaccuccuuuauagguaacucagcaaaacaaaucuccucucacugauagaaaauuugcuucacaaagcaucaacucugaccuugaggugaccuuaauaaucaucccaguaggcaagggcugucauccauccaauuaaugggacaaaccuccuugggggggcgggggggagaugugcuacacagugcuuuucccaaauaaguuggaucgcucuuauuuuccaaauaguugagguugcugagcuccguggagauuugggguuaagaucuagccucgccuaccagcuauuggcuaggaugaccuuaaagaggauucuuaaaucucuugaccuguaaaauguauuauuuguugaacuggguacaaaugggagacaccguaguucuuuuugccuucugaccccuuagcuguauaagacaaaugacuaagaacugauaaacagcagccaucaccaauaucauucuaugccuucaaguucccacuacagcuucgguucgguaccuuccuuauuuaaugauauucaggguguuaccuggacacaggguguuucccauaaagagguauuucucagaaaaugguacagcauaccauucuacacaaauuccuccuucucccacauaauaaguaucccgaggcagcuuuuacagaaugaugaagcugaccacgaaaagauuagcuuuaugugucugcccuucauaaccagucacgugauucucuauccuaaaaaggggggaacuuguaauagagcugaaauuuaaaucuaaaugcagcugaugucccaaaaccuguuauuuauacuaaaggagggauugugggcuauugucccaugguuaaaauagugugccugcagagaagucuaucuauggaauguuuguagguaaaguuuuauugguguaugcuguucaugguuguucugucaauaaaguuuuauugauacauacugcccacaguucuuuuaacacuaaaguuuuauuggaauacacuacccacggcuguuuccaugcuacaaaggcaaaacugaguucuugcaaagagaguucauucaaaaaguauucacuuucuggcccuuuacaggaaaaugugcugauuccugcuuuauccugcacuaauugacauaggccauuuguuuguuuguuuguuugauacaggauugcuguaugauauucuuuugaaauguauuuuaaugucauguaagaagauuuucaccuaaaaagcuaaguaggaaaaaaaaaaaguaaagauuuuguaagagacgagcuguuaccacccugguguuucuagauauauuaaauggccuguagugugguuucucuguguuuuaagcuggaaaauauauaggguagaagaacaaugaguggguaggcuucgucaaaacgggcaugaaccauuguaacagagaccagaaugaagagcauaagcugcagggaaaaccaggcgcuguguugucuuuccugggguucacacugggcagaaagcaaagcaacaggaccccaccccacccucgacaccccaccccgacccccggugcauggaccaggguggacuucucacauugagcaaagauggaugcagaaaugauggcuaaaacauuacucucagagcugagcuagggggaaaagggaagauuaaucuauaauuuacacauugguauucuggguaauuuaucccucaaaauuuggguuuuauuuuaauaauguauagcccacccacuucuacagauggaaaggagacagaacucuagaauauggauccaagaauauaauaucccggguuagaagcuccgguucugaaagucauccaguggaacguaaaaauaaacaauuuugcuaaagauuuuucuccucaaauguuuaauaaggauagaaaaccuuuauuuuaaccuuuaaauaaaacacaucuuaguaugauuuucuuggugaaauugagccaaauuuauuuaaauuaucccaaagacagaaagcugagacgagaaauagaaacccgugaugaaaaacggcguucuagaaaccuucagaauugcacaacucgauuaauacaaagccucuaucaacugcaguucccucccaggacaaaugaagccccuggccaaugagagcuggcuggcaagggacuccuaggaacccacguccuuuauggcaagccagucucaacuuuuaacacugaagaauuggagcacagccuuccauuuuauuggggacgacagaacucuagugagaaagaacaugcuucuggaacauccuguccuuggaccgacgagcuguuuuaggccccaagaugucggcuuucuauucugguaaaugaagaaguuccagucagauugaaaguggauacgaagcccaucaccaagaagcugaggcuuuggagucugucacaggccaucccgaagaccagccagagugauuaucagagagagacucgccccagcugcuccccacugacagaaacccuugccuacuagcacuguggaggcuggcucccuucccgaauccuaauuuaaacaaaaauaucuucagaaaaaaaaauauagcucugugggaaacugccacagucuuugguugggaacuuuccaguaaugcccagaauaauuuagccugagagauacuggcugaccaccacgaccacuaacucuggggagaaacaucuagaagcagauccagguucccgagcuggccacccagaugaaccggcagcaugcaaacaacuuggggaggcagacugggcaggcggucugcacagaaccccagcagagcggcaauagcaaauggucccacuucuucucugugucuggaugcagacaaucuugggcucaaauucucuaccuaacacaugauucaaagggaaagugacucagacucucgugugcuuggaacuucugauuugguaaacugagugaagauggugagaaccuaggguuacuggaagaggccaacagagugugcgcaugcaugcacaugaguuuugcccagggccuggggagauggcugucaguaaggcagaugcuacacaugcaucugaguuugagcuacacaaacaaaccugaguuugagcccccaggguccauaguaacuaaguuacuuuucuauuauugugcuaagacagcgugaccgaggcaacuuacauuagaacgaguuuuauuuggggcucacaguuucagaggguuagaguccaagaccaugaccaucaggauggggggcauauuggcauggcauggcaggaaggcaggcauggcacuggagcaagagcugagaaguuccaccuuaauucacaagcacaaagcagagaaagcacacugguacuguugggagucuucugacaccucaaagccuuucgcuggugacacaacuucaacuggacaacucaacucguaauccuucccaaauacuucuaccgaggaccaagcauucaaacgggagcccaugggguggggggacauccucacucaaaccaccacacauguggcagccagacagagggagacacaccuauaaucucagaaagcagggauaggaggaauccugagaggccagccgagccaaguggccugcuccgaguucaguacagagacccucugucaaaaaaaauauaacaaacaaacaaacaaacaaaaacaaccaaauaacaacaacacaaacuuaaguggagagguggcugcaggagaccugcuuugucaaccucugcccuccacacacaccaaugugcgugcacacccacacuuacacaggcacacacagagcagggaaagaguucugucugccgccgugcguggaccgaacaaagccuuuggucagccccuacugcuucugcagcggacaccaguccuguucacaccaugacagucuuugccuccccaccccagccuccaaagggaagacauguacgguggcugauucccaggguccccgaggcagagagaggccaguucugcagccuguguggauggcugcauuuucuacuagcauuuugccuuuaccuuccuuccuuccuuccuuccuuccuuccuuccuuccuuccuuccuuccuuccucccucccucccucccucccucccucccucccucccuuccuuccuuccuuccuuccuucuuuuucucuuuuucuuucuuucuuucugauguuauuccagggucuugugugcacacuccgaaaagaucuauuaaaaggagcauaaugggguguccacguggaauguacacagagaggcucuuuggucaaacuugcaccaaaaaagaaaaaaacugguucugaacugaggcuugcuuucauuugucauuauguuuuacacacaaggaaauuuuaaugucugaagauggguggcggugauaagaauggaguuacacauguuuuucuggcagcccggucaccagcacuuaaauucacuugugacagcuccccgauccagagaccguuagcacggagcugucgucugccuuugcaggggaagcuuggguacuggcagucagucaagaggggagaaucgcucacuucuuuauuuacagauuuucagcagggcaguauuucucuaugcggugcgacccuuaugccacucuucgagaugcagagaaagcagaacguggagaggcuugaagggaaagcacccuugggcccgaacaaucgaguacuggaaaaaucaaagacuaagugugaaauggguggucuugcccuccgagagagucugggucagcgacugcaaagggcccucaagcaugauaguuucugaacuccuuacuggauaaaaauguaaugacugcuuugagggauggaggacggggcugcgaucaagcugucagcucucuucagccgagacgcucacuucaguacccaaucaggacagugcaaauaggggaggaaggaagcguaagaauggacgggauguuccuuuggccaucaacuccugggugacccuaauaaucucacuaguucucugaguacaagucccuauuaccuuuacaacaaaagacagcaucgcagaggaguuaggagggaucguggugcgaugggcacauagcagcuugcccccaccaccuaccaaaugcugacuauacaucucuucccuuaccuuucuagccucacuuuucucaucuguguaauggacauagucacucccaccaugaaagaaugcuuucagaucugaaccagaaggcgagaguaaaguguccuaaaugugugugccuggcuggaccccccaaaaugagcuguaacuucugcugcugggauuguuaguaauuuugucccucaacaaccacaggcauauugggaugaggauuuggcgacaguaauaaaacacagcuucuagaacggaggcuguggcuugucugaggucgcuugacucccgcuggccagcacugucuucccagaagaauggcugggaguuuggaagugcucagcaaaugccugguaaguaaacggacaaaugacggaggacgggaugaauaaacaaaugugcaagccgaugcuauuccuggcuuccagccccucagagagcucuugcaagagagggcugccacuaaggacgcggcaccagaaagagcacauagugagacucacacuucugaugggcaagacuggagggggugguggaucuagcugugccugugagccaccaaauggucuucacauggcagcaauaaaagcaccuggaccaggaugcucuguccauggggcgcagaccacuugcuugcuaagcaaagaucaaaugcugugauggucuaaaggaucagaauggagucagcacuagaaaccagguaacaccauagcauuugaauaccccacaccucucaucaucucaggggaugucagcguggccucaucugagcccuaaccaucuuaggcucgcuggacucccucacaacacuguuuucccccuuggcaccaccugggcuaggauuaaccuaauccucacgcucucaucaccucauuggaaaauaaaauuaagcuuaguuauuuauuaaugaaacugaagccacugugguaaaugagacagcggugcugcuuggcccuauagaggcaaccaugaaaauaaacccuggaaacaaaauacuguaauuguaacauagcuagccgccacugcuuucauuagaguggagacugggucuccacuucaugcccuuccucuccuccucccuucuuucuuucucuucuucauuucccuucucuucuuucucuguagggaggggaggcagcuggagggcaacaguauauagggcccaaccccacccccauccccacccccacugcaccuccacuaaggggaucugaggaguuggugaagaacguucccucauuuccaaugucagcugaugcaguggguguaagauccaaccaggacuguggguucccaggaguuggaaaaggcuggaaagucuuacaagccccaucugugaccagagcuguauccacaccccaugucugagcaucaaaggcuuacagagcaccagaagacagcauguucaggguuucagccccauuaguacagaguaagugagcuugucggaugcccuugagguacgcucuuccucgauucugauagauacgcaaugcguuucuaacaaggcgcaucugaaaacugcccuggugugcaucagcccuacaaguuuuaauaaugccuucgcaucuugcuuuuuggucugggaagcuguuauuagauugaugacacaucucaugaggagggugacucagagucaagaaaaaauacgguccaccuuaaccguacauauaaaugagccucuggugccaagacagcacuacagucuuguguucucccggugguguucaucugauaaagacauuacaauaggaaggaauugugauguaugacccccgaacuggaacacucacacauucuuggccuugaaugcuucggcaaaaugcugcacgcuacggagcacggccagguccagggucauugcuuccaccuuggcuuugugcugcaaugaaaggaaauaagaaagaaaugauaaauaacagcaagaaugguucgugguaucaaguuacaguaaaugcguuauggaacaugucggaauuccccuguuuaauauuagaagcccagagagacuauacaucaccagaaugaauggaagaacacagcuuuuacugccaaguccggggagcaugggagggacucagcuggaucucuaggcugggguuacacauggcuucacucagcacacggaagaggcuccaaggugucuucuagcucaugguaucauuaaauaugugcuccaaagagcagcaucuacuaggggguggguaggccacaagagcaagccuggccacgaugcaauggacaguucuaaucucaaaagacucaacccagguuaugaaaucugucaacugagcuugcaucacccuuaaagacaauccagccaggggcgguggcauacacuuacaauccugagugagauuaaggucaaaugaggcagccuggugagaagcugcucuaacucgaaauaaauaaagagcaggguuggggagauagaugaucaguuaggaaauuucuugccaugcaagcaagaggauguuaguuugauuacuauaaccuauguaugauuacaaaccaggugugguagcacaugcucucaauccaagaacuagaaaggcggaggcaggaggaugucugggacuugcugaucagcuuguguugucuacucagaagcuccaagccagugaaagaccugccauuaaaaauaacagcagcaaagggcuggggagauggcucagcaguuaagagcacuuguugcucuucucaaagaccagaguuugguucucagcacucauguugggaagcucacaacuacauguaacuccagcuccagaggaccugauacucuuuucuggccuccaaagauacucacuugcacuucaagugcacgugcgcauguaugcaugcauguaugcaugcaugugggcacacacacacacacacacacacacacacacacacacacacacacacaauaaaucuguaaaaaauacugagugguagggaauauuuccaucucuguugcaggguggcaucuuaauagacugcagaaaugauaauucagucccacacuuuucuauuuacuuguguuuauccaauagguaaggauucugcuagguacacagaaucuguugacaggugacuuguacucccccacguucuuguucaugauaaacacuuaagugcuugaucagaccuuuaaacaagcagauaaaccgucagccccugcccaccccagccccuaacucccaugcaucccaucucccuuuugcccagggcaagguaaucauugagauacacagaauccuauagaaaugugacuauuuacaaagaaaaaucaggcauucauuaaaaucgucaugccuugcuggaaaccccaaaggauaugcaugcuacacauuaugaaaauacauguacauauuuucccccauaaaacagggauaacauucccagauggugaccccaaaucaauccaaugaaaccaauggccgagccaagugacccacacauuacucuccguguguaacugaaaaucguuaggucaucuuuugguccccauccccucacacacacuuuuauucuucaaaauauacugcugagcugccauugcuaauaagaacaaauccaggacauauauauccagggggagugagaggucgccccacuaaucuguaagcugcagguuacucggcuccuggggacagagacuccaguccucacaggaagauucagaggucucugccauggguaucagguuucuugcuucugaaaaacugugugcaacucagugaggucuugggggugggaggaagagugugccuuugggaauuagaguagggguguguguccacuccucugcuggggaggaaguuugcccuccugguugccuagcaaacuucgcagcuucaucaaaaugaugacuguggcuugcauucuaacugggaauggagucgccugguagagcgacagcagauggaacucauuucugaaggguggagcuguggguuaucaggggagggaaggcagggugcccaaccugccagugugagauuuccugccuagauugguggugacugucagugauugaucuagggugggccacgugucacugagcagguguaaugcauaugcuuuuauuugggaguagugacagagucacagaaaaggucaaaacuaguauagaaggucucuccauccagcuccccauaguggugcuaucacacuagugauaguacaugaccauaaccuaaaaaucucagcacucucaauacuacaauuuauuauuauuucacagucauuauaguugucuguuuuguuuuuuguuuucuguuuucuguuuuuuguuuguuuuuguuuuucucucucuuuaccaguuuggagauauauucauuuucuuuccuuugauuggucuauauuugugucaaauuaugugacguuuccuuuuguguguguugcuugcuuuuuuugugugaacuugacauaagcuaaggucagcugggaaaaggaaacaauuacugagaaaaugucuccaucagacuggccuaugggcauuuucuugauuacugauugauguggaaaaguccagcccacugugggcggagccauccccugggcaggugauccugggugcauaagaaaggaagcugagcaagacaguaugcacacucccccaugauuuaagcuucaguuccugccuccagauuacugcccugcuugaguuccugccuugccuaccaucagcaauggacuguaaucaagacauguaagucaaauuaaaucccuuccuuccaaaguugccuuugugucuucaucacagcaauagaaaacaagagaacaagguaacaauucauacaaucaucuccauauucaagauuuggaaaugacccaucacgcauauaaaaaggaaaccaaaaacauuacuuuuguuaacaaguggcugaguuagcacgcuucaucuagaacaugaaaagccuuauuuggccaaagcccggucucuacuuuggcaaaauaucuuugaaaaaaaaaaaaacaaacccuuuugcaauucagauggaccagcaaaaucuccaaauuccuuagcauauccagcaaggucuucucuaucggucaucaagggcuguagggaacaggcccugaaucagcacauuauaacacagcaacaaacccuucacugcucacauuuagcaaagccagguucaucuuugucaugauggugccuccacagcaggcagugcaaugggcuacacacaagaucucaagaggcuuccacuggacaguggaggauauugcuuacaaucacaccucauugacggaaaagugguuacaagauguaauacaguguaaaucucgugugcccugggggagaauggugauccaggaugaggauggagauggcagacaugaaacucacgucugucuaacuccccaaucuugcuucaaacucacuucgauucuagaaaauauuuuaacaaguaugaugaacauaauaaacaugcaauaaacaugcaggaccaguacccacagccagauguggagucaaaugcaguaagcccaguacuccgaggaggcugaggcugaggcaggaggacugugugcaaaacgucagaccugacuacaaagcaguagcauagaagcuggaggagauggggagauggauggaaggguggggggagggagggaggggggagggagggagggaagaagggaggggaguggggagaaaggauaggagaggggggaggggaaggagaggggggaggggaaggagaagggaggggaggggagggaagucuuccauagguuccauauuuauguacauucugaccauuuuaccuaccuaucaaucuuuggucaacagaaagaacuccaugcuaagaauaugcaaugccucacuuccccaaaucuuuacuguuucacauaaucagaccacuaugcaaguuggcuucuguggcaaaaucgagauguuaauugauuauaaauuauacauacagcuucuccuuccccacauguuaaagcugaaccacccaggggggcauccacuacaugauggaaacuccaagagcgcuaagaagccugcuugucccaauacguggggcucaaccagggagaucauucaagagcccacgcucuccuccccuguuucucugagauagagguggugucgaaguggaaagacacaccuucaggauacaagccuucuuuucugcucacugugacaugcuagaaccugugcccacgaaucaugaggcuguccacguagacacgaauggacugcugguggcuguuacgccacagugcucugguacuucaugaguauaaaucagccaaguguggcucacaugugauacugccuaaaaccagggcgagcagauggggagcagcaugagguauuuagauagcaagcuggaaacaugaugucacuuucaacagagaagccagagccaggcugaccuggauucacagcucagugagaccacacagcacugacaacagaacucagagcagcgcugggccucaggcugccuugacuugagaaucugcauaaaugguacuugccuuuugagacggggaaacaagucuauuacguaugcaagccaugguacaagaccaucagaaaaugcuaccaccgugaacuugaagacaacuguucaagcacacugcccacugguuuucaauaacaaucuguagcaugauggugacuauagacuucuuuugcuaaucuuaacucugauaacuaucauggggaagaauucaacagcaccugcaugaaggcugagacaugauuugagacucugggggaagccacugaaccuccccuaagucacaaacacaugccuuuccgagcccagucaauguauguuccuaauaguaaaggguuugauuauaccauggaucaagccaccagaaugcugggaaaaauauuucucccgaggcauccggcuuucuccuugguaaugugggaaugauagcagcuguuuauuggggacugagguuguaaaguagaauggaacccauccagagaaacgggcugugagcauagaucaccacugagaaacggcucacgaaugugagucaccacgguggcugugcacugcucucuugucucccucaggauggcuucaccucucacugacaagaacggguccucacuggccaacgacagcaaucucaagaagcugcccauaagcccaggcccugguguaucugucucuccugacagccaucuacccauguccacagagaagaagaagucugugacuucacccagauagggccacuguccauacuaaguggagauuucccucccuuuugcuucuauagcccacaguguccaugcaacccaccucuuuccucugguccacuaccaggucccuggccugguucguggccccugcuaacaacugaggccaagcucaccaucaucaaauagacaaagcaggguguuguaagcugcacugccacuaagggagacaccauucaucccucucuuccaugcauucagucuuuaacacugccucggaaggugcuaaagauuccccacgaaguccaucuccugggccucucucuucagugcagcacaucagaggaaguccugcccacucagagucugcuuacccagggaggcagacaaaagacgugccccauaaaauaaaaucuuagaagugaaacagaaauaauuccaggaagcugagcacaguggcucauccaauaaucccaacacuggggaggcucaugcuggaagcuucuucucaugagcucgagaccagacuggaccacauuguaaaacccuggcucaaaaaaguaagaaaacauuuugugaucaaaccuaccuaaaaggauagcagucaaaaacgaaaaaaauaaaaaaauaaaauaaaauaaaacaaauuaaacaaacacacacacacaaaaaaaaaccaagccaaaccaaccaaacaagacaauagucaaaaacaaaacauauggggguaggggaucaaaaucaaccaaacaaacaaacaaaaaagacagcagacauucuuacagcaugagcaguauuugguguguuggccuagccugggggaagggcgugccacacauuauccuuguauuucauaggcucugcacucuccauucaucuggaccaaaggauucugacucauacucuggccugcaugaucaacacaccaaaugcugcagaagacagcagcucuccacugguaugauuuguuaaaaccaccaucaugguaagagucaagaggagggcaacaagggaugacuccuguggucagucgagcugagguggaaagagagaacuaacucccacuguccuccgaccuucacaccuguacugugacaacccugaacaaaugcacaaaaaaaugcuguuaaaaacauaaaacaacaggagugcuuagggcuauggcagacaauggauggagauauacggaggccuccaguggccucacagagcugggccucuaacaugcccagaguguucuguccauugugggccacacuuccugucuuguugagugaugauuugaaugagaauggcccccacaggcucugaggaaguccauauuugaaaggaguaggagguguggucuuguuggaguggguauggccuuguuggaggaagugugucaauggggguggguuuugagguuucaaaagccaaagccaagcccaguaucucucucucucucucucucucucucucucucucucucucucucucucucucccugcugccagauggaguucucuuccagauggaaaacucucagcuccucuccaucaccacaucugccugcacacggucauucuccccuaugacaguaauggacucacucucugaagcuguuugccagcccgaauuaaaugcuuuccuuuauagaagugucugaggucauggcgacucuucacagcaaugggauacugacuaugacaagagggaaagaacaacuuugcaguauugcuucgagguggcggcagaguugguaguucugcccaccccacuccugggagaacagggagaguuuguuucuggauccuuguaaaagaaacacgcguguaaagauaccaacuugacaauaaaagcagcaagaguagcaaccagacacagucccugcugcucuuacauuugacagggaggugaaaaucccuaugcaguguauguuaacgugcacaguuuauauagaugacaaaacaaagucuggugaacuucgaagaggcacagugggaaugggcaggugacagcuaagauaggggacaccacacagcaaucuggcccugcuuccuuucaacacacagcuuggggaagcuaccaagaaauuaacaacacccauauauucucauucgagucuacuuuauauuguauuuauuuuacacacuuagaauuuauaagagcaucguuauugcugggagagaaaaaaaaaacccacuguaagcaaagcuauaaucuacauucagagcuuauugcuaauggcaucuugcaaauucuaauccaaugggccuuaauugcauuaugcugacggcucucgcccuucuuuacagacucucaguccugguuuuauguucugcaaccuuaaauaggacuugucacauuuacaauggcaagggauacuggugccgagcauauuauugacaugacauuauucacagaacuacaaucagcaucuaaccaaaccagauuaauaauucaccgauauucuaucuaaacaggacuuuggaucaccgauuuuuuuuuuccaguauuguuuaaggauguuaaugguggcaaagaauggcagucuuaccacugggaaauguaugaggaaaaaauaagcuugaauugauuugugaugucugaagcucucaggugggugaguccagucgagcaucaggaguagccuugguggggagucagccugaucuaagacaggcuuaaaaguacaaaccagaugccaauaaaugugcucuccaacagccaggagaggaagcauguagcaucucuucccugacccuauacauuuuaacuacucuauacaguauguggcuucccauuugcccugguuauuugagagagggucuugccauguggcccaugcuugcuuuaaaaguaggcuccucccacccuggccucccuaguuccggauuacaggcaagcagcaccauagccaucggucuauuuugcuucuaauaagaaaaugcucgggccugggggugggggcacucucaugaugauugcacacuuugaaacugggaaguaacccaaaacgauccuuggcagaacccuggauuucucuucaaaucuugaaggagagcggcugaaucugucauuucuaaccuugaaaccaaccaucacaaucaacucucauucccaggcuccccauaaacacccacgcguccccccugccaaaauacacaaacauccuuaaugagaaaaccaugacaacucccucuucacuguguacaggccagagcauuucacuuuccguuacuggagcgcagcuuauaaaauaacucuaucaaugcccuauagauaauugcaagaagaacucacgcuggagagcacuguauuuaauuugguauugaguuaagaguuauguaaaagcaaaacuauuaaaaaugcuuagacaguaauuggcaauauuucuggauuuuuuaaaaaugcuuaucuugccagaaacuaacaaaaguguagaaaauauuccaaagccuuccaauuucccucucggugauguagucacuuugaagcuucgaaacaguuuagggcagggcacugaguggccugugaguuuggcaggcaacacgagggugcauuuacgcuuugcaauugaagaaagagccuuguuuucccccccccacugugaauguuucauucuaaugugagugaugauuuacguuaacucuagguaaaacaugguuacauuccugaaggauugcaggcaaguacagagucguacaauaaguugaagcauaaaagcuuucucugucauaauauuuauuauaauggcauauaaaauagcugagauaaauaauggaugacugaagguaaauucauaugauaaagacuccuucagcagacaccauuacuuuggacuggucuagcuuuauacacaguugaagagucuuaauaaacacgcccuauaucuucuguaaguacugggagcaucaaagaguugcuuaaaaggcagcauacuggacauuuggcuaauuuacuguauaauuauuuucucaacaggagcgagcggucuauauauuuugcauagcugaguucuuaaugaaaguuguuaagcaucggaacccccuaccuugaggaauuuucugguaggagggacaaaggucaguaccuucacccuagucuaaguucagaaagaggugcacaguucccaccagaguucuggggcucaucggcuaccuaguggcaggccaacagugaagaaguugauuggaaagacaacaaucaagacuugucugccaugguuuagacaaccuuauaccuugcccgaagaauuuucaagguuagaagauccugaaaugggagaaccaucucccuuccagacagugauggaugcaaaugauugucaucugaccacagaucuugaucagggacccgucuauguaugcccugagcauccagcaauguccauggguauuucugguugucacaauuuugaagaggcggacugguaccuggggauagaagcugugaugcagcaagcaucccauaaggcacgagucugccgcacgggacaaagaagcuucuggcucccagggccagcaacaccaagguucagugcagguuuggugagagucuucaacugcuuaaaaguaccuuagugcuuacaaagguagugcauuucccagcacucacauggcagcuuacaacuaucugugacugcgguuccaggggaucugaugcccucacaccaaugcauuauauauauauauauauucaaauaaauuuuuaaaagguacguguaaucuaauaccugcucaucucaaacucugucagaauguauguuucuacauauauaaagguagucugugacuuuccuuacuaaugaagggguguggcacagcacuguucacagcuuugcuguucucagucgauaacugaccaugucagagugcacaauuccacccucguucuuuucaauccacaugugguaacaagggugaguaccuacuuaauagcuugggaacuugugucugucugucugucugugucagucugccugcugccccagccccauccccauauauguaugacagaggucuaugccaagugucuugcaaucuccagagacccucgugucaccacacccucuccuugccagcccuggacauaucacaaugcugacuuuguuuguuuguuuacuuacuuauuuacuuauucauucauuauuuauugaguacuagagaucugaacuaaggucaacuuagugacagggcaaucuccuugaccccugaauuuuuaaauuaaauucuccaugccuucccucacuccucuguaaacauacaaacaucagaacucaucuggagaguuacugugaagacucaaguauguggcauguaugaagauggccuugauaauuucaaguguuaaauagacaacgaguaccuugcuguaugugcuagcuguuguguuugucaagaacgaugugauccuguuucucguuucuuccggugaaagcaaugcuguaguagacacgcauagcauuaugcaagcccaucccaccucaggaaaugucuugaguagaagccuuaggucagagguuuuguugggugucuuccaaagagguacuagcagcuuccaucccuacaaacacuaaaggaggggcucugagagaaacucaaacauccaauaacccauguugacacagagcguaaacuaaaagcuacaguguuauaucuuuaccugauguuugauauaccaucaguggcacggggccgguuuucaggaccggcuugacuuuugagaaugaaugaaugaauggaggaaugaaugaauggaggaaugaaugaaugagcauauaauauaguaccacagaugaggugguaucaagaggcagaacuaaaacguagcugaugaugcuggcuguagccauuucccacuuuucccacagcccuccgauaauccagccucuccugaguguuucgggcuggcuggaugagggcuggcaucucugagguuguucacccugcauggugauggauaaggcuugggcaugcagggugugauguaaacauggcaugguaucauuacgcuggaggaguugccacggcaguuauuuuaaguuuacagauagagccaaagagacagaucgugcagaauuucugcagaagcaaggcagagauucuaaaagauaaacuaggagagacugaaaaucaggauuccgaaagaaauaagguuuccugcuuaaaacugcaucgccccagcagccuuuuaaaggaccccaccaaaacacucccaagacagaggacuccagugcuuaaaacaacccucgugugaaaggagaguuugaggucagguuaucgccaagauaugcaccuccuuuagaugagugaugagaucagauaaauuacgcucaaaaaacaaggugggugaggaagagaaauaacgugaaaaggggaauuugcuuuguggagaggagaauuuucacugaacuguuaaaucaccagguccaaacuugcugugaucagaaugauggagccgucaaaugacuguguauaguguaagagaagacuuagauguuuauguuuaaauuccaagaguaauagaagaaggggagagaaaggaaagagccuuuaccuucugcaucaacacggaaagucugaugcagggagugccaggauacacaguuuuauuacucccagauagauccaaauaauaguagagaaaggaaacgucauagagaagaaaugcagaaauaaggacagguauguuaggagucacaagaauuagagaagauuucaauucaugugcgaaaaggcagaaggcaacacaaaucagcucugcauuuuauucagaauauacaccacauguagagagugagcugggccccaggaccagucuucuucuccacagggagggauugguguaaagagggugguuggaacugugccaccauauccucagccaguagugcggggagggugaggcaggcagguuuuugcuaagagcaaaucgugaccuaacccucacaugaacuggguuccucaagucaaauuucuccuaccuuaaaacgcauauggagugcagugggauccuauagaaaccagacucaucaacagaccaaaaccagcuguccaucagagacacacaugggaaggaugccugggccaguuaguuacuggcauucucuauccauucucuguuguaacuuggucaaaguucuaggagacaucuggaaugccagugugcauagguugugcccuggugucaucaggaaagagaugugccggggagaaagcagguuauucaacuugcgaagcagaaaugaaagccaagguuugcagagcugaaagccagacagcguggacucagccaggaaaagucuuugagagacaguugcccauuauaagcuuggaguuaacucgaauaaauucaccccgguagcauacaucagauuagugaugcugcuuuucagaucaaguccauuacuccaaaaagccugaaggaguugauacugaggagaaaaaagaaggaagggaagaaaagaagggaugauggggagaaaaugaagaguuguagaaagacuuuagaaguagcgacgaaacuaugcacggacugagaacaaacagaucugacucauauuaacaaguaaucguacuuaguuuuuaaaaaauuaguccugccuuaaaacucuauuccaagucccgacucuguacugggcaggguaugacuucaguaacugugacuaaagucccaguucugauggggccaacaggaugagccacaagacacuuccccugaggaguaggugcaaauugcuccugcugcuaagaccugcaccagccacugcaggauucgaucacagacugugacuggcaucgccuucucuuugcaaaauaggaccagaucccgcugacaguaugacguucuccaugucuguugcucaaaguggaaauaagggugggcaugauuuuuaacuucauaggagccaugugugaacaugaagacccccugccuuagagggaaaagaauuaauguaccuuuugugugugaggaaggaaucaaaaaguccauccccgggugugaagacuggaaaacagcauuccgguggccuaccaaaucuugaugucauauuucaaagguccucaguuugacugacuacccagggcccuccaggaucaagcacagcaacaaacuuacagucagcaaucagaauaucaauaaguggggcaugcuccuucaggacccuccaaccugaguauauacauucccgguacuucuuauccaccuccaaccagugggaauuuaggaaauacuguaauauaacuuacaaagaaaccaacacugcaugaaacuaugagcauauuaaaaacuagguggaaauacuuaguugggagggggcuugccuuaaaugugucgggcacuggguucaaaccccaguguuguagcaaacaagcacacuggaaacuauuuguucuagccacucucgucaccuaacaaagcuacaugaguaaaacaaauaccaaaaggcugaaaauaaagaggucaagggaaaaauacugacaaauccuuuaaacccguaagagcucauccagcaauauuacauaaaaguccaauauuaagcaaaaaaaaaaaaaaaaaaaaaaaaacagucgcuggagaugaaaagggacagugugcaaagacagagacaauuagucaagaaaacucaugaacgcgcacgugucaagcacauagccuuaaaccagggaagaaucugacacccuuugaaggcuuuuaccauucacauuagagauggaaagauaaaguagauaaaacagagccccaagaccaaacagcuaacaaggcugaugacgcaaaagagcccuaagcacacacuuuucaauuacacgguaguucugaaauuaacccugagccagagcacaaaggcaaugucaacauauucaaaucaccucugucgcuuaggccacauggucuugccucaaguagggaggcuggagagagcaggguggaaauggauacccagagguagagagguuggagcaaggggacagagguggaaggaagucuccuggccccacugugucucauucaguuaaaaccuggaaauaaauggcaggagagcacugggcauuggugagcugaguuccaugggcuggcuggccccuuuuauucagagcagagcacccagauguaugaaagaugacgguaacuauagcuaauaugauuaauaauaguuuaaaaacugaaaauaacugagagacaaaggaaagaaagagaggaggucagagauucagggagcgagcagccuucuaaacacuguugaacgugggaagcagacagcacauuugaagauguuggccauuuuggacuggggcuguagcuggaggagaaaguguuuaguuagcaugcucaaggccauggguucaaucccggaucugccccccccccaaaaaaaacccaaaacucaucuaaaauaaaaagucagaucacgugugcugaugcauguucguaaucucagcucucggcaggaagaggcaguagguucagaagaucaaggccuucucagcuccauagcaucacagcuccacaguaucaaagcuacacaguaucucagcuccacaguaucacagcuacacaguaucucagcuccauagcaucacagcuacacaguaucaaagcuacacaguaucucagcuccauagcaucaagcuacacaguaucacagcuccacaguaucacagcuacacaguaucacagcuacacaguaucucagcuccacaguaucacagcuacacaguaucauagcuccauaguaucacagcuacacaguaucacagcuauacaguaucucagcuccacaguaucacagcuccacaguaucgcagcuccacaguaucacagcuccacaguaucgcagcucuacaguaucacagcuacacaguaucacagcuccauaguaucacagcuacacaguaucacagcuacacaguaucgcagcuccacaguaucacagcuccacaguaucacagcuccauaguaucacagcuacacaguaucacagcuacacaguaucacagcuccauaguaucacagcuacacaguaucacagcuacacaguaucacagcuacacaguaucacagcuacacaguaucacagcuccauaguaucacagcuacacaguaucacagcuacacaguaucacagcuccauaguaucacagcuacacaguaucacagcuacacaguaucgcagcuccacaguaucgcagcuccacaguaucacagcuacacaguaucgcagcuccauaguaucgcagcuacacaguaucacagcuacacagcaucacagcuccacaguaucacagcuacacaguaucacagcuacacaguaucacagcuacacaguaucacagcuacauaguaacuuuagaauagccugugcugcaaaagacucugccucggaaaggcaacacaaaguaggaaacauuggaucuccagcaguaccuugucuaagaauuagaagcaaaaaacagagagagagcaaagagugugugugugugugugugugugugugugugugugugugugagagagagagagagagagagagggagagagagagagagagagagagaauagucaggaaaacuauaaaaggcuuauaagaaagaacaacaucaacaucagcagcacacgaggcuacaagacccaugaaagaaugaaacucacauugaagaggauaaagaacagaauuuagcucagagguaaccaggaccggaaacucugcucuggguuacaaacaggggcugcacccacagaguuuucuaccagagcagcgagugcucaggaaaagggaccuggauuuggauccaggacccauuugguggcucacaaccaccuguaacuccaauuccugggcacccaucguuccugacccucuuaggcacccgaauguaugcgcacauaaacucacgcacacauacauaauugaaaauaagaauuuccuuaacuuuuuaaaaaaaguaaucagcuauaaaaaaaaaagaaaccaaaguguuuguuccacaacagagagugaggaagaaaaaguguaaaaaaaauaaaaaauaaaaaauaaacaaugcugcaaaugcaaagauuaaagauacaauuguaucugaagaauuguagauacuguuuugaggcagagggcaggaucaucaaauauggcauuuaaacguuaaaaaugaacacuauagauacaggcaaacucccccucccccacaggguauuaccuccucacauccuuccccuuuucuucccugccaaagcucaucuguucgugacauucauccaagcgacaauagucaaugaugaccuaucaccuaguaccaaccaccugcaaggcuuggaucuagacacaguuacaugcaaacccacagaaagcccuugcagaugccacgaagcgaugauguuaucuucugacuagaaaaugacguggggugagguaauuaaaaaaaaaaaaaaacaaaacucaauggagacggcaaagaugucuuguggccaacuguucuguacagagauguuacauucugacguuaaaggcuaucacuauauggggcucuguccuuaagcagugucuccuuuguuuuaacgagcuauguuuaacuggauuucugaaccggcugacuugugcucccucugagagugacccuuuuggguaaaugacccauaggaggguggauaauuuucaccucuuugggcuuucuccugagaaaaacacugaacuggguguugucguucgguuagcgggucagcucuccucuccuguggcugggugcagucguucaggggucagguaagauguccucuccuguggcgugugacaggccugcuucucgacacuucauuguuaaauucagggaggcgauugauuucuaugccaucuggaauagagcucuucauaaguggcucuggggcggcauuucaugaacucuuccucuuccuaccucauagucuucgcauauaaaacauacuuugaauauucaguuuugaagucucgacuuuccaauguaguacuuuuugaugacuuugaugugguuguggacaaugcccaggaugcuguaugguacagugcuguuaacucgagccggccaacucuccacaauaaugguaucccuacagcugggauggguuaacagaaaggcaggauaaaggaagaacaaagguaaggaagagugaggagggaagggaagaccgagagaaugagagaggcugagaaacccuaagaaaaggaggggaggggagaagagggagggaccggggguuaaguuggccucuaggugucugagacuuuccaaccaccuagcaagggcuacguuaggaaaccaaguuugcacaaggugcugcaugcaggaaggcugucuggggcaccaacaaagacagaaggcccaggagaggcaagggaggggccuuccguucagcucuggaagcacgcuggcaagggcuuggcuuguucauaccucgcuuguucuggagucuugucucucauugacuagucaaaugggaugaauggaucauguaggauucuguuaaaagccugcuaaguuauagacuacauguuuucugaagagcacccuagacagcuuagcacagggaggggauguggggggacaccaccuuauaaauguccauuagaaagccacuucagaguggcuuugcacgggugcacacacucacggguucuucaauauuuauaagcagccucuucgcucuccccuuggcuggaucagacauacacucuucgugggaagaagaacacccccacuccuagacacacagggcagcccggagcuguccaccuuaaacucuggcuugguacaugugguaccuaaagaaaaccaaagaaaacagccaggcccgcugugccgcccuccucuggggcucgagguuuuuaauucauacccgggugaauuaaaagauguucucuucauaccagaacuuucuucuuagaucuuuauauaugucugcgcauagcaugcauacagugcuaguagaggcuagaggaggguaucagauucccugggacuaggcuuugaacugccacuuggguacggguacuaggaaauguacccagguccuuuagaagcacagucagugagcuuaaccacugagcccacauucauucuccucucucucucucucucucucucucucucucucucucucucucucucucucuuucucucuccaauccccuucauuguuucuuucuauuuuguucauaacauuaaauuacagcuuugugguggagggucggggagcuaaccucaaaugcucuccugcuuccaacccccaagcuguggguuaaccaaguuggauaacggagacucacacuagaauguaauuccaugugugcagaaggaaaggaccuggccuaauuaugugcucacuauaauuuggugggacagaguuggguuuuguuguuguuuuugguuguuauuuauuuauuuauuuauuuaucuauuuauuuuuuguuuccucugaauggccaucguacucgaucacaggucagcaaauuauuuucucugaaguauucuaaaccuucuagugggcuacacugccucucccaacuauuuagcaccaaguagcaugcauacaaaaagcagacaugggcaaugagugagugggcaaagccucaauaaaacuuuauuuacaagcauaguuacagggcuggauuucuucgcaucccuguuauagagcuagauuuuuuuuuuuaaaacagucuucauaagcugucugauguuggucaaugcugugauuaguauuuuauaugcagauguuuacuagcagauauuugacguuuuaccauaccggcuacugauaaagagagcaaccauucacaaucccaaaaagugagcagaacuagggauguucuaagggguugguuugugagcauauuauaaaauuucaccaugcacaaggggucuucuauucccugagguaacacuucuggagccuggguaacuuacgaauacccacagcuuguggcucccucaguuucuucuuaaaugugaacuuuuuagaaauauauguuagcaucucuaaagauuuggaaaaacgugccaaaugagugagguacaugcauauugccagccccaucuuaggucccugaccugaugagacauucuuauccuauuaaugugccucuaugcauuaaaaaaaaaaagaacaaaauaauauaccuaggaacuucuuccugaaaagaaacuuugcuuucccuguuuuacuacagagaaaagaguugcagaaagauucaggaguuggguggguagaagagauaugaaagaaaaggcaagaaaaugaagaaaugugcugggggaugcuauccaguaauggaacaugugcucaagaggcaugaggcacugggucugguugcuagcgcugcaagaaaacagccacaaacagaaaaaguacaaaaacccaaaaagaaaaagucaggagccauguuuuccaugucuagaaaucuuuuuucugauccaagugccaauuagcagauaagaagcaauugacagccugcggucacuccacaaagcauuaagaauuacuuggggacuggaagagauggcccagugauuaagaacacuggcagcucuugcagaggaccaagguucaguucccagcgcccccaugguggcucacagccauuuggaacuccaguuccuaggauuugaugccuucucuggcaagcacggggaccagccauucacacggugugcauaaagacaguaaggcaagcguuccuacacauacagugaaauaaauacauucuagaagagagagaggaggaaggaaggaaggaaggaauaaaggagggagggagggagggagggagggagggagggagggagggaaggaagagagcaagggaagggagggagggagggagggaaaaaauaaguaauggccccaguauccuuuagggaauuccugccauccaacgguuagagauaaaucuggagcuugcagcaagaaagagaauuucuuugucauugguggagaaauguaaagaaacccugcaguccuacccucuuuccaugaaccaagccuaccuggaaaccacaacuugccccaugccagcccuccccaccccgcccuucucuucucuucucucccucucucccccucucccccucucucccuuucuacauuccugggagacagacccaggacucagcucacgcuagauguagaugaugaagcuucugcccucucuaagcuccagcccaucuucagaaugacaguuucccacaggcugaaggugagaugcgccucaucgacagggcgguaaauauuucuggacaaauagaaaagcagugccuagagcacuggaaucucccaaggaacaccuucaaucguggcaacgaccagagguaacgaucccacacucaauccccagcucgcgcacagcuacagcacuccacguucacacgucccuuuauccauagcaccuuuaagaaguagauguucagcaucuccauuuuguaaaugagaagauggaaaaaaaaagcccccaaacuagguaggguucauaaagcagaugaagaacuugaacucgagccaaguccaucucaaagcaucacugugucccauccgcagcaaacacgcgccgugacuuugauggugggaagaaagaagaaagguugaaagaucugcgaagccgggcgggcagagaugggaucucaggcaccuacacagacugcaaauggggguuagggaugggaaaaacccagaaaggacccaaaugagugucauguguagagaaauacagagggggaaaaagucauuuccuggcuccccuaagaucuacagcacgugcucugcuguucccgggaagugcagacauauacaggguagcacauuaauccuucaaacacuaacagaugcuggcagggauuuagacuggaauguauuuacaaagugacaaauuauguucuguauuagagagagagagaaagagcacccacaaacgggcugauaaaugucagcuacagucacgacaaaugguuuauuuuuauuauacuguaaccacaaauguuuuuuuuuuuccucccuauuuuuuuuucucuaggagucccaaagauuuauuuguugcagggaaaaaacaagauuauauaugacacaaaguaauaacuguacgaucagauauuccgggcacccugcccuuuuagaaagcuucauccaggcagcccggugcuacuaaaaacgcuacuuucgcccaggcagaguaaaugguuaauaaaucagaacugauacaauaucuuguaauuagauacagccuuaguucacagacuagccaauugauagacaauauccaauucccccuuuaguggcuaucaguaggguagaguaacuauuagaauaaauuuaaugccugugacagguaagaaaauauaccagaagcuaaaauguaaucaguauauccaaacccaaaauaagaucauagucuuggcugcaaaguggguccagaaggagggcuguggauggagagcgacauccacaggcugacaagggccaggucaggaaagcucaaccuugaaagcaagauggagaggguggauuuggccuagggccaagaggaaaugcaagugcacgugugauuaaaagaguccucuguagaacgcuuugaucuccuccucaguccagugcugggugcuguggcaggugaucugauggguacgcuggcagacuugguacagacagaucugucuggcuucagguccaagaagaggauggacucuucuggugacacuggccaaguuccugcccuccuagggugccaccuucuccacugcaaaauagaggcucuggcucuccaggaggugggagaaauuccagagcccgcuuucuucuaacagccugaaggacagcaaacugaagagggcuaccagaagagcaugaaggugcuggccaaguguauucaagaagcauuuugucuucagggacuuucagcuucagauuucuugcaaaaucauugcaaguuaaaauauccccacuucccaauacucuaaaucaaggcauuuaagauuauagaauugagaggaauucauaaacacauucaaagccuagauuguauaauauccuauguauguucacgcauuaugccuaaguguguaaguucgcauacucaagugcgggagagugcacauuccugcacacacacucacucacacauacacacacacacacacacacacacacacacacacgaucucuacagcuacagacuuaacacgugaguacuguccaguccaucaguaggaaugaagguagggccugggaaaaugcaccuucucguuugacccuccgaacaggacaccauucugauuccagcauccuuguaucuacauuucagucucucacagcugugaagcccuguuuuccccaucuuugaggauauccuguuaccaucuuccucucagcaacagggagaaaauaaagacauaaagugaugacugcaccacgugaugaugcagcagcugcggggacuguacuaaggucugugagaaaucaacacucucaggacgaugaagagaaccaaguucuccaagcacuacugagagaguaagaucucuaugggccauugguaggacuggggccaccucccggaaacacuccacacucccauccauccuagaagaauagaugcucuuccugaaagcaccagguaaguuuuuguccccaucacuguguguccucccuucuuaugucaacaagucagagguacaaggcacggaucuggacaagcgugcucccaagaguucccccaacgagccaucccuagccuacaaugaugagaaauaaaggcagcgagccaggaggggcaccgugagggaagagaucgcucaacuagaaacucuguccuucaccgaagucaaccaccacagguucuaacacccuggacuggaaugaacugagcaacugaauaaauaauuauggugcuugauuacaaggaacagaauaaaauaacucugugugacucccgugcauguaaguaguauaaugaguagugaauaaauggagaccgggcuaguuuuccccuggagaauccugauuagagaaucagaaaguguagugggugcccgaccucuccaagaccaaccagcacaggaagugcagcugcaggcaagaccugacaaggaggugcacggucaguguguggaagggacgggggaaggagggccuugucggaaucccaaagcgcugcuucugaaugaucacaaagcauguaggagagcuuagagauauucuaccaaggaaguucagaagucaucucccgaaccaagaaccauuguuaacucauggcgauaagacuuaucaugguccccugaaaacacaugaagacgcuaacuacaucgcuccugagacguucacggcuccaccaaaauaaugccggccagcaaucugaucacaagaaacaggccagacagaucaagggucucgauggcaggaaagccagaagaagaugcaggcccugucagagaugggagguggccaggcagauagcagcaggaccccuggaccagcuccugagauaaaagcgaaucacugggugauccaaguaaugugguaccauggaugucaaacaccaaugucuguuucagggcuugauccuuggaccacggugaggggaacuguuaaccucgggggaaaguaggagaagugucuauuucuaggaagugccugccauuucuaggaaggucugaaguuaauucaaauuaaaaaaaaaucaaaauaagcguaugucaagacaaugcuugauauuagaauacgcuuacuuuugggagucugggggaaugaaucagugguaagagcguuuguuacacacgcacggaggacccggcacaugcgcacacgcacucucacucugcaacucagguuggccuuaaaauuauggcauccuguucagucuuccaagugcugggaaugcagguaugaaccuuacaacagacuugguuauuuauuuaucgauuuaauuauuuauauaaaauagugaauuuugagagcuguuauguuuauuuaaaagauauuucuccgggucucuugcuuuuguuuaacaagguuucauguauucaaguuggccucucaguuaccagguuaccaaggcuggccuuaaaugccucauccuuccugccuguaucuacuaaggguugggacaaugggcauguaccaccacacccgacugaaauuaguuucaguggcucaguagcaaagcaaggcaaguucucaagacgaacgcuguuccuuccauggaauauuaacaaaauauugauugcgaaauuaaguuccuguguuagugcugugcugaagcaaaaugaagcccuccguuccuucuuccaggacaucagccccaaacccugccccccaugggcaucucccaucacagggcacucgagagcuucuguuucugugcuuucucagguauugcucacagcagaugauaaccuucacaaaaucauggucuccccacauauacugcaccccacuuccucuaagaggcuccuuugcagugagcacagugugccuauggccagucucaucggggaagauaagucaccugugggaagagcuccaugugcgucaccgcagcuuuugaaaaguuuagcaugagugcauauacaccuugaacccuacguaaaugcugugggaacggauacaaccugaguccuuuaauuuucaagcaccaccauggguuuaaguaaaaaaaagugguuuuguugcccaaguacucaucccuuauguuuucugaguguucuucuuacaauaauucugaagcccccgugaaagggaauuuauuaucaauuaaucgugggggggggagagaauuuuauuuguaugugguuuauaaccaauuagccaaagcagcuuaaaacuuugcaugcaaaguguuaaaucuuuugucccacacaucuuuaacauugauaugaauacugagaguaacugucagacauacauagucuuugcucgcuguuaucaacaaaaaggguuuauucagcagugauacuagcuagucauuagagaaugauagcuacguggcacggugaggggaugagaaaacagacccucaugggcuucugggaaaagaaagcaaaucagaacaaccauccugcagaagaauuauuaauuuccacgucgcauucucacuucagggugagcuagcggcgucguucacagcugugaacaacugaacagagccccugcacccagcaaucagggaaguggcaagccagugguggcgaugucaugcaguuacugagccugugcugccaaggcacugucaucccuauagaagggcagcugggauacaauggcuuuaacaguaggagcauguuggggcugcagagauggcuuagugguuaagagcacugacuauuccucuagagguccugaguucaauucccagcaaccacaugguggcucacaaacuucgguaaaggaaucugguacccucuucuggugugucugaagacagcuauaguguucucacacauauaaaauaaauaaauaaauaaauccuaaaaaaaaaaguaggaguaugucaacuuuaagaaauacaggagcaaaauucauagugauaguuuccucugaugaaguacuucaccuauauuugaauauaugcaaguauagcuaauaaaguaauuaaaguaacuacauuacucuguauccagaaaaauuagaauucuaacuugauuaaacauaguauugaaugcuaauauguaauccaacugaacuaaucuacugcugacauaagcaauuuuguguuuguuuauucugagugaggaaacagaaaacaccaucuuugggagggauuggugcuaaauguugaauggauaugauggcgagucuugcgugaagaugauuuuguauuacuuaaaauaguuuaagcauauucaaaaagacaagaagagacuuggggccaagagauuuaccuggacagaggccuaagccaaaucugucaugcaaaccuccaggaguacagguggcaaagagggacacuugacccucuccucaacagugccuuuccacccuagguaagaaaguagagggacagaaaucacccgaguucagcccaacucugcugauacugaaugauucucuaagcucucugaggccugauggaacauggguuauucuaugcaccaggccagagugcuaggagcacgcaaucagacagugauauugaagaaugcacuacugugccuugauaacggaggugaucaauaauuaaagcgaauauguacaggggugcccaugaucuugauauuacugaccccacagacguauagggaauaguaaggauaccacauauggaaauguucggcauacaauaaacauuccauagugugucccaagcuacaugauuucucucauucuacccaagucuaucucccagauccacguuaauucaaccugacagggaaacuggugcauagagauuaaagaugggcggugugaacccacccuccuaagcacagugauuuaaugagccccagugccaacacuguugggaaaaguguauggaagaacauggagacucagggcagguauccuuccuuuuaagguucugugugcaugugguguugaaaagacggggccccaggccuucuuggaguaccaacaggaaguaaccucucuacacuugugacuuccauuagcagccugguggggcauugauaaguguuccucaaaaaccaggugcaagaggcuugauaucugguuggugguggcaccuucaggggguugggccuauaggaaggaaauuaggucagugguggucauugguggggggccauggccuucaucaaagaauuggaaacacuuguucuugcccuuaguccuuugcuuccuggaaugcuauuaggucuguaggccccucugcugugcaccagagcauaaugugaaggccaaagcaaugaaaccaggagcuaauuagcuaucgcaguggggaauugugagcucaaacuggucuuuccuaugaguucaucaucaugaguaacacacaacuuacuugucuccuuucaugaggagaauugucuacagcacgugguuuccacgccacaguucaaacuuggggccaccaugacucagaggagccagagccugugccuggggucuuauagucggcaccaugccuuggacaucugaaaagcccucccuagcuuuauccuucgaguuggcuuucagcaaugcaaacagaacagaaccaaagagacagaaagguaaccuucacugggcgaucauccucgacccuagugccaccaccaaagggccaaacucacaccccagcaaguagcacgcagcaacgcuacuccccacccagauguucucccaggaaacacaucucugcucuggcccacaccuguguugauggggaucggaaacugagagaccagcuuuaaggcaacacguucgcaguggaccagagaagcaacugcaucccgccacuugcccagaacuaagaggcucucucagguccacaaaccuauaagaaaaugcagcauuuuaccacagcucucugaacuuuucgucuguguguguguguguguguguguguguguguguguguguguguguguguguuuggcauauaacugugggcauggcugcauuguagaacucagaggacaaccuguuggaaccuguucuuuccuuccaaguauggacugcagagcucaaacacagaucaucagucuugaaggcaggagccuuuagacacugguccaucucauccgauccgaagugcuguguuuuuaaugaugggccacauaggaaagcauaaaaucacggagaaaggaacccaucaaaucaacaggaccuaggagcaggucgguaacaacgauaaccgaagaccaaccggcgucaucuacaguggcucaagggcacucuuaaauggacugaaagggggaaaacaagauggggauauuuauugguaaggacauaacaauaaccaacucaggaagauuaaggaaugcaguccaaagcaaaaaggggcgcugguggccugcugaggacugcuaagcaaauggaaaaaauaauggccucuucagaaauggaaauguuuucuaguuguaauuggcaguuuauacaguuuuucaauacaucaucaaaaaccagccucaaaauuaaacggcaguaaugagcagauuagcagguuucccggccauuaaugaaauaaagugcuuugggucccuacggaaagucguuugccaauaugugcaccguccacgggcuucagcucaauggucgcauaccugugcacuugaacagggcggguggggcgaaucagccagcacagucuucuccccuagcuuggcaaacgaguacaaaacgcaagaauccuuuuauuuuugacagggaggggggagguugugugugugcaggggugggugggcacucacuaacagauguuuacaaacagaagguaacugguaaaaacccaaacacaaagccgcauugucuuccccgauccacagcaacgaagccauugcagcuccugcgaagagcccuuucuggacaacauccaggaauuaaaaggugccaacaagcugccuaauacccuugcguagacugaauucuuaugaagaaaauaaaguuuauugucuggaaagagcgaaagcaugggggggaagcaguaaggcgguggaggugaaccguuaggcagcuguucacuuacggaaauacagggagcagaagacgccaucgcugcggaguuuuaugagaagccugacggcuccuuugccagcgucaagggcaaggggaaaggaagggaagaggauggaaaacugggcugugcuaccugguucugaugaccuuggauaccaagccugaaggggaagcaacugugagccggccggguacauggcucguuucaauuucuaccuaaguucugaaaggcagggcccugacugaaauccuggaggguugagagauguauuuuuggugcuugauauauucauacuaugcccacccccccccaaaaaagaagauaugccaaagucuuugcaucucuuuagauacauccccucccccaccuucccaccaugaaggaagcaaaagacuucagaaagacaucucugguugcuaguccugccucaacuggcaggguagggaaggacagagaggugacuugcaugcugagugugucacgcgagcaggcugauuuacaugaacugauggauucauaaaaauaaucugacugggccucucucuugguuugaagcccuaggaggcucacagauaacucuucagcccagcuguaacaucuugaaaacuuacgauccacauaucugguaguuuaccccucaauuugccugauucuuucguuaaguugaugcccgcaucugugugcccuuugguuauugcucuuggaguguugcaggccugcucgaauaauuuccaauccacugggcauagugaugcauaccugacuguaauccuagcacuugggaggugggcaagaaggucaaaugugcacuauuccaugucucugugugcugcuacagaacuaacucucucuuucucucucucucucucucucucucucucucucucucucucucucucuccucgagcaugugugugugugugugugugugagagagagagagagagagagagagagagagagagagagagagaagggagaggaagagagagggaaagggggagguauacaugaauaugcauguagaaguugauaauaaagucucacugcucucuaucucuuuaagacuuuuugagacaggaucuuuuuacugaaacccaaggcaugauaauuugcccagguggucuuagguauggaucggccugucucugucucccgagggcugggguuacaggagugagcaauugcucuaucuuguuaugugacugcuagauauggaccccagaucucugugcugcaagcacuuuaccaacugugcuaucucuccagccccacuuuuccccaucuaaacuggacgucaaccguacauggcagagacaucuaagcaagccuguccaauggggaagcagugaagaugaucucugaccuuggggagugagucaaccaagccaaguuucaaacaagcacgcaguggcaucaacugaaggaaggaugggcugggguguggcucucugagcacauggcuugcauccugguggcucccuguuucuguccuugguccugggcacucagagugaaaaaaacgaagcaaggaggauggagccuggcagguggacuaaaagcaugcccaauauccaggacuaugaccaugaaucacagcagagucaaaccugacagcaaagcucccaagucaaauacgcaggggagaguaaaagcccacuaucagguucuacuggacacgccgguaaugucucagugggggcaggagccauggagccuaggagaucugcugaaaagaagcuacaguggaaaggagggggggggggcguucacagaggagacuuuacaacuggcacaaauaucucagaggcaucugcacagcacauacagaagggaaaaacagccauccgcguuaccagguauuuauuacuguugaacaaugagaccgagagccacaggcugaacaccaagagaagaaaaaucaacuggacucaaacucaggauucaucacuuccccaccuuccuagcccaccugugccacaggaaccaucccuuucgcacacgggacaucugcugucuuucaagcccagggacaacugugcaugaggguugggugacaagacguagcgaguacacggcaugccagcucaggauccucagugcauccgcuggagacuuggcaggccugggacaauaagcagugugcugugugugacuucagaucaggccacuguugaccucucuguugaagaaguaggggauggaagagguucugaagcccacaggacccaaagcgacauccggaguugacauucgcuagagccuccuaugguaugggaagaaauccacguggcaaagcuuuaggcuccacaaccucagaaugugacuggacuuggagacagugccuauaaaaguggugacuggguggaaaguaaagaagccuguggggcagggcugggggugaggggggcugacauaaccaaagacuguccuucagagaagaaggaauguggacaaagagaggaggagaguuuauauaucuagaaaaauggaugggugcagacaugcucucugcaggucugguagggacugucaugcucauagcuugacccugaucuuucaguuauugcggcccaaagacaauaguuuuuauuuuuaccuuaguccccuagucugagauauauauauauuaucacagcagccugggaugaacacuccaggcucaguuugcaggggcucccaaauccucuuuucucuucggcuacagaguguucugccaaggauccaccugguuucugacuuucugcuccaggcacacgugcacacacgugcauaugcacaggcacauguguucuggucagagccaucaccuacaccuuccaauguaagcggccaugguuguaagucacugguuuagcucuugccccaugguuuacuucuaauuccuuccaaaugaguaacggccucgccaggagccagagcucucccugcuguggcucccccaccuuuuccagauguguguccgugacacagccugcccaccaggcauucacuguccaacagaggccuucuucuucaguauccuccuuuucacagagcaaaugagaucccuuucaggcucaugccuuguuaagaagaaaaucaacuuugggacagaagcaagggugcuuccgugcagucgcuaaaccauaacgaccucagcucugcucccacugcagauagugaggauggugaggauggugaugauggugaugauggugauuaauaaccauaauuccaagguggaauuaaacuagacucgagcucuguguauuagaagauggaagccaacgggaauauuuuuaaagagaaaguuuuacauuccuguaaaacacggacucuauuuuaagaaagucuuguuauucuugucuuccaggcuggcucucgcacuguuaacagaaugagagcauaauccauauuguuuuauggggaauccacuuucaagauauguacaacauuuaaggaccauuaaggaaagcggaaauugaaauccuuccagaaaagcuuuaaguggagauaaggaaaaaaaaaaaaaaaaggcugcagguuagaaggacuuccagaauuauaacggggaauuguuggggcaacuguagguggacuggaagauggcugcaugaauuauuucauauggcauggaguaagacaaucaugcaacucuuuucuaaagaagauagaagggagguauauuuccaagcauucuggagaacccacauuccugucuaaaggcccguucaccaggccuaacugggcugggugcuggaagaaccucuaagacaugcuguccuguuaagcaacuuggggacaugucagaugugaggaaugacaggugcuuguugggggaggggccuggagagacaaucuggcuuuaggacacauugaaugugggacagaaaacaucuacauccaggcaaauaaacuggauaaagauacuuggagcagaacuccaauccacaugaaaucgauaguguaaaucucagggugccaugugcucuucugugggaagaauuauuggucggagacagcagaaaacacaauuauggaacacauugaaacuuaaaugguggaagggcaaaauaggaaucgaggugggggaaagcagagccaaauaauuaccgggaagacagaaguaaaggaagacacggcuuaaugaugcuggugacccaacagcucuaugaauauauuaaaagccaccacauacgauguggcaggugagagacaccucaguaaagcuacuacucuccucucagaaaaaggcagaguaaaagagacgcacugaggaacauauuuuaguggugaauauuauauaucauuagucauucacuuuauaaagcaaaagcauaacuugauuguaugguauguacaagugaaauaaaaaggauuagcaaugucaaacauagaggauaucuagcaacuugcucuuauauaccaagguaaagacuguaaaauagcacagagggcuccugagcaaacuggccaguggcauaucggugagcucuggcuucaacugagagagacugcugcagagagcgggauggaagguccaugaggaagggcccaaacaucagcucugggccucucugcacacccauguggaugugcauccaaacacacauguaaacauguauguauacaugcacugcaaacacacauacaugaaaagagaaaaagaaugggcuagaaaugaagacacugcccacacaaauaacuaacugugcaugaaagaucacaguagcuucagucguagcagcacgcgcacacacacacacacacacacacacacacacacacacagauccuaccccagagugaucaaugaaauuaaaacuacguuacccugacucuaaaccacacucacuuaaauaacuuuuuuaaucaaaagaaaugaagaaaauagaaagaaugaauaacugaauaaaagcaaaaauguuaagaacaaaggugagaaagaaguaaaaagggaaaggaaaaagaaaagcauuuaaauacacuggcccgccuuaggcuuacaccgcaacagaccauaauuuguauuccguacccauuucuauugucuaaauugaauucaugguagauuaaggccuuauugccccaucuucaaugcuaggaaaaauauuuuauggggaaaauaggcaucuuaaaaaaaauaauucucuucaaugaaagauucuucugauuauuuauggaaauugcaaacuagcucucuguaccaauaucucacgaguacuuagcuccuuuaagguaacaauaguaaaacaauuuaacauaaagacaggcuauaucccaaagguggggggagccagaacuacagaagacaguucugcagcugcgaaacugcucaucuuuuuaugucugcggaaaacaacaauggugucccuauggauaaggcaaaguacagagggcuaaagagagggcuccguggacaaagggcuugcagccaagcuggaggaccugaguucggaucccccaagacccauguaaggcugaauguagcaguacaggcacagguaaucaaucccagaaacaccccuacagugagauaugaggcacagaugagaaaaugcucugagagcucacgggacagccugguacacacgggagcaaaccagagcucgugccccaaagaagguggcaggauagucugagguuguccccuggucuacacaugcgcgcuccccuuucccuucgcagcaggagcaaguagggccagagauagaaguucgguugccuuuugaacuaggaagcuuucacauggcucggauuuaguucacaauauuaaacuguccuuuccuguuuaccuaggagagcuuuagucgccaccgugccaugugaauacaaacacaggacauaaaguauuagccacacucccuucugagauggcucggggucugucacuuuuaauaagaacagcugugcgugauguuaaaaagaacggaaugaaccggguguggugggccacuucuguaaucccagcacagggagguggaggcaggcaugugaguacuccaggcgcauccucagcuccauggcaacucugaagccagucagagagguuugccuugaagcagagcaaacaaguaaaacaagaagaaaacaacaacaacaacaacaacaacaaaugcucauaaugaagccaaggaagaaaaugcuguugugaucuacguggcugcugaguuauccgccgcaauacucugugaggcaucucaagaaaaaacaguuguucccaacaaaagauaagagggaggagagagaggaccugcuggaaaaggaggagaugccuaccccagcuacugcugaggcauggaggcuguaguccuuacaccagcaauaugaagcaagggaaacacugucgcucaaugacucccagauucaauugcugcaauuacuagagcaacccggaugcccggggcugccucauucuuagcacugggguggucaagccaagauauucuuaguccccugagcauggccagggcagagggugacauaaguagauaguugugagugucuguguguguguguguguguguguguguguguguagaugcacacaagagcaugagcaaauacauguacacuuuguggggugcacaugugccccuggguuuccuuaguugcccaucuaucuugauguauugagagacauuauuucacuagccuggaacucacugccuggcauaggugggcugguuggccugucucugccuccgcagaacugggauuauuagccacaagacaggacaccuggcuuuuguuguuguuguuuguuuguuuguuuguuuguuuuuaaaauguggguucugggaacugaacucuguuccucucacugauauagcagacauuguccugacugccaucucugaagcuuagccuaguuuuaagcacacuuccaaaagagaguuuugaaguggagaaacugcuguacgcaugggaguggagugaugacuucauguauggguuaaucucacaguaaguacaacacaggaggugaacuuuaacauaaacuaaggacuuuaguucaucauaucaacaccaguuuccuaauuauaccagguaacugauauggaaugcuagcacugugcccuaugcuuggggaagugggauggacagugaccugcucaguuaggcuaugccacuagaggcgaacauuaaaaacuuucaacauaacauuugacaauauuauacccuuuucucagucuguuuuguuuaggagcaucugauguggguuauaaacuagcaaccugccugguuuucuuugaacugcacauuguuuuaaaaaguuuuaauaaacugccauuuaaagucagaaaauaucucacuaaagagccaggacugucaaacauuacuaguuauuuuuaaauacuuauuuuucuguguguagggacacaugcacgccacaguauacggaugucaggaugugugggcacaugcaugccacaguggauggagaccagggcaacuuucaggcaggagcugcccuucuuuacuaugugggcccuggggaucuaacucacaacgucagguugggagguaaaugccuuugcucacugagccguuuucuuauggcagcauugggugugaauguguaugugaguuugaguguguaugaggaggauaugugaguguguguguucaucuguguguguaugugugugaaugaguaugaguguauguguuuguaugaguguugugaggaggguaugugaguauaugugggggguguauaugugugugugaggaguguaugugaguauauguguguacauguaugugaguguguguauuuugaguguguguguguguaugugugugagaaugcuuguaugaguaucauaugaguguauguguguguguguguauguguguguguguguguaugagagagagagagagagagagagagagagagagagagagagagagcaugugugugcuggugcccacagagaccaaaagguuccugaaccuuugcagcugcaguuacaggcaguugugagccacaggacauaggugaugggaacagaacuuggguccuguggaaggguaggaagcacucuuuaauugcugagcuaucucuccagucacauggguuaguuuuaaaggugugggguuuccccacuuuccagguuggugguuagagaucccuggaaaugucucccauaugaguuaacauuuuguuuaguuagcuauuuaaaaaaauauauuguugcgcguccccccucugcuggagucaagucauuuaagguauuucuuggcuuuauaauacguacaauuaguucugaagaauauacaacucuaugcuguguuugggaacaucuugaucacacaaaugcagaacuaauugaacagaacgguggcuggaaaacccgaaccgcaaagcuccaauuccuguccuuucugccacugggcuaagaacugugugcagcaucccagcaaaagagcucccuguaucuuuaauggcucacccagagcucagagcgaaagucucaacuauuuguuguucgcuguuguuauauucuguuccaagguucauaauuugaaaaucgacuuuggggacuuuuugcuuggucuauuaaaaugauucauguugcauucaacauaaacuguguguucacagaggagggugagagcccgcacucacagcauaauaacuaaagugaauuuugaacgagccgcaguuuguggcagccgugugguaucauuugucuuaauuuuucuuuggcauuacauuaggcggaugcauuuacauucccagguauggauaaccacuuuaaaaacuuuguuuuuacagcacgaguaaaggggggaaucaaaucugcauguuuaugcuguggaacaucaaauaacaccauuuuacuguuuggaguacauacagcgugggauuuacauuccauuuaccugaccucacggagggaacucggacugauaugcaaaguacaugaaauauuuacuacacuggaucaugccaggcuucuaaaggaaaacagaugaagguacgauaauacccuuugugcuguggucuguccagcgccuugcuguacguuuaacuggaaucccauuaucacacucaucauuuacauccggauucaucuucaauaaaaccagacuccagauaacuuaagccagaacuuuaggugacaauuguacagaguagccauuugucacuaaugcgccaauaaacucacaugcacaggcaagccgccugccuccaacucaugaaauauguauuccggagggcugcaagggagggucgcuacauucccauuagugucauuuaagaugagcacgugucugcggguauaugcacaugucuuccagcagacaaauucuauaaauaugagacgcugaacuauuucagauggguggagacuguugcgaguaaaucuuacauucucucggcaugcucgaaacaaacuaucagaucagaauggacgaugcugcgacccagaguuauaaugcuuccuaggguucugguuucuguuuacgccugaaaacgagcuuguaaaacucugacacccagccuaggaaagugugguguucuaauacccaggcgaggaaacucgcuugaaaacaggguuugugaacuauuuguauaaggguucugugauagcuaaugucgguugucuugacuggaucaggaucaacucaaaguuaggcagacaaacguaacugcuggggaacuucuuggucgggcuauaugaaccagaauggccaagucuaaauguggguagcaacuucccgugacaccugggagagaggacgucccagguggggagcuuugcuuuagcuuauuugccuuccugucuugcuaaugacaucauccacuccugacaaacuggucacccuguugcagcagcagcuggugcuguugguccugcugcuaccuugguuugaugauguuggaauccaguuucuucaggcuucccaugaugacuggagaccagugggucuccaagauuccuccaagcuugugacugcaggggcauccaggcuuggggucugaguagcuuucagguucauggucccuccagccacuguuagacuaaccagacugcaucauguaagccaaucuaauaaauucccuuuuaaucuguauuaauuccauaaguccuguuccuuuggagcaccaugucugauacaggcucugaacaauuacuaugguuuaugaucguagcguuaagagcacgggcacuggagacucacuaagcuggcaucugacucuauagcugacggguugugucacacaaagcaauuucaacuuucuaaaucucggucucuucaucuaaaacgaggauaagaaaccuagcaggaccuuugaggugaauuguuuaaauuucaaaaaagcacccagugaaugggaguucuugcugagugugguggcacacaccuguaaucccagcacuugggagauagggacaggagagucaggaguucaaguccaugcucuccuuggcuacauagagaguucagggccagcuuaggcuuggugagacccugucucaauagaacccaacaaugggaacugagaaaaaugcuugaguggcuaagagcacuuccuccacgagcuaguguaaggaccuaagguccagucuccaggacacaggcaaaagcggagcauggcugcacaugccucuaacuaagaaggacugcuggagcucacuguccagccaggcuggcaaagccacaauggacucuagguucaguaagggacuccauucuuaccaaagagugacagaccaggacuuuuagaguaauccucucagcuccucacgcaccucccuuacgccugcacacacaugcgacauaguucacuguggucaauagccaugauuaaccguuauuauuaaaacuaccaucagggauaauucaggcuggaaucaucauaucugaucaacagcucauuagccacaaaaaaugcuuauuaucuucuuaacuaaacuauauaaauauuugcaauagauggaugaaagucucuguacucaagcaaauguaauaagucuugagacauauagugugcagcaagcagccuggguagaaugcuggcuuuugacaucugucuuucaucuuguuaguaucuagagucgcucagucucuacauaucccaggcuaccccacuuaaggagugugcugacaucagagaggagaaaacaguugucuuggucugaagcugcucaugguugacaauggcaugcuauaacuuuucuuggggagaaaugaacaaauaucuauuugucccagauaggguaccaacaaccgaccagagaaucaauucuaccggaguccggcugagggaugugugucugacuccaaggugccugccucuccaaauaaucaucacagugagugaggcugugcaccggaagcuaauuucuggaccugcaggugccuuugccccagcaacuguuaccuauauaagcuuggagguggggagguauugugaguccuguaucuuucgggaguguccugagccuuguaaguguuacuuccuucuuaagucuuaagaaguucccccaccaaccccaggaauuaaagguuuucauucagaggaaauagcuauacuacacugcguguuucuuaaacuggaaguagccaaacgaugacuugggaagaguuaaaacaaaacaaaacaaaaaacaaacaaauaaguagagagccccaaaagguccaccuaggcccagcaauuggccucucagaaugaguguccagaggcacuuuggggcaaaagauggaaaauaacucuucaaguauagagaaacaaaagccagaagccuagaugugggugggcacaggcaggacagugacacaguaggcucacucuagaccauccuaaggauucuggguagguuucucuggagaggaaggucugaauuaaggcuggauugaggaguaggagucaggcucucccuuacagacaguggcugacccucacuccugcuuuagcuugcuuagugcugagaaacagagccuuagagucagacugccuacugcacagacucccugauggaagguuauaugcugucuuuaagucuguuucucugcccguaaaagaagucacuauagcagacaucucacagguugucggaaggauuaaauaaagccacauaugcagaaguaucgggcucgcugcugguggacaagagacacuuuaggaggcacuauuaauacagacguuucagguaacuaggaggaacuaaggaugagcaacucagcccagcaaaacucaccaccaccaucccccugucucacagcacacccauuccccccucacccagugaaacaaacagggacaugcaaggagauugagccaggguguccuagcgagguugcuguuauugugcuaaacucucaguugcuccaugacagaagcaacuugggaggaagcugucugcuccaucuuccauuacugagagaagucaggguaggaacucaaggcaggggcuugaagcagacucuaggaagggcucacucccuguggcuuaugccuggucagcuuucuuauaacugaagggacucuagacagcccaggacaggccuugcccuucgcucucauuccaucugccuugcuaaaaaccauuagauuauguuccugaagauaagcccccgaagucuauacccuuauuugggccccuuccuccuuucgaggcugacuaccaagguucagcuaucaaaguguuaaaaguccagcaauucacagcccccuuuggcucgccuaaucaacuugcccaaucaaaacauacuacagcguccuagcccauucgaacacagaccaccccuuuuucuugucuuaaaaauuauacuugcaaggucauaacggagauaaaggacaucucugagaaagcggguguucgggugugcuuugugccucguccaggucagggagagaaacggcgcugugugugggguccccuucaaucaccccacucuuuagcaccacaggaacaggggcagcaucgccuauggugagcugaucccuccaggaucaacuagcaauaaagacacuuccucucgguaucacaggccaagcugacggaggugaauccucaaaguucccucuugccaggugucucuauuuucgucaaguuaacaaaagguaaugagaauacugaguuucugaaccaggugccagugcgguagaacauuaguuugagaguguuaggagagggauaucuacagacauuugaucuuugggguggugucuucaugagugggugaaugucugucuccugggaauggcuuggcuccccacauugcuaaaucgaauuuugcucucuccugcgugaacuuggcaagcuuuggcuuuccagucagucuucaagagucgaaacagagagaggacuucacuggaagccagaugcugacacacaauauuggcacuugggcuaccaggauggguggccaaaauacaucucuuuccauuauaaaguccuugguaugaguuacuaugggauagcaacgggaaaaaugaacugagacacagugauuuuuuacugaaagaugcuacauuuacagagccuuguccuaaccgaaucccagagccacaucuugaaugugaaaaugaaagcaaagagugaaggaaugagugcuaaccucacugagguggucuccaaaagaaucucucacacauacacacccaaagagaaggcacuggcgcgagacuuugcagagaagucuauaauuagguuauuaguuucuuaauuggagagcagcucuaaguugcaaaaacuauauaaguaacacaacaaauaugucaguuccaucuuuccccuuaguucuuguucuaggagccgacacagcugucugccagaagaauucauuuagcaaaaggggaggaggaaggagagaaggagggagaggaagagagagagagagggaaagagagagagagagaggaagaagaacaggaaaaggaagaggauagguagagaaggaaaucccucaagcagaaaagaccucuuacugauaauauuuuaguuuaauugcaauaaaaaagcccuuucaaauuauggauagcaaaucugaaucaaauauagucagggacuguagguguuaaaaauaauacagaccuugggaaaaaaaucuauauuuuaaucuuuuuuuuuuuuuggaaaagaacaaauuaucuuauuuacuacaugaaugauuuccucaauuuaacgccaaucuuuagagccaacuccuaccuuucugaauaaacaggcugcgacagaaacgacuagauuauuuauauuaugaggaaguguuuaaaaauaaacgggagagaugacuuuaccaguauugaaaaucaaaacaacauacauagcaucucagcuucacgaaaaucuaauuuuauuugcuucuguuuccaagaggggaguuuaaagagaacacauaaaauaguaaauuaaauuucucuuugagggugggggaggagagagagaaacacaccuuaacuuuacuggcauguucagagagaaacacccacugagccccauccucacauggcugacagggugaagagaacuuaucccuaguggccugccugugauaauguagaugagggcauucauauaaagcuggaccuuguuggaaaucaauguaguuuucaaaagaguuacggcaaaauaagaucuacgguguaaauuuuagcaugcagauuuuuaacuagagagcucaaaagcaguaaauccauuaauauagauaagggguuuuuugguuguuuguuugaugcuaaugcuauugcguuugaugaacuggcgggguggggguggggccuaguauuugagagacuagagcuccaccauugagcuaugucccccaacacuuguauuuuuacuuuguacaaggagacagggucuuaugaaguugacuggacuggguuucagcuggagacgcuccuggcucagccucugcaguagcugggauuccaagccucaccaccagguccuauuuaacuacucauuuccacuaaaucagagauuauuaaaaugaagaucuuccaguguuuucuuggaacauauacccccuuccugugugugugugugugugugugugugugugugugugagagagagcaggggcggggcacauaaugccaggcagacaauuccaaugacaauaacaaguuguuacuaggaaaagagagaaaggaccccuuccgacaccugucccaaccacacagcaucuacacugcaaagggcuuucucuaugacuaucuacacugcccaggggugugggaaggaaauggcguguuuuauuacauagaaaacacugcuaagcagcguaugauuugacgccagacccugauaccugcccucaagugccauucgaaugccuccagcacaacaguggagccaggucgcuuuugcccacaaagccucgagagcuauuuuagcuguuaucccggcccuuuggugacagagucagccaacacaaugacagcucuuuccagaaccucugaggcagaggacuauucuaagaaacaucacagcucccuucccccaugcuucauccuucuuuauuucaguaucccacgccccugcccccccccccccccccaaugcagcagaggagaaccuggcuggaccauggguagccagaggaggaaauuccagucucaagaaaaaccagaaccaaauguuagcacgcagaugcccccggguuguaauuucccuguaaugguuucuuaugauaauuaaaaccaugucagcaaagguugcccgccuugagacuacagcaaggaggacauggacagugugugaaagccauuucgcuucacuggggguagguucucagcacacucuaggucugcaggggggaaacugccauuccuacuggaggccaaugaggugguaacacugucaccugacuccauuuuaucuccuuucuguaucucaguccccuuuggcucccagcauggagcacagaagguccccaggaaacacugcucuauggauacagcaguuagcauuuacuuggcagcacuccccgaggacugugguccuccuccuccuccccaucaccuucuuagucaccuucaguugggggagagguagaaaauuacacaaccugcccaagggccucacagagaaggauuucuaguucuaugccugaacuccaggcaggugggcggagcuacaguucacucagugauagggugccugcagacgauucugguuccaaacucaaccccacgaaaaauaaacccaccugccaaucaauccacagacaaacugugcaagucaaaucugggagugugccuggcgggugggucgggguggggggagaguucagcugcucuuuuucuuuccuuucuuuaaaaacuuuuuuaagaaguccacuaaugauacauacaucaguaacucugaugcgaggccagacccaccuacagcaguaaaauagguaggaggagguuagauuauuuuuuaaaagccuaggcuacuuccccaacugucucaggcuagcucccccacugucucaggcuagcucccucacugucucaggcuagcucccacacaguucugcuaucaccagaugugccuggaacaagcagcauuucauuuguuuguauuggagcugggaguuuccuguaacaguuaagaaagaauggcucagcuggguguggcguuucugcagccccagggcuggggagguugagucagagcccuagagcaaaggacucaacaaucucuuaauuuuaaaguucucucugggaagcucuaggacagugguccucaaccuggaggucaaaggguuuacacgggccccauaucagguauccuacauaucauauauuuccguuaugauucacgacaguagcuaaauuacaacuauggaacagcaaugaaaaugguuuuaggguggggggggagucauuacaacaugaggaacuaacuguauugaagagucucacagcguuagcacugaugagagucacggcucaggggauucgcuggaguugucaacaaaugucacagauaaaaugauauggccacagcuagggaggucugagggagaaaaaguguuacuaaaaauggcuuucuaagcucacgaugagccugccauuguggcuugugucuauaaaccaaacaguauggaggccgaggcaggaagaucagaacuucaaggucaucuuaaagcguuuauuugguuuggggcuaaccuggacauguaagacccugucucuaaaaaacaaaaacaaaccaaaccaaacccaaaaccaaccaaccaaacagacacaaugaaugaaugaaugaaugaaugaauaaauguuaucugcuugggaguuggaagaaugcauccuuacuuaaaagaccgaugaacaguuaugaggcugugauggcugaaaagguuucagaagcuucacccugcguccagcagacauuuccagggggagcaagugcagggugcccaacaccaccccuggagacuggaagagaugggucaugauuuaugguugcugagugcaacuguuccccaagugcaagcgaguuccagguugcgacgucucaucacuccccagcaaaguccucuccuuccaccugggguugcaggggcugagguagcccaaucaagaugccccagacccuagaaaugggcagggagcaggcccucccggcuugcgugccuuauauccccauccggacuuuuuaggaagcugccucgaacaaaucaagccaggcugucauacgaugacaaaguggauucuuucccaaugugacauauucauuuaucaucuuucauaagacagaccugaaccauaauuuagucccauagcugcuguauaaaugaacuccgggucuugaugggcugggccaguuucuucaacaugagcucacuuaggaacuugaacgcacaaggucaggaucuaaguccuuguagcggcucuccagggggacggugcccagggcuauagaugggacccaggaagccuggggcagcugaagcgauaaguguccuggggacacauacaaaagcgaaggaguuguuggcagagugggauuuuaauuuuuguguguuuuuccagcauugccacaauucgacauucaauauucaaaaagaacccaaccucagaaauugagcuuuuccuccagaaagauaugucugaaaugaagugagugaugccucgucaaugguuaggccugugcuuuaaacauaaugucaaauggaggaucuugacuccucagcggcaaccaagaccccacaucacuguugguauuugugauggaaagacaaaaaaauacaaaccacgucuuagacaugggcugcacaccagaaaauaauacugcguuuuccuuucuaguaauauaguaacucugcuugagauggggcugaggaagacagagacagagacagacaaagacagagucaggcagacagauagagagacauauuaagaaacuguucagaggaguugaguaacuucucuaaagacacacagaaagcaaaagugggguggggggggauauaacauuagaaccuuuugcuaaaucgugcugccuaugugugaugagaaugcucagccacccguuucccuggagaauaauuacaacgugacacaaucacggaaaaccagugcagggggguggagguguccaaugagaagaaaugaauggauccucucauacauccaucgacacaucaugcagcccugaagaauccuucucuacagugaacacauuuguccuuagugcagugcgugugauggcucccguucugcuugcugggcucaugaacaucccugugguccacccuccccagcuguguucuaacuguguggccugauucccugugccuccaaacgcuagcgagaagaaaguuuucuuccaagcacaguucuucugagccauguacuccaaggagagcagacaaaguucaaagccagacaggggauucaggcuguaccuccucggaucuuuggcuguaaagucugcggguagagagcuaucugaguccaucucaucccaccagauccugagcucuauggugaugaacagaaacugcaucugcccaucaucaggccccugacccaaggaagcauccaguguuggcaguuuaauaguuuuaaacauuuuuaauuuucaccaaugcacguguuuguuauggguaccuguggaggcgagacaaaugcauucaauccucuagagcuggagauucaucaccagcauccgccgcuaccuguaaguguccaagugcagaugccgaagcaaagagaaaaaaagaaaaaggaaaaaagaaaaacaaaagaaaacaaauacagggaggaaggaaggaagaaaggaaggaaggaaggaaggaaggagggagggagggagggagggagggaggaaggaaggaaggaaggaaggaaggaaggagggaaggaaggaaggaaggaagaaggaggaaggaaggaaggaaggaaggaaggaaggaaggaaggaaggaaggaaggaaggaaggggggaagcaagcaagccagccuaauuccugaccccuguguuccagggcagugggcucgcuugcuugccuggaagcgaauauaucaguagucacucaggcuauggucccaugaaaaacaugggcgacaaaagccccuugcagcaaucuccaagaaggaggaauaaauuaaucaaacugccagagagagaaggccggguugaccuccuucugaucucauuacuucucuauuacccuuuugaaaaacacccucuuacagagaucacuaauugaagauuauguggagggaaaucgcaccucuccaucacggugggaacuuuuccucauuugucauccuaauaauucacuucuuuucucuucugaagagacagagacacuaauggacuaucaucaguuaaaaaggcaauuuuuccauuuaauugcgcucauuaaauacugcacuagaacaauuggaaaagcaauagucucaauauuuaaucauagcauaggaauaaugaaacauggcuccaaaauaaaucuuggaauauuuauaaagucgugaacgagcuguuuuaacaacaccuaugaucaggggcaauguagucagaaugagacgugugauuuuucauuucuccugauuagaccugguaaacauuugcacuucguggggagaaagcgcucgaaacaguucugucuucagaggcugcuacagaccuguggcugggcgaccacucccagccuguuuuggaggcucagaggcugacacacaagcuggucucuuagaagaacauuugcauucaggugcaggggagcaaagccugaagccccacccccuccagaccccauguuccaucuuaucuaccuacuuaaauuguacagugggauucguucagcugacucacagucaagccacugccacucugccaacugcaagucuuuccaguccauuuuaccugacguuuccucuuucuccucaccagcaggcagccacucaucuauauccuguccccgugaguuucuuacucuggaaguuucauauggguguguguaugcaugugugcaugagugcacgugcgugcaugugugcgugcaugugugcaugcaugugugugugugugugugugugugugugucuccugagacuaacuggagcuuagcuccgugugucacuccauucuaccccugaagggcagugaugaggauuugcuacaauguaucuacccauuggucugcugauggucacuugagucauuuggaucacuaggcugcuaugaacaaugcagcggccauuuucccacucacagacaaaacucccagaaugcuuccacugcuauucaguaucuaugugggagugggcucgccgugggagugguaguugcacguuuggucauuauagaaacuacaggauugcuuuccaaagggcuguuucaccugauagccccaccaacagaguauaaagguuacgacacgacuucuccaugucucuagcaacacuucuccgacuuugucccuucagcaguggggugauucauagcccaggaccaggaaagacaagcacucgguucgugcugagaacaggaaaaccugucagcugcccugucaaggaugucaacgucccugaaugggaagggcuaggcuaguggcagaacagguucaauccugcuucuguaccuuccaggcuuccuggaaccuuggucaagucauuuaagccaucugagcuuugauuucucuuauccauacuucaaaggaaauuagcuuaccggaugaagguaaguggugaaaaaugaaaaggacucaaaaacugcucagcaaaagucuggagcgagggcuugguggguagaggcacuggcuccucucccauaauacccacuuccuuccccagaacccacacgguagcucagggacaccuguaaaucuggucccaagggaccugacccuuuucugacauuauaugcauauggugagcacacacacacacacacacacacacacacacacacacaccaaugcacaaauaacauaaugaauuuuuaaaaccugagugaaaugcccauuacccaaggaaggauccugucaccacguccuagaccucacugaauggugacuuugaguugcccugaggucauuucagucugugcccuggguuccccuccagccuuagaccuaacaagcccugagauccauaaccucugugggcagaagggaaggcaaacguagguggagguaaucaggagccuguaagcucagugagcagcgagcaucugccaggaaacacgccucuguggucgcgaagucccccuccuccucuguaucacacugccaugcacaagaaggagagccacagccagauaacagcaugacccacuccaggucggugagccauccuccgggaggccccucccucucacuaugugcuaugucugaauucagugccuaucguuuuagcccauguucaaagacgaaagcggaaaacagaauagcgugguggcuuauggucacauuaugcccugaagugagccuagugcacuuagagccugucucccugaagaucauagaguccugugaggcuggaugaccuaucugcuucauucucuaaugugugaauauagcacugugacugucacauaagaggucucagaauggauggauggauggauggauggauggauggaaggauggacagacagauggaugaauaucccaaauuuagcccauggaacuguuuggauacuuucccagccaccccaucaccucuaucauuccacauaaaccaacuagaacuaagcauaugaaaagaaacaguccgugcucugagcuucaagacagacuccgaguugcgcugguccacauaugacagucccaggaugcuccuggacagguuuguggggaaucagcugaaguccucagccgucaugggacuuucugacuuuucuacaacaguuaucauccaucuauaacuacugcccagacucaacccacucccacguuccguguggcuuaugagcugagaaugguuuucccaccuuugaauaguugaacaagaauccaaacaagggucugaugaagugacacauggaacuccaaccucaguagccaugaguaaagcuuccguacagaaguuaguuacucgugguggcuucuguaccguaauuaccaacaugagcaccuaggguggacucgacacacacugcagggccuauccaaccucagagaaguccuguucucucaugaccaugaacucacuuccccugaaauggugaagcaguccuacagacaggcacauccaggaggaagcauuuauucggacauaacugaguuugaaucccuccuugaacaguuacuggcuguguuuaaucucucugaaucauuacuuucucugcugucaaauaggaucgucgucgucgucguugucgucguugucauagucgauaggucacuugguagcuaugaagugggacagggaugaaaucauagggcccagguccuggccaucaaacacuagccauccuugauauagacugcuccuuaauuaaaacaguuuuauagacauguuucagaaggcaucaaagugucagcccuccccuuagagcuggguaacacacagaaggaauggaagauguuguuaaaaaacaauagaacaaacuaucuaaucgguguagaacagaauccagauggauuaucccaugcuguuaguccuugccuucccccacccaaccagcccacuggcaggggaagugggaaauaaauacaccaccacccuauuuauauacaaugaaauugaaaccauuuggcuuucuuuugccuugccuuaccuugccuugccuuuucuuuuuccuuucccuuucccuuucccuuucccuuucccuuucuuucuuucuuucuuucuuucuuucuuucuuucuuucuuucuuucuuucuuucuuucgaaccauuuggaaccaaguguucaggcaaaaggcauugggguuugucucugugugcuaauuugagcuaacguuuggccuacaaccugucucugcgggucugucacuuaugauccguacaacaaaccugcacaaaugaaacccauuugcaucuaauucccuaggacgggcugaugucauuggagguaaccagaaucauaugcuuacugguccagcucuuccuggucucaugaagcucccaaugauucuauuuugguaacugugcuucauagaaggaaacggaggugguguuaagggagaguccuaugggaggccuacagguauacaagugugcccuaaagccgaggacgaagcacgccccccccccccacacacacacuccuucccgaucacucugaacuauuccaccaggcagcuuacaaucacuuccuucccugugcguucuuggguguaccaccuaauaaaaggacggcauuaccaaguaaaggggaauucccaggcucacaucuguguucgagauucgaacaucuguuuaaggacuucaaauucaaugcagcaugccaacaaccgugggacaaggauucugugauguggcuuucauuuccagccuccaauaaucccuccaauuauaucuuuauacuccagucuuaauaaucuuuuuuuuuuuuacaugcaaccuugaaucuaagcacagcugaccaauaaaugaaggccagagauaauccucucuaaaauucuuguuucagaaauauacaauugaacagucauagcacgggaauuccuguguaugauaggauccaugcaucccagacuuuuuucgcacuuaaacacaaagaaagcuuggugcuuggccggcuuagagcaccagcagcugucauuuugcacaccuguaaagaucagagcagagguguggcuacaucaagaauacaacaggagauauagacugcguagccugagaugguaaaugagacagucagcuaacaucuucugcagucuggcgcucacagccagaagacagcuucacacaacaggaagcuguuuccuuuuccugggacucaacuguggcuucagggaaagacauggaccccauguagcguacaggauucuauccugccuucuaacucuccccucugacuagguauaccaucuccugcaaggcagcugcaucauuugucaauagccgaaagauccagauggugggaaacaucuagauacuugaaaacaucuggauauuucacucuucauccagauguugggcuuccccuaggugcagccugcuaucuuugguuaaauaauuugaagacgcauuuggccaaaagguaacuaaguuuacuucagcaauuccuucuugagauacuuaugucuggcaaagaaaagccuacgcucucuggggaauaauacaguuauugggguuuguuuucaucugaaugaaucaggcaaauuacuucuggagggggaaaaaagcuacagagugaaaaaacaaaagcaaaaugguuuaccaugcaauuugggcucagucagguuaagcuauccauuuggaauuuacagaaguguaacaaagcacccagcacuaaaucagaaccagguuagcauggcagcacacacuagugauuuaaaaaaaaaaagguuucuugacugaaugcaugcacaacugcauaggauucuuguuucucuuccguuuacaaaggcaggguggaaagcuggcucagcaguuaagaguacuugcugcucuuucagaaaacugaaguuugaguccuagcaccuauguaggaggguucacaaaccacuguaacuccacuuccggaggaccugauauccucuugugcuuuccacuggcauguguguauauguauacacacacauaccuucacacacacacaugcgcgcacacacacacacacauacacgugugcacacacacagucacucauuuacucaucuaagaaggaugugcuugguaccuacugugugcacguaccuacugugugcaugguaacauagaacagagaugccuuguuugggaggacccuccauggcuggcagcucuggcagaagagcccauaucccugucuuccucaugaucuaauggcuacuguguggggccggggaaccauggaacugggaggagcugguauggggcaagacuggggucaaggcaugcacaaccccaaaaaucccauccucuguucagcaggaguaggaccacucuccccugaaugcugccaaccccccaccccccaaccucaggcuugcaugucccagugcacaaaauccugugcaaaauagccuuuguccacuccccacccccacccccaguuaaacacuagcucgcuaaagccuuccuucugagacacuauucuugucacacuuacucacugccugacaucacccccuauucguccuggcuuuucucuuaggccacugguccugauugugguagaucacacuguuuugaguuggcaaggggagugggagcuacccaggaacacuggcuccugaccuuaagucccuaccuucaaagcuauacucacagagcacaguccuuuucccagcacugccuuggcucccuucucugaccccuccucuaccucuaagggacuuuaguugaggucuuaguuucuuuuccuguugcugugauaaaauauccagaccaaaaaaaaaaucauauacgcugguucacggugcaaggugcgggccuuuguggcagagggguuacagugaccagagccuaaggcaaguggucccaacauaaccauaauccaaaaggaucagguguaggaggagucuggagagauauacagaggguugggaaauugaacagagguguguagcaaugggggauggggaauugggaguagccaacagaaagucucagaggccaggaaaccaagaggcucccaggacccaacagggaugauauuagcugaaauacccaacaaaggggagagagaaccuguagagaccauauccagagguuaggcacagcccuugguugagggauggggccacccacauuucucaaaauuuuaacucagaauugcuccugucuaaaggaaauacagggacaaagucuggagcagagacugaaggaaaggccauccagagacugccccaccugugaauccauagugaccaaacccaguuacuauugcugaugccaagaaaugcaugcucacaggagccugguauggauguauccugagaggcucugccagugccuuaccaauacagaugcagaugcuugcagccaaccacuggagugagcauggggccuccaauggugaaguuaggggaaggacugaaggagcugaagggguuugcaaccccauaggaagaacagcaauaucaagcaacuagauccccagagcucccagggacuaaaccaccaaccaaagaauacacauggagggacucauggcuccagcugcauauguagcagaggauggccuuaucaaugggaggggaggcccuugguccuguguuggcuagauguaccaauguaggaggacgcuagggcggugaggugggaguggauggguggguggaggagcacccucauagaagcaggggaaggggggauaggauagggggcuguggagaggaaacggggaagggagauaacacuugaaauguaaauaauuaaauagcuaauaaaaauuaaaauaaauaacuaaauauaaaaacuaaaaaaagaaaaagaacaguugaaugggaaaaggugaagguugggagcagauaucagucuccuucagggaccacugugaacaggcaaacauagugaccaaggaagagcuagggggucucucauugcccccuccuggcugcugcauuuaauuccuaacuucuuuuucaguuuuaguguuuugagacugaguccgccuguguaacccaugcagacuucaaacucacaaucccccugccucggccucguacuaggauuucgguguguaacacuguccucugggaguccuugacuucugcaguguccuuagggauguacauaaaguaccucuugcucuuucaaacauucuucggcuuucagcucgggagagcagacuuuggcucucagaugcugugcugagaaccucaaccuggaguugagucauuccugggcagcacuuaaccauccaggagcccgaggggacauagccacaguacuauacacaacggaagggaagccacaagccuacaguggcagagcugcaaguucacugggcuguuaguauaccaaagccagccuuuuuucucugaaagauaaacuuuagugaguuuguuuguuuguuuguuuuuuaauaugcaagcaaacugacaucugauacuucucucuguuaucuuuuuccuuagauuaaccaaaaucuuugaugaugcuuguaaucagagaaucuuggggugggcauuugucuauugcuaguugcaugaccauuuaaaaaaacuuuuuucuuacuuuuauauaugucuaugugagcaugcacacauguauggguaucugcagggccagaagugggcccaagaugccacaguagugggacccaaauucaggucuucugcaagaggagugagugcucuuaacugcugagccagcucuccagcccccaaugaaaugaugguuaaucuggauaauuaauauaauuuagaggaggcauggccacacaccucuaguuaugucuaugagguuaaauuaagagggaagacucacccuaauucuaaguggcacaaugucuccggcugggaugucagcuugcauaaaaagaagaaaucaugcugaacaccagaauuuaucacucuuuguagccugaggaugcagugugacugguugacuucagcuccugcugccaugccuucaccaaacacaucccucggaacugugagccaaagugaacccugcauccuuuugcguguguuuuguuuuguuuugucaagcauuuggucauaguaacagaagacauagcugauacaaacagaaugcagaauuaugaacucuccccucagcccuacaaccccagucccaugaaaacccaaaguccucuagcaauucaaacacacacacaagcacacggcugcauacauccaggaaagcucucacuuuccagagauggcuuccagguugccagggucaaucaugguuccccugcaggaagcagagaucaagugcgagcuaucuucccacucaaguaugagggaaacgagaccuuuagcgcaaaaggaaaaggacucacaucccucaguguuuucuaaagggauauuguuagaagcgauuccuacuccuggaucuuuuguguuccgggguagaaacaggcaacgguccaaacacuguaaccuuuucagcagccauaaggaaaaagucacucccacuuugcuuuuuauauugcggcuguagaaagaacagggcgcacggauucgcagggggauuaacacugucuuccaaaaaagaaguagaagauacuuuauggggagugaaaugaaugauaauuguaucacugucugcucucauuuccucucgguccagcaucucauaaacacagagcggggggcuacagagcucaccauaggucaaggugaggacacccugaguggagcugaugcagaggcaaaccugccggguggugaccucuccagacagggagucaaaaggcagggggcaggcuuccaggacauagaggugggcagaacagacggggcauuccccacgucccguaagugaccauucacacgaguguauacacacagaaacacgcacacagaaacacacacacagaaaugcacacccugcgaaaggaacuuuucucugucacuauccuacucauuccugcccuugcauuagcccaggguuucugaauuuagaggcagauagcucagugggcagcaggcagcacacaggaggauguucagcgcugucuaucugcuagcugcuggcucucccucucuaacacacugccacauacaagaauguuuccaggcacuagcaaaugucccugggaggaaaaagaaaaucacuauaaggaaacaaaugcugcuuuuuuugauccaaagcagaauguguguuuucguguguguguguguguguguguguguguguguguguguguauauacucgcgcgcacgugcgcaugugcacagguuucaucaucagcacucaaguuucuccagaugcuuaccccaucauuuguguguguguguucacacaugugggaacaugugggugcauguacacccguguacauaugcacacugaggucacaagcugcuauugguagcuuccuugauugccuuccccauuuacuuguuaauuuauucuauuuauuuguauuuugagucagggucuuucuaugcagcccaagguauguguguccaggucugaggaacaagcuugccucaaacucaacucagagauuuaccugccucccugccuucugagugaugggucuaaaggcauguaacaccgugccuguccccuuuacuuuucaagacagccccuuagugaacucccaauucacuguuucaacaugacugggagaacacugagcuccagggauccgccuauguccacccaccagugccaaccuuacaaugccacauugaugccugauuuuaaagaaugcagaagacacagucucagguucucaugcucacccagcaagcccuuacccacggagccaucuccacauaucuaagcacggagcugucucaacauauaagacaucuaagagggaauuuuacagcaccaaccugcaguucuugauugaaccuuacaaauaacugccccaccccuuggaugcuuagcccuucuuggauuuaaaacaaacaacaacaaaauguggcugggcuuguacaguagcaacucuacaaaaaaucaaaacuagacaaaaacaaaacacagacaaaaccaggaagcugcuaacagugcaaugcuagaacuggucaaaugcacacacaugugcucccuuaagcaggcguuccuacacaaacagcgacugcaaguaaugugugaaaccaggaagaaguuuuuggucugacugaaccugauacacaggugccaacacagggaaacccuacccgccagaagauuggggcauagugggaacacuguauccaugaaccuuaagcagccauggucaacugcacaugaucacaccagccaauauucuaggauaggcaggggaagggcucacgagucugaagaucuaugggaaguagauggcugcugagagaaggagggucgguuuucuucauggacggcccccuuguagguuacccgugcuccaacagacagccccaaaccacuguacauucaggcaacacuaaagagacugaguaggagauauagauagauagauagauagauagauagauagauagauagauagauagauagauagagauauaugaauagaugaucaauagguagauagaugacagacagacagacagaugauagaugaggacaugaauuugaggggaaugcgaugaguccaugagaaaaaucagagggggaggggaaaagguggauaugaugaaacuauauuguauucauguauggaauucugaaaggaagagaagaaaauaaagagguuaaagcaauacagcaggaaccacagccucaguugguucugcaaccuugccuugccuuuguauccucauuuguguacgguagauaugggaacaugagugguuggagcaaugcagauguaggugggugugcaugcgaaagccagaagacaaacuccugugucugaaauuuucaggaaccaucuaacauugauucauucauucauucauucauucauucaucuauuuauuuugaaguuuaggucuucacuccuugagcagcaagaccccaggauccaccugucuucuccucccgagugcugggguuacaagcaucugccaccauguucuguuuuuuuuuuuguuuguuuguuuguuuguuuuuaacaugacuuccgggcacuaaccugacauacucauacuugcaaggcaagcacuuuaccaacuaaacaauaccucuagaauccaucuggauccucuucccacuucccagucuccugcagacaucagcacaagaaacaagcagccgcuguguucuuuguccgaguuucuucacgcauugugugcauagcugacuuggcugagccuuuuggcacuacugggcacaaagaguuaaccccaggaaagaaaaaaaacuagaaagcagacacccuccaggacuguaaaagaguccuagggucugcucaguacugcuacggggaaggaggugacagcugagugccuuuccacaaaccuucugucaucccugcagcuagaaacugcacagucuaagcuugcuaaguacucacugcuuagcagauaaagggagggauauguuuauacacauuggaccuugugugacaaggggggaaaauacguuagcauaaagcauacagagaacaaaacucagcaacaaaucagccagcccaaccauacuuugccaccgacacacaccacaugcccauagaccguucagauuucaucgccuccuauggacugaaugcucaggguuccuggaaguuuucccaagucuccuaucuguuccccacgucuccuggaagcuugguggugacccauaaauuaagucugacuuucagagcuggucucggaaaacuucccugagaccacacagaggacuggcccaugcucucccucuguguccauuuagcuaugguuuccagagagccuggcuauuguccacugcaucagcaaaggugcuggcuucucucggugggggcucgcuggaaauugaggguagagagauucuccuaugauuguuuuguuucauguuuaauaagagaugaggucuccuauagccaauuuggcucccaauucacuauauaaaaaagaauaaccuugaacuccugauucuucugccucagucucccuugggaugaaauuauaaguaugauauauguauauguguguguauguaugcauaugucacaguugauauuacaaugccugucauuuccacugaggacagcauaggacauucagccugcacaugcuggguuggaacugggacauacagugccaugucaacgacuaguauuauugaacaccuggguucaccuaucagcuccaucaggaaguccuuuugaacuggccuugcuugcagagaugaaacaaauuggcuccacaaggaauauagucagcagugcaguuguuauucuguaaaauauuaauucauuccaucaacaaacagcauccacgugagugugugcgagcgcacaccaagugugugucaggcaucaagggacgaggcacggcaggaaagcucucaggagaaagcacggauugugaaggucaaguuucugugcaaucuuuacaccuggagccaggucacagguggaaggaaacauauuacgcgaauauucuuacagaaguugacacaaggccuuuggacauguuuugcagauaaucacaugaguuuagcagcuucgugggugaugguggucaugaugguggagaggaugauggugauggaagcugcagggaaguuguggucacaagaaugacaguaauggaauaccaauuggaagccagacuuuguucuacgucuucaucagucuggccuaaucuagucaucucagcgaccuugacauuggcccagugguuacccucacuuuacaggggagaagacucagauucagacugguuagacagcugccauauugcaagugcuagagccagaauucaacccagggcaccuaccuauuuccacaguuacaauucgugaccuuaaacaaauacugcuagugacccaccuuuuuuaucauccacuccuucuucuucuugauuaacaaugcuccaguuuaacucuaguuaacuguacaccuaguaugagcaucagccuuuccagacucucuugcagcuaugggagguuacaagguaaaagccaggcuuugacaaugcuggaggaauucucaccucucucuuuauugucuugccugccugggaaaacgaccuggggguauagcaaucacaagcuaaggcucugaaggagaacuacagcagccaugguaucugagagccuuugcucacaacuugagcugccugcuuucaaagcuuuuguaauaagaaaagaaccaaggccuagcugggcaggugggagucagagucaaggacuugcuaaugcaaacauggaacaucaaucuuccaucuacuacuguaacucggggugucacacggaggaccaguucuccauccuaaaacuuuacaggaccagcaacaaaauuugacuauuggugaguuccuuuuguuuuccccaccgcaacaauagaggcauucauguaaccauuucagucaauucugucuccugguucuggaaaacagaaguacagaauuaauguuucuggacuaaacucaacacaugggcagagcagguucuucccguugcucuagaaggaaaugcacccccagcaucuugcagcuccuagaagccacuggcaucuugcuucguggcugcaucgccaccccuccuagugccacugcccucguguggccuuccuuccauaggcacgcuuugcuaugcugcccuccaacaagaaaguguagagcugcccuuagagaccacacagauugucugcaucaucuacuugccuccaaaucccuaaccugaccauaucugcaaugucucuuuugcaguguaacauucccaaguuucuaguauuaggaccuggauauaggagccaugaccccugcuauuugauuacuccaugcauuuguuccauagcuguucacugaaaaacaggaauugugccgucgauaaaggggcagcagagaaacaaugcuuuguccuugcaucauaugcaaaaugccuuuaacaacacgcucugauaaaaccccucgucugguauccuuaacaaacaccaacagaaaaaagacagggugcagcaacuggaaaucagaguuauuagugaauucuaacauaucaucugaaaaagauauaaaggacaacugccccagggaauacugaagaaacucaccaagggauaacaaaaugaguaagacaaaaccuggaagcucacaauaaagaggaacacggguuauucgcaaacauaccacccaaguggggcucccugagaauugugggaaagaggagacaugcaggauuguggggaggggugagguuugcugguacugaugggaagaaauagggugggaauugugggcaagaguguggugggaauuguggguaggaguguagggggaauugugggcacgaguguagggggaauugugggcaggaguguagggggaauuguggguaggaguguagggggaauuguggguaggaguggggcuuacggugacaugugggaagaaacagggcuuacugggaacugcggaaagacaauuucucaacacuuugaccuaagaaugucaccuucuggccacagacugaaggaagcccaauacauuggaauugcauaauaaacagagcaaauagcuaaagccaaacagggagccaucuuugggaagggugccaaaccgaacucuuguguaacucaggggaccucuguggaugccacagacaggacucugaaaugguuacuggcacgugggaaagcaaaucuucaugagaacuccaaccuccugagaagucgacacaacaaugcaugaaaccccuucuggacuggauucgcccugucagaaucuucuaguguaaaaugcccaggggaagcauggguauuauugcccacgacacgaguccccagagccuuccgaucucaagcuuucuuuuucucacuuaacccuauuuuuggaagaaagaagaaaagcuaaacuuuuuacuaacuauaaaugcacucaagcaacacaaauaugaauuacuggaagauaaucacuuuugaagaguuaaacacuaacacacagacgcuuuuacagucuauauauaaacacagcucgaaccaauuguggguauguaagccaccgaggaaggcccaugugagggacaucuguacuggaccuguucccaaucaauggaaagcaauucuucuugguggucugaccacuuaacuuaaacaaaaaggcuugagccaacuucuaucaaugagccuuucuuccaaccaaagaaaaaaggaaaaagaaaaaaaaaaaaaacagaagaauuggcuacugguuacggcaguguugugccacaagguuaauaaugauggguuuuaggucacuggcaauuucucauuucaaauuaacuugaaccaucaacccucaagcguggaucguuuaaugugggcugugugguacccauggugcuccauggacacccacguggugggugggugccauuacucuguccuuggaucauuacugagauagggcuuuccauccuuaagaaaaaaaauuaaaaagaaaaggaaaggaaagaggaaaacaaaggguaaaaauauacaacagcgccuguuuugagauccaagaauauuuuguggacacacuugguugaaaccuggaugggcuggagacucugaauugguuuggggaauuggaacuaauuaugauuuuuuuuuacacuuuuagaacuuaguggggaauuuugaaauaucccuacaucaugagaagaugguuaucuuccccacauugcccauaguuuuuuuuuuucuugcguguuucuuucccuuucaaaugcucccagcacugacacucaccuggaggcuuuguucaucauggauguugggaacaggaacuagaggaugcuagcucacuccucuuuuucuauuaacagagucucccuggucacccaagcugaugguccuacucgccagaggauaaccuugccuucgcagaugagagaagcaaaggaccagaguaugagcagaugcuuacaaagggaccaccaagccuguccuaacagagguuagccuggaggucaagaggagcugagaaaccacggagguaagagaugggaauucagauucccaacuggguggggcaagcagcugggucucaccgcccaaugcugcuaaguuaucuguaugcuuaaacugaacagggaagaaaggggaagggggaggaauaaaaacaagagggagggcagagagcgagcaaggacaauggaaguuaagaaaaugguuuuuuucuaguguugguagacaugcacgcugguuccaccucaguacaaagggacuuggggauauuugucaaaauccuuugaucccacaucuaaaaaaaaaaaacggaucuguugaugccauucccagucaccccucagccacugaugaugcaggccugaccuaaaaccagaagucugcccauggggacgcuguuugugacugcaaaacaagggacacauccaggguuacaucgguggagaauauauaaacuuguggacagcuucuaccaugaggcugaaugccuguguuaucugccuggguucacugacaagggagagagucuaugagauuggcagugauaauggacaagguguauguuagagugaaagacaaaucuauaagcauugucuccacggggccagcuucuagagacgguuuucaaucguugcauuuuggugacaggaggaaaaaauguuaucuugauaguagaggauuuaaauuuauugcauagcugaaacugguuacugaauugaaauuauaaaguaaugaaucauuuccugaagaaagaaaaaaaagucaggccauuaguaaugccacugugugacgaacuacuuagacaugucagaagcagaggguaggggguagagagagggagggugggggcuacuaucugguaaauuauaucuaaauguagauacuucgaagaagaugauaaaucuacguuuaagagggaaaagaaagugccccgugcuuuagcaucacugugaggagggcugcagagauggcccagugcugcucuuccagacgacuugaguucgauuccuagcgcacaaauuacagcucacagcuaucuguaacccuagcuccaagagauccagcacccuuuucugaccuccauaggcacuggacaugcauguugugcacaacuacaugugugagcaaaacauucauguguaaaacagauagacggacagacagacagacagacagacagacagagaaugacagacagacaggcagccagauagacggaccgauggauggauagaaugcuuauugugagagacuaguaaaucuucugcuacuuuuuccucagucccauuuuaaguaacuccucuauaggucccacagaaaucuacaucacuagacacuuuccauacacuggggugguggggguugguccagcucccugggcggcuuuaacacacugguaagaugguuccugcccuccuucccuaucugaaggcacagcaauagaaccaacuugacccgcaucuuuguccaaggcccugcaucuccaaccugauggccagugugagagcaaacaggacaugcaaauucaacuagggggauaucacaagcuggcugggguaucaguuugcauuuuuagcauccuacugcucuuucuucucugcuauguuacugauaccucuagagaaacagcguuucccuaaacaucaucacuacggcagaucugucucugugucacagguucagagggucagaugcaguuacggcgugagaagagcuuaucccugagaggacaugaagcucugaagugucucaccuacagacaaauguacuauauggcacaaccuuugggguggacacuaaguaacacucacagacuuguguucaguguucccucgccaagcgccuuccugagagucacuguagaggcugugcucuuccaacccagguaagauauccccguacguggacaagucagagagucuccugucaagugcucuuugguucccauugaaccagaacaugggcagaaaugcaguuuaucuuuuaugguguaaaaaaggaaaggagggcuggggaggugagucaggggguaaagccuuguaaccccagcucuggagagugguugcagacaggaggagucugagugcugaaaugauaggaucuggguucuguaagagagagguuaucucuaagacuaagguggagaggauggcucaagaacccugcccaugcacaugcauggaugcacccccuacucgcacauacaugugcacauacaacauaaacaugcauacacaugugugcuugcacaaacaaacacacacacagacacacaugcuagaagcaaaaacaaacaaaacagaagggaggguggggggagcacccaaagucacaacgcuggaaaugacagaagcuaacauucuugaccacuuacgugucccgaggacaguguugagcaauucucauguguuuuucucacuugguccuuccagacucugaggcaggaaucaguauuaauuccacauuucuaggugagcaagccaaggcuccuaaagcuggagcaaacuguccaaaaccaugcaaacagcaaacuguccaaaaccaugcaaacagcaaggggcugagccagaaagcaaacccagaucugccucagccugugcuucugagggcccaucugcacuggggcaugcggucuuccaugucacaugucaccccuucuggagagacacuucuucccagaucuaacucuacauccuggaggcauuacaggccagucccaugagccacucguuaccagcccaggaagaagccaucuuccccggaacucccuagggcuucuuuucauaucucuggccuuuccuaagcaauggauuuagcuuuugucuagguuguaagaauaagcaguaugauuuuuguaguguugcugcagaguucucgacagacucccugccuauugauggaaaaagaagcugccacaagucagcccaacagacgguguccauggugaauugagguacauuugguagaauugagccucuuagggguuaugauaaaggauacguuguacugguuaaaaaacaaaacagaagaaaaccccauguauuccgucuauaauguguauauguucaucaaacuccagcagucuacuugauauugucguacugucucuaaagaggaaacuaaaggacauauuuuggggggcauugaauggaaauuauuccuuaauauaguucuacacuaacagacuuacaacauuuuuuccaaauuaucuacccagagucgugggggcugcugcuggcaggcuuccuaugcgaagucauaauuagcagaaaauggaaaaauccaaguaagaugggggcuaugaagccggguucagggaccgagggcaacuguugauccaugagaagaucaaagcuggguagaaaccauuccuggguuuacacagcugcauguuccaugcaggagcucuaaaacaaacacagccaggaccugagggggccgucuugugauagggaguaugugggugucaacgaaucuccaggacaucaagugaccccaggggcuggaggccaccgcacugcagagcuagaaagggaagcuggugcuuuccccacaauccagaacuugucuuuguugaggcaaaauuuuuuauauuucacuaauccggccuucuaccaacaucauaaggaggggggucauuaacgacauacaagaacgucguggaguuucauaaacacgaccugagaaaaguguauuggucagagcuuauuaaucugaaaaugagaaacuagccacuccagcuccuccaacugaguugcuguguauggcgagccgagugagacccagagcuugcaaaacuccuuuagguacauaaaucccuaaacccaguaauaacagagccauauguuacuguguuuguggguaugaauugcuguaugagacgcaaacacaacagcagcucccacuauuguuugaauucauuaaaaauaacaccaucucauaagcuugaaaauguugauuuuuauuuuauuuuauuuuauuuuuguauuauacaauuuucauauuucccuaguguauggaaauauagugucuuuacaugguuguuuucaacuugauauacaugcaauauuaggaaaugaaaauuauguguauauauauacacacauacauauaugaacucugugguucauguauuagaaaacaauauguuuugcucauuaaaggcgccaauauaaaugcuauaaaccaugaaauuaccuuugagcccuuccugaaauaaccaguucacaaacaaaugauccauacagaaaggcaaaggggagauuacaauaagacuaagucacauuuucauuucagaauuguuuuuaauauaaaaaagcauuauugccacaaaaaccaacaucuggggcagguauauccaauuuguggaggaaauaucaaacgguacaggcugagaauauaaguucaaagugggggcucuacguguuuuccaaaugggauacagaacucacauuuacaacaaauuaucccaauaagagaaauuuacuuuuugguuugcucagcccagagagccggcgcaaaggcugugguagcaaaagcccuucacuaaagugagcuugaugguguucagacccuaaggucauagugaugaccaguggacacugugggcagaagggaacucacccuguaacucagcaugcucaaacugaaacuaucagucuuuucaagccauuugugcacuaugcuucccagacaaauaucaucaacaccagcugggaauccaagaauguggggcauugggucccauuccgaaagucuugaaauaaaaggcucugggauggcguccugggaugucuucuaaaagguccucaagaugcuguuaugugcucucucuugagaacauguaccacggacagacaugagaguuaaagauaacgauucacucuccucugagacuacaaggagccuccacagguucuucaaccugcuuccaagccauugauccccacucucucacaaugccaaaggaacagaagcuaaggcuuugugcacaucugcucagauugagcuaugccaugcuuucugcccuaacguauaugaacggcaaagcuuucgacuauacaggcucagcuaacacugccaugacugaagacagaaaccaaggucacaagacacaagacacucccaaaagucuuccgggucuuaagacagcagacacagcagaaacaggaagaguccagaccucugagcaugguguucugcaauagcugagccucccugugugaguccucagugcaagucuacaugucuacuuuuuccagaucuuguuggcaacucauucgugcauucauccauucuuugcuuuguguguuugugcauuuaguaagccauucauucauguaauaagaaacacugacuuaaucaucucuucuccccgccuucauuuccuucucuccuuccugucuuccuuacucuggcccccaucuuagaacaaucaugcuacagcacacugucuucuaauagcagaauaucauuacucuacuaaugaauauuaucaugugcaguagauugcuguauuucaccaccauuuuauaagguccaccaucuagugagagucauaugcacaaggaaaucaucauaauucacuggauuugguauaaaacagaacucuccacuacgaagacuuaagucgaugcagaaacuuauuuuucucacauucucaaugggaaggagcaauagauacgauaaauccaagcccuacagaacaagugagaaccaagugagauuagaaagggggaaaguugggacuacaggaauagcuccguguaaaguguuugcugcguguacaaguaucaagacugcauuugaucccuacaauccauaagaaaagccugguaagguuacucaccauuguuaucccaacacaugggacucacuggcuagccucucuagcuaaaccgguugaguccuggguuccaaggaagaacccugucucagacaacaagguagccaaaaauuuagauaccugagguugaucuguagccuccagacgugugcacacagaugcaccuccccaaacauauaaaaacauacacacuuaccuacacagaauauacacacagcaccagcauacaaagaaaguagguaguaagauccaggcaggagcaagccaugaagcucgagggcacuggcucaccaacugaaaauuuaucucuggcaagaaacauguauuugugccucuaugucucuaccucaacucugggcuuggcuagagcugcugagucggguccaguagagauuaaacuggacaggcagccaggaggucagcucucaaugcaguaguguuacuuagagcucuaguugaguacaggaagaaaugggaauugaggcgagcaggcuggagcccaguaacaaaggcuggcauucucccaccagccaggacagugggggaacgaccaaccacacacauacucgccugcuuccuuaaaggacacaucagauccaggcagcuuacaacaaugaggaggcgggagaaagaagggaggaaggagagaagggaucacaggauaccuggacaaguagugccagguuaucagaggagagggcucaggagagagggccauugcucuacacuucuguacgggugagacuugaacucaguuacaaaaggugccgggagggagagcaaagauaaggaauccucuaugcccccaucugcacuuuacagcuuaaugggagagagucaaugucuccagugcugggugguguuggggggaggggggagagauuccuauugccuagcuggguugaccaauggcuuggaggugagaggccaccuccagagccacacaggagucagaucugugaggcugagaaggcuaucaggcaggucccaccuggggcauauccaccuaggggcuuagccaccagguucugauacccccccaccccccugacagaaugcaccccuuuggccuagaucucucacugccaaggacucagaagugggauucucuaaccuguccuugaauacuuuaccaaguauucgaugucaugcucuuccaacucuacugccccuccccucccccucucuccaaucaaucuggagacaguagaggguucuaaacaccucaaggcaaggccagcacuuaccccacauggaaugucccgucuuucugaaaagagccauauuggcucgaucauguaaauacauuugaagagagcuuuuauauuuuccuuuucauuucucuucaaaaaauaaauaaaacauaauuuuucaaauaaauccuaauuuaaagcauuuccagguccaaaagauaauuauuugaaccgcauaaauaccucauguggguggaacggggauugcaugcauagugauuaaaaaaaaaaaccaaaaacaaaaaaaccuuggaucugcuauuuucuuaaaauugcuguguuguuaccauuuuuauugaguucauuaaaagaccauaaaaaucaauucaaacauguuugcaaacggauuuccaaauuucaugacaacaaucuuugguuguuaggccaaagauaagaugacagaugucucuauuccuacggcuuuugugucgccauucauucauucauucauucauucuucauccagccagucaacauugcccucuguaggccaagcacugaggcggagacaguccccaugcucagggguggugauggacagaagcugaggugcacuggugauauccguggguggcgaauuuuguauauaaaagauuagacaguaucuuucagccuggaagauauaaugccucugccguaacuccuggccucggcuacugcagucugaaagcagcuggcuaagcaaccaggaaauggacaaacagagcuggguuccaaacaaacuuuccuucuggacaaucaaauuuaaaagucacacguuagucaugugaccugaaauaguuuucagcuuugaauuuuaauuuuuuuucaaauauugaaaaauguaaauuauauauauauauauauauauauauauauauauauauaaagcagggcuugggguauaaaauuaguaaagugcuugccuagugcacaugaucuuggguuugaucuucaguauugcauuaaucagcauggggaugaacaucuguaacagcagcagucgggagacagaggcaggaguucaaggcugucuucagcuauacaggaauuucugaggucagccuagauagacaccccauuucaacaaaagagaaaaaaauuaaaaacaggccaaccauaaguaaaauuugauuuuaagaaggggauucccagaaccuaauuuagguuguuauacaaagaaaaauguacugucuucuggcugaucauuaaguauccagacaggacaauguugggacuauaagccuaaaaucaguccccagggcuuccucuaacaacccagguggcauugcuuauggggugaaagauaaagggacuuccucccuuagcuacuggcauucaaaugccuuggcccauuccccugcccauuucuuuggugacuuuuccuagaaacucaauuccaccuugacaaaguacuagguuugcuuuguuguuguuaaaaaacugcaacaauaacaacaacaaaacccacagcuguauaacuuugaugaaaagcuaaaccaaugcuuucugaaaauucaaagaaguauuagcccauaguaugaaaccugggaauccaaacagaacauagauuucauggucagcuucuaaaacucuccagguagccaucucaguugggaaugaaaggaaaucgcuguaugagucccaggccccuuauccugacuccauugcucaaugacagccaccagccaucucuguuaugaugagagaaacacaacuuaauccaugugacuggcccucugugggcaacuguucaagcacaugaagguucuaauguaauuauggagcauggucagccaauuaacugcaaaugugcuguuuaucugaaagaggccaacacugaagucugcugaaaauaacacugggcucugauccuuaagcgaaggauacacucugaaugaaaacagggaacaguagaaaagcugaaguaaagacuucaucugguauuucugaagacugauucagauuaaaacaugcuaucuuagcucccugaauauuuaccugaugaauuaagauggaauuccuaguaacugcugacaaauaucaacuggaugagagagacagagagcgagagugagagagagagacacagagacagacacagcaagagagacagaaagaaacagagagagagacaaagagaaacugaaacagagagacagacacacagacacagagaaagacagggaaggagagagacagacagacagacagacagacacauacacacagagggagggagggagggagggagagagauagagauacagagagagauggacaggagagagagagagcaagagagacagaaagagagacagaaauagaaacagagagaaacagaaacagauacacacagagauagacagggagggagagggagacggaggaaaacagacagacagacagacagacagacagacagacacauacacaugcagggagugagggagagagccagaggguggcuauaaauaucugguaccucucaccuggccuaaucucuagucuuaagcugacagacugguaacguucgucagcucuuuggaagcuucucggugguuuagaaacuucuccaugucccuuggaucucuaaaugucuuuaacaguuugggaaaaauuaaacuuggccuuagugacugaauagcauaacaauucucauagcuucccccaucuaaagaauuaaaaagaaagagacucaucauaugauuucuauauauacaauuugugcugcuguagaagcauauuuugaaaagugcucccuaaauaauuaaccuauuccuuuuaccauacuuccuauauuacagaagucauuuucccaccaagaaucaauaagucuuuccucaugucagucauuuuucuccauuuaacggaauggacuaaaguccgacacggcaaguuacauuaccuuugaauuaugugcguaauuuaaaauucaaaguacugcgcuaaggagcuuuuuagacugaccacucugcacgcucuucauaaauauggccccucagacccuucugacagauuuaccgaacaacagaaguuagggcgggucgagacgagagcccuaugguaacguuuccugggucacgcugcggcaggaacaaucuucucucagaggcagcacgaagcaggcugacauccaucacucaccaggaaacgaagcugcguuuccagauuaaugagaaagccauucuagagugccugggcuuuaauuacaaauaaacacgugggcagauauugacaugucugcuuugugaguauguggggguccgcaaggccaaucgugcuuuguuuggucaaaucugggaccuuggagaaaacuucagguguagagacccaagaggagugugcuggcgagauccuucaguuaguacaacacgcacaaggggaaagaauacagagagaugaaaauguauaaacgggccagcgaggcgauucccuguuacaaauuuaauaaagcgauguuuauaaccuugcacugaaucugugagcugauguccuggggauuauaaaugaaacacagcugaccucauucuucagggaaagaaaaagaaagugacgauuggaaaugucaccgaguuuucucaaaucugcgacggggugacucacacucuggcugguagaauuuuuuaaaaaaagaaaaaaacaaaaaaaaacaaaaaaacaaaaaacaacaccugccaugaagaaaaucaguucucuguauacaaccuguaauauuuuacuccgagcuuuggagaaaauaucacaugauuccagcuggcauaagagaaagauuucgugaggaugugcucacaagcaacguuggcaagaaaacagcuucauuucagaacucugaucugcaagugaauggcugggccucuuucccugaccuuugcucaggaagucacuacucuguuccuucccucugcuccaucguccacucacccccucuuuccccuuuuccuccgcagaaauucauugaaauaaauguguggaccccugccgugaaagcaucucacaugcuucccuuuacagaaccccuuuagggugugccuucuuggguucuccaaaaacuacuuuccuuugcgaaaguuuuauuuauuuauuuauugccaaguuagcaucuugaaaacaaauucucucucucucucucucucucucucacacacacacacacacacacacacacacacacacacacacacacacgagagagagagagagagagagagagagagagagagagagagagagagagaggaaaauaggaaacacauuaacucuccugcauucacuuuugacaaagauggcauuccaaagcuaggaagaaacauuguggcaaaaguuuugcugcggcagccugugccccgacucucccugccagcuugcaggcaugccuugucuuccuuuugaguucaugagaagaaguggagccuuccugcugggcaguacauuacuucugcauggcaacacuguauaaucccaagcacccaggaccuccuccccuccccugcguuaguuuucuuuuugcucuuccaauucuugagaugauaauuguuucccuaaauuugucuggauuuuacccccaauuaggagaauguaguggcucucaccuuccugacagaugcuuaaauauaaaugagucuauucuuguaaggaaauaccgaugagauauaauaccucaugauuccaauggucaguucauauagaagaaggaacauauaaaggaaugauauucucuggcuuaguuuguucuaaagggguuacuccuaggaaacuucaacuugacacaaagggagguguuacauuuauauugggccccucuagagaacaaaggggcaaaaaucaccacgcagcagguacaacacaauucuaacaaaagaugggguacggaacauauuccuuuuuugcagagaaaacugcaacguagcuuggcuugcucauucugcacaaacugcauucaaacaaaagucacaaccaucaucacaacaaaacccaaaccaccuacaccaaacuaggacaucauuucugauacuuauaaagcacgacguucaucaaagccuccgcaguaucugucccaggccugguaaugaauuuccuauauguaccugcuguugaaggggcagggggggggggaaguaaacucauaaauaauucaacacacugucuccugccaaccgaucauauauuguccguguuucaccugccauauuaaauaaaaauuaaaaacucuuuacucuuuucauuaaaaaaagugcccagggaauaauuagaggugaccacacaaacuacauagaauggggaagaaaguaguauuucuuuaugauauguacuguauuauguguguuaaaaugcagagugaaaauagucacuuagaacagcuguaucaaaaagggaaaauuagcuaagucucaagggaaacgauuauuguaaauauuuccaaaacugcuguauuaugggagaguuaaggguucaaauuuaagaaagcaggcugcuuggaugccuuccugcaggcauuauuaaaaaccaaccaggacucaaacacuucauucuuuuguagguaaaugugacuccacugaccuuagccacuuuuucuaaaaaaaaaaaaauagaaaacagauccaacacccaguccucuagaaucuaucuaucuaucuaucuaucuaucuaucuaucuaucuaucuguaucuauauauauaugccaaaagaagccuuuuugccugaagguuugauucagcuaguuucaaaagcuggguguuguggggggauuuuaagugguccuguccuugccccugugacugcuccggugucuuggcaggccaugagaagggaggcaccuucagagucuuuaaauugcuacuguuacuaaauggaaaaacggucaucugagugaagagcccagggaugccugcagggggacagcagacugcuacuguguccaacagaggugcccugugaacagccucucuaaagggcagagggauagaaggaguuacagugcuuuguggauacagaagauggagacuucugcuugacuucaaagacucagaaaugggcucacaccuggucagaggucagagauccagacucugacccuggcagggacuuuaggcuggaugguagcucaacagucagggcuuaaccaguuaaagacaccugugaucacagcgcucuggaggcugaagcaggggaauugcugugaguucaaguaagcaggggaugcagaguaagacacuguuucaagaagcaaaggaaaacccuugaagaggagaaacguugacaaccccagcagagaagucugggacaucaagucucacucaaacauguggagacauguuugauuuuauuuaaagaacucccagccaguccacauaguuuuuaaaauugcauguuuuucucucacuuucucucucuuucuuucucucuauucuuuuucuuucuucuuucuuucuuccuuucuuucuuuucuucuuccuccuucuccuccucccuccucuuccuccuucuccuuuuugaauggaugccaaagucagauggccacauccuguccuauugcauuauaaaggaucaauccuuguucucacucaggagaaaacucagagcaugacccccauguggaagugauggaguucaggaaccugguagugaaauggaccagugauauacguggccguccuaguuucaaacauaauaaaaauaaauaaauaaguaaauaagaacagaagcgcucaugaaaguaacauacuuuagggcagccaacugcagguaaauuuggcuuuccuuugauagcuaccgaauaauaacaggaugguuucauugguggcauuuuucccuggucuauuuuuauuuuuuauuaucuucuguuguuugcuuuuaguuuuaaaaguccuugcaaauacgcaacuuauaaaucaugccggaaaugcguguauuauuucauuugggggaagaaucaaguucuagaaggcaaugcucacauuucacuuaauuaccaaacaaagacauaauggacuauuuuucuguauucacgagagacagaaggacugucaguuugauugccuguuaagguuucggugaaucacaauguuauuacgcuuuuaaaucagaggaucgguuccuuccgcuaagucuaacaauacuagaaagugagaaggaggggggaaaacaccucaucuggggccguaauauuugcugaaaaaaauccacuucaaaacauuaaucaaauuuuucgccuacugggcaaccauauggcagagcagcaugcgaaucucacaaacuugcugaucuccuguaaccgggugcaauuaauuacgcuggcugcauccaucucuuggauuuucgccuugugaaaaaaaaaaaguauuuauuguaacagcuuuuacaaaacaagggaaugaaaaucucaauugauuaaugagaggaauggaaauauuuccguuagcagauuuaaaaaaaaaaaaggauuaaugcuguggauggaaaggcgcccaccucaagcucaccgugagguggguuuguguuuuuauuuuggaccccccaaaagguagaggaagagugggcugagaagauacccggagcucugaaaugcauaauucacuagcaggcuuuggaucgcaaguaauaaaggcuuaaacuggggaaguaauaaagagauuggcuuuacaagacacuauccugggagacagaaaagcuucuuugauuugaaaacacugaucuuaaaggacucaguggggugaggaacaggacagcccugacaaagcaggcaauggagggagcucuuaaaguaagcaggacaccccguccucagcuaguuacgccuggagacugcugcacaucugggcagauuacgguuuuagggcugccccaucaaaacagguguccuggaguguguuaggacuguccucaccuacuaacgcaaggugcggacacagcgugaaugugacccuuuccccgugguauuuagacugugaacuggggcagucagauccacuucaaagagugaccguuaauaugucacugagguaacaguccuucccucguggaggacugaugggccccgggcuggggucuguaggccagcaggagcagugguccuuugucucucuccaaaccuguccccuuucuguggaacccccagccgggguggacaguugugaccuugucuucccagcauucuucacucaggaggguuaauuccacacucuuuaaagaguuagcccaggaggcuggguuuaaaauuccaauaaacaccaccuugagaaaauaagcagaauacuaacuucaacagaauuauacguguuuguaagacugaggacuggaucgcauuugcaaccaaugaaggaaaaaaaacauauuagagcaaagcuuaguaacucaaguuacaggcugacuuuucucuacagugacucccacauuuaaacgugugccaggaaaccauguggagggccuugucuuuuguuuuacuacaaaugugagugucugguccagugcacgcgagaacacuuguguacucacucguguguggggagagguaagggacaauguccugcgucauccucaggaauccaucugccucuguuaauauaggauuucucacuggccaggagcucacuagugaggcuagacuugccugaguggggagcccaagggauuuuuccauuuccagcucuccagcucuggaauuacaaacgcaugccaucucucccccagaacuuuuuaugugaguucugggaucgaacucacgucuuaacgcuuguacggcaaacauuuuuaccuucugaugucucccuccagcaccugcaaaugacuuuugauaagacuucauuauuauuuuauuaauggguacauaguauacauguggcaaauaugaggauucauguuuuguuuucuuuugguuuuaguguuuuuuguguugguuggugguuguuuguuugagagaugaaaucuugaaucaccuaaacucucugggugucuaagcgagcaguaucuaaaaaaaaaaaaaaaaaaucacaguauuucauucgagcaacccauccuguacaggauguauguuuauguuaacacucauguuugaaaauacugccauagaggaaaaagaauaauggugaacuuuaagguagcagacguauccaagcggcuaagagacauaaaagccacaauggguggcucccaaacgcucccugagcuaggggaauggcacacugguuagccugccugcugcaccagcauggggaccugagccuguagccagcaugaaggcugugggagguggcacagaucugcaaucccagugcggagaguggagaaggaugaaacaggggcaucccuggagccugaugcccagcuggucuagccaaagagaugaguucugggucaugaaagucccgguuaguucauagguagguagguaagcaggcaggcaggcagacagacagacaggcagacaggcaggcagacagacaggcagacagaaugaaaaguaggguggagaaagauuaagaaagacacuugaugucaaccuguagcuucuauauguauagccccacacgagcacauucaauugaacauguacacaacacacacgugcaugcacacaugcacacaaaauaauaauaaagugaaaaucuuacuacaauccuuuaacaaugagagucucuuuacaaucaaagaagaugcuguucuaaagaaagcaccgaccauggaagcacgcaagaaaguuacccugaaaaaaguccuugaugucccaaagcaaagaauaaauaaucaaagggaagcaggccggcugauuccgugaaccggugacccccgauugcacaccuccacgcacacagcaccccucggaugauccccaggcuccuccuacacacaaggguuauuggcuuaaaaguuuaaagagcuaacaaaauguuuuaacgagauacaaaucucagagaucauuaaucaauaugcucaauguuauuugcgauaauucaucaugacgugauauuaauggguuacuguacccuucagaggugagauuaaugcaaaugagccgccacaauuaacuuuacugcucccaacucccaggaauggacagaugauuauaaaugacaacuauaugucaauuacaauauccaauaaagugaggcuuggagaacaaucuaucuccguuuauugcacuuccuugacguggcugcauucagcacagcccacuguugucucuguguaaccauuguuuggggagggcaaggggcuuuccuuuuucacucuuucaguaucguacgaaaagugcuucugaaauguccagguaacugcauuuuucuagaggaggagcgccacgggaaaccaggaacaaaugccuucaccgccgaguguguuuuaaagaagaugguguccaucuugaaaccauagcagccaggccagcacggaaaccaccuacccagcuguguauaauauauuuacucaauuacaacgggaagauguuagcccagcauccugaauagccuugcguuucacuaaacaaaacuuaacuugaggaucaccacgggaggaaacaggucagacugcagaaagugagccugagaagauuucagcgggaagagccugaugucagcuugcacaccugugcuggggucaaagaagggggauccuguagaaugcaugggugcaagaccugacuucagagcauuucaugaaugcucuguuccucucugcauggaggacuuguuugagaggagcuucuggaugaaggugagcacucuguaguacugccaucugaaggugagcacucugcuguaguaccgccuucuugccccagacccuuucucugagcagagcuacccagcccaggagacaccagcuauugaugaauuaugaucacaugcuucuaaucugccaccucccccuauuccccagggacuucucccacauagcccgccuucccuggcagauguucuccaaucacggacugccgucaguuaaagccuugucucaggcagggccaauuuggguagcaucacuuggcccuccaggagcuccuguuggggucagacugaagccaaccuucaguggaagccacauucuugucgggaauucugcucuguggccucugucuuccuuccccuuaggaaggcaaguccacccagaacacaggggagcagcguggagcucugcuucuagggacagaccugagaacagguaucggaagcaugugagcaggaaggcucucccuguagugucgcuuagaaaguggcccuuucuuugcggaucacuggugagaccaauucaucaagcaguugacaaucacaccgggauuucuuucuagccccagaaacaucucgaaagacccagagcauggggugagcuaccgggagaacacuguggaugggggaagccauggguuugccuguccaagaucuuuccugaggugcuuaguccggugaugugagcaaagaugaugcugucccaguagggaacggagacuccuagcaucauguacaaagagggcguuaacaccagccuacauauggaacacuauuaccugggucacugcuggugauucacgggaggucucugcccaauaaaaaggccaagcgugguucucccugagcuguuuguaccaggaaccauggggaaaagagcucacugugacaagggcugcugucuuagucaccucucauuacugggacaaauaacaaagcaaacacugcaagccagagaggauuuauuuuggcucacgguuucagaggucuuuguccacggcugggugguucuauugauuaugaaccuauggaugguguggcauggaggcagcgauagggccaaguagcucauuucaugguggaacaaccagaggggaaacaaaacacuggagggggccagccaucagacagaaccuuaaauaguaugccagcacagccuacucucaccaagcggcccucacauccugacgaucuaauguagcaaggaauccaccaguagauuaaaacauugaugaggguagcauuucaugguccagucaucucucaauagcacagggggaccaggcagcauaugacuuucaggcaaacauuagcaguugcuaagcucggaaaggucugacgucaguagccauccugguuuccacuaaaagagcauucuuuggggcacguaccugcaaucccaacuauucgggaggcuguggcaugaguucaaggccaaccugaggaacugagugagacccugaaucaaaaugaguaacuaaggccuggagauguagcucaaaggugagaauacuugcuuagcaucugugaagcucuggguucaaucuacagauaagagagaggggcugacacaguacuggggcuggacaacaccucagccaacccugaaacacugcaaccuacccguuccugugcagaccaggagugaaaacaauuguuuuuaacaguugagagagaaagaaaggagauacaaaagaaguugcaagaaauucaaaugccagcaucugcaaauaaagucccccccaccccccacccccgugcauggccauacuggaucauuuaccuacugauaaggcuguucgugcaguguugaagucaaaaggaaggaaggaguugccacagcauccgcauggcucagagccaacugcuuccaugaucugucucauucuuacaucccacaaugcauguugggcaauaacagcaacccugcugacuuacaucauuugaacuuggaccuuccguguacaagaacaaaagccacuuuccuucccaccuccacacccacaguggaucaggaccccacagguaagaaugcaguguccagauggacugauggauggcuucucucgcuggcuccugugaagcuauugcguucuuugcugaaugucauggugaguauguugaucuuaaaaugggugaggcacauaauggcuaucaucacuccagcuacgaggcuggguuuucuucaguguuucggaaugaacgugucuuuaugcacucuaggcaaccaugcucccacugagcuacacuccuaugggaaaaggggggaaggggggccauugggaaaagggggcucaccucauaaccucugagcaugccuaguagugauggugauggugguaguggugguguuauaucuugauuagguuaacugaugugggaaaacucaucuaaaccauggcugggaccauucacagagcaggagauucuggauuagagggacggcaagugcuggcaucuaucaucccucugcauccugacuguggacaugaugugaccagcguccucagucucuagcugccuugaccuuaccugugacgacaggcuauaccccugaacugugagccucuacaaagccuuacuccucugaauuucuuuaaucagaggauuuuuuuuuuuaaucacagcaacagaaaagaaacugacuuacuuggaaugcuguaacaauggccuuguacagaugcugugggcacacuaccauggagugacauuuccagauauccauuccaaauuuuauauauauacauacauacauacauacauacauacauacauacuacauccaaccauggaaacugaugcugucauuuuaggccuagcaauggaagaaacuggggagagaagagaaauuccuagcacugccacucuguccccagucuuggggaagagucugcugugaucagccagaauagaccaggccauuguggucaugguucaggaaauccugcaggccggugagaggucagcgugcugcugcugacuccugcgauggaugaggaagacaggcaaugauuuccugguucccaucaagacacacuuccagguuuacguucacccccccccccccccacacacacacaccuucuucuucacuuggguccuaagacaggagcagcgacccuggccagagccgauucgcccugcuuuccuggacacgucagccagggcugcuggggaggguuagauggaagaggcaagcuacuuuauuucaucagcauucgaguguaucuggcuuuuaguuuaacaauacgaaggcgcugaugggcaacuaaguuggagcugaauggcucuguuguaucuuccuuggcaggggugggaaacaguacgacugccaggauaaaucacagcgggcagcgcaggcacuuucucgugcaggaguggacucugccuuuuuggaaaugccgaggugcaaacgcgccucagugagucuugcaaagggaagaaauugaaauugauuucuccggguaauaauuaaccucagaaaauaacucugagagguugcuuauuaauuauuuuugcuaauauacuuugggaauauuucuucuuuucaugaaagauagagacaaaagcagacacauuuuaugaucauauaaaauguuauuagauuccuauuuuauugaagaguaaaacucacuuaauuugcaaaauguucaauaggaggagcgaguaucugccccaccaccaucucacacugcuuuuuuuuaaagcuccucaauggugcuuuuuugaaaccacauggucuugcucgucuuuuucacacauaacugucucugagcuuuuaauauauuguugcuauuucagucucccaugguuuuuuccuacuuacucaaaaaagaauguaguuuucaucugaauaacaguguagaguacacucugaggacaugcucauuucuuuuuuuuuuuuuucuuuuucuuuuucuuuuuggaagaucagaaaaaaagcuuuugcauccaaaaaaaaaaaaaaaaguguuacuacuccacauaacauaccuaggaugaaagauucuacaaagauugacuaguaguuuacaaucacaaacacugugaucugauaacgucacacacacacaaacacacacacacacauauuuccugaaaaugucuuuaucguagcuacagcuagcagggcucaagcucacuccguugggaaggaucucuccaagagucucagcggcugucacugaaguccaacucuaaauaugaacggggaacugcaccgcaaagacgaaccauaacgugacauuauucaaggugcuuuauuuuuucccccaucccuuuaguggcuggaaauccuuuuccccuugacacaaaauuuuccugcacaauuuauacugcacaaaaauuuuauucugcaucaauuuauuuuuuuuccgggccauuuacccugugaaaaaucccauacccaauuguauccuguuuuccuggagggaagcauuuuguuuucucuaagagacuaaccaaaagaaacagcggugaaaacaaaacaaaacugcuugugaggacaucaugaagcuguuucuugaagcauucgaaauauaaguuuucgcuaauuaauuaacaaauucaagcugguuaaauaaaacccccuuuccaacaccuccuauuuaauugcaguuuggcaccaacaaauauauaucaaaauuauaguauuuccccugacaggaagcuccuucucugcgcgugcuguuaugacucucugcagagcgagccagaauugcugacaaccuugaacgacacuacaauauuacuauacuuggcagagaaguacccuugcggcaagagaggagcuguaauuuugacugucacuucacauugcacaagauauuauuucacuguguacacacgcacacacucacaaacucuuaauagacuacaguuucgcgcugccugacuuuccaauauaaauggcaauauaauacgaggggaaccgccaaugggauccuggcaagaaacaaauguuuugcauuaugaagagcgcugcuggaggaugcuuucuaaggguucuccuuccuuugccccucacuugcacuccuaagacccuagccuugaucucaugagccuuggugacuaugaacaacuguccuuuugucaucuccagggagagcgaaguuauuuccggggaagaaaauuccccgggauggcacggcccuggcgauaauccagaugcucucggacucugaugccugacauagaagauucuuccaguuuuugaaaggcacuuuuuuccccaccccccacccccaccccagugcacuuaauuugcuuucuuuucacagagaaggacuugguucaucuuggcugaccacuugcuauggcucgaccaaacugaggaaacguggcaaggccccacggaugucgccaaacccacaggcugucccugccagggagcagcgccugucuuugcagagagcugcuugcagcauaugcuuccuucugccugagcucacacagaagcagauugcgccagaucccugcuggcucuucuccccgcagccuggauuuacaagauggugcauuaauaggccccguguuugucccaggcaaggaguucugugguguccauaggagcuuugaauuaaggacuccgggguuuucagggaauggaucagagggaugaaaacaugggcagauaaagccagaacuugacccagaagagugucagaagaggcuggcaggaaagaagagaccuucaggagcucucuuaaguagucucucagaaaacuagaaaaucaaaauuaagaaaggaugagauuggagcacuugucucaacacaaucucugccaucuuaaaaaaaaaaaaaaaagacccauuucuuuaaaauuacaaccccacaagagccuaugaagauuuaaacuuguuuuacugaacccagagaagcugccucucuguccucuguuaggagacugcauccagagcuucacccugccugcugaccacaccagauuuaacaagguucgcaaaugaacuagaguaaguuucccacagugacacauuaauaauaaguuccuuaucccaucuaucccaagccaugaauauguaauguuagaaaaugaguccuuuuucacacacaacagaaccucagacgugaauaaauaaaaacuauccaucacgagucugugaaaaauuaaugagcguucagagacgcgaggaaaaauggggacugaggagagauggcccaauucguaaaagcaucgcuuaacuuucagaugguaaauauccucgcccccgccccuugcccggcugccaggugggggugggaaauggcaggcugucuucccaaugugcugagauccacugccccucuuaaaguggcagcucugacagggcuacagagagaucccuacuucaagggcuuaaacuccgagaguuaauguggcgccaaccuggacaggagagcaggggcugauuuacuuaauuauuuagaauucauaacuagcugaggaugugcucagccaggcugaggaaacugggaggagugagaugacuuugaagaugaaacuuuagaaaggugggaacuccugcucuuggccucuucuccuucacaguggccacagggcacaaggcaggauuacccaugagccuucugcuaugauuaguaacaugaucaauaccacuugcugggugccaucucucuucccaagugugcugagugcuuuguccaagugaaugccaauucucuugcccauuccguuccauuggacacugagguggagcggggauaacagagacauccccaagucuaagaaccagaagacgauggcuaacuaacccggagggagcccucuaccuguaccaucuguggcugcaugggucaaagaggauucagauucagcugggagugggucaggggaaaaacuauaaggacagguagguguggguggaccugugguugacacuguaaggaaaucaggagcugcuacuaggaagggggugugguguguggugauaugauaagaaugucagauuugggugggcaaggaucugaaucugaaauguuuucgauaugaaggaguagaagaagaggaagaagaggaggaagaggaagaagaggaagaagaagaagaagaggaggaagaagaagaggaggaagaggaggaagaagaggaggaagaggaggaagaagaggaggaggaagaagaggaagaagaggaggaagaagaagaggaggaggaggaagaggaggaggaggaggaguaugaugcaaaacaugaaggguugcuccagcauaacuccaggauacacugagccaggguuuaggucuuauaccauuauacugcuuggccacuuuaugcuagagucuccuaagagcaaaaggacagucugagagacccuuuugugguaccugccuccaggaggucaugucacagggcuaguugaacuaggcugauucacacagugacuugguaccgauacauacaaccagggcguuaacaaagaugaagacgagugaaggggaagagggggaggcccugguaccugaugggagcggcauuucaucccacgcagggcagggacuaagagugcucccuugaaccugaaugggcugccugugcuuuacugggcaagaagggagauaggggugcgugcguuuguguuuucucagggggaaccccaaggugaugcagaguccaaaguggaaagugugagaccaguucaggcaacagaagcagucaauagugagaaaggagggauaagaaaauaauccacucuuggugucuaagacauguggacaccaacguaguccucugcccaggccacacugaucacagcaccaugcccagucccucugccggggagauccacucuugaagaagucauauaugacagccugacaugggaaagggagaggacagauacugacuaggcacaggcaguuaaaacucuuaacuuuuuagugugggcugcuuaaaacucugcucacacuuuugcauaaauuauuauguauggaaagaguugagcaaaccaaaggcaaugagagcugaccuguaaacccagcacucuggaugcaaaggccagaugccagcccggggccacaccaaauguaucaaaaauaugaggggaugggggcgggauguagcaaauucugaccuuaaagaguuacaaauauguaacauguuuacuccacaggaaccaguuuguuuccuuuugcauuccagacccaaugugcacaguccuacgcuauccaguccauauuugacugccaaacuggacgaccacuuggaaggauggaucuuccacaccaucuugacuuggguauggcuacauccaacauagugcuuuccuaccaccuucuugucugcuaacccuaccacauccaccaucgaggauggauccagcaagcacgucacugcucaagacagaacccacaucacccucgauccuuucuucuccaugccugucacuccgcugcugucguugaccaaaccuuacuggcuucucccuccuuaagcccacucgugcuucucuccucccugcuuucucugcacacauauggacucaggagcucgucaguucaucaguucucaucugggggguccagauauccacccugacucuugguccccuuccucagagccagcuccaaagaggaaaguccuacuuuccacuguucugcuccugaugccuuccauggcucccuguggcuggacugcaugucuguagagugcauacguuuucugacagcgugcauucuuuagcagacaugguccaguccgggcucccuuggacacagacuucugacuguucuggugaauggagugguuacuuuugaauugcacacacacuggggaaauccugauccuggggaaacucagaaagugccgauauauggggaagaagguugagaagguucgccacgucaguuugaagcugcaggugggaaguuuagaccggacugucaggucaccaaggguucuuaaggacacauguaaccagagaugacuggauuucuaagaggucaguguugucgccuguuuaaacugucucugcaccuaauggccuuccuguggagcuaggcucucauaugacauuucaguguugaaaagaguuagucauuuccauaugaccaagauguaaaagaaauggcaaggucagacgguaaccucccacuggaggacgguccuccgacggacacaaaauuccugccauucuacgaggaaaacaagaaagagguucuucagaugaaaugccacccaggcccucucgccaaaugaugaguuuugaagaaucgggaccugugaaaucucucuugguugguuuucgggauccaaaugcuaaaggaaccugggcaggugacaggugcagcagggcugucuguaggacagaagaacuugaaacuucagcacgcuguggcgcuguuuggauggauaaaauguuggaagccagaguggcuuuacacgggcugugauuucuguugacaggaugcauccgcucguucuuucaaccuaagcaaaauucccaggacugagauggauuugaaagucagguggacagggggaccaucugugggugagagaaugcuuagagucaucaaaagaaaucauggaaaaguauaugacuccugcagacgcacagcagcauccgcaguccuaccccuggugaccucaagcagagguagaagaaauaaaucaaagugaugauguugauucaauaauucuuaauuucauugccccaaaauaaacaaaacauucucaaaucacuaaauauugauacauuugugacaugaguuuuuuuuuuuucccccucuaccaccugucucccucaucaacaccaagcaaugugacugcuugcauuucuugggucaaagacauuuacccuguuucauuucugcuuucuaccccccuccccccauggaacagggugggcaacuucaagauuugcuuugguuagaaugcccgaaaauuuccuucucgggagagccaaacugcccacagacugcuaaaagcucccgaaugccagggccaucagcuuaaaagaagugauuuauaaccgaugugaaguaccaaguuaagagggcuauaaaaaauaauacggcuaguuacuuugaaaaugggccaaaagaugagcugcauucaggagaaaaugagcugcgagggaagaccagcucugagcccugagauccuugggcuggaauuccaggaccaguggguaucgugagauccugggggcagccacggcauucgggggcucgaucucuccacguagggcaggauacagacaccaucuacccaaacuccagagguguguucaaccccuaggauguacacaagcaaccaaagcucaauguuucuguuaucagaguggggcagcaaaggguuaugaacauaggcccugagggucugugcucuaaugguucacccaccacauaccaccccugugccuuggguaaguuagccagucccucugcacccacuuuugcacgugaaauuaaugaagagguccaagugguugccuacauagggauaauggugauuguuaacucacggggcagcuauguggggggggggggagccauuccacauuguacaaaucguacaugguuaacaguguuuauuugcugcuauuacugcugcauauuauaagcagacauugucaaaacagucuucccuaaauuaaauugacaauuuuuugugugaagggugagacaguauauaucuuaguuuguagacacauauaggccuaaucacucccccaccccguguauauguuuucuuuugucuauaggagcauguaggcauaccuacgugugugcauaggugcaugcauauguccaguccuguaugcguuuguauguacacagguggaggacaugauuucaaccucaaguaucacauucuugggacauccacugguuuuauuugaggcaaggauucccaguggccuggaucuccacaaggagggacccacgugccccuggcuuucuggcacugggguuacaagugugcauggccaugcccaacauuucucaugguucuggaauuaaacugauguccucucaguaaaguuauauucaaagccuucuuuuuaagcauuauuuuaaaauaagaggaagagaaagaaggaggaggaagaggagaaggagaagguagaggaggaagaaaaagaagagaaggaggaagaagaagaggaagaagagaaggagaaagagguggaagaagaagaggaggaggaggaagagaaaaaacaagaacaagaaccaaacaaucugcuuuagcccaagggcugaagucuguucauugucagcgccccucuucucaguucuggaccuacuaaauuuucacaaaguguuuccuaucccacccucccuggaagcuccgaaucgccaccaggccucucuagaagacuggagagcugagaaccagacacagagauccccauacuugaagcugaguaauagcaugaacuuccuagugccgucaggaccacacacacacacacacacacacacacacacacacacacacacaucuugcucugccaucagucccacacggaggauauaaacacacagcccaggucggggaucugagcacagcagguaucaugguuaaauaaacuguccuuaggaaucccagucuuugucagggaccuccacucuaggcacuacucuguaggcaugacccaccuguuuaugcugggcuaggccacacugucaccuacaaagcucaagcucgagagaaccaugcaaucuaacugucaaacagacaauaacaacaaugacaaaauucauguuguuugacguacuuuacaauuuuguguaggguggcauucuaggcuguccaggggcgcaugcagcccgaggacaaugaauuggacacaccugugcuuaggagaaagacagcaucucaguggcagaagaccuaagaaauccugcccucccacuccagagagaaacugccacacuauuccaacauacacguuaggcaaaaauucuugaaaagaaaacuuaaagcauagcaucucgaacaucagaggccucaagacaggcaaaagaaaauguucaagccaacaugacuuuaaucugaggguccuucuaugaacuaauaaauguaccuacauuccucaaaagugcucaguaauaaaaugaacuugacgauuuuaauguuucagaucaaauacuauugagaugacaagugacaucaucacuucgguucugcugagaaagugacuucaguuaaaaacagaaaccaauuugcaaaugugaauuaaaugugcaacacaaacacacacacacacacacacacacacacacacacacacauacacggugggagaaaauccuuacauguagauguaaauguuuccagacagauguaaaugaaaacuaauacacggacauuuuucauauuaacugcuggaaaacacuguaugugagagcaugggagugugugcaggagugcacacaugcagagggugugguaugcaugugugcacauauggagagggugugaugugcaggugugcacacaugcagaggguguggugugcaugugugcacauaugcaaauguauaaauguagguaggaguggaggguauguacuuuuuuaaaaacagucuaagcauuuuucacuucuguuggccuaggaaaguauuugcaaaacggauaauaaauaauuaaucugacuggcuagagcuacagcuccuuuucugcuucaaccauauacauugaaaugcuguuuaaauuauaagagcaaauugauucaaaaaggcucccauuagcacgcuggcaaacagguuugaagucagcuaauaaauuuuagauaaagauuuagucuuugaugaggacgccgaugugagugugcuggucucugagucaccagcuuguuaaguugguggcuaaugucuggguuucucccuuucucacaacuccugguguuaaccaaugugugucacaggacaguuuaggcagucagaucagaaugugccggcagcacggucguggggcggucucucucaggcucacaacaaccuuacuuugcugaguugcuagccuaucagggcuuacagucuauuaaucaaggguaauuaggcccaccugugaugcucccacccaggauauggcaccaaucaagaaaaaaucuuaaucagaacccagaaauagaaaacacaaagcucuuaaucccacugaccugcacgugguuaaucuaucaacucaaccauguaagcuauggaauacuacacagccauuaaaaaguaacuagagcuauauucacuggcuggaugcacagauacuauuuacuaucuaacaaugguagagcauccauaccccuguuuagaaaaagcacaaaucguguguguguguguguguguguguguuuguguaugugugucuuaagacaaagacagaugugcaaggagcuaguauuccuguuuagccccaaguaugggaaccccaggaggagggaggagggggaggggaggagaagauucucaaugauuccuuuauagaagucacaauuucuguaguuuuuuaaauguucaaauaagcauguguuucuuuucuauuuauuuuuuaaucuaauaauuguaacaacacaaagguacauauggccuaugcaaaaaaaccauaaaaccagaaaguuauuuauacguccugguaaguuuggggccaucagugaagcccuggacuaucuacccagccucccugucaaugaucuaacaacuaagccagcagugguuuggaugagaaaugucccucacaggcucaggugacaacacuugcuccccaguuggcagcaccauuugagguuaugaaacccuuaggagguggaaccuuccugcaagaaauaccuccaugggggugggcuuggagaguuuauagcuuugcccagcuuccugucugucccucugccaugugugugucugucugugucuguuuccucugucucugucucucugauucuucucauucuuccuguauguaggugaaaacucagucagcuagaguccugcccggugccacugugccauguuuucccgucaugaugaacucugcccucugaaaccauaauccgaaauagagccuuucuucguucaguagcuuucagauauggcagucuaucacagcaacagaaagguaauacacuaguccuaaggcgacagagaugggugcugggaucagcuuggccuugggcucuugcgaagguuaaagguuugcaagacgugcaaagacugcgcaugcgcgggcagcauucucaacacaagcaugugccauuguagaagaccggcaucuguauguaccgcuguguccagcguugcucacgacagcuagccuaugggaucagccugagcaugggucaagagcgagaggccucaggagauacagacaaaggauggaguaguauucagucguaaagaaugaaacccaccccucgagggaaacuggaugaagcuagagggcgcuacggugagcgaauugggucagacgcaggaaagcaggguuugucucuuaggaaggaaaaaggggcugaaaagcagcacggaaaacagaauucugggggaaaagaaaaaggugggguaggaagggagaaaggagagacgugggugaggaagaggaagucgugaucugugcauuucucaugagaaccauucaucuguaggucaagguacaaagaguaaaaggaaccagcuauugcuuggcauaagggacucacgguggucacuuuagaugagaaaaaacccuacuagguuacaccaggaagccaggcugagcaggcagacaugcauggccgagaucugacugugcuugggacacugguucccuccgaugcuaccagcaccaaggaggcugaggcagaaggacacccaugagggcugggccaaccugggccgcaguuucaaauaacacacagcagggaacuaguuacaaagaacucagcuucacacuuaucaagucccuacaccaaguauuagugggguaaaaaagauaaauuuuaaggaguaccauauuuucagucuuggcucuaugaguguguguguguguguguguguguguguguguguguauacaucugugugcaaacacaugugugaacauauauauggagaccagaggacaacgucauuuucauagccacuggauaucucuuugagauagugucugucacugggaccugggucuggacacuugggcuaggcuuguuggccccaaagacauuucugucucggccucuccuguauuaggacugcaggcaugucccaaggucaugcccagauuuuugguauguguccuaagggucaaacucaggucuuugugcuuucaggguacuuuacugagugaccucccuacaucaguaggucaggcugagucaagagaaaugcauuacagagagcagacugugcucacacaguggcucccuccuguacugacagcacucaugcuuucccccuguaagucuguguaacaguacugguguuggcaccagcaugagaaauguggaaaauuccagagcagacuucagugaggaccaggguccccccaggucucugaaaagaaccagcaccgggugaccacagucacccuugccuccuuccaacuccaucaaucccugcuggcugguuucagucuuccccuagcaaccaaugcuguuacuggccauagcaccaggaaaccucagggacaggccgccuuugggguggguucagccuuugccacccucauguaggaauacccaggaaaguaacacccacuuucuaacuuugaugggcugcaaaacaaaacauccaaaccauacaaguagagagaauugaaaagagagaauucucauuuuuaaucaaguucuuaauuauagaacaacaaaacaagcaauuaauuuuuguggggcuacauuaagcacucuacacuucagugacacagagagaauaacagaauauccuucccuggauaauauaauauacaaaauuggugugugugugugugugugugugugugugaagagagagagaaugaagagcacaugugucaagugcucauuauauacugagcagugcccccagcaccagagcucacugacagcagauggccccugcaguaggcgugauuuucuuuugacugaugagcaaucuaaagugaaagaaaaccaacauggcacagaaacucaaugugcaugcuuccugggcuccaaaagcucaugugagcagagccaagcccagacccuacucuaguccccuggucacacccuuccuuuggcuaaggaggaacaagaagauacaauagcagaggcaggaauuauggaagaaggggccuacugacauaggcuaugggggacgagaggcuguagacccugcugcccaccccuuuggucaucagcagaagucaccagcgauagcaggaggccagcggaggccgugccgagauccagaagcacucuacugaaaagacacuaagccgagacagccacaugaugaccacaugaugaccacaugaugaccacauagcacagaccaugcuucucuugaccucucccuucauccuucaagcauaaagcuccuugcuagaccccaagcugucuggacaguuagggcaggucacaguuggcccuucaacuguggucuguggagccuuacccuccgagacucugauuuuaaaaucugugacaguaugcucuggcgccuugccgagcacaccucaguguccacauccgaacaagggaaccgucacagcucucucacggauucauuuugaaaauggaacaaacuguuucugcaucccucccagcacgguaccgggcaggugauagacaacuuaguuggcuggucgauuacggggcugcuguuucguauuaagaugugaggagacagcagugagaacagcagccacagcuuggagccccaagugacaggguuccaggaguagaauucccaguguggaagcaucacagcucccaccgugcuguccuugucugugugggcugcuacauccauuccuuaggcugaguaaaaccccaaacacaggaauauauuuaaauacaaauccgagaucaaguugagcguuguuguaaacucuggauaucugcuuuacagauggugccuucuggcugagcccugacaugauggggguaggggauaaucucccacaggcaucuuugauaagggcauuaaucuauuucugggcgugggccccucaugacuuagucauuuccccaaagcccuaucccuuccuucucucacacggauguauucaggaagacacacacaugcucaaaagcacacguauggcugcccccgaagagugagagagccaggaaccugggaggcugcuuggguaucaagguuuccgcagcagugucugcagccuggggaggggaaggaggcuccucugugacgaagucagggcacacagacuguccuguagaaggcaucaguagcuaugcuccaaucaagggguaagcugagaagaggaaccggccgaaagcacaugguuaacgagaguagcacaguguacagugacccguguucuuggcugggagcaucugcaugacauccaaggccccacagagcuucagucccuaugcaaacgcauccuccccaacugcucucucacagugcuggaccagugcugccuugcgagcuauaacucaccuuugcccaagugagucccuagggcccucugugcugaugaacaaauuaauggagagugcuacuuuaucgugacugagguguaagaaggacuuacaguuacagcaucucacacacacacacacacacacacacacacacacugagccagggcagguggcccaaaacaagacacccuaggaggaggcaugccucagcacuccacagcagaaagaucacagcuaaacacuggguucccuauuacauuaagggaaaaugcacaggccagagggacuagaucuuuaaaggauaaaaugcagaaucuuuccacacagaccugagaagcgugccagagucuaucccggauauuggccuuccaucaucugguagcugggcucacuggaagugggugucgagaagacaccaacacccagauaaucucuggaaagguuggguauagccauuccacucaucagugauucuaaagcuaaaagucacaauccacacuggagugaaaacaaauaggaucauucucucuugaucucucuggccccaccucccuucacaauggucagcaaagcuaugacaacuucacccugaggaacacaauggcuggagccaccagggaccccauuaagaggcauuugauggcaacaaagccguggaggggugaaguagaaauuuauggguucuuuggaaaguccauuguguuggaugguguguuccuggggcaaacacaugaaggaguguuuuccugaagugcauacagguaaaaggcuaacgcagccucaugaagaaacauuuugcugaagcacacacaagugaaaugauguucugcuagagcaagcaugugaaaggacacgugaugaaggauuauucgcaaaugacacacauguauuggucugccuugcacagcauaguugaacuccacuuguugggacuccauagggagaccccacccccacccccggccuccagccaaaacacuucugguggugugcugcaguuucuugccgcuuccuuggacucgggaugaauagcagagugauguuagcugagacagacucacgugcugaggcaagacuugaggaggacacaugaugucuggaggcaguauaaaacauacucuauggacagugauggaggcugagcuaggcuugcuggcagagcuaguuuugcaacacuuguuggugucuugucuucagugaucuuugcuuugcuaagaaaggcacagccuagaacuuuuucuggcauuccaguugauucuggucucuccugcuaagaagugcugaggcugaggccuggcugucuuuguuagguagagccacugcugcugauucauguuugcucucccaucucuaucaaacuggacugcugguguaucuuugaaguguuugcgaguagauggaacugccucugcuaaccugugaacugaacugccaauuucuagacaacacggaugggaguugcuccaaagaaccauuucuaaacagguccacuucccccaucuacuaccucggguggguggugggcuagaagggagguuagagcauuuaagaaccaucauuuaaaaguaggcuuagaguucuaugacccaguauaggggaaugccuggaccaggaagugggaguggguggguuggagagcagguggguuggagaggauaggggauuuucagaggggaaacuaagaaaggggauaacauuugaaauguaaauaaagaaaauaucuaguuaaaaaauagauaaaaagaaaaaaaguaggcuuagaaagaaauaaaguuggggggagggucaauuguuuuugcucuuccuccaaucaugcuccuuugguucugugacauguuccuuaguuuccuucaggugaagccuacaccccacugcauuuccaaguugcuugacccuuccugugucaagaagugaccacaugaccauggcugaaccaaucauagcaucuuaguuaggguuuuacugcuaugaacagacaccaugaccaaggcaacuuuuauaagggaaauauuuaauuggggcuggcugacagguucagagguucaguccauuaucaucaaggugggagcacggcagcauccaggcaggcaugguguugaaggagcugagaguuuuacaccuucaucugaaggcagcuaggagaagacugacuugcaggcaacuaggaugaggauuuuaaagcccaugcccacagugacacaccuacuccaacaaggccacaccuucucuagcagggccacauguucuaguagugccacucccuggggcaaacacauacaaaccaucgcacauagugugcucugaucaccagugauuggcucagaaaugagcaugggacucagaguggcccaauacagaugaagccuggaccauuagcaagugggagaacuaggaaaacauacucugagccuaggugguagagaggacagagaaguaaacaauauggcaggaugcuccccccaaaaggcccaugugagaaaauaaaugucaagagaagaggccaggcucagccuggggcaagagccaggcccggauacagcagggaaacaagcugcuuuuuaugguuacuauaucacaguuuuuccauguucuugagagcugaugaaaauuaagcaguaggggcaaggaaugucaucagccccuuguuuuaugacuagugaaguaauggcacagaauaacagcuuuuccucacccucgaguagccucauguucaauagcaccuucuugcuauaucacagucccaggagcugucaucacggaccuucugcacagggugccuuugaccccaaguaucaucccuuccugaguucccuucccaugugccuggaccagauccaagacuuuacuggacuggcacuguaaguuaagggcaugcgagccucaauuucccaggucuugaguaguauccagcccauggaauggcugaguccacauccaggauuaguuaguuagcuuugaaaacuuagcguacacuagaguauguucugaguaucaauuucccucauguugaaacauuccauccuggagggaaacucauuaagacucaaaagguucuaaacggaggcucauuaagagacauagagcaaacaaaccaaaagucuuaggaagucccugaaacuuaccagaugcacgaggcccccuaccuuccccaaggcuagauaagcgguuaaggacuacagaagugaggagacucucuaaccugacuagcucucuccaaguugcccaaggaguuccaggguuccagcuuccaugaucugugacccauauugugguggguuuucugcgauguagcugcuuuggaauguauguauuccuggaacgagacccauacucccaaaauagucauugguucuccaagugccuuagaguuucacugcugugaaaagacacuauggccgagguaucuguuuuaaaggcaagcauuuaacugaggcugccuuacaguuucaaagguucgguccauuaucaucauggugggaaguuuggcauugggaaggcggacacgguucuggaggagaagaucugaaagcagccaggaucuucugcccuggguguaguuugagcuuauauagacuucaaagcuuaccuucaucauggcgugcuuauuccaaccuacuccaacaaggccauaccuacuaacagugccacuccucauaggugaagcauccaauacaugaaucuaugaggaccaugccuauucuaacgaccucaccaagucagacauauuggugaugcugucacuuuugucagcgggaugagaaauucacaaauagacuacgaacccugaaggcaaagcuuguccuccagaaauaugacuguucuacucagcuugauuucaagaaauucuucggauguaauagggaacacaaauaucagaagaagacagacaaggcagauauuuaccacaaagaaaagaucucccaaacucacaaaacuuuggcccuauuuuagaauccagaaggugggagacaugcauuuccuauuucuugauuuauuuuuuuaacuaccaaccaaagaacauacaccagcuaggccuagaccucuccacacauauguagcagaugagcaacuuggcuucauguggacaccaaacaacuggagagggggcuaucccaaaagcuguugccuguacguggaauauguucuucuaacugggcugacuuacguggccuugguggaagaggaagcgccuagccucacagagucuugaagucucagggugagaggauacccaggggagccccuacuugcucaggggagaagggaaggagggacagggaggaggauugugagaaggggugaccaggaauagagcacugagugggguauaaagcaaguaaguaaaaaacaaacaaacaaacaaacagaaaacaaaacaauauugcaaaccuuuuaagaaguuggaaaugaaagacaagugacaggcauuucuuaccauuacaugauacagcuauauuaauaaaauaauguuauacagacucgaagagaugccacacuuuaauugaauggguauuggucugauuuuuuauuuccaacuacuugugauuagaaaauauacuaauguaccuauucugcuacaaggaaauaaacauaucucauauaguaaaaaaaaacauguggagaacauacauuuccuauuucucgauuucucaaagacccacucggauauuaugaagccuuggccucccaauuugcauuauugauccaaaauguaacuuacucaggcaaauccuauauguaaauugucagaaaccauugagagaaaacugaggagcaacaacugugauucuacaggaugauaaauuguuugcauaugucacuguaaaacugaaaguguguggaaauguguaucuuagaaacuuugggguugucgccaugggaucaagcugagacgugugagcugaggcuuucaguaucuuccuuguucuccaauguguaguuucaaccagagacccuuucuagagucagaggcacaauaauugcaauuauuucuguaaaaaaauccacaugcagguggucacagaugaaauggaaagcagucucacuggaaagcacggagugaguaacuguugaucucugccuucgauacagcaaugacuguauucucaauagagagcauguucuuucucacuuuagcaaccaacugcuagugucuuaguuccccugggagccuuuccuaguaagacaaugagugggugggcauuuaugucagccagagaagauuuaaaugcagacacaaaaaagaucaacacacacacacacacacacacacacacacacacacacacacacacacacggcccuucagcaagagucauaguguggacacccaaaaagcacauacuagagaagcagaggagagccauaucagacaucuggagcagagacacagcuggcuccuuccuaaugaagccgcucucagaguaagccugcaaggcugcacuuguacagugugcuggaaggagacagaacuauaugugcagaugcaauaggccaacgacagcuuccggagaucacaaacgagugggacgguaucacuucuuccaaacacagaggacacagcgaaaauggacaguggcaccggaaaacagcggccuccaccuuuuccuuaguacauuuugacuucuaaggaaucaguggaagacaaaccucauuuuuagacuuuuaacaguuacuuuaacuucccuaaucuguaauuuccucccacggaaagcugagaggaccccacucccuaugagucaugcuacaacagaggguacacucuaagaagcauauccaggaccauaucacacccagaaguuauaguguguaaaagaagcuagcagcagcagcagcagcagcagcagcagcacacuagucuaggaugaagggucacauaaacuggaugcaccauuaacaaucucaggguucccacugaaacagccacacuugcucagaaauggaaaacuguuucuccaaaacucaugcuuugucugaagucccagggaguuuauauuuaaaagaucuccuauaguuugggacucuucugugacauagugcauucuuuacgacuagucacaauguccugggcagcuugcugcacgaacaguagaaaauggggaagaaaggccccugggcaacauggccagcccugaugcuucaacugacuuuccauuccagacagaccugcucaugagcacacucugcacuguuaccagaguucucacaaugauggcccugacucuaauguguuucacaugccauuaacaugaacaagaagaaaagggaggauaauugcuggagcucuuccucuuggccaagcaguauggaaugcuuccuguuguccagcauggaucauacugaucagagaggauucugugcaaaaaccuccaagaacucaagagaucugugaagucagcaagccaguuguuuacuacaggaaaugaggguggaggugggcggggacagaggacuuucaggaagauuuugcuuaacaaaugcugcugguucaaguuaaauucagaaagguaaguagauaccauggaucauccaucaauaacuaggaaggaugagaaacaagggcuccacuaaucccagcguagaaguaagucacagggcccuuggaaaagggucaaaggaguuagguaacaagcaggucccgggcuacagucuuagaggggggcugggagggcaugucauggcacucugugcauacuuguacugugacucuaucaagugcaucucguuuccacgacaaggggaaggcuccuauugggucuuucccuuguauucaaaucgggugaagacucauguuuguaugugugugcaacguauguuugugguguguguguguguguguguguguguguguguguguguguguguggcacgcgcauagaucucugaagagaaaauuaauauuagcugcuauaagacaagauuugguacucagaaaggacaacaccuggaaggugccccuagugucacaauguggaauucuuucugggacuccuuccucucugaacgacauaguauaugcaccuauuauaaaaggaagaugucccuauacuggaauccaaggugaugggucaaggcagagcuauugacaaaauaaaagguggauaggcuacaauucaaucaaaacacuauggauacauucgcacaggcucuggaaugauugacaggccucuucuguuuccuagugauuguucauagauaauguacuaagauuuuuccauuuauuuuggaaggcaugaucugucagauggaccucucaugacaauuuaauaaaaugcguauacuguggucacuuugauccucauggaacuaaaauacaaaucugacagaaagaagucucaccagccucaaguuaaagugggcaaaucccaguuccaaacacagaugauauucagagcgaaccucugccuaugguagagaauaaacgcccaaguauuugugggaaugauuugugugagugaaauaugcccuaaacaucugacguggauaugaacacgcugguaagguaucagguggcaaccacuaugaacaguaugucuucccuccccccuuuuuaguuucuuguuagcucuuuuacuuuuuauuuaauuuuuuuuuuacauacaauauauuucauguuuucugcugcccuaacuccuccaagauccuccccaccugccuacucauccggcuucaucuucauguuucuucuccuuuacaccucccuguaucucagcaaaacaacaaaaacaaaugaaggucaaaauaauaaaacacaaccacacaaaaaggcacacacacacacacauacacauacacacacacacacacacacacacacacacacacacacacacuuuguuuugugaugacuaacuacuccuagacaugaagccuaccuuggaguuuaguugauauacccagugacacucauugaagcuuuguuucccuuuuccagcagguauacaaauagcuucuugauuagaggugggacccaaugucuacucccucaucucugugcuaggaccccuucaggcuugaaccugugcagguccaaugugugcuaccauagucucucaguucuuaugugcaucaauccuauuacagcgauuauaauugauaguuuugcuggguauuggaaucugggcuggcaucuguggccuaucagagcuuauaaagcauccauuuguaggaaugauuucuucugacuuucagacucucuauugaagucagucauuauucuaauggccaugucuuuauauaugacuucaucuuuucccuuguaacuuuuaguacccuuccuuuguucuguacauuuaguguuuuacuuauuaugugucauggguaguuguuuuuuuuuguuuuguuuuguuuuuguuuuuccugguccugucuauuugguguucuaucugcuucuuguacuuugacaagcaccucuuucuuuacauuggaaaauuuuuucuucuaggauuuuguuaaaaauauuuucugugccuugaccucaguauauucuccuuccucuauaccuauuacucauagauuuggucuuuucauagugccccagauuuuauacguguuuuaugccuggauaauuuuagauuuaacauuuucuuugacugagcaaucuauuucuuuuacuuugucuucgagacaugaaauucucucucccuugucuguuaaucuguuggugaggcuuaucucugaaguuuuuguuugacauccugaguuuuuuauuuccaguuuuaacucaguuugaguuuucuucagugagucuauuucuuuguuugaauuguuugccucauuucauucaacuguuuggguuuucagccuuugguaaggaauauacucacauccucuuuaagguccuuaaacauguucauaauugcuauuguuaaguccuugcauuaugcuucagguacacuguaauucucagggccuauggcacuauggcuauugguuucuagaggaggcagagugucuuggcuguuccagauuguguuuuuuggcugggaucuaggcaucuggaguucugaugauuaaugugcuccucagcauauaugucuagucucaucuuuguuagggagauauuccacuuuuugguugcuguuguucacucaugaucgugccaagcaugggcucucagguagagaauguuugggguggggguuggggaaggcacaaaggaauggagauagacuagaggaaaaggcugaaaugggugacaggaaagaacuagaaggaaccuuggaucagcacuccacaauugcucagacuguuuuccuauagaacucaggaccaccagcccgggguggccccacccauaaugggcugggcccgcccacaucaaucacuaauuaagaaaauguuugccauacagcccaaucuuacggagguauuuucucaacugggguuccuuccucuuugaugacuuuagcuugugucaaggugacauaaaacuagcucacuggaguacaggcuuguuucauucucaucuguacccccaaagccuuaaaaacuggcuaagaccuuuggaaccagcugucagauucaccaaaugcuaacuuugcauuauauauguauguauaucaaacagguaacuucaaguuauauauguccacucauccacacgcacacauuauaacaauauacaaaauuaacauaacaucucccuugucuugcaauggcuuucuuagggcuuuugugaaaugcaugguauuuuaccugugagguugcuauaauggaacucaacuguuaaauugaguugaguugccuuaaguuguuuuauuccccucggguaugucucuauauauaaucauccuaaaaaggaaacauuuuuaaaacauuucacagaagcagggugugguaucccaugcuuguaauccuagcacucaggaggcugaggcaggaguaugaacuuaagaccaaguugagcuaugucucaaggcccuguccacuuaaauucuacaguuuuucucuacccacuguguguuuuacuuugucauaagaaaaauccaugucuucaaaaguacaauaaaguuuuuguucuuggucaucucuucucuaauuacaaacuuuaauguuucuaaauacuguuuuuuguuuauaugaccuuugacauuuuuaucauugccccuccccccuuccacucucacuuguugauuugcgggcgcuguuuauuuauuaaguggauuaaauaucugaacugccagccaaaaauaauuguuaccggcucaaacacauacuuaccaacauaauucaauaucaugcgucuauuauuaauguggugcuaaaugacuuuaugaguucuuaaggauucuuguuuuuggcacauuugaagucaggaaugagacguuccugguguuuccacgugugagccccagcaacugugcccaggccaagcucgugguuggagcugacaggggagggaaccccguaaaggggagauuuguggggugugauaaugaggugagucguuauguucuaacuggccuuaacuguuccauaaauguuucuuuuaccccguaaacuuuaaggucaagauaauaggcagaguuggagugaggaaagcuauacaggccuuggcugggagcucgccugugcuuagagagccaggagagcaggguuacuguuuaaccgcccagugaacacacagguggaaauuuucuucucugguccgacugacaaccucagcucgaggacaagcuggguguaucacgcccgucacagacagcuccugggaaccccgugggccaccaagccuccgaggaggguuugucuuauccucuaaggcacagccagggaaaaugugcugugagcucagcuucauaaaccuacuuuuccagaaagcaagugcauggaccugggggaguggcgggggugguuaacggaugggucaggguguuugccaugcaggugugaggacccgaguucggauccucaggaccuucaucagacucgaugugggaguguaccucuggaaucccagcauuuuagggggaaaugggaggaagccaaaggagaagccacugaagcucacuggccagccagccugguauacgcagcagugaagaacaagaauuccugucucaaaggacguggaaggugaaggcuggcacuugaggcuccccuuucaccucaccaccccaaagugugucgugacacacacuuuuauucucacacacagagauaauuuuuuuguuauuuuuuuuuuaaagcaagaacuucccagugaugauuuuucucuccacaccaucugagauucagcaauaccaaaguggaaaaaaagaaagguccccaucaaagcgucagugaagcuauauccagguuaccuaccuggccuguaacuuaauccucuucuaaucccagaaaaugaagagcuaacaaucuggggcaggauuuacaggcacauuaaauuaacagaaugauucucccauagcagcuauuaauacugcaauaugaauaggguuucuuuuuuuccgccuacaaguggcuaauauaauuuuuaaaacuuccuucaaauaucauuagcgagugagaaaucgauggguuauuggcuggugugagaaacauuuucaauaucgagagccacgccacuaaaauaaaacauuuuuaauuauaugaaaagcauuuuauuaauaggcaauuuagaaugccggaggugguagguacccaagagucugcaggaccucagaccgggacacaggagaaccuggguucacaugcaggcuggagguccuaggaaaugcaguagcagcagguggaauuuuauauacauuguuuccaacuugagaauguaacaagcagcgaccugacccaggaugaguuaacagggaggugcgacagcugcuguagacccugucucaaaaaguaaaaagaugacugauaguguaguucagugguaaagcccuuguccagcaagccuuaggcugacaugucagugcugucagaaagaaagacagauaggccauggauccaagccucggccccacacagcacuccaagacagcgagugguaaaaguguaucagaaaacaagucuuaggaugucaagaacacugagaucugucccggaccuugcuaugcagagcaagcagcgaugccagaggaauaagaaggcuguucucugaacacagcaucuccuaaaaacaaguuaugagaaugaagggccccaucuccuggcgugagaugcccuuucuggaaucuaaugggaagguuccaggcaacaggggagagcagggccaccucuucccaaaacagacccugcagguccccacacuggagcaggauucugccugguuugaaacauacaggaagagugucacacaaugcugugacacuucagcugcuggcuaugcagagccuuugcugccucccaaagcaacugguuaugaaaugguauaacccaaaucuauugauacugucucucacugaaugggcaccccacuguuccauggguagcagauauuugauuguuguucagaccuggggcaguacuugagaaccacuugaggaaauccgauagcucuaagagcaacauauacuccuaagccgcucucuuagggauguuuacagggagauuaggaaaacaacagauggcagucauugugucaaccuagaagagccauacagauccuucauuaaacaauggagcagccagacauucuuucagacuguuaaacuaucacauaacagggaauagucuaucuuagcucuccugaaguaaagauauauaccaugucuucuucuucagauuguaggaguuggucagaaaccacugcugaaacauaugaaguaaugggucugucugcuggucuacaaucaucccgagccagagaugacuccaaggagaaagcccugaccaaguccaccacucuccacugccuggcuuuguucucuguccaauacuucgcucaauacauacccacucuguaaauucagggugaaccuaacccuagcuuuucaucaaauuauugaguugacaggcuucuucucaucuggugaacgauaacacuuacaugaggaauuaaaucaucuaugagggucacaagguugagucuugcuagugugucuacugugaccuucuguccugacuugagcugucuggcucauuacagggaaaaacaaagcaaacgaacaaaacaaaacauacaagucuuaaccaagcacuaauaccaaggacaaguucuaggaugggaggagcgaaaaaggggagucuggguugagagccgcagucgaguacaugagcuggugagggccaccggggguagaggcuagggauggaggcugggaggugugauaauucccaccuuuuucuuuucuuccacuccguuccauaaauaugugaagcuuacggcauggggaccgcccaugagccuggaggucagaacuuugcccguaccaucaugggaauagcaugaccuucaagauuuuccugauuauaaucuaauggagaaaaaaaaaaugaugcuuccuggcaucgugugugacuugaguuugauccacagaggaacaaacgucaaaaagcugaacaaaacaccgagcccacacaguaauugguuuggauguaaaacuuggcccacaagcuccuguguuuggaccugaguuuccuguugggggugcuguuugggggaggcuggagagacacugaggcugugaccuacacagugcaacugagggacuggccuuugaaagugacaccugcuucuguguccagccugagcucccuggucccggagcucucaagaugugaacgggccgggcugcaggcucccaccaccacaggccaaguuuuccagucaccauguuucccccaccaggacagacuguucccucuaaacugggagccaaacccaacuuccuucaccaaaguggcuuccguugugcuuuuggucauggcagugaggggaacccaggcgacucuuggugucauuuccuguuuucaggaugcgugcugcuuucugaggccucucucacacauuuuucucaugugaagugcgagggugcagucaguaaauguucuuuucuccccgccccuacacugucucuccucaggcuacguggcaagagaaauaacuguaaaagcucacuucccaaaagaacuuaugcccuugucucugagcaauauggcuuguucuuguuuuccaauccugaauguugguucaguuguguuuccuuuuccuacuucuaaaagguuucugugcuugaccgcuuuuuagggggggaauaagagcgcaaaacuguaccaccagcucguaaagcccguuagccaggagccggaagguaaggcaggagggaggggcgggaucuaagcuugccaagucaguuaugcccuucuugauggugguaaugcuaaacaaucuccaaagccgugcggaaggcaggccugugcaaacacacccuggcacgcauuuagcgugauggagaaaaacaaagaagaaagugauggcugacacugggaacacaguggauaugggacugcggauacccugggcagcucuugcaaaagagagccucccuggauccccuccagacaagggacacggggaggcucugucaaugcucuguggcgcaguaauuagggguacacagagcagacagaaccuaggacuucccaggagagcauuuagagaggagcaguggacagagaggcaacaguguggcuauccaccaugaggcaacaccucugaggagcggauacauuuuuuguuccuuagaacacugaaggacagcucugcaguaugagccacacuguccaugcaaagguaacugccauccacugguggauugguguccacgggggaugggaguaucaaaagacagacacugugacagagugacccauagccagcucaucuuccuuucaguccuggagcuguuggcaagguaccuaaccacccaugcuccucgguuccuucagcuuaaaacagacgugacaaauacacauucacagaauucccauaaggaucaaaucccgaaauacaugcaauucggucugcaugccacuugggaggguaggcagggggacggggggggggggggggaggcggagauccaggcucaaaagaaccuugacuccagagugaggccagggcaggcuuggacaauguagugaggcccugucccagauuaaaaauuaaagacggcuggggacauaguucaauggcagaacucuugccaggcauucacagagccuaaguuuaacccucauuucagagaggagaaaacacacacacacacacacacacaagagagggggggggcagagaaacagagagagacagagagacagagaaagagaaggacagaaggacagacacagacacagagacacagugauacagaaacagagagugagagagaguguguguguguaagaaacagagaacacauaggcauuacuaugauacaauuaucuccauuaccaugauuaacaaauuccaggcucaggcacacaauacagugucacaugaaagaauggccacaugaucucaagaggaguaccuuccaccaagaaauaaaauaaauaaauaaauaaauaaauaaauaaauaaauaaauaaauaaauaacagugccugaaucccaauaucacuuccuccgugauggagggaaauaccagacucucacagacuuuaaaagauggcaggaaguccuugccgcacuucaucuuuacucuuauaaaacaggacgggacauuuuugcacaauuauucugaucuaaacagagggugcggcccgacauuuauccagggccuagguaaauagaugauauuccugccacuauuugcguuucuaucggccccuaugcugagcaaucaauaauaaauguuguuuaaacaaaugguguaauuuuccaaucuguguuguucuaaaccgaccuuuccuccuugcugccauuugcaaugcaugcauaauucauuggccaagcagaaggagaaauaaggagcuuggucuaaguggcccuuuuuggguuguuuuugaucauuuguuauaaucccauaaauaaaacaggcuugccacuguaaauacgagcugcguuaucucgagguauauuuagcgagaaaaaauaauaacaguuaugcuaccucucguggcaauuuccaagcauaauuaauugcugaaaagauguauucuuagaguugagaggcuucuaauagaaggaaaauaaaagccauugucaacauuaaugauagagggagcuccugaagggcagcggccuuugccaugugggggaaguguuccccugaagacccugugugggacgcaccaagccugguuuuuauccaaguggagauaugugggugaguacuuuuuacuaaagaccuuucaauaagucauaaaucaagggccuuacagagacagcuucugucacuuuuacuccugauugugguuggcucauacauaugaaugcacaucuucaugugacaaaaacaggcaugcaauuguguguguucauaggcagguauacauauauacauacauacgagcauauuuuuuuaaacauuaacgauaaagcaugaaccaagagccuuccagagcuacugucugucuacccagucugacucugaccugcuauuugcucguguauuauaaacccuuccaauaugggagagagagcaagaugccccgcuuuccccaaaggacaccuccgcgcauucgcucagaucacagcggaugacaugucaaugaaacggugcuugcucucgucccggggaucaaaaugagggcuuaaccugcaauuuacacuacaagucccgugacgcuugccagaucugaagacuucauucuaaucuuccuggcuggggaagaaaaaaauaaucaaauacucuagcaaagauguauugacaacucuuaauuaaccaugcuaaugggggugggaagcuuggauaaaugcauuccacacauaaccccaaaccuucauuuggcaauucauuucuaccucuccuucacuaaaucuuagggagauagagagaugggguaggagauggacauugacuaauccuuucacauuacaaucucuugacgucucuuucugugcuaugcaaauccuuuccgggcaagcuaaugagcaagcaaauggcuguaagcccauccaguccaaguauggugguucaauggucaucuuucuagaugcuugcuaauaaauacacuuuggguguccaccugaacagcacuacugagcagcauguucugagaccaaauggauggagaugugucauuucuuccccuuuuauugcugcuuuuaaaagaaaaauaguaaagaaggcacacacacacaccccaaaauguucugcaucaaacagcuaacugcaguaccagagccacaaaagcaaaagccaacaccucagaaauagccaaagcagagagaagauaagcgagccaaggaguuccuccuaaauauuccaguguagcuguaugaaaagcuaggagacaagacggugcaucccugagcauccgagccuccgcugacugggcgguacucuccaucacugugaccuacacggcagagcugguuucuauggguuccuugcugucacacuagcuuacacaguuagguaacgccacugagcaaggcguguuaugaaccaucucaucuaaagcagcauugucuggugccauccuucugcuacagaggagggugcagaggcacuagugaagucucgccacuuacccaaaacugcacagcuaagaaggagcagcgugcagaacggagccaucauguggcaggcaggccaucacgcuucagaggugagcucagugccuugacguaggcaguucugauguuuguccuaccacaccacauacugugcuuuggccgccugcaugcuuucucucugaauccuuaugcggcccuacaaaugagagcucacuacuguuucacacacaaggcaccuaucuugcagaagggcagugaacugucaaggucacagaguccaggaguggggagcaaugugccgagagccaggacugugacucggggugaagguagugauuacgagcucagguccaggacaugaaugagcacugcucaccugggagcuggccucggcccucugacuacuguaggacuuuauuacuuuccgauucccugggcuuggcacaccugcucugcccuuccgcuucuccuucugaugcccuuuuuccccauccaggucccagccccucucccucccaacccugccaucucugcugaaagugcuagaaaaaugaucacccuuuauggugccacaaucuagauaucuagcuggugauuuuucauucauuccuggcugggggaggggggagaugugggggugggggaguguguguguguauguguuagcgcauaaaaaacagaaaacucaaauguugcuaaaauagucacuucaauuauccuagaacauguucaagauuuaaauucuuaccccucccacauucacaaccacaagggucaaccuccacaggccacgccuucucaccucugccugaaaccagcugaguauauuacaggguuuaaaaaaccacccaggcuucuccagugacagugcagagggcagagacacccagcucagcacuaaguuccaguacccagagcaccguagggggcuugugaugguacaggaagagcucaggaaagagcaggcgggccuggggaggcaguagaggcaaguccacacugucuacacccucaggaccaauccaagagcauagggaagaggacgggaccaugccugcucaucaguagcacaggacgccagagaacuuaccuucagugaugccaagaggaugugcagagaacauggcgcacugagcccagcccugaguggauaccuaaggaguguucguggcaccaucacugucaccucccauggucugccuggcccauuccagaguaaauggucuugugagauucaccauucaggccccacuguacagagaugaguguucacagcuccacuugcacagggguucucuugauugagggaugcaacccagaggugcugcaggaugccaaguauaacugggagggaggaaaggggacaaucccacaucuagcugggcacacaugaaccacaagcgcaugcccaggggaucagaaaguggcccaagaccacagacccaggaguugagagccagagaaggccaugaguuuuucacaggaccagugggacuaugcaaaguuagaguuugcacugagcuaacagaaagaaagggagaggagauuuugggugauaucugggucaacgcagaugguacaguuaucaucuguauucgcaugcuaccucccuguucacccaucacccuccugcaggacuggucagcauccuuacuguugcucgaggcccaagguucccaguuccgcagcauggcauggaaaggcccacagguggccaagggagcgagguccacugagggaagauuuuucaagacuucauaaaacauuucaacuucuuauugucacagcacuucaaagagugucaguggaaacacacuccucucccugagcugccccggggacuucggacccucccagguuucuucacaucuacuccugguaucccacgguucuguacacugcagucacucaacaaauauuuucagaaggacagaacccgacacaacgccaggcgagggcagggaucccguagauuucuggcaacaaaaguguaaacggcacuguggcagagacauacaaacuccaucccucugaacagccauguuaucccaucuugugugggucaauaauacauccucaugcaagacucccaaccgaccagacuguguugcuagggaccgacuggagaauggggccucucgcauuccuguggcuaugaggaucacccccggggguccugggauuuauuucccuuucuugagagcagaggacagauaaugaauacaccuccucaacugaucaauugccugcacuuacagccuggcaccaucccuccuccugaacaaggugaaaagaacgaauccaugagugauggucauuaagaaacuggcuucagaagaggaaggagaaaauauuaagaaaacaacgugggcauuuaaaagcaaagcccucuccaccccgcugaaguggcuuggacauucaucuuguucuuggacucugcuucaccgaacuugauggaagacgguugaacugacauaaagacuggcucaacgugagcaaccgugauugauggagccauucccagcagcaggcaaaaccuacacugaaagaugccuugggcuuccuguuagccguuuucugaaggggccgauacucucccgugcccccucccuggguuuaaagaauagacuagcagaauccgugauuucaaaaauagaggagcauucaacagagagggagaaagacuaggucauggggcauggaccucuugggggaagacagcagaagacccugcaaacuggguccuaucugguuuuaucuggaugcagcaguuugggucuugggauacacaauucagaugaguuuucacuuaauuccauuaagugggcucaucaugcaaucacgauggcaaaagaaaaucuagcuuuccuugggagccaggaacgcagucacagguguggcaaacgagccaggcuacagagaguugggaagggcggccagcuuggauuggccugugcucaagcgcacgcucuuucaguuuggagaagaggagacauuugcaggagggcuguauucuuaggagguuucuuaauauggaacggaaaagagcaggcuuucaagacugcuggggagccuuucuuccuuccugcccuuucuggauuacaggagaccuuucccugacuuucuucccucuuaguuuugaagaagguuaauuauggcccaggaacgucuugaaacaucuugguacuugggauucugccaucgucggaggcgaggacaaugguccacagggugcggcgggaaccaacuuaggaagcauccaaauaggaaggcaugucacggaguucugugugagggucaauaccccuucgggaucacaugacuuugaaaauauguccauaaaggaaaucucagcgaugcuuggcuuuaaaagaaucaaguggcucuuuggcuaucaaccacaagccgacaccuggugauucacaaugaaaaggcauugguauuccugucuucuaccugguucauuaguaagguccaggcacucucacuacgcaguagauuucuggcuugguuuaggagggauuucgagucuuagagcuuccuuaucuugacccacauauccuagggcuuucaaagcagagauguucauggccgcauaacaucccuaugaauucagucagugacaacaugacaauccaaguaccaagacaacacagggaauaagccacgauucguccaugcguuucugacccugugaccauucagaccaauguucagggccagugagaagguagaggugugguuaggaaaugcuaagccccaacagcaugcucaccaccaaguuaaagcuggguauaucuaggguauuuggauugugggaacagaauaaaaugcaaaccccuugugcaaaugaggguguucuucacaugucuacauaguaccaugauuuaaaaaacagaagcaagaacaaaaacaagcuagcuaggcauguuuacauacugggagauacugggagaggguguaccagaauucugauuaggcagccuucgucagagaggcuucugucugacgugggugacggucaaggccaagacucagaccuggccaaggugccaagaaccaaugacagcugugagcacagucaugaguggaacaacuguaguguucucuccgaggcccaauauccauucuuaugcaagcaacuuagacuaaaggcacugagcaugaaaacugagaugggagcauaggacucgcugggaggaaaaggggucagcaggaagggaaccuaguuucaacagaugauguauugaacugugagcagauaaguaauuuuuauaaaaauuauaaauacagacuaggcaugcagauauuggaucucucucacucucaacuuuuuagcuguuccauauucuuaaugcacguguuccuuuuuauggggaauugcuaacuucaagaaucccccuaaccagggaaaauguuucuuuuugcuccaugauaacugaguagcugaggccaggcauucugggccuauggcacucauuccuacgccuaugagaagaacugcagagcaccaaacaugagcagagaugccaggcagaaggaacaggcuuuuccugggcucugcccauaggauuugaucaucacaguuaaccccuuucagacaagacuaucaacagcacugauaugaaaaacccaaagccagguugcugcaggcuaugagggauaagggucgccaguucaaggccuguccugggcuacacagcaaguucaaggccggccugcauaacuuagugacauacugucucaagauagaaaguuaaaaguagggauacagugguagaucacuaaccuaguaugcaagaagcccuaaguucaagucccuguguggaaaauuaaugugaauaugaauagaugcaguaauauaaccaucugauaaggugauguggcaaggagucgggguuuauagauggaggucaaggcagaggucgaauccuauucuggacauugagagucucuauuucuucaucaucaguaggaagaguggacugugguaggagguuucaaagaggcauaucaggaaacguggcccaaaugacaaccugguaucauccaugauugcuaauaacggcuggccauuuucucaugcuucagccucccggggacauuacaugcccugucucucacaaucucucuucauuuccaccagaaaaauauaguuugugauaguuaugguugacugucaacuugaugggaucuaaagucacauaggagaugggccuuuggguaugccuguggaaaauuaucaugauuacaugaacuaagcugagaagcccuacccagacuggcugcuugcuaccucagcuucccugccacgaggaaccgauugucccucaaacuccaaguccaacaaacccacaguccacuggguugacccugucagaguauuucugucacaguaacaggcaaggaaaugaagaugaccacugucggcucguuaccuugaggacucuguagugucacuggguguagacaccugcacacuacagacggaaaaggagagggcagagaccaauacccagugcaggagacaucccaaccaucugagaaucccuccacaaugugcagagccaaaacaaggcccuugcuggggcgugaucaacacaggaaaucagacuguacaguacagauuggcccagagucaguguucuucaaguucaaaccuaaguaugucuccugugauugcacagagggguggacugcucugagacucucaguccuccugggcauucugagaagugucugccuuacaucucuccugucacgggucucuaggacauauguguccuagagaugggagacuagucagcuggcagagagggaggcaagagaauguaaucccgcccauucacaccucuucaauaagccuccucaaacuucucauucaccuauagguuugcgucucauuuaaaauggaaugcggcauuugguggggccagaaagaaaacuccucauuauaaacugggagggagauguguggagagagaauuauuuacccaaaggcugugcucggucaguguugcccaauauuuauuuagcccacacacagagaaguuguguuaacauuugccagggaauguaacuuuauaaaguaacugguuugaaaaaaaagagagaaagaaggaaagaaagacagcauaucauuuuacaaauaacuuuacaauugcuugagguaaauggcuggucucucucagguuugucuuacccaaaugcuaaagaaacaauauccagaauuaugucucauaaaauacagguauuacagacugacuguuuagcccauuaaagaaaauggagagugaaaugugaauuauuucuacccaaggcagaagcagacagaguuaccaaaauuacguuaggccaauguggcaauucuuuaaguccgcggggcagcgcggcuagcggcuccugugccaaaauccuauuaggagggcuggauuugucagccaacggugacaggaauuccauuucucagacccaaaucgaguguagcuggagagaauuuacccaaaacauuuguuuuugguuaaucagcaacauuugcaggccucgaauauccugagagagugaggccuguugaaaggaggauaacgcuccaggcuguuuauuuaaugaguaagaagacaagcggagggggcacgggcgugagacccaacacuguccucuaccgggggcgucaagcugagaucugaugcugucauaaucacucacaggaacaaaccacaaugaccagcacuucccagguuugacacgguugauacaacacaggaugagaccggaggagaaaggcaggaagggagaugcccugucucuuucccuauugcugugauaaaauacccugacaaaagcaacuuaagggggccuggaaagauggcuuaguaguuaagaaaacuggcugcucuuccagaagacccagguucaaauucuggcacccacauagcagcucacaacugucuuuaauuccaggucuaggugauaugauacccucagacagacagacauggaggcagaacaccaaugaaaauacauuaaaaaaaaacuuuaaaaagaaagaaagaaagccacagguuccuccuggcucgcaguccaaggguaccuccuguccaucaugacagggaagucuagacagcaggagcuuggaacagcuggucacaugacauccacacucagaaaguagaaaacaaugaauguguguauucagccaggguucugcauucuuagaccauccaaaacuucaacccacccacagugggcagauuuuccaugaauccuaucagaguagugauucuagaucucaccauagcugagauucacuaucgcuggaaagagaacuugcagcaaacagaaguaauuaagagccacugacgugaacugaccacuuacucucugcuugaaaccaugauccuugcucagcaugggaaguucagcuaccgcauggagagccuggauagcaacgugaauacucagucacaggucgcgguacccacaucugcacaauggggacuccuccagccacgguacucguggaauagugagucguggaccaugagcuuacaacggaaagccuggguaugugaagaacacacuuacugaaacaggggucgguaggucaagagacgccaugaccacaauaaaaugaggaguguguggcagucauugauucuuugagucugcuaauauuuagcagcuuugcuugaguucucaaaagagcuggagccgggacccgguuccuugccugccuccucaaugggagagaaggagaaaaacucugcucuccaucccagccugccccuaagaggcugugaagauucauuuaugaacaguacaaauguacaucaggaggccucgauucugaaaugacugaugcgggcgaggaagacauuuagggacugcaaaucaagaacaaaaauguuaagucuccuccgggaaguuccucgggugcuugcuagggauuaaaaagaaaauaccagagacucccuggcuugauacaacaaaaauuugugcccugacauuucaagagcucugaaugaaagccaacaucaagaugucugcaggguugcuuuaccccaaagccagccaggucccaucucaacagcacuugguucuccaaggucuuggugucuccucauugacggcuucaucacuaauuucuauguuugcucuucuuucguguaucucgcugccuccuuuccacuguuguaagaauuguagguauuggacuugggacucauucccccuuaagauucuuaaaauuauaucuucaaagaccuaauuuccaaauaaagucccauccagguucugguuggcaauggagggaaaaggguguggcugagacggagaucccacccugguguccacagggguguguguguguguguguguguguguguguguguguguguugauaucaacugaaggucuuuagaauaggagcucagcaaacaaagauucauccuccccuggaaccucacugaucggcuccagcaccucccauccuuccacaucacacagguaccucucaugcccagcuucgggaggaaccuccaguggaggagcagaagugacaaugacguuuauguuacauaagugaaaaugugauuaagaacacaagacaaaaaaaagaaaccaggacgcugacaagucucaagucagcugaggacaaguuugaccaacaacaaauggauuugcuaaaaaauuuucugugggguggggggaggggggcggaauuguuuuuuuuuuuuuaauuauuauuguuguauuuuagaccucugugcauguugguuuaccagcaaagagacugcagaugggucuuuacaagccucacugaaagacuuucuugauccaggcagccuuauucccaggaggaaagguggggagaggaggcaagacugggcucaggccagcccucccacucccaccagcuccaccaaacuucucccaggagauucgguuuaaugaaagaauuugggagcaacagaaacgacugaaaaucauugcugugugucagagguuggcaaacccuuuucccccuuuuuagguagagggccagaugguaaauaauuuaagcuuugugggccaagaggcaaaaccaaggccacucagacucauguaaagggagaaaagaaagcccuuucuuuuugaagggacccaaaacguagcauuggaacugaaauaguaacucaauuugcaugugucauaaaauaauauccccuccuuacuuucccccaaccauuuaaaauuauaaaucuacuuaguucuuauucuugccccuaaagacugcagacuacaugggaucuaggccuaauaauuuguaacacccggacuaggauuuugcaggucaggcagaacccaguccuagaaugaggccuguuagucaucgcuguaaggggguugggggugggggugggaucaugugggagcccaugacccggacagagggaaccagaucuggcaguuucugaaguaagacagggcuucaacagucacaccauccgggaagcaacugcuuucugcucuguuuucaaaauggaaacaccgaauguggcugcagguaccauaacuuagcaaagagagauuucuguuaaauaaacacaucuuuucaaguuacagcuaggagcugaagagaugacuuagcaguuuaaaaggcaguguacugcuacugcagaggacaggaauuaguucccaggaccugugccaaauagcucaggagggucuauaaagccaguugccaggggucgggugcuucuucuggacuccauaagcaccugugcucacacacacauacacacacacacacacacacacacacacacacacaggcucauuucagagaucaacagaaaucugaaucacagugacaaagugucucaugcauaugcaaaucaaucaaacauuauauugcccucuggccaccuccucuggaacucagcgagccuggcacaccuuacuaccagggaacaacccuuuucuuucuuuuuuuuuuuuuauggaugguugugagccaccaugugguugcugggauuugaacucgggaccuuuggaagagcaguccgcacucuuaaccacugagccaucucaccagccccaccagggaacaacccauccauccccagaucccuggaccaacucugcggcccuuguacauuugucuucuugcugacuuaaggcuaacccugguggcuuugcguauagacuuccugguauucugacgccucacccuucuugagcaaagaauauuccacaacagauuagacaaacccagagugaaaaugugcucucugcccugugggagaguggggaaugaucucagaagcucuugggaguaaaccggaagcaaaucaagugucuaaaauugcucugaggaaaugugaauucucuagcacagaagaggacggccacagugaccuucaaacuuccaaaaugacccacugaaauugcaaggcagcugucaaacuggaaagcaagagcaaccucagaucaacuguccuccaugugugguacgccuaggaagagcucccuccauccuccauaauugcacaaaacagcacagaaauaauaugugagcuaucacucugaacccuguauguuuugaauaaacuacaucaucuacacuuuucaaaacauggcaacgaagcugguuucaguccauuugacaaauaaggaaacuguaacacagaaugaauugacuugcauacauuuaugggauaaguaagugucggaggaaagcuagaguccagacggacugucagaauauaguccauagggcaaaucuggcccucagccuggcuguauaaauaaaguuuuauuagaacacagcauccacguauaaauuuucuaugcugcuuccauguuguaauagcagaacagcauuucaacaaggacuacagcgcucacagagcuauaaguuggguuuuuuauuuguuuguuuuuuugguuuuuuguuuuuuguuuuguuuuuuuaccaccuagccuuuugacaagaaaggccaugcaguagccccauguggauuccaacuagacuacaguccuccacuggagaaagcuggcucccucacaggcucucugcgcagucucacgccugggcaacuguucagaucagaugcaugcagccuuggaaccuccuuucccgaauacacgacugcccuuauugucuggacaaugcgaauguccagaaugacagagcagacugucuccggggggcuugcuagacagcucuguccacaaggcacgagggaacugcaugccgccuuccauguuuccgucuauuuugagaguuugauguacguaacagaaagcagaaagagaggcaaaaaggcacaaggauggaaggggagaccuugagaucguggagccauccuugacugaccaugcagguagagcugagggcagcuccggguggaagcucuuucuagccacaagagaaacuggagucucaacaccaucgccacaagugcacucccgugaccugccaccagggcacaaagagagcuggucuggcaggcuuguuucacuaggccagagggcaaggaccaaaggccuuagaggggugauuccugucaagauacacguguaaaaacuguuaccauuuugaaauacauucuuaaccauuuauguuuauuacuaacuauuacuaacgucaucuuuguguguguguuuuuuucuccuuuaaagccggcagauagccugguaugauacaugcccucauuucagaaagcagaggucaguggaucucugugagcucaguaagagcugggccuacacagugagaugcugucuugaaaaugagaauaagagcaggaaacaaacaaacccccuaaagccaaguaaauaaaaccccaugccccacccacacccauacccaacaaccaacccacaccccccuuuugagaaacugacucacuauuauuauucuuauucauuuuuauucugcuauacucugagacagggacccuagugugaucaucauuacagaggcuucacccagcaacucagggaaacagaugcauagacccgcagccaaacauuaggcuuggggaauccugcagaagagaggaaagauuguaggagacagcagggccaggacaccacaagaaaacccacagaaaucaacuaaccuaggcuuacgggggcugacagaggcuggcccgacaaucagugaggcagcggaggucuacguccucugcauacauguuacgguuguguggcuggcucuucguaugagacuccuaagcgugguggccaugacucgcucuuacucuuuuguccgcccuuaauaaaagcagaagaggcugguuuugcugcaacuugacaagcuaugcuugguugauauccuugggaggcccgcccuuuccugaagagaaauggaggaggagaggguggggguaaggggggggggacugggaagggaggggggaggggaaacugcauuuaggguguaauaaaugagaaaagaauaaauaaaacaaccaaaaaguguugugcuggaggagccgagggggauggcaaccccauaggaagaacgacaucagcuaccuggaccacccagagcucccgguaacuaaaccaccaaccaaagaguacacaugacuccagauagagacguagcagaggauggccuuaucugacaucaaugggaggggaggcccuugguccuauggaggcuugaugccccagggucagaggaugcuagggcagugaggcugggguaggguggguggguggaggagcucccucauagaagcagggggaggagggucaggaugggggggguuguggagggguaaccgaaaagggggcuaucauuugaaauguaaacgaauaaaaugauuaauaaaaaaagaaacugauacuguuucaaaaacaaacaaaaaauaaauaaguguuuaagaccacccagaagggcacguccaguugaguuuucacucuaauccccuugcuagaaaggacaaaaaagagaggaaaagaaauuuuagagagagagagagagagaaggagacgaggaaaauaaagcaaggggaaggagggaggggguuugggagggauucuauauacaacauccuucuuacucaguuuuguuuuacuuaacuuugaguuguaaaucccuugugggaugagacuugugguauuuuauaauucuuguucuauuuuuaaaauacagacgugugguucucuguaccaaaccagccugacagacagugagcuguggccacugugugauaccgggcgcugccugggacuuggagaauuaucagcaucguuuugacucaguggcugcuugguccuauaaauccaaacauacccaaacgaguccaggauuucucaauauacgauaucgcugguuuucaaugauguuaaaaccaaaaggaggaggaugggacaggagcccaggcgcugagcaccuccuguauccuaagaaagggacacacaggccacccuugagcuggagcuguggcaaagagucugggcccacacagcacacaugugaacuucucaugacccucaaguacacucacaugauauaucacacacaccauaaaacagccuuguaauuacagggaaaaauugauuuuaaagggccuauaucaaaauuaauagucauaaaaauauaauaacccaugucagagaauuuaaggaccaaagaauuuuuuaacauuauaucucagacuuauaaauguuauauauagcauucacaaaggccuuuuuaaaaauagaauaacuaaugcauuagggauuuauuauauaaucucaauauuuuaaaaauaaguauuaauauccuccccucuccccaugcucaggccuaaaaucgauaaguucaucucaaaucauuaaagcccugauuccagggcacaugcucugcauccuggacuuaaaggauaaagugcuugcaucagccagaagaggaggcagucacacgugugccugcaagacgcaacacaagggagggcuuuucccaggggagcaaccaguaagaagcuccaaggagaagaaacuuuuagaauauuugggugaaacuagaguauauccuggaaugaaaacuaagccagcagaagcaaauauuuuaaauuccugguucaauuccacuccagaagaugaaacccacagcugguacuauuauuggacuaaaaaccucuggcuagacaguucacaggcccucgagaaacuuacuaguauuauucugcuaaauggacaugguauuaaaauaacuaacuccuaaugagucaucaauaugcuacaccuauagauuaacgugcuucucgguccucaucagggaaacuucugccuguaguagauggugacuaauacagagucaugcaacugucagaguauagagaccaugaaacaacagaacuaucagcccuacagggaauauauacgcacccucaugccuuucaaaguuaaggguaugagagcuacaggccaaugugagagccacaggcccaugauaacuaugaggcagcaguagcugcuggaccuaggauggaacuacacauacaaacucacagaagcugugauagcgggggggggggggggggggaagggggggcuggagcgauggcucagugguuaagagcacugaccacucuuccagaggaccuggauucaguuucuagugaccccaugaugucucauaacugucugucauccaccuccaagugaucugaugcccucacacauacaugcaggcaaaacaccaaugcacauaaaauaaaaacgaaucauuuuuaaaagggggaauugggauaacgagugcagggccugggcaaacccaaaucggaugaauuccuagcgugaagggaggagcuaaggaccugggcauggccucucacccggagagguggaguguuggcauugguuguggaaggaggagucgguuucucuaagagugcagccucugguggaaggccacuaauccaagaauauuugggcagugcaaacuggauuggaugacauuucucuuuuguuguuuuaccaaaaggcacacguuggauugacggugaagggugggugcaucugaagagcacugggggaguggggcggguagugaauaugaucaaaacgcauuguagggaauucucaaggaauugauaacuuuuuuuuagauaaaauaaagucuugauuaaacugccaugauacauauaugcgaugaaacccacugauagggacagaaccaaacauaagguagauaacacauuuaaaauguccucaaguaccuaaagucagcaauaauauacuucacacugaaaaacucgugaaaggaaucgaugucacauugagucuuuuuuuuuaacaauuaaaauacaagaaauucaauucauggcuacuguaauuggaaaagaaaacugucuagaauggaggugaacaaagugguguggcugugauauguugggaagaaacagcggguuuuagugauguuuucaagacauuucagauggaugggggaaaggugguguuaccaaaggcacagaauuccagugucugaugcugagccuaagacgcucccagcuggaagcagccacuggcagccauggccagaggcaucugucucuuuccuuucucccacuacacgggaaaggcagucuggcaaauggagacaaagcauuuugaaaccaucacgggcaucuauuccuuucuuacuuuuugauauuugguagaaaaaagagggucugaguugaggagcaguuuauguuuuucuguagcauuuugacacuugaucaucugauaaucuuucauuagggaaagucaacucgagcuuaaaauaauuguuuaaccucugcagaaaaaucuccaacuuugacaucauucaaaauuuaguuucuuaucuugacccaaaaucuguugagacaaggacuucucccugacaguuagcucccuuuguaagaaacacuuguguggugauuugaauaaaauggagcccacaggcucauagggaguggcccuauuaggagauguaggcuuauuggaggaugugacacugugggggugggcuuugggggcucaugugcucaagcuacuaugagcccaguauggcucuccuucuacugucuacacaguaagauguagaacucucagcuccuccuccaguaacauaucuaccugcaugcggccauguuacccagugugaccauaauggacuaacccucugacgccauaagcuagauccaauucaaugguuuccuuuauaaaaguggcugcggucauggugucccucaagagucaccucucgaagccucuuccaaagcucuggacuugaccuuucgugacagaagcuggacugacagguucagaauuggcguggugaggaagaguuacagucaggaaggaccagaaaccaguucccuggacagugagaagugcauuugcgaguggaagaaagugacaucacauagaaacucucuucagagccucaguauuccagauguagcuuuggguaaguuugcuucugaccucccacaccuuaaggugacuuuuccauaaaaagacugaaaaucuucuuuuguaaguugccccgcucugcuuacuuuuaaaaggugauuuuuaaggcucugcguagggcagugaauacuuucuggaagagugugcgcauaugcaccuucuuuaacuggagcacauagcuaugugcucgacuucugucccaaguuggguacaaucauagcaaggacuucuccucauucacgggggcauguucgaaucuuagugucaaggccuaacccaaagcaggcauucacgaccuacugagugaccgagcacaugaauucuagagaguguagggaaagcugaccucuuuaaaaauuagcaugucuugcagaaugcagggccuaggcaacccugaagagcaguccagugggaagucauugcaaacaauggccaugcuaucaagacaggcccaguuccaggccugcaauucucugaaucagcuacuccuuaaguucauauuuuccuccucuccgccaauggcaauucugggagagaagcaauugauaauaauuauguuuuccgccuucucucggguuaugaauuuaucaugaugcgaaagucgggcaagucugaugccgcguuaacaaugauaaacaccauaaagacaaaaaagaaacuaaauuugagcauuuagauucugcagggggaguuuauuaaacagauuaacuagggaaaggcaaagcuacacaauuauggaaaacaggcagcaaagcucuggcuggcuauuucugacggccaccugagagccugcuucggaugcccuggauucugcagguacauaaccgugugcucuacugucauucacggcugcaugcugcuuaaucgguauucaggaauugcaagugguaauugugagcugcagagcaaugcagaccgcuucucggacacagugaccaugccagagccaccccuccuggggaacccacguucagccagacagcaagagccacgggaaggucuucaaaagaccuugguuugaaggaaaacuuugagaggcagccuuucaacucaggacaucuguguucucagucccccccuuucuucucucuuggucuccccccaacaacacuggaaagugccagccgcggcacaguagcgagaggaacacagcagcgagagcuagagcagagaaagaggauacuggguaugccccuuaccuagaugcagucggggcaggcaccugagaauagugacgcugcugcuguuuucugcguggaugagaugagaaguagccccagugaccuaagcucgugggaaaugaaucuccccggagaacacacauucugauaggugcuagcuuccucuuccauguccuggcugaucuaguucccugaucuuacaaccuuugauuuccaacagugaaugcaccuuccuuuccacagggccccuguacguggauuugagaucaagcuuccaguccaauggcucccaacuuucccagcguugcagccccuuuaauacagcuccucaugcuguggugacccccaacccuaaaauuauuuuguugcuacuuuguaacuaauuuuugcuauguuuguggaucacaguguaacuagcugauaugggggucaugacccacagguuugagaugugcugcucuagccaaagaaagcaagguccuuucuugaacgccuuugaaaaugacucacuuuagaaacggucacucuacaggggacaguacucucccuggaaagcuuuaacuugaaucaacauggugaguagcccagugaaugaugagauaaauauauucaccaguguaacagaaaugcaauaucggcuucccuuuucuucaauucccauguuuaaaauuucaaaugguuuuccaaggccggcugccaggaaugugguccacucaaagcuggugccaguaugaacacuacaacccuguucccuuccggcacacaccacggcgacauugagccuacagaaccaggccuuucugagguucacugggacauucuaaacgugauuuuagaccuuccaaguacgugucucacucugguuccaacauuucccaugaaucucuauauuggauagaaugggccacacugaacuagaaagaacaaaucaagagaggggcugagacgcugcucuuaggggggggaagaaaaaauggagcagccaggaccaaaaaagggaagggaaaggguuagauuguuugacgguugguugguugguugguugguugauugguugguugguugguugguugguugguugguuucaggaagcaaggccucccucacuauguucagcccagacuggcaucagacucaauccuccugcuucuaacucucccaugcacugggauuacaacacaggccaguggcccuaaagugaagcuguguaggauuccauggggucugcaggcuuguggcuuacauguaugugugcccugcaggcucguggcucacgugagcuaaggacacuaaaacugcagaauuaacuaagccaaaacgcaggauuuagguucagacucugaaaccaaaagacgcugcaaauagaaacacuuggccuaugcucuggaaagccaacaauuagguuauagagaaauaccaaguuucugaccaauuagagaugauuuaaauuauaagcuauaaagaacaauguagacguagggccuccguuugaguaagaaaaaagacauaauuuugaaaauauuucauuuuauucugugcaugugagugugcugcccaugaacgugcaggugcaugcuggaagucgcaucccaucuccuagaacugaugugagucaccaugcaggugcugggaacugaacucggguccuguguaacagcagcaaguguucuuaaccacggaaccaucucuccagccccuuaauucuuaacuccagcuuaaaacgagcgauuuggucaaugauaaggagcuugggaauccgcccgcccccgagucuucuuccuugaaacagauuuaugaaaacuuucuaaguaucgacaguaugauaguuaacuucacucuugccauggaaaaucgauguuuaucccuauuggucuauuaaaucuaaccaaauuaagaagacguggaucaggugugggaaauagcuacagggcuauaaaacuggggcaugcagguacuccagggacagacagcaaacaucucaaugcaaaccaguccuggcauaaaugaggauaacaguggcccaaugacaagaauaagggcaggcaaugcuugcuacauuugacugucuucugcguugccauuuauuuugagacagagucucaaaguaugacccaagcuggccucugacuuccaauccuccuacuguagccccccaaguccuaggacuguggguguguguccccauucccagcuuagauuugaguuuauccaugaguaucacgaaagguucaaacacuucagaguugaugcagagcuacuaagcaauaaaagccaccacagcuccaggcucacacaacuuuucccauaugucuagaauggagaagagacuuauaucacaccucaaugauacaucuguuaauggaugauuaccuuguuguguuaaugggcuggcccucccaaaaaaaaucaaguuuaaaaaugcuaaaaugucuacuuuuuagauaaccugaaauugugacuuaucuaaaagaauaaaauacgaacuuucacucagagacacaaucuauccugaugucuucucugggucaccugcuaccucaccuaauaaaaguagcaucugggcugauuggauacuuuggucucugagaugaacuucuucugucccaugcccugucuucuuucauaaaggcuccaagagauggcaucccagcgucccugacaguguccuccuguugcuuugauaggauuucucuguggccagagccagguggccuuugaugacugucucuuugccagagagaugaccuacuggccacgcugguaugguguccuagcgacaucuuguggugaaauaaaauauagagaugccuaagguuccacccauuugacugugccaggguuugugucaacccaggugacuccucauuugcccuugcuuuuguucaaaaguacaaaaagagcacacauuuggguccaguggguaaacaaaguuaaccacagauuaaagccaaugacuccacagaggaaagccacgaccuugacuuccacaacggacacauucaaagugagccaacaguucuagguuccccuggccacaaccaucccagugacugaugggugaaaaaggugguagacagaaucgaggcacagacauacacauuggcagcaacacacgugccucggauccccagguaauacugagcucgaaugacagaaucccagcaagugccgugaaagauuguuaacauucaacuaggaauucugucaucuugaagcguccaacucacgaaagcuaaauguugggugugggagaugaaaacuggucaagacugagccuccaacggacuaaacaauuacuuagcacuguuaauuggucauucggcagugacugcaaacagaucaaaaguaagagcagggaggaugaugacaggaagggaccucaaacuaauagaggugaauagaagaagacaucugacuaauauuacguguucgcuguuggucagcgaggugguaaaggcacuggucacagaagcccugagaacugaguucaauccucagaguccacagcggaaggagaaaaagaacuacuaaguuguccugugaccuacauaaacacacacacacacacacacacacacacacacaacacaacacacacacacacacgcagacacgcagacaugcacacacacauacacaugcacacaugcauagagacauaagcacagacacaucaaaauaacaauaauaacaauaaugauaaugacaauaauaauaauaauaucauugcauccaaagucauuucucuuuaagccuucagaaggcaaaugugcguaggcugcaggucugucgcguguaagggacccaccaucugggagcagcucucaacagagcacgccugcuggucaguacaaacaccucccuuuuccuuugacacacugccacaaccuuuugguccgugugcccauuugcagagaccacagcgcagccaggcguggccuuccuccccuacucaggugugacaaugaaugagacugggugcacacaucuguuaccugcuguuguccaccagaguggcguaacagcgaaaccucagcuacacgacagcaagucacaagauccuggugcggaguacacuccuucuuccuuuuagcagcuccuaggcagagcaaggagcuuucauuaagguuagugcagcugauucugcugcguugccgagaguggucggauuuuccgacagaaggccuauuaugucagagauggagacucaacguuguagccacccuucuccuaggucacgggaggcagcaugguuugcauggugcaaacugaguuauaauuuaaaguccagccuggagugcagaauuuggacaucguaccucagaagguucaccucugaaggcucaggaacccacucgucccaugggugaaggagaccugaagacagcuugcgaagagaucaccgccaaauggucugcauggucuuccauugcacaagaacccaaaaugcugaguuuucuuuugcuuugcucuauguuguggggguucuuuuuuuuuuuuuucuuuuuuucuuucuauuacuguguaucuguucuuuccaugcagaacuagcagggacugugauggcaggggcacagucauuugcuuuuuugaagacauggguggagaaaggggacaauauguuacuauuugacacaggcuacggaaguuaaucaaauuaugagacccagagcaugggauguaauucaaagugauggacagacaggaagaaacccguuaaucugaacgacuaagaggguuaauaaucacaacaaaugcacaggcgagacuguuccagaagaagugacugagguuaugaacaaggggaggaagugggggugaaggcgaacugaaagugggggagggcuaaccaaaggcagcgggggagagggugaacugaaagggaguuggaugggggagggcuaaccgaaggcagggguggggaggauggagguugggcuaaccaaauggggaggccauuccaagaagaagcgaccaagguuaggaacaaggggaaaggggcggagagaggacuaacuguagggaagggggccaaccaaaguaagugcgcuggaugucacaaagaaagcguucucaaacaaacaacuagcggagagugcagcuauugaggcuggucacuggauuugaacauaaaaugauaaagaaaaauguccgugaaaaguauuugcgauacauucuaugagguuacuaucuuaauacccaaauaugcaaauauacuaauauguuaguacccaaauaugcaaaaguucuuauuguucauaaauguaaacuaacccaggacaggaaaaaaaaagcaaccuacagaagaaaaaugugucaaugaauccacaaagagaguucagcuucaccaagagcgagggaggcacacgggaagaguccgaccaaccuuucccuuaacagcuuuaauugggaaaugugacugguuccucgggaagacacaaggaagcugcccggcagccuugauucaagagggcggugagugagcaggucuccucaggaccuccagaggaucuuacccuggagugagcaggccuacaaaucgugccugcugugagcuuuugcugcacagcucccuucacacgagagggaaagcauguguccagccugcaccuccaacaacugggggucguuaaaucaugacagugaugccuccauucagaugcugggcagcuacugagcaucuuccugugugggaugaguggaauagagagcagaguccaaaacggguccguuuucuuucuucgggggcaugucaguuauuuguuuuuaaagaaccuuauggacaaacauaucucuagcaucgguaauagauaguugaaaugaucaccucaaaaugaccaguucuuaaggaagaagggagauugugcaggggaucuucuggucccugcccuuccgcugauacaggacaucagcuucacccauuuagacacaguguagaagagaagcagccuccauccugggcuguacggaggagacaacagcguuaugucugaggacuugcucugcccguguaaguuacggugucguugcacugcuggguuggaguuugcagucacacuagccaaugaaauccauuucucgucuccacuggcagauguguccucacagcuggucacaggcaccacacucccaccaccaggucuccgcacugaauucuaacuuccugucucuuccuccuggucuccggacuccuguguggacaccagggugcucuggcuacuuuccaugucuccagucccuucacuugguggcuugcuagcuuccuuuauccuccuaggcuguguuacacugcucaucuaugcuuuggguuucgaagcgccagggacacagucuacaugcgcacgggcucucuuagcuuuggcaucacugucuuuuggagcaggcagaucuccgugcccugaaaucuccuguuuacuccagaaagcucugcaacauuccuaauauaccgaaugcaaaucacaccauucuucccuaaggugugauaacugaaaugaaucccgauguggccauguaacuccuuagguccggaaggggugcgggaucacucuggcuaaugaccacugcaucccgugagugagaaaggcacuauugucuuaguccugacaggucugacccagaagcagcuugucccaagucagauaaaugacugugucacaaaugcuccuucaaccuucgcucuccagaagaucucagccggaaucuccagaggccgcgugccuccuuccuucuccugcuacccucucagccuuagcaaaggaaggagacggcccguggaacacggagccuacacgaggcuccucugagagcauucuagaagcaccacacgggcgagcgugaagaucuuuuugugagauuacuuuaucucaagcgcgugucacuuuuucagcaccauaaaacugaaauacuugaaauagaugucacuacauuugucaugagcugacauggccaauuaauauuacaaauucaccauggagaaaugcuuccagcucccaaggaauaaacugcugaacaucacaauuccgccuuguaacaaugggccgaccucuccagggcuauaaauacgaugcagcggacugauuaaauggcaggaggagcuguucacuggucgucucucuccaggguugacacuuggccuaugccuaaaguuaacagguacugccagugacgugucugcagaagagaaaugucguuucacccuuucuuuacgaagaaguugacuguuacucgccaugucuuuccuccccaccuuccucacagcuagugaucggcacaugcuuuauaugacaugaaagauucuagacauguuauccuaagcucuguuguaccuaguggggcuuuucccccaccucccuuccuugcccccucccuuccuccucacucucagcccaugcugucacagcuaaacucacuucuaauaaggcacaggugggccccuggcccugaauaaaauucauguugguaaugagcugcaaaacucuuggcuucccuuaagcuuucuaagagaagagacaguguugcccccuuggcccucuuggaucuggcuggcuucuuucccuguggccaucuuagcccucaagcagagaaaacagggccauuguuccaagccacgcagugacuuuuggugaauugucaauguucugcacucgugccugcaaagggagggcaguggagugaaucugugggauguuuggggaccucguggaccuugaccuuucuuuucuuggcagaagcucuaaggcccacuccccuggaauccuucuuuaugcugcuggcuuggaagacagggaaaguguuaaggagagagauuagguauuaaggagacacggugugcagugauaaauuaccuaaacugaauacacggagucugcugcgccaagaaggcccugaaggaaggccagaccuguaggaaugagaguaugaaaucaaagagaaaugugucaaaaacaaaugacaaacuuucccacuguggggucgcacaggaacaccagcuggggugagccgucaguuggcugcaaggugugcacugugccuugugucuucucauuuccagagaagcugaucagcagccguggguucccagauccccagauuggaaaggaacugagaagccguuccugccucucuguggaggaacucacgucuuuaccugaucccuuuucuuuacuucaugcacucaaaauaccuucugaagggagacaaaguuuuguuuccugguccugcucuuaauucacagcucaccgaauuaaguacuuuaccaagucccucacaucucacacaaaccagcuacacgggagguucuaggccuguuuauaacacaacauugccccuuguucuucguaucucaauaaugaaaucuuuguguuuuaugaaaguucggccacucugugcaaagggcaguuugcuccaguacaaacagaaaucagagaaaauaggaaaaccccgccaaacccuuucaucucugcuugccaagcaggugaauuaauaaggagcacauuugagauuuauuuucuuuaagcuccaacaguaaagaauguuccaaagucguucucaaagcucuggagauuuuaaaaauucaaaugaaucaaacuuaacuugcugguauaauguauaauaaagccaguuccggggcuuaccugcucaaagauacacucgcuguacauuuagaugagaaaaagaaauuaaggagucuaaacauacacggcaugagauggccaaaauuaaguaaauuaaaaguguuuucaauaaagguuucuagcuucagguaauaaagucgagguucucaauagauaguuucaauccugguguuaggcugagcccaaaagaaccuaccaggguguauggaaggaagggagggaaggaaggagcaagggaggggaggacaagaucacccccacccugccgugcagcugagacgccuucgcucacacucuagcauggaacugguuauugucccagcccauucgcugccucagcacuugucaggugaccuguaaacuuuucaauacuaugggacacauaagcggccuucuuaucccuacacgucuuauggaagaaaacacuaagcucauuuuaaauuaauauuuucaauuguccacagauaaucaaagguuaaaauauccacaauguaagacuacugaguucaacgggcugguaaaaacggaacaggaaacuuugauuuccaaguuccaaucuggggggggggggggggggaggagaucaacggcagacugcuaagagagcagaagaauuuacagaggugugggggacuugucuaucacaguaacuccuguccuagaguuggggccaaacgcuguaacuaucacaagugguuguucaguuugguuauuacugcaacugaacaagcaugguuuacuuugaaaacuugugugggggacaguaaaacucgauauagcagugugugcaaucagaauaagguaaugcuauaauuucugcuuagauugauguuuccauaauaaagcacacaggauucacagauaucaaauauaacugcccccuccccaaauuaacccccaacuaaaaaacauacugagcaaaaccauagcacacucuaugcacccgucucaaauaaacuuguauaaacacgcuacgugucggcacaugccauuggagaacccaucauaaauuaauuuugaauuaaucaaaauagagucuccagaguauuuucuacugaggacaauucaagaggcacuuuuucuaaaauuagugcagcuuuauguagauguaguucacacucacuucacccacuuaaaauguacaacucaacagcuuuuaacauacgcagccaucagcaccgucgauagaaaggacaaaaggagaggggagaaaacggggccagcaaaauggugcacugaucaagaguccagugaccgcaucugaaucccuauagcccgucugggggaggagaaagcugagucccacaaacuauccuugugacguccauacagcuucuccaacaugcauaugggcacacacacgcacacacauacaaagagauacacacauacauauacauacacagagagagacacaugcacauacacacagagacauacacacacacaagcaucaugcaaacacacacacaaacaaaagaacagauuaauaaaugagaugauaguaaaaagaagaaguggggaggguacaaagagguucuagggugagucuccacggucccugacacaucguuccucugugguauugcagauguauuugccugguagccaaacgacgguuuccaaaccaaguugggaagaaaguaaaagaaggaacgcugcugucauuugcaaggcugagacucagccagagaaaaaaugaaguugugcagaugagaaccauaaucaugggggacaagcucugaggggccuuccaucaccguggggcugcgucaguuucaagucaugucacauuaaagacagaagcaggcgcaaaaccguacacaccgagugucgcuucagagugcguuggcuguugaugccaggcugagaauuuugccagcucucuuuuacauuguaaagauauugcuucgugguaauagaugaaaagcuuauaacugacaacuugcucgccuugcgcagagaugaacagacaacacgaauuaacgcggagggagaaauaagcacuguccaugcagauucauauuagcaucuucuuaacuaacgucuucaguguacccugacacaaggcaacuucaaauccacugguccucuuuuuaaaaaaacaaaacaaaacacuucacucuacuuaauuuacgaguuacacaaaaaucaauuuguggucuaucugccuucaccuacccuaccauggaggggggaaugggaaaauuccaucuccgugugucucaaugucucuucaagugcgacuucccucugcucagucucacugagaucuugcuaaauugcacaugagaucagcccugggcucugaggacuucuaaacaucaaguugcagaaaagugacacuucaccaauuuaagugauaaguuuucaaaucguggagcaucuaauugcgacaauaaauucaccuugcuuuccuguauggccagacaucuguaucuuuaacaaacaaaaguggcaguuuuaaaacaauuagacuccaaaaaaaaaaaaaccucuaaugaauacaaaucacugucucuacagagggcacaugacaguggauauguacccuggcccugugucuacaccacacagcccagagaggacauggacacccugcuccugaagggauuccucccccccaaguauccgcuuccccucagcuuucuggaaauggagagcauucuaugaaucuagagaagagcuuuaagccucaccaugaauaucauggauuuaauuacuucaccacagcuugcuucuccucugcgaguggaaaguggucuacaugcuguuucacuguaggaucagacaaaaaacaacugauugucaccuaacacagccaagccaugacaucugccccaaauagcccucgccuuccucaaaugccugaguucgcuggagaacaauccgcuuaucuaaagagcaagccuaggagaaagagaacugaggaacaguagaacccgaguuguugggugaggugggaccccuuuguuucuguuuuccuagggagaggaggcuacauuugaaaccccaaguuuucaagaaagaaauugacaggugaacucccaaaccagcuaugaguuagcuuguguguuuugacagauuguggaggguugcuugacaggacucuguucucagcuucuccauccaccucagauccugccaaguacagaauaugaggucccacaaccuccagacagacuucucucugcgccuccguacaugaaagcuuccuguguggauaagugaaacaacugcuugcugacugaauaggccuuguacuuaagacuccacguggcgugaaauaccuccccauaggacaucacaaaccuguuugaaugugguucaguaccaaauccaucaucaggcugaaaguaaaacccacggagccacacgccuccacucuugccuggcacugggagaacuugccugauucuccuuaagguucgcugacgauccacggucaacuuacuuuugcaauaacaaggcagcucauuaauaaagaccauuaaaucaaaccaugaagcaaacgcaggcuaaacaugcugggggaggggagugucuggaaauuaaaaauucugauaaauggagaccuggacuugccugcugaagaaggcuagcaauuucaucacagauuugggcuguggaucuuagcaaguucuaagugugguaguuaaacgcaucgcuaguggagccaauagguacgacugaagaagaauccuggagguguaggguccaggaauccacgagugaaugggggaggggggacuuguagaugcuggugauaaugacggcucacagcugugacacccacugagacacaagcacugugcucaaaaagacucuuaaagacgaggaaaaauuccacaccauauucugaagauuuggaaacaggagauuagagggcuucagugcuuguuccgaggucacauaggcagggucuuaggaagcuugaaccuggagcugacaugcaauauucaacacccuagcgugagcagucacugugacucugggaacacagacuaccugaggguuuggguaguuugucugaaauaucggucccuggacccugccaggagcccagcaugcacaggccaugggcagcggagcagcaaggauaaucuggugggcaagguguggguguccugcuggcugagaacgguagauauccccauacaaggugcaccucauuuuaguccuuggaagagccgaggcagccgcgcugggaggcauagggcacaaugugacaugcucacaccccggacaggucuggagacagccuccugaaaccgcccugggggccccagaggcccugaggucuccagggcuugucacucacguaccgaauacacuuagucuaauuggauauuguucuuucuuuaugaagccaagcagguuguuaccugguuccuggaugagacauuugcagcuucauuuugcaauuacaucuccccggcauuugucauggcacagaagugaaauuucuguuucugguccccaugucaucuuuuucauucuguuuaaaauagaggggcuacuuccaguucuuuccucgccccccccccacuuccaucugcaagcuguuuuuccacccucuaccaaaaaaaaaaauucccgcaauaucuaaccaauuauuuucucagucacauuaaaaauggaugccacuuccauugacaugugacagauaggaacaucugcucacaagugucccaguuccugaauucauuaggacacauaguagggcuguguccccuauccuuucgaagucaaucuguccacagguuuuuuucuucaccuaagaacuguuguagaaacaaaauuaacuggccuuccauggucucuuccuagugcuacagagcuaacugaggcugugucagagauuaauuugagaguccgucuggagcccugacagacuuaaagaucaaaagaccccugccugccuucugcucgaauauccuguugagaaacaaggcacuguguguguguguaugugugugugugugugugugugugugugugugaagucacaaaggucugggucuguccugagagguccaucaucacguccugauucuuugucauugggcuggcuuuucuuuugcuuccuaaugcuauaggauugcucaggauucgugugcccuaaaccaucugaguucuguggacacagacauguuggucacccucuaucuuguauuuaaacuagaacuacauagagagagagacugccucuuagcaagucaucaugagagagagggcuagaagggguggacacacccuucucuacaaaauucaaauccagauaaagucagucugcuggaauccaggacaugcuacgcaauaucaucaaaggaggauucauuacuccacuuugcccuggcaaauugccaccacucuuaggaccugagcacuccuagaaauguagucgccaugcccuuguacaucuuucccuaccagaaucaaccaucaucgucuaccuucaaguggcagcucagccuucuuuuccaggcagugagccugccuuuugcgacaguuucugacguaaaaaaaaaaaaaaaaucagccagcuaacagucugcagccauaucagaagccggccucuggaauaagguugggacugggcagggacgccuucugucaggcuguccuucagucagccucuuugaccuuuucaagauggaccaguaaauaaguaagaucaaauacguauagucaacucugauuaugugcugggaacagaagacaucuaacgagcaguauccaccacgaaggaaguucugagaggucagaugccuggguuguaacugugcucuucagaugcugugugacuuccccuaaaccccaacaccaaacaacgccucuccacgccuuuucccacuguucucuccucuccaggaugacgcuaacuccacaacagcccggguuugguccuggcuucccaucagccaucuguguuuuccacaggcauccucaauccucccaugugcagccccaacucuccugaaacugcuuaccacaguucugcuaacagagcuagcucuccaccucugggcacagccuagcucucuaucucuccgagcucucagguugccaccauguccgugguauguagacacaggucuuaaagaugcaguugcaagagcauuaucugcccacagcuauggagccucgaugccuggugauuuacugagcugugcccuccugucuuccuggccucuccugcagccaggcucaaaugucacuucuuccagucaaaccuuccgcccucgaaaaccugacaagggcagugcuauauaaaaaggaggcccccaggacagauauaaugaagaaaugaguagaugaaaagauggauggauagaugaauggauggauggauggaugcaugcaugcaugcaugcaugcauggacagauggguggguaguuggguagauggacagauggauggauggacaaauggauagacaaauagauggaugggugaaugaacagacagaugaauggaugggaaagagccccugaugucaugucuguggacuuccugucgcauggaagaggacccacacaacagccacaagaugacucuuucugagaagcagugauccugaagacugaggagaaguuugucgcaugggaacuaaauccacagucucuguccuuccuaucgagcggugcgagggucagaaccaaaaauaaaucccucagccuugcagcuucucggucggaauauccaagauaucuuuaaucaaacuagagaggcucagauuguccacaguucuagaaaugccuccagauacuauggauuuaucagggaagagaaugaaaagaaguaaaacuugcuucaugguuaaagucagggccacuuuaucccggauguacuuaaaucacuuagugcuuaagagaaucuuuaacaauaaauauacuaaauuugguagcaggagagauuaacuacaaaggaaaauuaacacugccuuagagaaaagagauaacguauuaaaccacugauaggcuacuuuugagaauuauaacagggcaggccuaacauuuuuaaacagauauuagagaagaggaaauagccuuuauccccuucugaaaugcaauugaauuuacauugauuaaggaggggaggggcgaaaucuaagaauguaugaagccuuacacuaaaaagcuuaaaaugugccccagaaaagacucauucuagugacuaaguagugucauuacaccuccagggagaaaauacacagggcuucauucccccaugaacgugaguguguguguguguguguguguguguguguguguguguguguagaugaauggauguucucuuucuggggagacucgcagugaggaucaagcuugcagggcuuugucauuagcccuguuugcauucuccaaagcaaacugucagucucaugaugcagcacauuaaaaaaacccucggugcuaucgacugccugaagccggugcuuccccguuaaauacagcacagcucaauuaacagcucuucaauacgcaauuuaauuuuucuuucaucuugauccacagccuggcuugaaaugaggaaugcggggauggauguacuuugaauauugaagccggucuuuauaaauaaaccuaucacacuuguaaugauuucugucgugacaugacagaacacaugaagccuggcgccugccacuucagcccacacgccauugccucagcacacacacacacacacacacacacacuuuuggcuuuuuuuuuaauagucccccccccaccccguuaacucucaauagcauccugcuauuuuagaaaaguuuaucuuucuucuuuguuccuuaaccuaugugacaaaaucuucagaaagaaugaagaaaauuacuauucugcuacguguguguaaggugaggcaugcaacuuauaaaugaauuaugagggucuuagccuuggaaagacaugcauauuucaucauagaugcgauccacaacacuuacuccacauacaguauuuauucuuauaugugauuauucaaggcuuucuuucuuuucuuuucuuuuccuuuuuuuuuuuaaagucuugcaagugcuuacuuucauaagcaaauccaacauucuccuuucaccugcaacacgcaaaacagaauauacagaggcauggcucaauugaccucacauguccgcccucccccaguggauguuugcgaugcucacagugaauccaacaaggucucaaaggcaugcaacuugguauucaaagcgcuccuugcguugcugucugucaaaaaggacacgguguuuugcccuggccagaugcaauuccuuauguuucaacacaucugcagagaaaggcugaaugccagccaaagcuguggauuuagaagugcacagcauuagcucagaaaagaggaggaagcugucccuagaacaagacaaagccacucaacguaaccaggcugaagcccacagccauuccagaacacugagaucuccgucacaaugucacucacugucacacagcgaugacggacucaguaagaacuuacugguuuggccuggguguacugacgugcacauuaucauuuacaacccauuuuuaaaguuuccagccauauucgucaacucauacacugccucuucggcaugaaauaggaagcacacauaagaaaaacagaaaccaaggcugaccggagagcccaguuacaaaagcacuuccugcacaaacaugaggaccuggcccacacguaacgaacucgguacaguggaagucacuggcaauucugggacugaggagggggauagagacagaucccugggcuagcuaccuggucaggugagccuaaugcccaugccuaaggagcaagguucaacguuggccucuggccugcacacgcacuaacacggguacacacauaacacccuuagcacccacacacguacaagaaguggcacaccaaagaugcaccgaagugcaucaaacaagccauucgaaauaugagcccauauuauuccccguauucuaaguauccuccuuccuuccccagugccugacggcuacuuacacgaggggcgugggggaggcugaacaaaagcuuuaagagaccuuuuaauugucagagacagaagacuuccaauuuauagccauuaacuacucauuauuucaaauaagaaaauuaauugguauguugagaaaaucugcagcauugcaaaacuuaaaauaaacauuacaaagauaucauuuacaacuaaucuauauuuaccacugaagugagcuucaaccuguauuucuuccuauuaugcuuuuauuggcuauagcacacaguaaaugggguguguuaugcauagcuuccuaaacaccuacauuuauaaaacccaauuacauaaauuaauuaggaaugaacacacacauuuaugccuuuguuugcaacuguaacauauuaaccaugacaaaauuaauaaguagacccugaaaaggaaaaaaauggugucacguauucauuuuccauagcagauuuuuaugaaauuuaauuugacuucucugguccuaagggucacacuucuuaauaaauaugcaguucuggccauuucacauauacaaaagagcagguuuucaugguuccuaaaggacuaagaauguauaaauucaagaacauuuguuuccaggucuagagacagaagggcaaagcauuacucaaaugcuauuucugucucacuucucuccuacuuuauuaucaaagacagauuuugguaauuagagugauuugcuuucacuuagauuaucauagggaacaucuauucacauaagcuuaguccuaguuccacaggagaauagaacacugauguaugaucaagccaaucagaugaacauagcugcaaacagauauaaaugcaaggaucuauacauuuaugugcauauguaugugcccucaaauauaucuuuaacauaaaguaauuaauuaucuaauauuguuauacauaauaacauuuuuuuugcauggaaaaugcuaaaauagccugauuuuggagaaggaaaaaaaaaagaccuaaaacuaaaccaucugcccuggucaucuugaugcuaauggguuggcucccaugagccugaaguugcccagcccaguuauuagugugggugugagcauggcuccuuucacccucuguuuccauccuaggaaacaaaugggacuucuggacauagacuaugugggucaaacaucgacccaggcuccuuaaccuucuaucuuuccuugcuggaauagaggugagucccucaugaaaaagaguacuuacugcaagauaucccaccccaccacacaaaguagcccacuccugaacuggaccaaaguggaaaggcucaugaaugggcucucucucucucucucucucucucucucucucauauauauauuuauauauauauauaaauauauaaaucuucccuacucagcuaaagagccucugaagccaagcagaagaaggugccauccacuucucaauggaagaugugaacguuaaacaggaaucuagcugagauccacacagauggcaaguguuuaucccaaaggaagcuaccacagagaagaguggacgucaccaugcuuggauggaccacaacuaaaaacaguuaggcccagaaucucugucugagaccagaugucuuuuuuuuggcaaagggaugaaagacccaguuucaaagaccugaugguacucucuugacauacgagguaagaguuuagaugcagaacucaauugucagugggaggcgguacugugauugauuggugaugucugccguagacgugggaaaggugaguuauggcaaugucguaccugacaguaauuagaaaagaggcugauuaaugaaaucuauguacguagcucauccauacgaugaagaaaaaguaaaaauuaauguucauauuauuaugaauccaucaguuuuaaaguucaaaauccuauguaacucauauuguuaagaaaaauagacacauccauccaucagucauacagacuccaaacuuuagcggccgccccccuuuagguuucucuggccucaagacccagcaugcgugcacaugagcaugcacacaagcagauuuccccaggccccucuacugccucuuagcacaauuugaaacacuucugugcacgauggacaacuuguacauguguuggcauguguucuacuucuuucuuuuuuuuucccugacacuacugggggauggggacaggcauguaaaggccaaaaguuaacauacagagucuccgucagucacucuccaucucacuuucugagacagguucucuugauaaaccuggagcucggugauucugcuagacuggcuggcucaaaguucugaggaccuaucuaugccccacgaccucacuacuaccauuagcacagaaguuacaaacgcacgccaucagccccagauuuuauaggaaaacugggggauccaaacucugcuucccucgagauuacagggcaagcaguuuucuggcacagccaucccaccugccaccuuccuucuacuggcacucucaacaucacuuagaauugcucaaguugagaugcuuguuccuggaucaucugauguauuucagcaauucagugagaaaugcaauaaaugugcucaggacaaaacaggggcaguccaaugaauggcacacauacugauaguuuggguccuuuuuaaaacaggauauacuacagagauggagaacaggacagggcacuacuacagacaagguauaacauucaaccuucuuguauuuugagcucagugaaauuucuuucccaauaaggcugcauguuucaaauguuagaaguugaacuaugucuugugaccaauauguuccccaaacaaaaauuugaucaaaaaaaaaaacaaaaaaacaaaaacaaaaaccaaccaaacaaacaaaaaaacauuucaacaacuaaccuaauucauguuguaguuaugacuaaggugcagaauucuuuguuaugauugaaggcuugugauuucagccaugucccaacaccuuauaauucaacaugggcaaucuucagaugcacugaacagaagaaagguaaguagcucugucucgggaagggaaagaagacagaaggaugaggcauaauuggagggacagccucuucuucacaccagaagccucaaugugacauggccggacaaaacagcacugggccagcaaggcucugggggcagccaaccaaacccagccuagaagagcagacagcaggcccagcagguugucuaaagcaugcccacucuggcugccaauguggagucauugggucuuggugugggggggagggcugucaaaaagggguccauuaccaaguuuucagccagggugugaaagaaagaaaggggcuagcaagcauucagaaaauaaaacacaagguuguaggggaaagaaaguguagacugugucagaaggaauucucagagaggguucagcgugggaaaagcuacagacagacaauggugacuccaaaacaaugccgcaagcagccuggcuggcguggcccgaccuguaccucuuccagaaaggaccgaaauguuuuacugauacacaccgcucucuuccauauuuuucagccugaugcuaacuugacuuugucaaacauuucucauuuugggucuuuuccuaccaacacucugggcuuagaauacagucagaauaaucaaguucaagucguuaauacggucuucucaugccuucucaugcuuucaauauucuuguaagcuuaauaacuuuuccguacgcccucagccuuuccaacacucucugugugacgaugauguauuaauuugccugcucaauaaagaauuguccuuuccagacacacauccaaucagagcuaagaccccucccccucccccucccccuacuucaauaagcacaggagaaacagauucugcugucacauuaacagguacauuuuaacaucugaugauaaaaacaucgcauucaggaguuucucgauaauccaucacuuccauccggggagggcuaauggguacgaggcuaaaaccaagcaaugauccaagcagcuucuggcccaauuucccccauaauugcuucugugaauggaggacugcugucuguuuggaaggcaggagucaauguuuaucuuucaaucuuggguuucccuuguuugcuguccccugugcacuuagacccgugcacaaauaaaauuggaauggauguuuaauugcaugaaucacaugugguagggcuaccugcuuucgaagaguaaaugcaugcuggccgagugcucccacuuggagcaccguacugaccaaagggcagguccgggauggagccagugauucccugaacagacagacaggcccaccuggacaaaggccacugcacgggaaaauuaauccagcccuuuuuugacaacagagcuucccuggggccgugcgcguugacgagggaucucccgguccauggauuaacuaugagacaccaccgaggaagggcaggccccguguggucaccuuagaagccaagcgccuggaagaggggcucagcaauaaucagggcgguaaugaaaaguccgggacgagcugcgguccacuggaucugcugagcacggccacagaacuagcugugccccaccgcagcgcugugaugcagaccggaacgcacagcugaguggugggaaacugagacucagacgccuugagcaaagcuuuuugagauggguacugacucuguagcucgaagaucgccuggaacucagaccaaacuuccuccuccucaccuccggagugcugggcugaugggcaugugccgcugcagcaggcuccuuucuuuucucuugccugcucgucaucuccaucuguccaucccucccucucucuccccuuccuuccucucuugcucucuccuuucucccgucuuuccucacucuuuugagauaaccgugauacagagucacccccaggugugugcguagagugaggaggacaaaagggaacccagcucacaaaagucagucacaggaaaccgacgaggaggauacaagaccagagagauucuggaaagcgauggagcuggagggauggcuggccacuaagagcauuugcgacucugacccucuggguguugaguauucauacuugaagggccuauacugcuguggucagaaggguuaaauagcagaacauuuuucucuucgcccuccagagccaacugacucagaagacuauuagccaucucccaaaauguccuauaacuaugcacagucaccuguguucuuggucagggacaucacagaaacgccacuggguggacucuaaccaguguccggucugcaaagaggagggucaacacacaggaaaagucuccuucacacuuccaagugcaaaagugcggugguggcacacgcauuuaaucccagcacuugggaggcagaggcagguggauuucugaguucgaggccagccuggucuacacagagaaacccugucucaaaaaaaacaaacaaaaaauaacaaagaagaaggaggaggaggaggaggaggaggaaaagaaaagaaaagaaaaaguggccaagugaggccucuggcauauccucacauagauggacuagcuaauaaaagaaagauuauggggaccagagauuccucugaagcccagaugagcccugaggaugagauuuucaauuggccuucaaaguagauuuuuuuuuaaaaaguuaauuuugucuacuacauagccuuaaacacccacuaagaaaguauaaccaggaucccaaugauuaguggguuucauuaacaauucaagggaauacgaccucagacauuacaccacauaccacaaugagauguuauuuggacaauuauuucucaauaaugauucucuucuugaaaaaaaaauauauugccuggauacaggacaagaccuucauugucuauaagcagcagagaaaaacgagccucucuccuugaauacugagccaaauuuuaaaagguuaaaaacuguauuuaccaacuacggaaugcuaucucucucuggaagagagccucccaccacugugauguauccuuuugcacccuaacuacccacaguuccugauuaaaggagccugccagauaccuccuaaucaaagagaugagccugagaaaauuauccaggauaccaaguagugucgugggaaaaugugggauaauccuauuuuaaaacaaaacaaaacaaaacaaaaacuaaugggauucuauuucucuuagauugucaguaagaugcugauguccaauuguaaccugaacaaacacaucuggauuucacucaggcuugcuccaugguguccauacccacuggacgugacaucuguuauacagacagagggaggcacugacggcugggagggcacugccaaugggacaguggcuuuaccugacuucuccuauguuuccagguacucucuccuuaagccggagucugauggaacaaagagguaucuaucugcauacuuuaaccugucagacaaacuuuaugucgaucucgauacagagaagaccacuuuucccaccuuccaaggcucuggugaguggccaggcagcugcaaagugaugguuuuccccuuacuaggcacgaguuacuuuagucacaauguuaagaacuuuccucuuuaauuuuggcugugaaugguccccacacgguugugacugaggagcccugacggcccacuucugaacucauagugaccagcagaaagcacagugagcucguaagccaaaccuacugcuuucccuagggugcacgucuugaaguggacagugauggaaaucgcuaucucgcuaaagcauauggcaaagccuuccaagguucucuggaugguucucuuuccuguccucuugaucaaauaagggcaaaauagcccccugccacuuuucuaacuacacucgcaauaggaauuauagcacuacugucuuacuucuuuuguauguuaccuuagaaacgguauccacucacacacagagcaagccccaaggaugcgcguuguccugaaauggcugucaugcacggguccgagaucuuugcucucacuccuccggggccuucuaacugcugcccuuucuacuuugcguccuuugcuaacuuagaagcagguagaacagcagcaaguuagggugaccucugagaggagauaacggggagcuagaagcuggauauagagaggagccgugaguacauaauaaagauggugguauuuccaagaaggaaaaaaaaaguguuuauugcucuuguagaaaguacuggcacuuggugcccaacaccuacacugggcagcucacaaacacuguaacucuaguuccagaggacccagauacaucuucuggcuucaagaaccuagacacagagacauacauacauacauacauacauacauacauacauacauacauacauacauacauacauauaaacaaacuccuuuaaacaaauaaacauauauacauacauauacauauauacauagccuacugugugcagaaggaacugguggcaaaaauucccacuccaucuuuccaguuccaucaugaacugaagaucuagccuuaaaaaucucuugguugauacauauaacuuaagagaggaaguauuaagaauacaauauccacuucuucccuuuccaucuuaacagacugaaaaugaaaauuguuuauauguuggcuaccuggccacuagucuuguagacacauaaugaacuuugcccuacugggaaacgguucuguguauaucaaugguuuccccucaggucauuaucagcccacccuacagccugucuagucuguugauaaccaucaacacucaaguguucauacaaggaugccuagcugccagagggagucaggagggcagagaggucuugggucagcccaauccagacuuuccccacucuauuuuuuuuauggcagccuggggacggcguaugaacauggagcacaaaauaagaaugaccgcugaguuuacucuugaaguggacaggugaguggcacagaggacacucggaccuccauccuguaagccuguggggaacaacagcauguugcagggacaacuggcagagcauaagaaaagagcuucacaugagcuucagguccccucgggauucugagggucauccugcuggggcgcuuagggagacaugaaacagaagaccaaccgcacugcucgguccacucgaaauaaaaaaaaugugacaucauguggcacucuucuaucccucaucuuuagcaaccaaugcagaggugaugcacagggcguuuaauuacuguuaaagaccgggauacaaauauuauaaguaugacagugcagacguaugucgaagagaccuuugagaggaagaagagagaugagaugagcuggcagaugcugggaagauagcucagaggguggaggugccagccuuguaagccuggaagcccgaguuuaauccccaaacugcacaaaggaaggagagaacggauuccuaagagcucucucgugcuguggugcagguuuacacaaauauuaguaauuaaaauuaaaaaugaaccagugggacacucuggaguauccacugccccuucuuagcaugcagaggucuugucuagagauuuauaagcaaaacagaacguaaauacuugcacacgcauaugauaaauguauguauacagcccuauuccauacaaaaacauacaaaacuggaugcuggacaaagccugaugggagaugggucagcuaacuccgagucccucacagcaaagccaccagugcaugaggugacuucagcuggcauuguaagcaccaggucaggaccagggaguggccaaaugcuugacaaccagaaaaugucaagaugggcugugucugcaccucucagaaacagguacacagagcccauccccaguucuggguugaauggacaucauggacgaaagcggaaggugaaaagacauuacuguuagcucuggcuacccuucugagucccuugauuuccccucccuacccccacuaauuacaaacacuugcaaaggagacaaggggcgucugcaggaaguugcuugcucuguucccuucuucuuauuucaugcagucccuccaguagcaauccaaugugcaggcucuggaagggcuccuuccuccaucggugaggaugugagaaugugggagaggaauuggcuauacugcgggguggccuggguagaccuccgcaaaggcaucaaccggaggagggaugugguacccaggacuagagggcagggauacgggcgccuggggggaagagaacugccuagccaacgcugccagggacaguugugacuuucugguugguugagaaacaacaauuugggugcuggagagagagcucagcagguaagaacacuugcuguucuuacacaggacuggagcucgguucccagcacccacaccaagcagcucacaaucucccauagcuccagcuccaggggagacaaugggcucuucagcucuuccagugacacagaauacuuauacauacaugcaggguacacacauaaaauaaagcacaugcacacacacacacauaacuacacacauacaaccauacucacacaaccacacacacacauauauacaccacacauacacacacauaacuacacacacaaccauacaaccacacacacauauacacacacacaaccacacauacauauauacacacacaaccacacacacauauacacacacacaaccacacacacacacacacauaacuacacacacacacaaccauacaaccauacucacacacacaaccacacacacauacacacacacacaaccacacacauguacagcacacacacacauaacuacacacacacacaaccauacaaccauacucacacacacauacacacacacacacacacguagacauaaaauacaauaaauuaacaaaauuuucaagaaagaaaagaaacaacaccuuuagaccaaagggguggaaacugucuuuuuuugccucacaauaacuacaauuuuuugcuagauaaagaaaaagaagaaacauuuuuaaaagaaaagaaaaaguaccaguccgggguggcugcuuggggugaccaugacagcucacugcacaugguugagacgaaugggcuccauuuucaaauucugcguccgcccaggaauugggaacauggccucgggcgcgugcggcuccccuccucccgcagucagcgugugucaccacacugucacuucccuuacugaccaaguggagacagugacaguccuucugguuauuaaacgauuaaaucaaaugguguccuguaaacagguggggcaccguagagagucagagcacuaugucccuucccccuccugccccuugcuacgagcgcuggagaaggcucagcucuccacggcacaggagauuauucauaaauguuuccuggaaggaaaggacccguguuuauagcaacauaauuaagcucagguucaaacaaacaucaaagcgggugggaaacguuuuaauguuuuaugccucccuguuuugaugaaaaaauauuuuuuaauuauagaauccaaacaucagucauuaaucagugacuuggaaaaaaaaaaguauacuacaaaacaguagaccugugcggagggcuaauuacagugucacccagaugcugugugcacacugaagcuggcugucauguucuaugaggaacuguuuauacaggagccaggugacuuugcagucaggcagccccacaggcugcguccugccucugccgccugaaagcuaggagcucacggaggaguuucuuuccucaguucccuucuacagaugaagucacagaugaugcagagccgcugucggguuuugagugugaaaucccuccccgccucggccucacauaucaaaacuucuguuuccuaacugaugaccuucuuugugaggaacacagagggugagaggcauggcuggcagaugugugucgcuacagugagccucugguggcuaaagccagauggucaucucuccuuuaccucaucugggggauaugcgaagccaccacagaccaacauacuccaaccauagcagcccuaacauaaugaacaggccccucugaaccgugagcuaaaacagcccucccuccccucugauaggcggcugcuccccagagugaagcucaaggccuagggccugaagcaaugcggggcuaaccugaaacccaacaagagcugcugacuucugcagugcacagaccccgagcuucauucguaggaucuauuuucagagugccguuguagaggagggauuccacucaaaugagggcauuaaggacccugcuuuguucccacuuacaggggcucaagccaggcaguggugggggggguggggggguggggggguggggggguguuaaaacucccugguggcuguuccggugacuuuuguccaaaaugaucagagagcacauuaacucauuagcagaaacuucgcugccugcugauuuuacaaugcgggcaaugaaauucguugcagaagcaaaauagggccaauaauauaauuacggugcucugccgaugcaguuggugcuaaugcuauuauuugacauggcaaggcugcgcuuucccccagagugucgguggagacaagguucguccuaauugguuccaaagcacagccuccccaccaccgucuuuccuuaggaccaguaauguuaauuuccacacgacuguaaauaguauuugcaaacaauacaaacaugguaauaagaggcuagguggguaauuaauguggguacaaagcagcuuauuugcauuuuuauuuaaaaaacggccuucuuuaaaaagcagcucagauuccucucugcaaaggaagccuugguuaaaaagcacagcaguaauuacucucuuuagggguucuuuuauauguccuucagggaauuaaaaugaaaagauaagcagaauuauaaaggaaaucauguaaaauaugaaauguacuauaaacacuuaaguguauuuaccguaagguaggccuaccuuccuucuuaauggaauauuuuaaccagcuaacaauacauucaguuucauuacagaugugguuaaaagguacaaucauccaguuaaacuauuuuuuuuuucuuacugucuucggggguuauuauguaaagauuugagaagucuucaccauaaaguccaucugccuacguccuguuggaaaaaagacagacuaagacaaagaguuuuuagcuugggccacacugagacaggguguguucaucuccacucauaaaaggcagcuuuggaggggcaaugucaucuuucucguauuggcuugcaccuugcauuugugaggucaaggaagaggaagcaagacaaccuguggggaguagaauucagucucuauuucucucccgauuuguuuuugucucguacucugagacaaggucucacauagcccagaggccuuuucuauagcugaggacagucuugaauugcugauccuccugccucuugcucucaaaugcugaggucucaaguauuugcuuguacccuguucugcuucucuuccuaccuagauguguggagauuucuggaaagugcccagggcaucgaaaccaauaguugaugagacaucacugggagaccacuuggugaucaucaccuagccagugguaggcgagcuggggcuggaucacagggucaucaagucacacgucuaucccucgagaacggcaugguuugaguggaaggacugucacacaggcacaccugucaggucuagagaagggguuccuguaggucugcugcacaaggcaagucucacacaggacaugaugcucaagaagaaggaagagacgacugugaggugggucaguucacuugcaacuuccagccggggccaagguccuuggccuuggaacagcuugaggcaacuggagaagagaagcaugcaugggagaguucaaugggaccccagugagcaaacgguccaaacuuggauucuggccaggccauagauauauguucacauagcucuucaagggauauauaccagaggccugcugucacagcauugaguucuccaucagaauucaaggcugaaaggcaguuagugguagagcccuugcuagcauacacagggcccuguguccccugcagcacaaggugagaacccggagcacauccauuaggggacagucuagaacucguaagaaaauuaaaugagaugcucauguacuguaagugcaaauuaaauaggaaagugucgauauuuaaagagggaagagggcugguuggugaaacagaacgaacaugcagaagaagagcagaguaagcaucaccucgcccaacacggugcaaguucuacuccgggcuagcaaauccuugucuuuccuuccaauauuuuuaagagaaaccagagcuuuguaaccucgaggaaaaaaaaauucuucuuaacuaagauuuaaaaaaaaaaauguuaucuagguaauccacagggcacccuucaaacaaagcuucccuccaaaugcaacguucccacauauagcaaacuagcgccaagucauaaaaaguaugucuucgcucucauucaccccacacuccaaacacuccgccgggaaacaaacaaaagaugccugaugguucugguugugucugccucuccucuucuccacaucuauauugguauauccauauggggcuucugucuucucacccucgguccgggccaugcuuccaacauccggagcccauuucugacaggaagucuugggacacugcacugcacgggaucaggccuucaaaaggucgagguugcuuuggaaauacuugcccgguuaaauuuauucauacuuuagauaggauuugcaugcgcugaugaaauuuuaaauaccauuucaaaacgcucgcaaaagaacggagaugcgaugaagugggagagaggggugauacguugaugacagcagaguaaacauccggaaaacugggucauuuacacgagagcugcagccuccccugcuaaaacacgccaaugacaguaugaaaaaugguuugugauuuuaaagaaauauagcacuccaaaugucagcgugagagaauucaauaacacuuaaugaaacuuuggauuucaaauuaauuacugauugacuacagcaucaggggagaaaacagccucgauuagaggagcuggggcaggcuauaaaucuggacagcucuuuccaggacacggagcugggacuuccugcucaggucagugaggcccgguuaaugggguuacagaucucuuagauggccacugauuggauugccagacaucagacuuuuccugacguggcugugccuuuugcucuuuuccuucuuccugacuuuaguaacauuuaaacuuguauuggugguuccaaaaacucgcuuacgggagcgugggagaaagaguuaagcggaucugagaggugguguuuuauuaaaagguaguagguacacaugugcaagagcacauuuggggagaaugguacccaugguuucugauuacugcuccuacccugccucugccacgcuucccugaaggcagaucgcagcgcccugucccacugacaauggucuugaccauggcuucuggcagagccgugagguuuugcccucaggaggcccucaugacgucaaguucuaggauguaaguaccgaucggagcucacggaggccuaaguaaggccucagacagaucuccaccuugugugucaugagaaaacaaaaguguguguuagugaaagcgcucaggaggcggcagucgcuuguccugcagcaaaagcuagcuuaucaauaugccauccuugcaaccaaaaaaaaaaaaaaaaaaaaaaaaagauguuuacgaaguuaaggcaugacuuuguuuuguuuucagaaguuacaaaauacaaaaaaccugaaccacaacagcacuaggcaccuggagcauuuuuuaugguuacugcuaggaaauggacaaaggagagacuauaucagccaugacuuuguaguaagaguuucaaagcauugaauggccagcggugagacaguugagagcuaaacaggaagccaggaaguuugcaaggugcugacugggcuggccugcaucuaagguugcaacuccuccuccgccccagggacaggcaucuguucucuuaucccuguuucauaaugaggagagugaaacgccaggaggcuaacaaacccauccaccagaaaaaccagaucaccucgcccucaucgcucuuuguacaacuccugguuauuucacaccccaucuuaguauucucugugcaucgcucuuucaauauagccaaaagagauuaauuaaaaagaaguccaaguccaggcaucucaucccucaggaaaggcacucacucuuaugaucaaauguccuauaaauucugagaccuaucuaauaaucacagccauucauuuuccgcauagcugugcuuaccucucuacaaugcuacucucaauccccccucagauaagaauuucuuccaaggaucaagagcccgccuugcuuuaaauccccacccaaacccuuccccaugugggaaaucuauauuaauuccaccaaacuagagcuaucagacagccaucauguauaggacuugaaaauaaaggacuaacauucauaaaaaaagaauuaacauauucacaagggcucuguuccuauguacaaaacagauauggaggcauucuuuaaaagaaugagaauauucacaagggaugcuccauauaccauggacaaaacagauauggaaggcuucuuaaaugcaaucucugagaauguuuggaaaaauauauggauauuuagcacauuguccuaagcccaaauaaauauaucugaaauggccuauaaugcuauucucuaucaggugauagcuuuuugugugacuugcacacacacacacacacacacacacacacacacacacacacacacacacacagaggcauguacuccccggauaccucaucuaacucagcaaauggugauccaaggagcaaggugggguuggcucccagccagccuuagcucaugaggccauguguccagcuggaagaacaauguaccucaggagagcaaggccucuuuucuacuucucccaauaaugcccugugacuaacaguccugcucuuaugcacugugcuggguaaucuaggugccuaauccagaucucaucaccagggguggggaggaagcugauaaaauaaauugcauugcacaguuucaucuuuaaacugaaaugggguagccuagaagcuagcagucccuugcaguauacgcacuuuuaaaaccagagaugccagaccuacggaaaggccauugagaaauccagugcugauggaaaccaccagccuggguuccgaauaaguaccaccacguauauuuuagaagaggaccaugaagugugcucaaguguggcaaaccagugcggcagaaggcacucaacucccccgacccauuaucagccagugcuacguuuugaugaaguauguggugucaccgcagagauuaaucaccuggcugagguugauccacuuagaaacugaccugggauccaaaccaaauggccucaagucuaguauucaaugugcucucccuucacuccagugagacugcgggcagccuuugaaaggaugcagggccucagccgauccauucuaagugugccuggcucaugugccuccuguuugaacaacacgagugacuggauugggggguaagguauaguguugauaggacagaaagggggagacuccaggaguaacagcacccacaaggcaaaccucuggaggcccaagcaucaccauguccauucuacuagacaaauuucacugccaagugagagaaaaaucaguugacaccagcucaaacacaaagagggagucauuauuuuguaauacaagggcaaggauuaagcuuagcuaaaggaaugcuuucauucagcuuaaacuacccucucuuaccccaccuccuucucacaucuccuuccaggucccaguccaacagagaagauggugcauuuuguccacugacucggggauggccauuaucugaugaguggccagcacagcacugccugccauugguggaguaaguguccagcguggcgcugaccgcugcuaauggaccauaauaaaccacagccaaaccagaucauguaaaacacccugaagcuuccgcagucugcaagaugcagcucuugauagccaacguagaugaagaaaucggcaucacaacugcuuccacugugagaagggcagggugggaaaccagcccagaagaaagcagggaagggcuuaggugccaugauggugucagccacuggucacagcuauuaacaacccccaccuccccauuucucaaaaaaguacuaggcaggcagcuguuccagauuucucugguuaaugacaguucuguagacgagccuccccaucuagggcugagaacggacaggggaaccagcaaaccaugggcccuuugagagccagcuacacgaacaaaggugaggacggagccaggaaagacagugcugugucgcuagaacuucagaggugauaaaggugauaaaugcuaucuguggaggcuaugccuuccugcuccuaaggcaggaggcaggauuccguuucuggcucugcucagccccaaugugcuuccuacaguacuauccuccagaugaacagcuccccucagccucaacguggauagaggaucagcauguacagaaggccaguuccucaggugcugcccuucugcccugcccagcuucauccuccggccccaugacccgauucuccucagccacuccuguccccacagcccccuuuaauguaucauagcacaaucucaccugacaucauauuuacucaucucuuauguuauugagcaagggaucaaaauaugauguggggucuggagagauggcucagcaacuaagagcaccuguuguucuuacaagggaucuggguucaaaucccagcacccacgauguuggcucauacuaugaauaacuccaauuccaggggaauccagcauccuguucuacaauuuacagggacuaagugcauagacacacaugcaagcaaaacacucauguacauaaaauaaaguaaaugacucuuaaaagagaagucaggcauagugguacacaccuuuaaacccagcacuuaggagacagaggcagguggaucucagaguuugaggcuagaaugauguacacuguggguuccaggccacucaggcucugugugugugugagagagagggaggcggagagggagaaagaauacuuuaacaaaaggaagcaggcucauuuucuccagugguccaaugaaaacccccuuauauaacuucaaagagcauguccuuccccccagcacccacugagagucuuagcaccauuaggucugucagaaaccuuacuucugccucagccagugacuuuuuuuuuuccauccuggacuaucucacgauggugcacaccuuacugucuacucuauaagauauucuuuacuguaauuccuuucuaauaucagcuucuaaacaucuccaguuuguggccuuacuuuuuuuuuuuuaaauaaaaccccacgacugcaaacuguauauauacucuuacaacuauuuucccuguguagcuaagagaacuguucuacaucgugauaugaacaccucuuucuuuugugauccccuuuaacaguuuugauuuaauagacacuggcagguacuaaauuccauggaaagcaguaguuggaagcccacagaaaaugccauuuaaucaacugaacacucccagguucccauaacccuacugaggaaucacaaugaaggcagugauguuauauuaauuaaauucuuggaacgcauccaugaggcuuaauggaaaugagacguuaggaggccucgaugcuugggaaacacccaucacaccgccaacguccccagaacccaccucccacgccugccaagggaucugcucaaauucagucacgguuaccacauugugcuuuaaggaggaagacucagauagggagauguuaaggggaaagcaagaguucacccacuaucugcaugcuguugugucuggggaguuggccacacgugauugaucacagagacucugaguuucuucgaagguggaaagcuuaugaaacuggaaaaaccauguucaugcauuccaucauucaacaaacaggaugaaggaaagacaugccuuccacccauugaauacucgaguugucuguguucuaauuccucaauuuucucauagagauaagagucaagcuuacagaaagccaccagggugcccaaugcacgcuaaauuauaggcaucgcaacaccagcacauggaugaacagggaaacauccuuaucaggcucuucguccuacaccuguugaaacugagacucaaggaaaguaaaaucucgguccauccucacccagccccaaccacgcaucucugcagacucagccucggaugaauugcucuuccuuggacacagcugcuuagcugauguucaaaacaguucauuuccauuuaauugauucguuuuuuaaaagauuuucagaaucacaauggagccuaaagaaaggacccuaaugaaaauaaguacaacaaacaugauucucuucuuuagagggguggggaagagagcaugcgcuuggauucacacaguguagauagaacgugaugcacacguguguggcauguacacaugacaggacagcccuugguuugcucaagacuuuuauucacuuuuuucguguguggagguaaaagggcaacccaaagcaguugguucuccccaggaguuaaacucaggucauccaaguuuagcagugagugccuuuauccagcaaaccagccagccagcccuuggucugaacgguuuuaaaggaagaaaugucaagccgggugguagugguguguacccuuaaucuuggcgcccaggagaaagaggcagguagaucaaugaauucaaagccagccuggucuacagaacagucagggcuagggagacacaguguucaaaagagggagagagagugggaagaggagagaaauguuaugugucauguuuacaggauguucuaaagagaugugggcugguggaugaggacacaggcagggcucugggaugauuagccuggggaccaugaagacagguacgucucaacagcugacugcaugaaauguaugaagagcuguccuccaccuuagguacaggaaaugcauguggguaugggaacggaaaguuugaugcugagaaagacuuagaacuuucugacugucuaguuugaccaaacuggugaauuccaagacagagaaggcacccaaugcuuaacucuggccuccacaugcucauaccuacuuacacacaugccacacacacgcacacacacacucgcaggcauauacuugcacacacacacacauagcagacaaucaguuaaaacaauagcuacacaagggcuuggcuugcguuaaguguagcugugucaggcaguccucagucugaucugcgacaucccagccauauaccccuguccacguacacacggcagcagguaaucccgagacuugggaauguggacacucacacgggccaaugggacaugagccuuggugacaggucucacuugggagcagaagcuuggcugcaauacaaaccagcaagccucuuccuuccugugcauagcauccagcuaugugggcugcaagcccgccccccuccccccacggcacucccagaaacacuggcuagagauucagucuagacaagagagaccuugguagcuuuaugcuguagaggguccacaggggcuguuggguauuacguccugacuagccuguccugacccacaauucaguuguucguucuggacaugugacauuagcuaucccauccggggagucucccugaaugugaggguuuaucgcaucugcuauauaacccaggcuuggcuuuacagugguuucauugcucaccauaaaaacugugauagucaaacuguauaaacaaaccaaacaguguuuucaccguaaaacaugaaugaaauaucaauauuugccuuugccuucucgcagcaacuguaaugaggguggaaaauucaugccauauguuuagaguagaaggagaaaauagaucccaacaauucauccgagcggguccuggcuacacuguuuaauauuuuuaauccauccguuucccuucacauauaaauccuuugcgaaucauggaccacucgagacugccaguuacaaaauccacugccauuucuacagagggcucuuugcugaggaguaaugaggcugguggcuccgccaugaugccaaagggcuacgccacccuugcagagcucagcuugcuugcccaggcuggaacaggaaagcacuuugagagagacguaaguagacagagccucccuggagcuacaggcgcaggagagcccuugcuccugacagcucccaucccccacccccacccccaccccacccccagccuucguccacacagagcacgcuaagugaauugugccugcgaggaccuucugauaugguguguguucaggguaagggguguuaucuguagcuccgagguuugugacaggcuccacagccagcuucacaggcggagagcaaugagggauguuuuuauuuugaagcugugauugagcccuggaugugaagcugcugaagccugcccagaguguuugcucgggcuuuuuaggauacgaagccgaaaggcgcagagaaugauucaauuuccuccaaauuggcucacggaccagagguuuguagaagcugucaccauccugcaaaauccaauaccacagugaggaagcuuuccuuugaacuugaagccgacggacccagaggaugcugugucuggcccugaggccggcccugcugaggcagaaggggcugcugcugggaagaggagagggaagacgagcagagcauggagaggugacgaacaggggcuuccagcacugugagcagggcacugcugucccauuuacaccugacaaucaucuugugaugcagggaagcaauaggaagauggagggcacauggaggaccacugagagcuaagauuaccacaccacuacagaaauguagagccagggagaguuccggccaaccuuggucuaaauccaaaccucuguucuuaaccacuaacuggccuagcagcaucaaaaaucaaucauucaauaaauaaaacucaucuuuccaguuuagcuugguggggcacgucuaaaaaucccagcacuggggagauacagaaauaggaagaccagaaguucaauguccgcuaggugacagagcucugaacccaccugccccuugcacaaguaacacugagcuugggacauaaccagaucucaaccccaucuaccuucauacuagacaaacagauagacauaugcaugcaugcacacacgcacauacacacacacaugcaguaaccagugucuuggauaccauuacucauuuacaugucugucacuguagcucagacuccaugaggacgaggccaaugagguguauacacacacacucacaauccaguagacuacacgcacagaugcugucgauaaguauuuguucacuaaauaaggagcccauccgacaaacgaucgauacacaaugggaucaaugcuguaaucaaucaaugcauaauuuaaaaacugaacgcuaaaggggacguggaagugaaagacggauguuggagaaugugaauagggaggugugggggaagggaugagggggcagugacugugacaaaguacauuagaugucuguguggaaaugucacaaugaaacuccuuaucauguaaagcuagaauaugccaaucugaaguuaaauaaacaaaaccaaaugcauucuguaaguuccugggaagcaggaagcuuugaucucuccaauagugcucagcacaguacccagcugagagggguagaaugacagguacuuuuggaauugggggggggggacagaauagcauccuggagaauccuggggagacucuggagaagagacgggcaugaacagagacucauggagcacagggacauaugguagguggacacgcuggcugugaucccuccaggcugaggaagcagucugugccaagauucagggaggugggaagguugggcgacacagugguucugauacagcuugaacaaggagcagaauggcugaguggccaggcaugagcuggacaagcaggugaggccauucugcaugugugccacaaguagggguuuuugacucuaucuuguuugcauguggaguauacacacacacacacacacacacacacacacacacacacacguacacaugugcacacacuagugcaagugggauagagaagaugaucgugacugagccuccucaggcgcuauccaccuuuuuuuuggagacagggucucaguggccugaagcuugccaaguaggugaagcuggcuggccauugagaccuagggaucugccugucucucucucuccccagagccaggauuaaaagugugcaacaacaaacccagucuucuguaauauaaguuccggggauugaacuuauguccgcaugcuguaaggcgucuccccagccccacuggguuggcuuucaauuguuucuugucucugcuggcacuuggauacuacaccacaaaccauucuaaguacuccgguaucauucuacguuccuggugagugacaugacaguugaucuucacaagccgauguuggguacuauuuggguacuacuggcaccccaugucacagacagaacaggaagugaaggaagccuggcucucgugugguacaaacaggacugagacucaggcacaccguagucugggucuguugcuuagaccugcaacguaguuuaugguccaacccuuucaggcuuugcaguuuucccagauaacccacccuggugcccaacagauggagauguguggacacuaaaugaauccuuuccaacaacuacugagcugacuuugagagccauuuauucuuccuaaguaaaggcuucauauacuccaguuuguccacuuacaaauuuaaauauauauacuaugcuuuaaaaaaaaacccuauauuuaauuauacauggcaucaaugaaauuucacuuggggaaugauaauccaacauaaacaaaugcuuccaauuuggggggggaaagcuauaauuuaaacuaaauugcuauacuauccaggaagaaagaaauguguucucuucauaggaagacaaaguauuaucugggauucaguggccccagccaaucagaacauagcaucagcagcaaaggacuggaagcgcccuaaauuccgccccccacugguucagaucccgcugcugauccaggcugcagugugugcagugugugcugccugcccuggccugacuuucauuaagguuuaaacucaauuaagccacggauuggaacaaucauuccuccuuugcaaaguauugauauuugccccccagacgcuugagggcuuuuccagcacucgagaagagauuuauguuagacaauuucuuucugauuaaaacaaaucauagcucaacaauucuaauuucuuccuuucuaagcaagaaaugaccaggggacauaagacacagugagcccgcucccucaucuggcccaggccaguccaggagagcucuccuuaagaggcucccaggaaaguuugcagcucugcuuugucucccugucuuugucugucuguccugccuuuguguugccagcucacuuauguucucuuuucuucugcuuuccucugucugucuguauacacacacaggugcgugcauauaaucugggcaaacuucaccauuugucacauugaacacuuauuaaccaagaaacaaguggaacguuagacacgcagccaaaccuugcuguuucuucugaccugagcaacgggaaaccagagagguuuuaugcuugccuucucaaacucuagcaacaucuucggcauuuaaaaacaauuacugaugcaauuaaccccagcagaggcaaagaacaaaauaaccauccaacucccugcucucccuguuuaccuauacucaugugaagaccacgggccuauggaaucuacccgcuggccuucagaucccuguguaaacuguggcaauuuucucgucuuagccuccugaaugcuaggauuaccaguguguuccaccaugccuggcuagcucuuuacuccauccccucugcucuucagugcagccucuggagccaaucuuucuaugugaagguucuucuuccugucccuccaggauguuugcuuauuaguccacuccccaucccagucaucccuccccaaaccagcacugaguggggaggcuggcuacuuauaaucaauaaggauuaguaauguccaacaaaagggauuaaauaccguaauacagcauuccacaaauagcuacguguucuugaacaagcuagaagucggcugaaaaacuggagaccccugaaauaucaacaggcuaaucaacucacaaagcucaaaacuuuauaaaugucugguuguauauaccuugugcuggacaccuuuccaaagguaaacacgcacgggauugugcuaucuggguuucaauguccaugacucgguuagcaaccuugaccgcccacuugcucuucccaugagugucugguaauaccuccugcgcugcccugaaagccccucaugccuguggugucucugcugugugaguucgcacacauccugaauaccucugugccuuaagaucuuuucaggaaaccagaauucaugaaacugaauguguggauggguccauccuuaacaugugcuaaaggaaaggacuagaaguacuuagcacagcgacuacagcaucaugcuagcugccauucuuacuauuaugauucucaauuucagagggguugaccaagggccgguaagauggaguauaagguaaaggggcuuccucggggcugaaaaucucugggauggcucaggaucugggcuaggacaauauuuaacuguuggaaguaaagacaaaaguguacgccuacucucuuaguaaaaaaacagagugggaaaccaggugguggucuauaucgacuucugcguguacccagauuuccuugaguccccaucuccagaaacucugaacuggugguucugggcaggacccaagaaucugcgugucuagcauguucucgggugauccugauucagccuugagaagcacucugugaguuucugcagcccugggaaccaccgagauuggucaaugagacaccgcagagagcaguccagauguguccuugcucuccccaccuuaaacacagcaccuuuccagccuccuugaugcuuacauuucugucuucucuuugcuuucaauuugggguugguuuuaagcguccuguaauucaucaaccaauucucuccuggcuacacauuccaaguaauuaaaguucaguaaugacugagucuuucugcuccagcaccugcauuucauuuguuuauuuucccagagucauaaaucugaagggcugucaaagugccauaauauuagugcaauaaucaaaguuaauuagucccucucaauaaacaacaacaaagcuauuacaaagcugcauucaaguuccucccggccuaacggguugcagaacugccucguagucggaacaacuggagaucccagaauuguugagugaauaaaugugguguuccuccaucacuuaaaggcagacugcgcccuugaugcgugcugauucauuaacuccagggaaggcaaagcaggcccgagcucccgcagcugcugccugcugcaagauucagggguugggguuccccagcugccucgccuuacugugagcgucccaagcuucaauaauaaaagagggacaaggguugcaaagaaaugagaaggggcagucucaccgccaacucucgguaaccugauagcuucaauaacuuuggauuuauuauuuagggaauuugagagaugcgcguauuaguugggcucugagaaaggagccaacagcgcucuggggaaggagcucagaccucugucuggugguucaggggaggagaugcuauuuucacuacgagggaggucuuucuaauuaauucacacagaaccagaaugggaugacugcgugacccaugaagaagagaguccacagcgaagcuggaggccucugaccugggaugcuguagcaggccacccgggaagucuuucaccuugagcagcucacugggucgcaggguccaguccgucccagagauggcuucugcccuggaggccacugcuccuguguuccuuacuaauguuuuccccaagagcauaagaccgaaaacuguacacauucuguaucuaaucaaaucuagcaggucucugggacauguucuagcagguggaugguucugaaagaagaacuuagcauguaaaucuaaaggaccaugguaguagcugguaacagaaggcugagcugggcagaggguucugaguggauucaaaccagcauugugauggcaaagacuucacauggcuccuaauaugguagcccaaauccagugacaccagacagugugcaaagaagacaccagaaugccuuucgggaacuuucaccuuucuugggggucgcccuccaucacuaccagcacagggaccuugcugagacacucaccagccccaacucacgugggugaaggauaaccaggcuccauucuugaagggagaauugucaaagaacugguuuauaggcuuugacgucacuacaacacaccugcaagcucuccuucugcauaauucucaaaacucgguugcaucuacaucccccagaugacagggacagggacagacaccaggucucaugaauccccuagggguagggguggccucugugggcuccacuucucuucagcacuaaccccagccuaugcaaggccacccugcuccaagucacucaaggcuacaccaguaacaaucaccucucuaccuccuaaggauggaagaggauccacuuucaucucagagcauuucagugcugacuaacacugcuggggaaacaaggggauccaacaggagaaaagcuuagaagugucucccuccccccuccucccucccuccuuuccucccuuccuugcccccuccuccucagccccgccucccuccuucucccuucucucuauucccccuccucccggucucuucuauuucucugcucuuuaacaugaggagacauagugagcuauaaaacagaagacaauucucaccaagaaccuaagcgagcaagcacagcguucagaguuccagcuucugcaaugcuugggaauggauccugccugagcccacagccuacggcauuuuucuaagaggagccugaacuagaacaaggggagaacacuuuuuucaagaugcguagaugcaucugucuaguucagggaucuguguuggacaauggugcacacagcuuucugcauugcagcacgcugggcuccaugcaggagagcucuguguggcugcacucuguccucguggugacccugaaaguugucacuugugccauuucuacaggaaacaagccaggggagccagugggcaacuguuugugucagaauuugaucccaagucucuagggcuucaaagaaaggaccugaaguauuucuguuguaaauacuucucuuggguuaaccuuggccuucugcccuaugcgcuggccagccugggacaccaccuucaguaccgcugaucucuuauuuguccuugccuggacaguuuuuaucagcacagugacuauuucucuucuauuuaaucgaauauacacuacaucugaggcucucugaaugccccauaauaaacaugaaaaacaguuucaaguauauuuuccccucuuaaauaacaggcuaaaagcugaguggccagaugcaagccuugcagccacuggcuagauaccaucugaagaugaaaucugucuuuucagacugugucaaaauugcuuaauaagaacccaggggagcccacauuauugaaaggauggaucuucuuugggcugcacacaauugggggugaugguugggagcgagccaccugugcuuccugcucauccuuuuaaaauucugcggugaaccacagcccuuguuaucuaaugguuauaauggauagaaaguuugaaaagauuccguucaagacugccagggauggccaggaagaaaaaaaaaaaaaaacugaagauacagaaauggugaucaaagaaugguggauacagucaagaguaagucaacgcagaauuuucagaaugagaaaugagauggaaaaguuggaggagaaggaccaggcacaauuuuucagacauucugaagacagagaaaacucggaauauuuuagcaaccaauuaugucuacgaggggaugaauaauuuauuaacugauaaagagucuuuccugggccugugacaagaaaggucaaaugggcaacuuaggcagaccgguaaauacacuacauagcacuuaacaaggaagggagggggcggaaaggaagaugcagucuccuuugacccaguuaucaaugacaucggauuacaaagagcuagggaaguuccuuccuagguaaccacagguacccucuuguuacugacacguuucccaucaugagacacugacucagaguacaguaucaggcugaguucuuuaacaagccucgucaagacgaggaguguguggcuccgcugagagagugcuugccggcuuguaugaaggaaggccuagguucaauccuagugcccgaaaaacuagaugagaugaugcaaggcagugaucuaaaugcaugagagggcaaagcagggggcagaaguucaaggucacucuccccuacaagagaaccagagauggcucggggguuaaagggcuuucccugcugccaugaaguucugaggggggauacugagaacccacaagagagcagauauggaagcaugggcaguuccagaauuccacugagcauuagagacagaagcuccugagccagcuacccaggcucacauuguggcaaauaagauacuccuucuccaacaagugaaaggcaagcuccaauacccacgacugucuucugaccucuacguacguaccauggcacgcgugcaccugcacucacacauauaaacaagugcauccacaugcacacacacacacacacacacacacacacacacacacacacagauaggcacauacggugguuaagagcacugacugcuccuccagaggacucagguucaguucccagcacccacauggcaacucacaccugccuauagcucuaguuccaggggaucugacacccucacacagacauucacagucaaaauacugaugcauguagguagauaggcaggcaggcaggcaggcaggcaggcaggcaggcaggcaggcaggcagacagacagacagacagacagacagacagacagcugaauaaagaaaacuugggccaaucuuuagaaacaacacacaccaggaauuuuagauuagguaucagaaggguuaagaauuggugugaugcaguuucaaauucaagauuccccacucaucccccaggaauuacacaccucuuaaccagcccccaaaagccuuggcagccagauggguuaaucaugugguauaugugccucacuguuaaugcuaagcacaucaccuagugcacagacagacaccucaauaucauaugaagaugacaguaaacgacaugugagaaugucccagggcagaacuucauccuggucuucugcugcgagcgcuaugcuuacuggcucaagcaaaaaguuuacauagcugcuguuggcucauagaacuguuuauaucauauuuuauuuacugaaauccaauacugugcagaaaaacaacuuuuaaagcaaauaagugagaaaauccaggggcugauuuaggauggacuuuuccuaguaacuaacugugguggcuugaguagagauggaccucauaucccaaggucugacaccauuacuggggcuauggagagcucacagaaagggaucuaucaugacugcccuccaaaagacccagcaagcagcuaaaagagccagcuacagauauuugcauccaaccaauggacaggagcaguugaccccuguuguugaauuagggaaggcugaaagaagcugaggagaagggugauccuguaggaggaccagcagucucaauuaaucuggacucccgagaucucucaaacacugaaccaccaaacagacagcauacaccagcugauaugaggccccaacacauagacagcagaggacugccaggucuggguucaaucagagaugauacaccuaacccucaagagacuggaggccccagggaguuuagcggucagaugagguggauggugggagcauccacguggagacaggggguggggaggauguggaacagacgggggggggggguggaugguuggggcggggacuggaauauggaguguaaaaaauaaaucaaaaauuaaauuaaauuuaaaaaaagaaagaaauggaccucagagacccacaguuuugaaugguuggcucaaagacaguggcccucucaggagguguggccuuguuggaagaagugugucacuguaggggcaggcuuugaggucucauauggucuagcuacugucuagcuacugugagcccaguguggcucacagccuccuucugcagagugaagcucaagagguggaacucacagcuccuucuccagcaccauaucugccugcuugucaccauguuccccgauaucaugguaauggacuagaccucugaaacuguaaucuagccccaguuaaaugcuuucguuuauaagauuugccauggucaucgugucucuucauagcaaucaaaccuuaacuaagacgcuuagugauaguacuaauaguuuuguggguuuguuuagcugacauucaaaacaacaggaugaguuuuguaccuuggacugucucagauaacaaucauguucuccaaggcaagcaacuaaccuggguagaaagcuucuaugucagccaccccacauacaacacacacacacacacacacacacacacacacacacacacuuacaggugcucacguugcaugagaggacaucaccucucacuccuuccaucuggaaaaacaaacugccaaguauaagcuuuuccuaucaaaagggacuaagggaaaauccgcacaagcaccgaggaggcuccaccagcccaguggcuccgggguagccagaaagcugcuggauuuccggggaacucgucagagcuguguugaguaccccacaccaccccacacuuacuacuauacagcgugagaacaaggagucagugguguugaaggcucagcugugucaggugguggcacacaccuuuaaccccagcguuuaggaggcagagacagcaugagggcagccugaucuacaucaugaguucuaggccagcuacgacuacacagugcaacccugucucaaaaaagaaaaaucuaagccaagugccagugcugcuugcccaacgucauggcaggcacgaaguccuucugauguccacgaugaagacugucaggacucaacagcaccaucaaugcccgugcaucuucacucuggggagauaaacagaccuggaaaccacaccauugagaacaggagugauuuagcucuggaucagguggcuuccaucaagccaacaugugugcucucugccacauuccacuaccaucacuaaucucucucuucucucucuucucucuucucucuccucucucucucucucucucucucucucucucucucucucucucucucccucucucccucccucccucccucccucccucccucccucccucccucccucccuucccaguauccgcugcuuccaguuuccuggugacugaauagcauuuccuggauaugugcaaaaggcagaucuuuguuaauacaaagggaagggcaaucacguaaauaauuaagaccacuuuucagacgacaguugagugcuaauaugaagugcacuggaaaacacuaaucaaccgacuaagugugcaucuaucaaacugugggaguccagaccugaaaagcugggaaaacaauucaucgugacuccaccucaaccguguugguaaacaucguccuuauagcuccccuucuggucacuuguggagggugagagaagcaagcuuugcgaugcgcucugcuccguguguaaguaagaaaccaauaacuccaucacugucauuaaccaaggcaguggcacugagcacguaaucuuucuccaccauguguuaauacuuuaccuacccauaaguccuguauuuaccacaaaccaccucugccuugaaacccacacuguacucugcauuuuacagauggagaugcugaaauuuccagaaguucagacauuuccccaaggucauaguguguaucuguuugccaacauacuacagcuuuaucuuuauuucuuauuauuguguaucccugugugccucuauguaaguuuaugcaugcaaaugcaggugcccaggggccaaaagaagguauuggguucccagauccuggaauuagagucaguucgcucuccagcccuacaauaucuuucuguaaccauuagccagaaauagguugcaacauuccuagaaagcaucuggauauguccagagauguucuagguugucacaaaaagaaaggguugauuguauucacgucgguccuuagugaguucaacaucaaaucagcucuaggcccugguggacccaaggcuggaucuaguggugcacgccgguagucucuccauuugagggacuuaagcaggagagacaugggaucaaggccagaauggacuacauagugaguucccagcuagaauguguuacaguuugagaccccaucccuauggagaagaaggaaaggaggaaggggaggagggauguggcuuuauugaugucgauguuuaccaguugcuuucucuaaagaugacugaaacuaaccacuuggaugccaccaaagcauccgaagcaaagacuguaaaacuuuaaguaugcgacacucagauaagagggagaagaaccaagugauugaucuucaaggcagauggcauaaacaagggcccuuucccugagcucacaagcuauguggcucugggcacugcccaucuuuggcacuugugccucggcuccucuaaugaagacuaggcuuguucuuuguagugggccaugccuggacacagucuaugacaggaaucccgugaaugagggcagucagcugccccaacacugagaauugagaaaaaaaaaaaacaaaacaacaacaacaaaaaaaaaaaccuuccucuggcuaagacacagacaugaagcacugggaacauggagauccuggaagaugcagcggaacuuggaugggaaagccuuggguggaacaagcccagcggaugaagaaaccaguuccaucuccagagcuaagcuaaagaugccgacagagccuuggcaccuggggggcaaucuggagccaaaaugcccggggacuucugaaugagcucuugcugcaacaagaaacccuggaccacucagaaccucccacaggguagcaauaugucuuagcacauccccagccaaguacagauaugguccaucccagguaaaguaugaucacauucaagcuggcuugcagacugaaaaccugcaguggauuaaacugaccuugacaauccucacugaaaugccaggugauaucccugugcagagacgggaaaucaggaggagucugaagaaaaucagaccagcaaugucaagggugagcauggggggaagguguggggagccaaacauaaagaagguaacaggauugggucucuacacugcacugacagggaaggcagugacagggaaugguaaccauggcuuuagugcuaaaucugggccuccauaaucaccaucuugggggaaugagaaauacccagaaaacaagugcacuggugagauaugaccaaagggcugaguuucuauaguccaaacccucuaggaugcgauuucagugugugaaacugcaagagacacauucgucuccgcugguguuuccuguucccacgucccuaacuugaauguuuccagauaaucauuccucuaggauugccacuccacaucaggaaacugucuggugaaacgccacagugauauuucccaucaucugaaucuggcucacggggacgccguuagggcuuaacaugaagggaggagagaguacacgcugggucucugagaucaucucauuaaaccuucuucauuagagaugugccagauguucuaaagagacuugcccgagguagauccaagaauuucugccucuguguaucaaaugguaauggaaucaggacaagugugguggccuauaauuccagaacucagcagacagacacaggaugacuacugugaguucaaagcuagccuggguuacacagugagagccuaccuggaaaaaaaauaaaaacaaacaaacaaacaagagagauggcaacaaagauggaugauagcuaaaugaagagacaaauagguaacagacagauagaugguagguagacagacaaaugauagauagaugauagauagauagauagauagauagauagauagauagauagauagauugauagauagaugauagauaauugacagucagacacagacagacagauuaagauaauacagaauugguaggugagagauagacaguggauuuaaauagaugauaaauggauagauagauagaugaaaauagaggacagauagauuuaagauaucaaaauugaauagcuacagaucagucuguucccauugguggagucuaagagaaagaucaggucaaagaugagaagcaacugagcuacaccauccgcuuuggagaccagcuccgagguuaagaucugugugcagggugcuaacggcagaaucacugaagucaguggaaccauugcaacccgagacacaucauucaaucaagugagaucugagaagucuaaucagccuccagacaccagguaagcuauugcacacaaccgacaggaauggacaugcagcaacaacugcauauguaaaaauguuaccugcauauguaacccagugaugagaggagcucacugcuaaggcuccagcccagggguaagucauagauuuaaaugcugaagaggguucacauacuuuagaccuaauuucacaggaauugaugagaaagucugaugcaggagauagaggacacuacaucacuuguauucauucccacaagaacgcuaacaaacuuucugagccccaaacgggaccgugguuaacuuaauauauaagcacacacuggaauagcauacaaccauuaaagaaaauaaaguuguaugguuuggagguaccgugccccccccccccagagguucacauaugaagacuuauuccguaaugcagcaguggucauauguaaagcuuugggggauaaaauuaggucacaaagauucugacuuccuggaugggcaagucuacugacugagaagaaucgggugguacagcugcagggugcuggaaauuagagagggacgccuaguugaguaauauaggccacuagggcaugagguguccuagaggauacacagaagccccaaucagucccccaccaacucccuucuuccucccucccucccuccccaacacccucucuuucucucccucuuucuggcuuccuuccuccccagucuaaaagcaaaggggugggccagcucuaggcugacaccugagccaaaacuaaaauuccuuucucccuucucuuuguaccuagcgagcaaagcccuagcccaaaggcuacuuagacuucaccucaccgaaagaugacgcaguguauuagaugagccaaacaaaaugcggaucagcauauguguacucuugcauacauucgaaaccuuuuuucuagaggggcacacaagaaauaguuaaagaugugcaccuuucaggguccagggaagacguuuacuuuguaccuucucuuuccacaggaaaacaagacucaucuagguguucccaucucgcuccccugugacucucugaggacccuuugaagucuguguccauguauaaaacccgucaaaaggaaaacaaccaaauggcuacagaaacagguaagcaaugucacgugagcagacacaucccaacuguacccacgggcauuucauuucucuuaaugaaagaguuaaauaaguaaacagucuccuaauaaagagagugacacuggcggugaacgguaaacaaacgcauggguaauaaccgucccacucacccuccccuucacacaguaaacagcgugaagaugacucagaaagcaaagauguuauuccaagagcagcgaacuauacaugcagcguugaaaccucugugcacucagcccgggguacguuuggauuugacagauaggaaacaaagcagcagagcgcuuacccacuccuccaggaugcgggacacggccucgcuggcucugcucagguuccuacaggccaggaucacaugcgcgccauggagggcaaaggacuuggcagucucgaacccuguggugagaagaaaaaguccacauuagaaacaacgcugguggcaaugugugggucacgaagggacaugucaguggacaguagacagcacugacgagacugagcggugcucaaccagagguggcucugugccccaggggacugggacaggucaggagauauuuucagagggcgagacugugcauuggaguguuaguggcuuuagugacaagauagagaaacuaucuuacuuuagaugcacagcagagcccugcugacagagaaggccaacggcaagaugugagaaagccgucccaaccgagacagcuauuucaaagaugaagaaggcccaguccaagagaguucaggccaccgccagaugcuucacuaccaaccaugacuagacccuugguuuaaugaggcccccauauucuacucugugauggguguuuccagaacuuacaaauccagcaauuguagcagucuauccuaggcccuccuucuuaucuuccuggugagaacagcuagaaaauaaucugagcauauauauauacacacacagacauacacacacacacacauacaugcacacacauacacacacacacacacacacacacauacacacacacacacagagcuagaaaauaaucugagcauauauauauacacacggacauacauacacacacacauacacacacacacauacauacacacacauacacacacacacacauacacacacacacacacagagcuagaaaauaaucugagcauauauauauacacacggacauacacacacacacacauacacacacauacacacacacacauacacacacacacauacacacacacacauacauacacacacauacacacacacacacaugcacacacacauacacacacacacacacaugcacacacacacacacacagacauacacacacacacacagagcuagaaaauaaucugagcauauauauaaauacacacacggacauacacacacacacacacacacauacacacacacacauacacacacacacagagcuagaaaauaaucugagcauacauauauauauauauauauauauauauauauguauauauauauauauacauauauauauauauauauauauauauacacacggacauacacacacacacauacacacacauacacagagcuagaaaauaaucugagcauauauauacauauacacacacacacacuccuuugugcgugugugugugaaggcauaugccuacaugggaacaccggccuaugcaugcaaacacauacagauauacacacacauguccuucucugaaaauaucauagaaguaugcuacaaucucuggaggccaagguuugggaaggcggggcagcacauaacaggacuauguuagggugucacucagucccuuuccaguucuagagcaguggacaagagacagaagacuggcagagaaggauguaaauguaucaaaaggaaggguccugguggauaugccagggcuacugucucacgggagagccagagucagggcagccuuucaggaagcucagccucgggcauuuggguuccugaauggaugaaaguagccugucccuaucaaacuacaaagcuccuugaggaaggagccugccaucggaaccuuaguuaccccuccaaccaucucauauucucauguaaaaucuuaggaaugggagccugaaacugugagacaagcaagagaaccagaugucacgaaaggccagaagagagaagaaccguucucgaugcuaucagaaaucguggcugaaagcaguaauggcuacgaucuccaggaaaggggagcaagagagagagagagagguggacagcccuagcugcucucccaaaggacggagaaguuccgcucccagcacccaccucaggaggcucagagacucaugucacuccagacccaggggauucaaugucgucuucuagcccuuaugugcgacggcacucaugugcacacacccacacucucacacuaauaaacauagugcaaaaguacauaaacagggauuaagagcacugguugcccuuacagggacccagguucagugcccuucacccacacggcagcucacaacuaccugugacuucaguugcaagagacccagugccuucuauugagcuccaggggcacuaggcacacacauggugcauauauauauauaugcacauacauacauacauacauacauacauacauaugcaagauacucauauucaugaaauaaaaauaaaaacaucuuuaaaauauaaagucuuuguaaauugcaauggugguuucguggagaguccucuccaaaccauccgaacacacacagaggcauguguagcuccuguauaguauuuuccuagauuuuaaaauguuaaaauuagauaaaaauauuaaaaggacuccauacauacccacaaacccuaaaaagauuuugugaaauguuugacuauuuuaagaugauaaauucaugagguuuaaaaggcaacuccagccgggcguggugguguacgccuuuaaucccggcacuugggaggcagaggcagacgaauuucugaguucgaggccagccuggucuacagagugaguuccaggacagccagggcuacacagagaaacccugucucaagaaaaaaaaaaaaaaaaaaaaaaaacuccuagggaaacacuucugaaaaaaaaagucacaaggauaaacuggaaaauugaaagauucuacacauguaaagagucuacauauguaaagauauugaguccacaugucaaaaucaucuaaaaagaaaaaaccauggagacggagaagcacggggugagagagaggaagaauaaaucuuguccuggaguugaaaacccagccacugcucugaauggcaaaaugauauguauuuuauagauacauuuuauauuaaugcaaauguguuuguguauguucauuugugcauggacaugguucauguguaugguacauggaggccaucagaucccacaaaucuggaguuagcugugguuuugcaccacccaacaaggguucuuaggggcugacccauaguccucuggaaagcaggaaacccucugcacccaagccaucccuccaggccccauaccucacuuucuaaaguuacaggaaauccaagcgaaugcacaguuccuuuuuaaaaaauuguuuuauuacuguuccauggauguguuuauaugugcgugcaugcaugcauguguguggacaucagagaauguuuuaaucuuuuuauuauugguguauggauguguguggagaugcgaugcacacauguauguauaugggcaucagaggacgaauuucagaagucggcucuuuccuuccacugugggcuacagggacugagcuucagcucugaggaugaacucugguuuuucagaacaaguaccuccacccacugaaccaugucccagccuccaaaaugccacauuuuagaagcuaagguggauagaacacuguugucugcaggaaagcagcaccaacgggccaauaacaccuucaucugcuaccugggaccugaugugcccauaagaucuuugagaagauggcaaaaccuggaucccuccuaaauuuucaugucaacucaaugaccagaaauaugugagugugugcuuuaagacaguuucucuguguaacccuggcuguccuagaacucucucuauagacuaggcuggccucaaacuccaccugccucugccuccugagugccgaggacuaaagguauguaccaccaccacagaaauauuuuaaucguguaaaugauauuaaaauauaaaucaguuauggcaagcacaguccccaggcauucuuugggaaccauuuugcuuugagacaaguucuugcuauauauccuaggauggcuugaaacucacuauguagcccaggcugcccucaaacuccaguucuucugacucuacuucccaagcguugggauuuaggaugugugguacccuaaagcaaauguauuauuucuggguggaaaggaaggcacagugaugcaaagccgggcagaugcugaggcuguauucagcucuccagauuaucaguaaacaguugucuccaugccuggucaucucugcaucccagacgcagucacuaaggaauggguaguucgugcagccugcuaaugggccgccaugcuguggagcucucgaauaauccaccuucucuuagacugcaacccuaauaauccuguaacuugcuuuuuaauaaauaaagacaaaauauuaaauuacugucagaauacugcucacuacguuuggaaugacagugccuggaaaucugcagggaaacaggaaacagaaccuucucugucaccuuugauuuuccuagguugcacuaucucacuugacaaagugaccuacugcacaggagccuguauuauugaaagcugugcaucuggccugaugucagcaacaggcugcaagggcgugaguauaccuucucucccucagauaaguccuggcuagagcuauggcuaagccaucugucucugugacuuguaaaguuauucucugaaccucacgccucccuuuaucuaaacagagcuacacacgcggcuagccgacuugucaaagcuacggcgacaaguccauuuucuaauccuuuacaacugccuuuggagcgaaaacaaagcggggggauauuucaaaagaugaugguuuaacagcaaggacaauaacacguuuauagcaaaccacaucuccagaguauggaguuuuauaaauuaaaaaaaaaaaaguuuaauaacauuaccuacugcuaaguccugaauaaagcccaugaggacagcaucccucaagcucggaacaccgcggcugauggccagcuuaauuaccgaaauguacuagugcuaagccaauccugcgugaggccaaaguugguacaaaauaaugaaggcaaugguuuacuaaauuuaauaaccugauucaucuuauaaaaaauuaacuucaugacaauguuuaaauugcagcagcuuaaccaugaggagauagccagugggugcgggagaauauuuaacgcuaauaaaaugaagagaauaaauaacagaaggcauuuuuaaacaacgggcagcagcaagguucccuagcgucugcaauaggagauccggucagaagagcuaaguggcccugggggauuuaacaccucguggauucagguugucaguuuuaaauacaaagagcuaagauagaaaauguaaacccccaaaacuaagugcccccuuaccuuacauuaguuuccauucuuggggauagaaauuacaaugacuaauuagagaacaaaccaaauacacaaacacuucuauuugccucauugucuucguccaucuuucccauccucuagguccuccuuucccccacccccaccccacuaucaccccccaccccgcuaucuccagcuucuuuucucagagccucccacauaauaccuuuucucccuaauugaauuagcugcaucucaggucagcuacacagaaccgccaugcuguuggcauuucccaggaaccacgugcuuauccagaucuguuguuguugcuguuguuguucuuguuuguuguuuguuguuguuguugagccaaguucuuguugcaaaggcuggacucuaacucaugauccuccugccucaggcucuuaagagcuaggaauacaggaggcaugcaccggauaccuagucaccugugauggcuauuauugauugucaacuugacgggauguagaaugcgucagaaugugucacuguguggcagcaggaaccaugggccaagaacuacauugggauugaaggagauaagaaagaaacaggugcacaaaaagguaccgggaaugacaaaagaugagggacagccucacaggagaaaagaugagggacagccucacaggagaaauguagugacagggauggagacugagccaugcacaccaauggacaagaggguguugaggaagaauucuggacagagcgaaacacugugaguuacuguuguggcuguuguuguuguuguuguuuauucaauuaaaguccuuccaguggccuugaagaugaaggagucauacagacauagaagcucuuugaucagucaggcggggacaaagaacucucuggugcugacuggcuaaauaugugacuuagaaaaacacuuggagaaauccacaaagcacggugacuugucuaaauccgggcuagagugggcauccgggagguuaugaugguuccccggcagcacgggugagcauagacacuuguuugcauggacagaaaacacacaggucugugcucagagcaggaggccacacagaagagcacagagcugcccacagauuccacaggcacaaaagacuccauggugggaaggcagaaccauaaacccugacaaggugccacagacacaggcuccgagaacaaggcagagucuuccacagugccggggacauucuuucugguuggagauuuuuaauuucuuccauauuguggaugugcuugggccguguccccguuuacuguaaauuaugguuuuaauuaucauuuuuauuaagaugcccaaaggaguugggacuuacgacacugguaauuucuaaugggcuguuauuauuaauuuauaauugugaaacacuggagacaaacacuacuugcaacuguaugccaauaaaaggacccagaaauggugguccacuacccaagguacacccccacacaccaaaaauggaccacuagugcagucuuuaggaaccaagcaacaagucagagaaucugcccccauuggccuucaucaugugccugugcauuucaggugacguuauauuuggggacgauccagaguuggggagcugucguuugguuuucacgugagugagugagugagugagugagugagugagugagugugcaugaacacaguacagcauguguugcucccaggaaagcuucaggucuguuugugggcagggucucuacugaucacugcaugcaucaggcuagcugcuagcugaucuaagagcuugcaggggcccccugucuucugccucucaucuuaccguggcaauacuggaugcucaguagcacccaccuuuauguagguucuuggaaugcaaacucagguuaucacccuuucaugcagaguacuuucauucaaugaaccgucucucugugaauagaccacuagugugggccagcagugcugcucaucagcagacugcuugcaugugugaggcccugaguucaagcuccaacacuauaaaauuaaacagguaaacaagcaagcaaacaacaaaaccuggucguuuuaaggcugugaguuuuccuuacacccucuuaaaucuacaaggaccacacuuuccaaacagagcugacuaauguaaaugggauuuaaaagucaugacagugacugagacacugaaacccaacucuccugaggcacugcagaggaaccucugagauacacagucaucccagugaugaggacaaagccaagaggcagugguaaccugcuuugcugauucuguaguuauucuaauucccugcauaaccccuugcaugaucuugcuuaccauccacacuguuucaaucacauaccaucacauaccuccgaguugcagagacccacgucacccucaccagacagaauccacaauugccagcucuuaagaaauuacaaaacaugcgaucucuccagagaaaguuagucaagaccagccuugcuuuggaaaugaugcaucaaauacagccaaugaaaaguaccuuacaaaguucucagcacccuucacaccuuaacauaccgaaaagaaagauauuaauucaagagacgaaaacucggaggugggaaauggguugguucccugggaaucuucaccaucccugagcuaaaucucuaugauuugggcaacacagcaccagaaugguuuugcagugcuagauaauaaauugcaagcgacugugugaguaucucucaagaggcgaaacugaccucaggcuggcuacgagugcugccacuggaccgggugaggacguucucaucugaccugcuagugacaguccugguuagaaaucacagcgagaagagugcccagagaucacaauuagcacaguucucgacaggcccaaugaagacgcaugcuguaauugcaaguauguugagcagcgccuggguugucaggguguggggaaccagacaaccucacauaugaagggaaagggggacauaaacugacucaaaaccucugagggcaacuggacauaucaaguguuaagugggcaugcucuguggcccagguauuccaccauuggacauuuagccuacaaacacacuuguacacacgcaaaauacugugggaggaacauuugacgccacauugucccucaguuaggcugaaucagccacauggcauguagagauuaaacuacacugugcugcgcuuaagcccagaggggcuggagaggugguucaguggguaagaacacucggugugcaggcaugagaaccuggguucggguuccagcaaaaagcccggugaacaugucucuguccuuuaacuccaguacuguuagaggcagaaauggggguggcuuaccgacaaacagcuuagcuucaucuucagguuuagagagagagcccugccucacggggugugggagagugcuggagagauagauacucaacacccuccucaggccuuuaugcgugcacacgggcaaacacuccaacacacacaauacaacguggaucuauaccagcgaguacugaagaauacuaccuguuggcuuguccugugccuuccucagcuuccuuucucaucgagcccagccccaccugccuagagaugguacccacaguggguugggccgucacugucaaucauuaaucaagggaguacucuuucaccgaccguggccacaggcuaaucuguucaaggccauucuuucagcugagcuucucucuucccaggagacccuagauugugcugagcuggcauuaaaaccuaaccaggacagcaaggguugcagcuugguagugaaacacuaguauucccuagcaugcauaaauuccuaccuucaauccccaacaccggugggcggggggaaugaaguuaggcuaggcuggguauauagcugagugguagaacgcuugccuaaaauacacaaggcuuugaguucaaaacgcagcuaucacgcacacaaagcuaaagcacggaauggccuacaaaacagaacauaaacaaggacggcgcauguguaaacagcgcugacagcgauuauucugagagacagcaauuguuugggagcaaggaagauuuacuguacaugcuacgacgcaugccauuucaauuuuuaacacauguauguaugccuguuauaguaagaaacuaaaaauaaccaacagaaugacaucuaauugauaauuuaugggucucuaugaauuuuaauacagagcaaucgagguggagaagaacgggaggaaccaauuccaacuccaaggaugguuuuagcuguguggcguguagacuauggaaacacccagauaaggaggagggccugggagaguuccuagcugcagggcaucacgaugggugcuuuauacaaugcagggauucuaagaagcucuucaaggaaaccuagaaauggugucaccauuucauacaaaaacaagcagugaacggaaugagacguaacccuaucugugcauaucacaagcuguggccaccacuauaugcaugggugcuuugggcacuuggacaaccuaacagcagcugcccgucaugaggaaggguggucuccacagcucaugccucaaugccaguaauguuuucaagccucucccgcuucugugucaccagagcggaaggcaagaacuguggccucuuccgcuacccgguuacaccaacacgccugcuucguggagucuaucccccagcucugccacggucucuaacaucucaucaccgagcacagaguuaacaccacuucacuacugacuucauagauaggucucugugugagacuuaugaggggcgaaagaaaggucacagaaaauaaagucccccugcaccuucuuccaagaaugguaacggcuuugcagaaugaaugcggucccucuccugcuuccaacagccaaugggcaaucucaccaccgaggucacagggugagcucacguuuuuucccccuuuaauucccuaaggcuuguggaucugaacuuuaaagggguguccugacugaaugggauucguguagccacugcucaccuccugcucuacaaacguaacaggaacuccgcaguggcuuguugucugugccucuuuaagcaaaguacauguggcacaauaauaaacacgcuccagagcccuaggacaauuaauuaaacacaggacaaaaauuaaagagaacaagggucuccugaugaaaaauguuuuaaaaacccgccuuuuagaugcugagaacaccguaccucggcaagacacacacacgggcauuuaguucacgggcauugaaaaaaguggggauacuauggagccagggucucacacacaguacucaggaguuuauuauguucuuucagcucaagauucuauuucaacauccacacacaugcacgugugcacacacacacacacucacacgcacacacucgugugcaugcacacauuugcauuucuagacccugggcacagugcuucugguuugcagaaguggaaggcuuugccccgaagccuggccuauuguacuuugaagaagucacuuccauaggcuucaagagcagaggcaagcccggcagagucugcacuugggcugggcugaacugaacccgcggugucugugcagggacaggacugugcggaaggggacagccuuucccagcccucccuccgcccgcccaucuucuggcucuugcaccuccccuucugccgugggggaagggaguugaucccaaggucucacugaggacuuccuucaugaccacucccaacauaccuuccuaugccuguccaugaggaaguggggaagacucacugagcaggaggaggagaaagaggaauggaagagaggggguaaaaagaguaaaacaauggggagggggggugcuucaagcacucucccaaccgagccaucucccuggccacucccagcacaccucccugauggaacacaccuggugaguggcgugccugugucccaacagagcgcacacccguugaagaaaauuacccauuaccuuuuaagcucccuaagagccgcucuuauaaaaaccaggcugacuugggggggggggggaggagaaaaggaggguugaguucgauaacgucuuguuuuaggaaaccaucaccagauauuaaugaaagacaucagcuugaaagccuuuagcuccucaggagccuugcgagcuaaccgagcuaaccgagcuaaccgaguuaaccgagcuaaccgagcuaaccgagcuaaccgagcuaaccgagcuaacugagcuaaccgagcuaaccgagcuaaccgcuagcugcaaugaggcaccugccugccaugaaccucagggaugcacacggcaccuucuagcugaggcugauuuugcugguuccugaagcuuggccagcuguacccuuucgcuuggcuccccuuaucuggcugccgcugguccaagaagucuggguagaaguuuccaacaucaguaacgggaaugaugggagauuaggcucaacuuccauuuggaaaggagaacgcgugugcucugagcugguggaggcuuuagagcccugagagaagauuucaguuugcagggagcuugguucccagccaggagguaugauggcuccgaacagccggaacagaggcaaacgggaggucauuccagaaaaguccgggggagauuuuccaucauagauuaaacagcuugagggaagcaugcucaaccagcacucuuucuuauuuaguucaaacaugcuaucguauuuagacugcccugcaagcacacagcauuuuagugucucuauuacagucaaguacacuugauuuucuuuggcacguuaaaauagacauggaaugggaaauguaauaaacgcauaaacaaaucuuuucuuuuuaacuuugagucaggguuuuauguagcccaggagacccuucacucccgagccuccugucucagccucccaaacgcuaggauuacaucaggcaccaccagaccauacucugaaagcaacggcuuucucaagcuggagaacacgucaagagucuuacuccauggucaguuuugccacuacuguaacgacagagguccugguccaucauggcaaacaacaagcaaaagagggguggggaagcaaaauauaaauagggacaaggcaagauaaaguccugggggccugcgcacagugagcugcuuccucuagcagugccccaccuccugugguucaccuuauccacaaaccaccauagcaggacuccaucacuaaagccacuuaugaaaccagaagccccgagaucugugugagcaaacaaacucucagauacacacaaaagucuguucuucucaucucuggcacccagaaccacaaggugguacauuuccacccagcuuacugaccacuguccacccagcuuacagaccucugguacagagguacagagcgcaaguaagcugaaauauucugcuucugugagccccuguuuccuugucugcaaaaugggaauguuaagaaacaacacccuuaacaggguuauuggaaaagucaaauggggaucgucaacagacccuuuuuccaacagcggggucagagugucagguuccccacuaauacaacagucacaaaacgcucucucuguaaguuaugccucaaauccuucugugaagguuuuaaaaucugcacaagagucuacacaaaagacaugaaucuuguuuguguucuggcugugccccucagccauuagucgugcauaccccguugacuuucaagaaguauuuaaagcacuauggaacagcugaagguggugguauagcaaaccuuuaauuccagcauuugggaggcaaaaguaggagaaucgggaguuuaaggucaccccagccuagggaguuucacaccagccugagcuacaggagacccugucucaaacaagcaaacagaagcagaaggaaccuccauaaguccaaggccagugacuugcaggucugccagagcuacagagagacucuaucucgaaauaaaaaauaaacacacuggguaacaaacacccacauacaagaaaauuaaaaauugcugggcaggcauucggugaucgccuaggguugggguucggguugggggcagggggaagaagaaggagauuuuuauagcgacacaaaucuacucugucuugaugagggaguggcuauggcugugugcacaugucaggcaagucacaagugugcacaccuaaugcacagggucuaauggaguaaguuagugcaagguugcuauguaagagugcagggaguagauuuucuuagaagggaaaguguguggcuuugucaagaaaaggaugcucauccaucgggaagcugaauugagcuggucauccccuugagcacuugcaugggaguucuguaccuccuggcaaagcaaugcaaugaaaggauacaggcugcugcaugguguccaucuuauucaauggaaacgggcauagcagcucuuuagaugagaagugcuuucuuuaaaaaaaaaaaucuacaaguuacaguaguagcaguaguaguaguagaaugguagccugcauguuggucugugcaucauggaugugugugguauccaagguggucagagagggccugagaucaccuggaacuggagugacagacaguucugagccaccauaugggugcucagaaucaaacccaaggcuucuggaagggcagucaguacuaaaccaccucuccagccccaagaugcacuuucuuguguuguguuguguuguguuguuuuucaagacaguguuucucuguguagcccugacuguuguggaacucauucuguaaaacaagauggcuuugaacucagagauuggccugccucugccucccgagugcugcgauuaaaggcauacacuaccacucaacuccaugaugggcuuuguuaaugcugaaaguuuaccagaagagcaucuuaucagaaagucuugcucuguagcuggccucgaacucacaguaccccucuugccucagugcccccaaugcugggauuauaggccugcaccaccaagauggcgcgugccuucuguaaaacaugucuagggcuuauuggccagcucugauggugaacugugauagcaacuguggaugauacacaaaugagcagguaucccgaugucugguaauacuuuaauacuuuauuacacuagaccuuacaaggcuagggugggucacaugcccguugguuaagcuaugaaaaaacaaugcacuuuuauaccugaagcaaaauaagaacaaaggucuggaugcagguaaccuugacuuacagaauuucucugauuaaaaggaaaaaaaaauuaauuucaacaacccagauucagggcuuaggaggacaguaaucguagaaaguuugauuuuggacaauuuacaaauuucugugcaaaacacauuaucugaggagaaucucgcuuaaacaaguagaaaacgagaaacaugaguacccuacucgcaucaaaaucuuacugugcugccuccccugacucuuccugcaccuugucgccaaucuugaguguuaaacuacauccugccuccccaucucugugcagucaacaaacauguugacuuuggguccuggaauucuggagaaagccaauuuaaaugaauuaaaaugacuuauguguugauucugcuuccaguccaauagaauguugacaugaggacccuugucacacacguggcccuauguguuuugguucaaauauaacaccaaacauugaagaaggccacuuagugaaucacuaagcuaagaauaguccuuccucauggcagggaucuccagcuugcucaaaugaguggaaacuggaacaaguguuggugagaucagccuacaggagaaaucggggugguggggccucugacuuccucaacaguguuggcuccgguggaaaaacgggaagcucccaacuguaagcgacguggcaggaucuguuucaagucacaggaaguccgacacaccacagcugaggaacauggcgcccaucuggccugagacuuauccgaaccccacgagaucccaccaaaacaucacaguguggaagccaugcugugagucugugugcggcucccaaggcggagcuccugugacuggcucucugccaacaggacaaugcuuugaugaauguucaugcugaauuucuuuuccauuggcugaggagguccagugguccuaacacgcccaggcaugacuuuguuuucuauguacuaacuuuaguuuuucaccauguaauaugugaguuaauuacuguguccacaaaggcagucccaauuucucuuuuaaacgcuguuaaacgugcuauggagccugaacuugauucuggaaguguuucucaccuaccuuccaugaagaagacguuaaggccuuggacguguuccucauucuaagagccaguccuuccaauuccuuuaaauuaauugcacauauugacuaucagaggggcuacuuuacgaauuaccuacagugugaauaucaaauuuguuaagagauuauaaaauaaggaaaucaauaauuagaggucuccucuuucaaaacgaaaagaaauuuaaauuuuuauaaggaagaauuuagaaauucagggucuagaaauggaaacuacauagaauauauguauuuugccccuagguuuuagauucaaccgugacaagcugucagugacugaauuuuuuuuuuuauuauuaccugacaguuauuuaggaaauuuccauuguuuggcaaaguguaauuuggaaaucagugauacguuauuaauuacauaccaauaaauuucuauccaaagcguaugcauuuaaagggaguuaaaaacauucacgggccauguuuucuuccuucuccucuuugaugacuuuuuauggaguagaagggggugggagcagacguguacauugaacugucagugccgauugcaagcccuggaaagccucgggaucguuucauucagaguccaggagccgguccuuccucuacccgaagacgcuacacaaaaccugucgucuacggaugcaucucuccccuaggagaggggacagagcuauaaucucaaaggagcacaggaugcaaaaauagaaaagagaaaagaaaagaaagaaaaggaaaggagagaacagaacagaacagaacagaacagaaaagaaaagaaaagaaaagaaaagaaaagaaaagaaaagaaaagaagagaaaagaaaagaaaaagaaaaauuacaaagguaacaaccaauggccugggaugauuuugaagccgaaaccuacaaauacacucuguuccccuaaaagaaaauggaagccaagcgcagggcguccaggugugcagguccauccagcccagcucugaaaucacccaaggcugaagcacucaccccaagcugagcacuuuagcacagagagcacguccccgcuuaguuccuaaugggggauagaaaccagaccaggagcaaauccuucugacacuuacgcuccacaagaaggccagcccuacaaggcaggagcauuuggcaccacugaugaguccuugugguccuuagacaggguuuguacauaauagauacucgguaaguugguuuguucuugcugcugcuacuacuguuuuacuguuaugggugguggugguggcagcggcguuguuuuaguuuuuugagagaggauaucauacagcucauucuagccugggaugaccuugaacuccugaucuguucucugccuucagacugcugggacuacagacaugagccacugcagccaggauauuaguacacaucacaaggccucacuggacagcuguauuuaccugaacagcacccauaguagagaacaucuucuguuuacaggacaguuguuacucucuaaacuguaucccuccccagaacacaacacacaaaaggggcugaacggaggccucuacgccaagcacuuuacaggagguaauguggacagagucaagguauggugagauguuagggaccagugagauagcgcagcagguaaggaugcuugcuaacaaaccugacaagaaguucaguccccagaauccacaugguggaaggagagaaccaaagccugaauguuguucccugacuuccacacaugcauuggggcgcgcacgugcacacacacacacacacacacacacacacacagagagagagagagagagagagagagagagagagagagagagagagagagagaaguauacaguauacaugcgcacacacucacgaggaauaaauaaacguaaauuuuacugagaccauaaggaaagcaaaaagaacugaugugcuuuggagaaaugaggggaauuggagaccgacaccgagggaagauaacgggaagggauguggagggaugcuugugcugacagagcagaggcuggaacugggaccacagccgagggaccacagccgagggaccacagccgagggaccacagccgagggaccacagccgagggaccacagccgagggaccacagccgagggaccacagccgagggaccacagccgagggaccacagccgagggaccacagccgagggaccacagccgagggaccacagccgagggaccacagccgagggaccauagcugagggaccucuuacagggaugcccagccuuuggcuucucugagccaugccaucaucuacaaguucacguuuaagaacuuuaaaaucuagcuacacacacacacacacacacacacacacacacacacacacacacacgucucaguauauauuaaauuuacaacuguguguuggucugcguaaacugcuaucccaggcgaccuguguccuucaagauguacaugucgucacgucuagaaucucucagggagaauccugugcuccaggugucaguuggacccuggcccuuccccaacccuugguuucagauuuccacccugauaaaacacaguguccuaagccaccacuuccuggcacuugauagagcuguccuugcaaacaauguguacgggcccaagaccgacagucaacuggacugguuugcagcccucacgcccuuuagccugaaggacaccugggaugaugauguccuuucacgucucccagagcaggaggggacugaagagccacggcaaugggugagcaguagcaggugucucacccuugccccacuacagaugcuccacugacuacaaccaccaccagcuggcuccagacagcaauaugugcccucccacccccaacuuccaauucuggaaauucccugacacuggagcaucggaggccuacagaacacugcuuggugcgccaacacacgauggggccaccguggccuaaaagggaugaaggccuauggacaaaugucucuccuucucugacagacagcucuccaaugcguuccacagcuuccucagaaagcccuugccagaggcgcagcagcggcugcagcacuggcccagcccagaacccgcgcgcuugugcuugcccgucuuucccucaucuccuugcugaauucucacagccucuguggaguucucugaaaucacaucuuaaacgauuugaagucugccuuuggcucggguucucccuuugagggaacaaaagcuaagagauaaaagacaaguucuuaaaucauucccauaaaaaaaaauaacaguuuucauacaacuugagauuuuuaaaaaggccuacccacauacacacagcagcuucugaucacuuaaguacugcgucuuguagaauuauguccgucacucccacgucuauccuuagagcagugguucucaaccuuccuaaugcaggcuagcagauaugcgaccccugugaaagggggucauuuggcccccuagggggucgugacccacacuuugagaaccacugccuuagaguaucuuaaguuuaucucugucccuaguagcuaucagaauuaauguauauaaaucucuccuaccaacccacuagucacucacucucccuuuaauggugugcucagaacagaaacuucagcaagcuuucagcuuauccgugcuucauccagaaaggaacagacuagucuagaucagugguucuugacuuguaaguugcgacccuaagaccaucgggaaaacaaauauuuacaauucauaacaauugcaaaacuccaguuaugaaguaccaaugaaaauaacuucaugguuggggucacuacagcaugaggaacuguauuaaagagucacagcaacaggaagguugagaacuacuucucuagaugucuacuuccauggucacaugugugcagaugccugcagaguccacaagagggcgucagaucccccugaaguuagaguuaccagcaguggugcgcagcaggaugugggcgcuaggaaccaaaccggguccucugcaagagcggcgagcgcucuuacccacggagccaccucucuaggcccugcuuacguuuauuuucaacaaacccugaucguuucaaccaacuagggauacaaaugauuugucuacgucaugggccgcauugcugaggaugucaagagcugugaaaggcagcugcgcgguggaagcauccuggagcaucuguaguuagagcugccaaaugcugauugagcccuccaagcuggcucucuccauuugcuccccuuucacaucaguggagaggcgcuuuaaacacuucacucuggcucucccgcagggcagcgcgcaggcugcuagcaagcgugauuacugucuaccagcaguucggugauugcuacugucgucaggcagcugcccgcuggcuucucgggggugggcugcccccaguguguuccauugucauucucggggugaggggaauaaauaagcauuugaaagacucccacucaggagguuauggcuccucaaaacauacuuacuucucagaaaugacuaaucacuccaguauucuccgcuauucucccaugccaaaucauggauaccagugcugacgaugagccugcacuuggccuccacccaagggcaagugccacacucggccugugcaucuuucguccgguggucuacacauccguauuuggaguccacugcucacugaguucuaaggacucuuuuuaaaaagaugcugcguguuuccaauaucuguuggcaagaaaccuggccugguucuuaaaagggaaagcagauuuaauaaaauuaagaggaaauauuucacugaagacagaauaauuaaaaggcacacuguaccguccguaaagcuaggcuggcucccaugggaguaugggagggaccggugccggccugugugauuguuuucaugucuucuccugucugacuaaccacugacagugacagagcacucagauggccaucgccaaccugccaggcagcgcucgcucaccguaugaaagcuaguccuuucaagugcauucucuuucucuugaccuaagcucccaucccucaacaggaccguauucaccuguuucuucuuuuuccucuugugaagucccaugaucacacacuacagaaaacacuuaguucuaaaagacagaugugccggguucaagaccugcuuggacuagagugaguucaaggccacucugagcaaccgagcaagacccugccaccagacauuuucauuuucgacuggugagacagcucaguugcacagugcaugcccaguacuccugagauaaaggguucaauccucuauacgggagaccaccacaacaagaaacguguggcuguuguuacaauacagcauacacagcugaagcuuugccagacgcccuucaauauccacuggcaauucugugcaguccagaaaaccaugucaauguuuaugaaacugucaggguggccaugacagauauacggcuaucccucgggaggucagcuuguagaucacaaacucaccgaguguucuuucccugugucaguuaagggugcauccuaaggaaagaagauaauucucuucauguuggcauguauuugaaauugucugcugaaaagaaaagaaaaggaaaggaaaggaaaggaaaggaaaggaaaggaaaggaaaggaaaggaaaggaaaggaaaggaaaggaaagaaaauuuuaaaugcuuguucuagaaauaaggccuuaagcuccugauggugguggugguugugguugugguugugguggcaguggucaguugcugcacacgccuuuaaucccagcauucgggaggcagaagcagacagaucucugaguucaagguuagccuggucuacagagugaguuccaagacagccagggauacacagagaaacccugucuccagaaacaaaagcaaaaccuaaaagaaaagaaaucagaccuuaaacacagaaacucucagugagcagucuguuacagacugcuagguagaugcugcacugaguggcuuuguuucugugguuuuauuuuuuucucucucuagccucuuacaacuccaacuggcuggugucuugggccccacuucucagaaaaagaagcuaaggcuugggauaaaaaacauaguccaaaauccuagaguuaacaaacuggaaaacagggcuggagagaugucucagagguuaagagcaccaacugcucuuccacagguccugaguucaaaucccagcaaccacaugguggcucacaaccaucuguaaugggaucugaugcccucuucuggugugucugaagacaacuacaguguacucauauacacaaaauaaauaaaaucuuaaaacaaaacgaaacagaacuggaaaauacugaaggaaaaagaagaggaaaagguaaaaauucuaauuaucuaaguggcaacauuuaagccaaaagcaaacuagaagucugcauuuauucuacuuucccaagccuuguuuuguuguuuucuuaaagguuuagugugugugugugugugugugugugugugugugugugugugugugugugugugugccugaguguauuaugugaaucaugcacacacaggcaucagguccccaagaacuagaguuccagguguugccagcuaacauguggugcugggaagcaacccagguccucuucgagagcagcaaaugcucucucuagucacugagaccucucucuagcccacacuucaucauguuaacuggaguuucuaauaguuagaguggaaggaaaaccguccccauuucagauguguuuuccugggugaaacuucuccauuuguauccugaucccucuugugggccgagcacuccccgccauggcagacaaugcaccuuaagggaguuggcauccugagagaaucagacacuggaagccuugccucgcuuuucacaaacagcacgcgcuaggcucuacugccaugucuugugcgggcagcagagaugggcucugccaaccagagggcacuggcccaguucggugcuaacugagaaccuuguuuacuucuacuguucaguagcgacuuccugacagcccgucaguauaagucaaccgcaacgguggucccagagaugcuucguuccccagucugaucuaucgcuggccuuauuucucccuuugcucauaacucaggaaggaaaauguauucuauaugcugggucucucuaacucuaacgccuccuuaagaguuuacagacccaccucugcugagguuuugcugguaagagugaaaaucugugucaucacuggguuauaauucaaaucaguccagaacuacaacaugcugauguggcacuguuagacccaaacggguucacgagccgcaucacaaugguuggguggacaaggucacacuccauguaaccuagaacugggaugcaccugccguaaauuaggaucuacgcaagggaauauauuucugugugugugugugugugugugugauuucuuguuuugcuuuaacacuguaauuuuuuaagaaucaggggcauaucaugaaaccccaugcucugugaaagauuccauuaucagagccgccgcuacugaaccuuuuacccagauguaaugucuuacauguuacaacaaguuuggcacgcauugugaaucucagccaagguugauaaaguucaauaacucggcuaaccaaccgugugugcggcucauuacaggaguaauaaauagauucaucacaaaggacaagaagaagcccuaggaaagccgggugccauugccagcacaccucagagaagcaccuuuugggccuuaaugcaauguuauauguggccacuauaccuacccaucauucaacacaccauauacauauaugugugugcauauuuaauaaucagccagacacacuuucaagcuaaaugcgcucuagucaccaucgcagaucuucuacuguagagaucuaaagcuacauuaaucuacccauguucaagguucacuccucaacaagccagaccaagcagaaagauaaccugacagacauaucuacagacauuguuuuaauuuaucuuuuguugggccagguguggugaaauguuuguuuguuuguuuuaaauaaaaucuuuauugauaaauaauucacauagcacauaauuugcccgugauauauauucaaugguuuucaguguggcauguaaagaugucaucacuuucacuauuauaacaauuuguggcgauuucauauauaaagugggagggggaacugauuuagauaaagucauggguggaagaaagaaaucugaguucgauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuauaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguauccaaggagcuaaagggaucuucaacccucuagguggaacaacauuaugaacuaaccaguaccccugagcucuugacucuagcugcauauauaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaaaagaaaucugaguucguagagcaaagagauccagcaauguucaggugcucaaugaagcuggccucugaugucugaauaccauuagcaacauuuaacuuccucaggcgaguagagagaugaaaaccuaaauccucucuccuguuguccucucuacuaagagaguuuccuuuuaggaaacuguccgcugcagacaccccagagaacgcaaguacacacuucccaggaagcaacuguggcguccauggcaaacagugggccaggaagggcuccacacuaaacaggacacaaaaggaacucggggcucacguuccgugggaggcugggcucugccugcuccuuggcaaaucacuauucauaagcugcugcacugcuggcuuccccgaauucuaagacaggaagcccaggggagcaugugugcccuccauucacaguaagucccgcucuuaaucuacaggggacagacggcauuucgacugucuggcaugcaggcaacaccaucucuccuguccucuccuggucuccugugucagcaacaucguaagucaccaaaacucacucucuugcuucaguuuaaugcucccuucugacuccucaguacacacuucuucuccacagcgggaagacgcugugacgacacuauuaauagccucagacucuccugguucuguucacauguaacaccgacaaaaacaugauggagcuaucuaacacacaagcuaucggcuuaacucagcaagcaaaacauccugugcuacucauucuaaggagcaccuaaaugaucacugccugagucuaaggaugggaauauuuuaacucugcagagaacaacaguagagcgauuuauguucucaaguagccggcgacugccaaaaucuuccaagagcuuaaauacuguaauggcaggcgcugaugugcugaaaucaaagugagagguaccaauaggaugaagagaccagcuggggcuggacuccgaaugucaugagcuaggaagaggcaccaauucucuugauaucaauggaaguugagcgaaucuaaagaggagcuggaugcuucccagagacuaagaguaggcguaaagcagcaggugugacuaagcacgggguaccagcccagcacuuucccaaaguccguacuguuugcagucaugcccagccuugaggauaguuucauuccuaaguaagacuucugauagcauccacuagcaaccgucacugcuagcacgggauguugacaguccacacucaaauucaagcaaaugcuacagaccacacuaaugcuuacuacucuguauuagucacaaguuaaguuccccacccacccacaccgccugagaacacucgugugugucugcaugcucacggacauggaggggugagcgaaaaggggagccacuguguagcaacucccaagggaaaccguuaagaagcauuuaagacaacacauauggugcucuaauaucugaacaagagccacauagucugcaagagaccaugggagaauuuacagccuauugacuguaaauucggaaagccguauuucuaaugcgauagcacuguacugauuuguucccucguggguucaagcucggcuccgcaaaugcauccccugcccucccucgugagcuggcuucucuauggggaggcuccugugugugcaaugcaagcagggcucucggcagcagugggauccauuuaaaucucucugucggagggucuuagaaaucacacccaaguacuucucucuggauggcuuaaacacaacacagaguuuuaaaguguccuuuggaaagugaaacacuuuuaaauucuucacugcacacaagaccaccuuuaugacaacugaacuaugaaauucaggucacucccugaggauugacuacgccauccugauuuaguuuacuuuuucauuuauauaacaggacauaaaaaguuggcuugggauacgcggauucgaauauuauccagcaccgugaccaguauccccacagcccugacagaaugcacaacaacgaguugcagcuccaggucucucccaccugcuucaaacccugugcaucagagaaacagcagcacuggaagaaugacgacaaacgggguggugccgagaauuacggcaauuaucaaaccuccuuccagacugucagauccacagccagcauuagcagagcucagcuauaccaucgggccugaagagcccagggcuacgaugaacuccugccacggagcgaagccugcgagcucacaaaaggaaaccuggagagaaaaggaaaggacaucuggccauggaaucaagcaaaggagucuugccacucagccuggcuacucguccccggcacacacgagguggagagucacugcccgggucagaagcaggaacuugaggcugcuggugaccuuuaaaaaaaaaaaccugcaauaugccugcgugcuuauuaacacaaugugagcagccaaaccguggugaacgugaacagacaucucagaauaagcaauuacgccggaucgcagaugacacagcgcuuagguucacggugacucuguacucacccuggaccuguccuacacucuacacuccuuuguggccacugcgacacaugugggacaaagcuuaggaaaacuuagccaucaauccuacaguuuaaagagcauccacccacuguuggcaacuguucucuucgaaguaaagaaucuauuuagugauuucccuguagaugggaagugacucagaggcacacauauacauacaaagcaacacugucaagcaaaucaaguggaaaugcucugcagaagcacaaagauccacugcuaaccuucugaguugucugcgccuuccugagaguagaggccaaggcugguucuacacugcagacuaagcaaccaguacccaacuaguacccuguacuugauauuuguacagaaugcauaaaagacugaguaaaaagggucucugaguuugugggucgaccuauccaaacucgccucacgacuaggucacaugaucacacacagcagggaaguagccugcagggggcagcacuauucaauaagcacccacagacgggcugccuucaggggcagcuuucuuuugcucucacugagcagagaaguccaaggucaggcuucugacuuaguguggcuuuuggagacagcccucauccugguucucaggcugccuucucagaccacacaacccccuccuagacagaaagagcuugcucucggguccagucuuacaaaggcaccaauccucuucacacuccacugugggacucacucacaugccugaggcaccaccuccacucagggucacucagcacucuaacacugugagcauaugugagcauaucuaacacuaacugauuucucacauuucucagaacuuuagauuuccuuuaaguagaauguccugauuuuaacaugaugguaagaaaauaaauaaauaaauaaauaaauaaauaaauaaaaugggccauuaguuuuuaccuguccuaaaugauaacuaggagcucugcucuuagccaaauacccuacacacauacacacacacauucauauauacuauaucaugcacauaugcauauacuacauacgugugcacacacacacuauauauacacacacgcacauguuacacacauauguacacaugcacacacauaccauacacacauacaaacagaccacacacaggcacauacacacuacauacauguacauauucacuauacacagacgcacagucuacacacaugugcacacacuauauacaugcacacacuacacguauauguacacaugcacacacaccauacacaauacacacaggcacacacauacuacauaaacacaugcauguauacauauuccuauauacaggcauccccauuacacacacauguacacaccacacacacauaaaugugcaaacccacaugcacauucucacauaaacaugaucacccacaccaaucacuggauuccaagggacucagcagcagacaagauagcacaaguuuuaggucuauauggaccuuccugcucucaagauaucaaacugguauagcugcgaugccaggaaacugcucccaaaacucagacauagcuuuucuagacaaaauuucccaguccagagauucauugaggaaagaaauagagagggacagaaguucuccaaguuaucacaauccagaugugaaacgacccccacagacagguggcugaacaccuggcucccagcuggugauucuguuuugagagguuacagagcccuuuggacauaggaucuugcugacagaagacaggucagcccugaggggcaggccuugaggaccagaauccgacugcacuuccagcaggucaguuuccugauccaucgagauguaaacaaggcauacggcaagcucuucaguccccgagccuuccccacuauggugaacuguaccuucuagaacccugagccuagaaucacuucuaccaggauuuguugccaggacaagaaguguaccugauaaucugaugcuaagguucugggacaacgcauuaauacauuauuguccagguacaguaaugucccuccucggaggauguugacauccugaucucuaggauugucaccugacacagcaaaguggauuuuggcaauggggucaaaugaagggucuuaaaauggaggaaggauggucuuggauuauggagggagaggagaaauacuggauauaaucacaauagcugauagauggaggcacugaauagcuagaccacucugggagaaaagguagcuggagcaauguacuggaaaguuagaggguggaggauagggcuaugaaccaagggacacaggcagccgcuaggagcuuuaggaaagagaaggaaauggguaccccaacccccaccccaaagccuccagaaggaccagcccugcuagcaccuugacuuuagcccagugagacgaacuuaacuucugaccucuguuaucugaggugcagaaaccuaguuuguuuuaagccaguggguacaugauacucuuucacugcagugacaggaaaugaauacuaaauaaauagggaaggaccaugcgacagauauggcguauacguguacagucugguuagucggucucagagugccuggcgaugacgcacaaguguuaacuggcuccaucccugaccgagagaaaaauacaaaggaaggacaagaggcaggggacgcuggccaagcagcaauuacacuuggugaaaaaggagucucgugcacguagacaucagcucugcaggcagaaaagauggugucucuugccaaaaaucugacuuggcuccuggcugagacgucucuuggaauggauguguuacagcgcuccccgauguacccgauacucaguuugguaaccguacaugaacucggaagggaaaugucuucacuaacagauaaagcuguaauggcaugggguuuguuugguccuguuuuguuucuuucuuugaauacacugaugaucucucggccgagacgagcuucuuaaacccagcugccgagcugagagaguacagcugguuacucuacaucacggccggccacacauaagagagcgcaaugcaguuagaggacaagaugggggggggggcuugcgggggagggggaaugcaaaaguuugggagggucauccuugaggacacgaguggcuaacagugagaggcccuuuuguuuguuuuuguucucuucccauuuuuaaguguguauguauggugcacaaguauauguguauauuugcauaaaugugggcacaugugugugugugagagagagagagagagaguguguguguguguguagguccuuggucacuaucaggaaacacccccaucgaucuaccauacucacugaggcagggacucucagucaaacccagagcuugcugauacaccuagucucacucucucaggccgaaagggcuagugggccgcugagcccacuggcauuauguggccaccaaaccagcuguacaucacauagucuagucccucaacaucuggcucccuuucugaacacuggggccuaggccugaagcaaccucagcagcccuagugaaaaagcuaucaagaguggccuagaauguuccaucuacggaaggaaugaaaacacucucccuucucuucuaaccuucagggcucuuuccuacagcugagagguuauuuuccuccacacacagccguaagcacccugauccuaagggacucugccuuaucaugcuuccauccauuaauugguccaugcacaacagacacagagcugggaaugguagcaugugcuuaggucucugcacucaaagucagccgagccuacgcaaccccauguguaacaggccaaugugggggucacugagacggcucaggaagugagagcgcucaccauugugccugaugaccacagcuggaucccagagacccauacaguagaaagagaagagacuguuaaaguuauccuuacacacacacacauacacacacacagacacacacacacacacacacacacacacucacacacacacacacacacacacacacucucucacacacacacacacacacacacacacacacacacacacauacacucucucucacacacacacacaaauaaauguaacuucgaaauguuuuaagagacagagagucucuacauuuuacaaaugaagagccuuauauuuaaaauacuaaaguggccugcccuaggucacugaacaaguuaacugucauuccacuaguuuucuuccuucuaugucccaagagccuccagucaaggugcugacccucugggugcugauaaaaucacacgccagcauugacucauucucgcguauuccagaggagaggggcugcaaaccuggacacuuagucuuaauacagcagacagcccugcaaaccaggaguuucaugagcgaggguccuaaugaaacaacugugaucugagucauacaagggcuaacgguucaagucccuccagucccugucugugauaucuuuuucugcucccaggcuacagaaacaauaaccagacagccucauuggauuugguuuuuguuuuuuguuuuguuuuguuuuggggggagggguguuguuugguuuguuuuggcuacaugaugguacuaucugacuucuaaccaaaaggugggaaaaaaaucuuuccaaacuaaagaccagucaaugccuaccaguuauucaaagcgaucaaaaagaugaucccggggccaaugcagagcuccggugccauccucgggaggaccuguaaagcacaaagcuagggaacaccaacuuaguauaaggacucauuccgggcccgagcauccgcugcagaaauggcugcagggcgagugucugcaagggacccacaucuccauccugaacaacugcgcagagacggagaacuaccugccuggcccaugagcuggaggaagucaccuggcccgagucacucagguaggaagaggggagcaguuugaaaacuaggucacgccugcuucuagagucagaacuccucgcccgccugccccucuccagacugaaacccgccaccaaucaagccugcccugccugucagcagagcuauuuucggcauugguacaauuucgcuacgugggagcccggcuugucacgugaacaaaugcacgggaaagcuccggcauggugcgacuagcuuuaacagaucuggggagcugggauguguaugggggguggggaggcgccaaucccagaaucaccaguuccuggcuacuguuuaccagccucucaaaccccaucgugagccagccagugcugagcugagggccccucucccauuccgugcccaggaugugagugugcuaagcaaagcaaauagccuugaagccuagaggacuucacagaagcaagaggggaagucaggccggcuucucucucaauugccucuugaucacaggauugaauauguacuuagaguaagggacacuuugagauaaauuaacuucuaagagaaagggacauuuugaaaauuaaauuauacugcauggaacgagcaaucaaucagcaaucaauauguaucugauagccaugcauacaaaaugaaaaggcaauucauaaaagaauaaguacaaauggcccggcgugaagaacggcuacaucuuggguauaaucggaggcauaaggauuuaauugacaguuuuuuuuucuuuuucuuuaugccccuucccaagauuggcagggacacggagcaacaacuggcaaucagauugguacaacaauuuaggggugcagugucacagaucaagauauuaagauuaguggguaaauccgucgauucagcaauucuccuugcacaaaauaaggcugcagaaugucacagauggguacaaacaucuaauugcaaaaugucugccuccauuccguggcuauuaaaaagcuggaagcuacccaaaugugccacacuggggagauagcuggagccauauaauggaauaguaugcaaccauuuaagagguggaauauuuaaugguaaggaaagauacauuucacagcccaguagaagaaaagaggaaagccacugccucggaucacagaugcugaacacuggcauaugcuuccaacuguaaggauuuugaauuguuuuuuuuguuuguuuguuuguuuguuuguuuucugguuuuuuuaucucuauuuucuacauuccccauagacaauacauuuaauaaaauaaauuuaaagucacuuaaaugagaggacacagaacacuaacuccauguaacacuuggcuccugucccucccgacuccaugagcaccccucucgcaugcuaaccuacgaugaagaaccccaagcaagcauccgugccuucacccuugauccaccuggggcuuggaaacugcaucugccacagccuacccuacagcuccacccucggucccuagaccaucggggucaguuccauucuagaccugggugcagagugagugagcuugacgggguaugugccauuacuucugagguaaggaaaggggugggcauagcacauugagccccgggcaggaacucacacauauucuguaccuguccaaggaccuaggcacacuuaggguacugaccucaccucucuguucuccuacucuggcaccauuuugauacagcugcaagcacugagaugaggauuuuaaaagacagcagagcccuucuauuuaaaaugccugucuguaugauauaauaacaaugcauaaacacuaaucugguaucauugaguguaaagauaagaaugagagaugugguuugaaguuucuuuauaaccacaugugaaugcuggcuaacuuuguuucugugagaucgguucaaacaaagagccuagcucugcucaccuugcuaaucaaccucuacacagugaaggugaagccccaacucagucuccagccuccacacagugaagcugaggccccaggcagccuccagccuccccucccucucgccuuucucccccaccucccaucgacaucucucaugcacacacagcaucuagaucuccuuagaaucuaggaaggaaucuuccccuugacucuaauggcagcuggcugaauacaguauauaacaauauccaaagagaaagagaaguuagacagccggauaaacaaacacugagagagacagagcgggcagcguggcucaugccuugcacaucaugccuuacucguucuguaccccagaguucaguuuggcaaaucacuguggggacuucauuugcuaaaucaagggaaaugaugaccuucuugguaaccuaugggugucuuacauuaagagacccuugaaagaggccuccgcggcccaagugcaauuuuggaaaaaguugagaauucacacggggguaaaugugcauggcugaaaaggcacaagacaggacaagacugcuucacaccacccaagggacagccaggggucccagcugccagcgccgccuuuauuaucaagucugcaauaauucccaaaagccaccuaguuuuaacaauuuauuucuuaaauaaugaacacaucagcgcuugagcgcacugaacaucuucacucuggugcaacagcucugcucuggaacagguucacacccguggcauuuuuaggcucacccauguucaaaagaaagggagaagucacugagaaggaacauaauacacgcaagaguaucuaacagaguuuuauccugucuccacuuaaaaucugaaaauaguuuauaaagccaagccuaagguccuuucuucugggccacaaacgaccugcucaaacuuuaaugguaauacccacccccccaacugugcagaggacugguugccuguuucacagucuggcuguuaugacuucuuauuuaaggaacagauaccaaauccaaaaggacacauuugcuucuaguaacagaaugcauagcucauaaacaaucuaauuaaaauacauuauaucacacuagauaaggcugcugggcaaaaauaaauaaauaaauaaggucacugaggcauucuaaaugaaccuuaaacacgggcauuaauauuuaaauauuacaauccccacuuagaaaaagaaaucagauaauugauaggccagcacacucaaaaccgauaaugccaagaaacacuguccuuguguaauuuggcggaacaagcugcucccugaacacaauggaccuuuuuguuaaaugggccucuucgucuuuggcauuuuauacaaacaaaacaaaaacgcaaagccaagaaagagaaagaugacaccgguccuagucuucagccagggcucuaucacugagccggacaugcccuagaagauauguuggggaaggaaagggcacuguuaacaaaaggaaaagccaggcuaggcagccagagaagaaaacuccgagugcaacuaucucgaagggcaacagugcccucuaguggggaaacaguauaaacuagauaaacauggcugcuuuuagguuaauuacaggaaacagcaaugcuuguguuaggacucguacugugccauuccauuacauaaaggcagggaagaauagaaucacuuuaauuggauuuuaugcgggaacauuuccaaguuugcaugugacacaccaccacaccuuaauaagagagaaaucagauuuguaaacauuuucuuuaaauuagggguuugagccacuuugucauugaagcauagcaacaggaacuucauuuacuaagcugacacuauaaaaaagugaaaaccaaacccaagugcaaauacagaauuaacuggggccucagaggacagaccccucuggaacuguucagagaggcaccuguggacacguauacaugaauguaaucuguugggggccugugacucauacacacacacucuauaccuacucugcuccuacccaggguuagccgacugcacggcagcaaucacgauggcauuucuaauggcacccggucuggguauuaaggguaccacguacuacgauaucuaagaacguucacaugugaaguggcuguuugacucauaaaauaaucauuuuuaauuuuuguguaaugccagucaaggacuuuucucaauacugucauaaaaaucucaaguguccagccagguguggagaaagcugaggcaggagaacuucccugaauugaaucuacucuaggcuauguaaugagacucugucucaaagaaaacaacuuccaauaguuucuccgaaggaaauaauuucagaucacuuuagcuuaagagaaccguuguugcagauauaguuaauuaacucccuaggggucucuuggaugauuuaggggcuuccccucugcuuaaugagcacagaguucccaaaaggaagauaacccaaggccccaucagcucaucaaugggaaaagaauguaauggggaauuccaggaccccaaacacaaggacgcgggcuuuacucaaaaaaggggguuacgggguuaaguucaggcagcccccagccuggcucaggauccucuacagcuccuuaggaaaggucagggcugcuacacggucuggaaggaaagcagcccagaaaggaaaggguuuacucuaggcaggaacccaucacaguaacaauggacaagugaaaguguggcacuaacuccaugcuggagcaucaccacagggucuagggacagacccucuaagccuacacaugaagacacuguacggaaaggaucccgcagggcucccagcaugaaaagcucaugccucugcucugcuuuaaagagaaccaagugagggaugacugacaccuuccgugugaaccucuuucaucucugggagugugaaccuggugugcgugugugugugugugugugugugugugugugugugugugugugugugugugugugugugugugugaaccucuacaauaaggccugggguggugauuacaauacucuaagaggagagcuaguuuuguuuuuguugcuccucuggcuguuucagggggagaccauguaugacgcugcccgacauuauaaagguccagaagggaaaagacagaucagaaagaacuuaaaaucaaaucugagccacuccaagcuucagacugaaagaagagaguucuguccuuagcaccagacaccagauugucucaugugcucauagcugcuaucggguuuccaacacaguuugccaaaagccugacuguuccuccagaaauacaaugacaauauaccggucucgaugaagcaucaguuguauggaacucaaaugccccucugacauaaagaugggcagcugcugucccacucaagggacaugugccugccugugucagagagugcugccugaccagcaagccagccugaagguucaaggcaagcagcuuccacacagcucugugcacacagccaaaucuacucucgaacagauguagcuuaggaaauccaugggccccagggaagugggagacucccuagucuaaacgcuagacuuucccuuuccugagacucccggggacuuagaugcagucaucuccguguugaagccguuuccuucuuuuuuuacagaaucagagccagcccguguguaacuccaaagagccacaaccuccugccccuccugccccuccugccccugcugccccugcugccccuccugccccugcugccccuccugcccggcugugcugcacacagggcagugagcugcuccauugucuacugguuagcaggcuccggcucuugaucugcuagcagcggcucuggaugaaaggauggcuccccuggagccugagaugcuguucuccacugagguccacaagcuacagcuuucaaucuaaaagucuucagguucagaaagcugguuaaacaaaggucaagaggagaagaguguuaguuccugaggagacaacauucuagucuuguagcucacuaagaccacggguaggggcaggcaaauacugauggggcaacccuuccagcuauucaugaugugcucggugcacucuuccuguagccuggguaucccguuaucccagccucagcuaaaugggcugauccgagacgcugaggcaacccugccuuggguucagcuggaucacccagaguaaaugcugagugcaggccccacaguaaagacuuugagagccacaugaucccuacuguaauuacucgacuucuggugauacccuaaaugugcauggcuguguuccaauaaaaaacaccuacaaaaucaaggaggucagauuauacccgggggcuguaguugauccacauccaauccagaaggcugaauucaguugacagagguaaagccagcucacaacuguagagagaagggcugggaacugaguguggcgggacagacccauaauccugucgugagaggcauaaagaucaggaguuggaagccagccugggcuacauugcuaacgcaaggcaaggacacacagcaagacacugugucuaaaaccaauguuuuucacgcccucguuguacuucugcauugccucugaaaccuccuacauuccaggaccauccugcccuuccuuccugcuuggaacugagaauuuacucaacugccuuaguacuaucgaguauaaacauucaaaaguuaguucugcauugcuuacggacagcgugagagcgucauccacacaacagucugcucagagcucacaucaaagggggaggcccugugagaacccagugggucagucagggagcacacaccucccuccauaucucccaccucccacguagaggggaguguggaaacgccauugccccaacagcgcucuugggcagacaaggugucuguccagucacagggggacugugcucagcacucauccacucagcgucacaggcugaagacucaacagucucccugcugcggcccuaagaaaggaaugcuggaggcccuggcagggcucgcacagagggcaacacuaggagccuugggagcagaugcucauuccauccugcagugcacaggcccaacgaagcaguaauggcagcuuauaagugggcaaguugcacggcucgagagaaggaagccuguuaucuagaagccacagacuaccugggcaaggacacuuuccaagacugccuggaaggacaaaagccacacugcagagugucugauccacugugguaccucaccuccucugccugcuagaggaggacacuggggacuccaaaaucaggaaggaaagaaaggaaaagagaggaaagcucaugagagaggccauaagggggggcacugugacagauaggcagauggacagaaaacugacagaggacaagcagaggacagacagaugcaguucuacucuugaauaugaaggugcauauccuaucccaaagccauucagacgcuaaugucagaugucaauggaccaaaacaaaguaaagccccaucucuugagguggcacaggugcccgccucagggcugucacugcagcagcccggaaagccaccguggucacugugguuaaacaggggcaauuaggaggguuucugcagaggugaggacaaggacacacucuccaguuuuaugaagaaauaagauacgguuaccaagagaaaacgauaggcucagugaccagugggaaccugcaguacccuuggauccaaagucacaaucuacugcuguccaggaucccguuaccaaucaauuuugguuugaaucagccagguaauuggaaugcauccaugcaccgcaccgaccgggucaaaaccucuuagccagagccuguugucuccagccccugaauaccaaaauagccacagccuucugcugacuucucagcuuugagcaacuucaaggucaggccccacaaaccucacacuguaacacugggauggagagggagugcgguuuuaaugagacaacagcugagagagcuguaacagccucuuucaauuggagagucaccaccaacguuucauuacaguuacauuuaaggagaauucuuugcagcacucacaaaaauuaaauaaaugaaauaagaggacaguaagcugcaggccuaccuauucccgaauuugcuccaguaaccaggaccaccuugccugugaagucccggcccugcaggaucuccauggcgguggugcucccgucguaucucugucugguggucggcuucgucggauuaucguccacgguaaaugccaaucuuggauccaaguagguaguucuuuuauuuauguggcugcaaagagcaggaagaaagaacauugaacucuauacagcaaggaccagcaucucuaaguacaagaaaaucuaauacuucaggggaacaaugcaccacagccuuacugucaaacacgaagagacccagaagccauuccaucuaccuucuggccucuggaaggauggcacucuugccugaaaagagccguggagccucucagaacaacccugaagguacugggacacagcaggccucuugggucccacagcagccugcugagaaggcucuaaguuucuacugaauucacauuaauauaaaugcaucuauaagaccugucagccacucucuucaauagacauccauguaauuucacuggccugugcaaaggccuacacacauugguacacaaggagaaaauggaaaugauagacgucuuaauaacuacaaagcaagccagacagcaagauuuuaauuguuugcauagccaagccaaucuauaauaaggacugaacuuuugguuuggaauuaaucuagaaacaacauuaaaauauacugguacauacagauuauuaaauuacuccuuuuaaucccauuuuuauauuuuuaaauacagucuugggcugucaagauggcucagcagggaaaggugucugcuaccaauccugaugaccuggguucaaucccucagaccuacaugacagaaggaaacaacuaacuccaagcuguccugauaccuaccuggaugccauguucacauacacacacucuaaauagauaaaauggaguacaaagguuaugugcauuuuugaggcuugagauaaagaccuugaaaaguuauagaacccuccugaaaugcaugggauaucaugauuuaagguguauguaucugagagccacggcauagcccugugaucccagcuacucaggagguccgaacagguagacuacaggccagccugaacaacuucgugagacucugucugaccacacugacaucuggcagugcuggcuggugccguugucuccacuccccugggauuccaccuugguggccuguaaguagcuaccagugacaguauuugcacauggaaacaaaucuacacuuccuuucucucaagagcgugcuaugcugaucucagcacacccuccagcaagcuggaaaauaccuaaccucguccuagcuugcuuccacgguccaugcucauuuuucauuaggccagcagcuggcugauucagccuacugccuguuucuguaaaguuuuacuaggacacagcaauggccauuauuuuuguauuaaaacagaaaccagguagugccaaagccuaaaacacaucugauccauuacacaaaaguucagcuggucccucucuagaguagaccagacaaaccugccugccucagaaugcccuggagggaaucggcugccccuuaccaccacaaacacaccccacgcugagauucagaugguaaggauuugaguauguguauaucuaguaagcucccaagagcugccaaugaugcugacuggagaauuccaucuuggaaccacugcucugggccagugaaaagggaaaagcacuccagagggcagcugagcagacgugugugcacagcagaagccuacacaggaggagucuggcugcauggagccugugagugucuacagccaaggggucuaaggaaaacguagaaagggauauuuguagcauaaagcuauaaagaaaugauagcccugucuugauaagggaaaggauuuuuauaaaucaagggagaagaaacccuucauagucuaaucauuagcaaagaacauccacguagccaccugcuggagaggcugcccuccuagggcugcgugcagcugcucagacucuccaaagcaagccuggccugccugcucccaguguggaggcugaacugcgagggaguucaugagguuugcugacaaaacacuucuccaggugagccuacugcuacaacgaccacuaucacuacauggacaguaaccggugaggccaaaccaacugucacuguagugcuaaaaacggggaaaaugaaguuccagagacgacgcagcaguuccagagcacgugcugcccaacugugaagacuggagccugggacacagcaccauccugcaaucccggcaucccauguuugcacaucugcacuccagcucugaagacugcagauaccgcacauucgcugaggcucacuggcuuccucgugagguucagggacagacccugccuaagaggagauuugaagacugacaggagaugagcccgacacccucgaacagacacacagacacaucaaucgauucuuugcaaaaauguuaguaagccucaggacgagccgcuuaaagaagaaaaaaaagaaggaaagaaagaaaagaagcccaaucaaguagagugaaaacccaaggaaaucuucaugaaacucccaaaauaucacgcugucuccaaaaagcuaagguuuuguuuaaccuuaaaggaaugacaauuauauuaugugcuauauuaggggugugcuuagggaguaccacaccacaauccacguggcagaugagugggcugacccaaccccaaaaccuuaguguacaaagaaggguggaaaacugcagacuagaagaaaaaaaucacaaaguuguaaaggggguuacuccugauaguaaaacaggucucuaugacuucauauuuuccuacagucaauguaggaaauuauaacuaaaaaucccucuuaaaagucaaacuggcuaggcuucuacacagacacuuacucaacgaaaaacacuuguccguucucgucagucuccuguucccauccauacggcaaaucugaaacacaaggaagauuaacagugcguguguagggaaugaagccacgucacaccccagggucaggaaagagguuaucccucuaauccccagucccccugccuccuccuggaccaggcuggucacauggcaguuagagagggcccagcaucccaucuggaauccacauucugccuccugcauuuaaccaaaacccuguugcacucuugaucacucuuaaguguucucucaacuccugcuuuuaccucaggucucggcagaugcuccuacgagcauaaauucccgaagcucacagccauguugcaaauacaccagacaugagcaguggugugcugcccaggcugccuugugcucugcuguagagccauccugucauguacgagcuccucugucuucaccugcauccugaggagccgcaaccccuugguuuccauccaauacucccacuccauggacuguguacugccucagaaacaucuuuguagguuuccauaaaauacugacaucugccucuacagccuacaccaagaguaauugcucccauggugcaacugcagagaagcccaagucaaagcuccaauuuucucaauaaacuuuguuuaaagccagaagacauccuucuguccaccucaagaucuuaucuucuccuucugccaaaucccguuaugcucucagacugacagccuugcuccuugacggccacccaccagacagccuucccagaaaggcaggguuaacugcuaccucaccaccgcugacaucuccccuagcuacuuaaugcuucucugcuugggacggcauacagaccuccugcgacccguuuccucuugccgguuuucggauguucccacugggucuucuccucagugugacuguaauagagacccacaacagaguaaguuaacacugcuauacgaugucacuguguuagcuguggcucuuccugauauagcuggaguccugagaacaggcagacucagggcagauggucugcugacgacgacaggucagaggccucugguuguaggucagaaucaaaccugaaggaaucuugcagggcaggcagggggaucacugggagagcaagcggggcagggucgcagcuagagucagcuuuacaaagcucugggaagcacaaagcucuagcaagacauucugcacuccucuucccuuuauucaagaauacacugacuaucuucaauaucugguuuauaacgcucauauuuaaauauuagauguagcuuaaauauugcauugcuaaaguuuauuuuccuuguucuuucuacuuugaguuuuggguuuuugguuuguuuugguuuuguuuggagacaagguuucauguggcgcaggcugagcucacuacguagccauggaugauauuaaacgcuugauucugcugccucugcuuccuaauuauuaaaauuacaggugugacuuguuuguuuguuuguuuguuuguuuuguuuuuucgaggcaggguuucucuguauagcccuggcuguccuggaacucacuuuguagaccaggcuggccucgaacucagaaaucugccugcuucugccuccggggugcugggacuaaaggcgugcgccaccaugcccggccagaugugacuuuuaaaauguauauucuggccugccaaaauggcucaggaggaaaaagugcuugccaugcaacccugaggacccaaguuugcugccuggaucccacggaggaagaggagaugcaguuccugaaugcuguccucucaucuccaccaauacuccaugggaugcacacauacacacuucacacacacacacauucacaaauauuuaaaucuguauuuuggccccagguauaacuucagugucucauuaaucucuggguccugagugcacccaaaaggauguuaagaguguagcgagacaguagcacaggucacuuagcuaugacaagaugaccacggaucugugaacgcugggucugaccagacagccccuacgcaccacugcuccacugacuccaccucucagccaucaccuccugucaucugcagaauggggcugucuccaggacacuguccaaauggucucacagagcaaucuuauaauacaauggugagcugucauacauucuauugguaaguugucugagcucaccgaaagcagacucugguauauaggaggcuuccccuuaccaggcuccaguguguuuauuucacgugcccuucaaaagcucccaagagacuaaugggcuccccagucugugacaggagaaaggaaaacagcagacagcuaaggguauucacacacacacacacacacacacacacuuuguccuugaacauagcuaaaagauucccaagcgccuucccucagcuacuguuuaucccaugauauaaaacugcccauggcuaagggaaacauggagaauaaguaccaggcaacgggagcuccaccacggccucagucggggcucccagaugugggcugauguuguacacaccugacuaagcuuuacuccucucucagcugggcucuuccagucaguuucugaugggcacugugagugcucuauugauaagauuuugcuagccaaggcuucucucuaucugcuacuugcuguuucuuccuuuacuuuugcucgguucacauuuaauagagugaaaaaguacaacuguacuagaccauucuccuuaaaacguggguagaaagcuagaaccaccugucaccagugacagggcaucccucccgugagggacacagccaggcacugaaggaggcacucgaagguuaagcuugauuuccuuaaauccacccucggaaaggaaguaaacuguauuacaucaucaccaauggacgagacgccgacagcggacgccaaggacugagaaacagugcuaaguucaggugguuggagcagcacagucuaggacguuuucuagggcugagacuccacacacugagguccacguaggagcacccaaugcaggaccauuggcaugccuauaccccagcaccuccugcucacacaauccacucaugucuccagagccacucaguccuucugaagacacaaacucacuaucacucccuggcuucagaucaucggcuggcucuagaguccgacaacaaaauccaaguccuuggugaagcacagaagggccucugcaaacugauuccuuucucaccagucucaggcuuuacaacucuauaccacagagagagggcugccuggggucucuccucccacugcccccuccaaccugccugacuuccuaccaccugaggccaccuucuacagcacucugagacacagggcaagugacaccucuccuaggcggccucccucacccacccacccaccucacgcuggacacagugcacuggaacuauaucauuagaaaucacuugcugguauugcagagauccuuaagaauggcagcugcaccacacuuagcuggacaucaccaaugcccacccaccggccuggcccuuaaggacucuugaaugaaugaacucaccaaagcuuuucuguuucuuucuaucuggccaccaggggcagcagugaguagcuuugaguaccugcaaaucucauacuuuacagcccaucaguggggagacgccagggcacauuaguuccuaauuugauaacagggcaagaacguuaucuuuuaagucuuucuggaaccagguaggguaguacaaacccuguaauuacauaucugggagguggaggcaucaagaacuaugucauccuguuuacaaaagaaagucuaggcaagccugggcuacaggaagcacugcuagacaaaacuguagcaugugccauuaaccccagaggcuggaaggucucugugaguuugaagccagucuggucuguauauaauuuuuuaaguuaauuauuaaaaacuaaaaauacacuuacagguguuaauacaauaguuuguuuucugaaagccaggugauaagauacucucauagaaagcuugaaaaagauugagucuccuagcuuuuaaagacauaaagucagguguguuguucaugcacacuuugcccaggagaaaugggagcucaaccucggccaccuaaccaaguuaaggccacccucgacuauaugagacccuguuuuaaaaauauuucacagauauauaagaaaauagaagaggaaguauuugauaugaagaaaaaaaucaggaaaaguacacaauauucauaagaaaaaggagaccaugaaacucggggguuggaggcagauagacaucuuggaaggcagacagggagaggaaccauggcuaggugacacagguggugaacuuccaagacagccagcuucuuccucacacucuuuaugugagucgaaagccuggcaucuuaaaacaaaguccuugugggcuuuuucuccugcuagucagcuguugcugaugacuggcucagcaaguucgagaccacaucaggacacguuacccaacagauguggguugaccaacccuuaucuuuucuucaaacugaccaacucuuaaauuagggaaugaaaacuccucaaugacuuaaaaccaaagcccucaagaagaggcugcaauuuuuucggcuccagaguucccuuuggcuuugcaguuguuuucuccaugugugucugcccugugaacacgaguccuccccuacagagugccuuucagccugcugacugugccugcugcugucggagguguuggagacuucuccacugcuaccugcuacauugcgaauuucccgcuuuuucauucuuugacuggcagagccugaucaagacuguaugaaaaccuagcauuuuguccauuaaguaucuauuucuuaaaaaugaacagagguccccaagcauagagucagcugcaguagcucccccuaugggagcuacuauccccuaucacgccuaugcaauuuugccacagauacaguccaaguaacagaaaacgccugcggggcaaccuacuagccucuccacugagugccuugugcacagcacagauucauucuugugucugcucauuucagagaugaggagaacagaaaagucaggggcuugcuuucaguggcccaaggucacgguuagcaacagggaaaggcucuguggagguuuccaagacuucccugggaaaccacugcgagccauccaggacaucugcuuaaaaauacagauugcugggccuccagaucagguccccauggcaggagcuuggcuuugaaguuuucucuauuuccucuuuagaggaguaagaccuaggcgccaccaccgcacggugcagugccaccuagugagcggcagggggcgugcggcggguggccaggugacgggaccuugacccagauccccuaauaacgggggacagccugggacagguggcuggcauuucggaugcgcaugcccgccuggcagggcagcgcaggguccaggccucgcaggacacggcucccaggaacgccgcuccaaggccgcuuacuuggcguaguacacccagccguccuuggugguucucuccucccagcccggaggcagcucauccucacuguccgugucguccaggcccgcauagcgcagagcugccaugcuggagacagaaguagccgccugcucuccucagcaacucacucuggcuucaaccgcgccgcgcgcguccgggaggg

SEQ ID NO: 12429 - RNA, 8171 nt, Mus musculus
gccgaucagugaggacuugcgaagugggcugcagaguuggaccgggcugcugcgugugcgcaggguccucgucauggggcagaucgagugggccaugugggccaacgaacaggcgcuggcgucuggccugagugagugaggugggcugcggguggagggguugcucaggacccguggggcaccgcgggggaagcagggcucgggcugguucugcggaccucaaagcgcggauccucggagagaccuaccggggccuccgggcacaggacgggcgguggccgcugcaggccgugcucggccgccuguucuagaggcgaccccgcccugcacccuguuggguccgcgcugggaccucagaggaggaaguugcuuacagcuggggaagagacauucacucggugguuucccgccugguuaggaaaacccccggaagacccucuucugcgcacagcccacuuggccaggaguugggacucuggccuugaggucacucgggcuccggcuucuccccgaggggccugggauaggagcuaagcucauccuagaggagcaaucggcuccaucccacaagcgaagugugcgcagaaacuauuucacaagagucuggacaccccucagagugaucuuagcccugauggccugccgaguuaagaugcaggacacuagucuuuagucagguugacacuggccguggcuugaacaguucagcuugucugggagguuugccaaggggcagugggaccccugggcuucacuguaccaggaaaggaaccuaauagaccagaccaugagcagcaggccugagacuagaaacugcagacaugccucaaagccgaagggagccagaaaagaccugccagggcagggaggauggcccagaccccccuccacucacccgggaauagcgcaucgaagaggugauagagaaaucucccccagcccacgcuggaagcucccguggaaggccuugcaaccccaaccuuuugaaaauggcgccccucccccaccugcagucucccuucuuacccuucccagccuccugccaguagugguuuguccugugaccacuauggacgguuucaaaaguuaccuccaggaagugggggugccagacacaccuaagggugggaagaccuggcgagcgcuguccaugcagugucuccuguccucgugugugcuaaggucucuauguacugccucagcuaauuguucaggguguucaggcugacacaagucuccugugcugaggagucacaggcuguggccacuuacuuucuccaccgagugugacuuccgcuaacuuuucuuuuuacgggaaagcacaacuguccugggaagguucugaacugucuagguccaaucaacagggauguacuuuguuuccuuuuguuuuuuuaacauuugauuuuuuucagauugugugugugucuggccauguguguaagugcgggggcgcuugcagacaaaggcuagaagaggguauuggaacccauggagcugguguuacauacggguggcucugaacugccugaugcgggugcugagaaccccacucaggucccuuggagagcaacccucgcuacuaaucccugagccaucucuccagcccccuauuuuguuuuuuucuaaaucacagaaaauuccaucuguucuggccccauuaccuggcuccaucucaagacgaaagcccguuccugaccccccugcuugucuccugggcucuuccugccuuccuugcuagguugcuccuucucugucucugaguuuccugaaugugcacggggaggggggcggggggggggggcuuuuuguacaauuggcuggggucacagcugaugccuccuuuucagucuugacucagaugccaccugcugagacaucaaccucagauagugggcuucccugggauugaacccucuguuacaguguaucacuucagcaagccaggggcuugagaaucaguccuugggucucccuguuggguaaagaaugaccccucccacucaugguggucaguguagcagaagcucacagugaggacaugagucccuaaggacuauggguagcaggccgagugaaugugugacaaaguacccuucccuccugcagagugcacccuuaaagcugaccagcaaaacaggaagguuaauauguagccgagcuucaagcccagcauagcaaaacaccaauacuauuuaaagagugggagagggaccuggagucuggggauguccagaacagcauggaagcuuuuccugaggcugcuccagggucuucguacugaagaaggcaggagucagcacccuagcaagauugucauagagcaucagucccuccagcugccaagagcuguugcugccagggaucccaaacagccaaagccugagaccugggccugaggaggguguaggggugaggcugccuccacccacagaugcagaaacuagagaccucaaguaggccuauggguggcugugggauuaacacccuauuggcaugaggucacacucaccguuugaggaagugaacccugugaggagucggcacccacugggcaggggggcuggucccacuggaaagagggacccguguucuugaaugucaaaggagauaaauggccaccuggaucugagaaagggaauuuuguagacacacacaccgaucagcucuugaugguaguggguacacugcgaauguaucaccuugaagaaggaaacagaaggaagccaagaggaaccacacagacguggagcuuucuacacagaaguugugucacacguuguacaagaagggcgagcaugugagacgcugaguuccccagugugggggagggcuuggaggcuucgcaagcacugcccagagaugaggagacuuuaggcugaagagaaaaagaagucuuuuuuuuuuccagaacgaauggaaacaaaucccuccuuggauccacgaaagugaaauuagacaaagagagaaaaagucauggguuacuaccaggcuagaguucccagaccuaucguggaugccaggagacggugcagugauaaucggauauugagaaaagaauacaucuccgcuggcaagauccugcuguguuucagcuaccgagccucugugcagugguggcuagcggauguugccguagcgagagggaaacugaauccagagaugagcugauggucgagagagaggacagaaacugccagaugagaaacaaguuagggagcaaaagcaaagcggagcuuccuagggcccacccacagccgcgaggaaucuugcgauaaguagccuuaaagaucugggagaauuaauuuucaaaugugaggacaggaaagagaacuugacucugcguguuucuguuugaaaaguagcaaugauaccucacuguaccuuugaaaauccuugcuaaaacauauauauauauuuuuuuuuuuuuacuaaaaucuuuauugaguaaaacuuaauuuuuuuuuauuguuugaaacagggugugggccugaaaucugugauccuucugucuuagccucaagggugcugggauuccauacauggccacaccuagcugaaaaacaauacuuuggacgaguggccggagcucuuaaacauugaccuaucgcuccagcucuucuaucuuuuuaaaauuuacuuauuuuauauauaggaguacacuauagcugucuucagacacagcagaagaggaaaucagaucucauaacagauguuugugagccaccaugugguugcugggaauugaacucaggaccucuuccagagcagucagugcucuuaaccucugagccaucucuccaacaccucucugguucuuuuguaaccaaaaucuucagauguuucuuacacuuggugugucacgaaucucccuaaaacuacaacacggucuccuaguuuuuauuugcuuaccuguuuguuuugagacaggguuucaggcuggucucagauucacuaaguugcagaagaugacucugaauuccuggcccucccacagucauccccugaguacuaggauucuagggacuuaaauguaucccagccacuccuggagcauacuguguaagcgaggcuggccuuggacucacggucuuccugccucccccuuccaagugcugagauuacaugcaaguaccauguccagccuaugcagcccuggggguugcacugaggacuuugugcgugcuaggcaagccccccaccaacccagccaugucuccagccuuugcuuguuuguucguuugaggcacaaucacgcugggcggugguggcgcacgccuuuaaucccagcacuugggaggcagcggcaggcagauuacugaauucgaggccagccuggucuacagagugaauuccaggacagccagggcuacacagagaaacccugucucgaaaaaccaacuaaaacagaagaagaggaggaggagggugguccaugccugcaacacaaacacauggggcgaggaguuccagaccagccgguagcaacaacaccagagugagccccugauuauuuacagagcaccucacuucaacuucaugugagcuaaagacauagauacaagaacuuccugaaaugaaggagguugcccguugugugguuccgggguggggauggguguggggacccaagcauaacgcucguguaauucuacuguaacgaagucuugggcgggcugucugagacauuagugggggugaggguagcauaguacugcaggaaagcuccccucucccuccuccuccccucccccugucccuccuccccccaacaggguuucucuguagcccuggcuguccuggaagucccucuguagaccaggcuggccuuggucucacagacaucugccugccucugucuccugaguauugggauugaagguauaaugccaccagcgcccagcuauacccucccaaccccuaccccgggacagggauggaacccagaaaugugcuacuuacaaaaggaccaagagguaacagcauagcugaaaagaguuaacguuccaaccaggguguagcacuggacagcuaugguggaguucagcuugcugcggcuaccucccugaguguccucucugucccugaaccccuugcugcacagugcucugcuccaguaggcagagaauuggagauggucccaagcccggggcaagcucaagcuggcucacaccugcagcagauggcacauccuaaccaccucucuccauccuuaguucucaucacugggggcaucguggcuacugcuggacguuucacacagugguauuucggcgccuacucuauguauccuucuacuggggaccaggaagguggggugaugggagugcucucagcaugagcacaucaguucacggagugcuacacauagacugaccacagccuccagagacaggaccagcuccgucugcagcuuuagaggccaaggcccagggcuggaugcccccuugccaaaggccacagacgggguucaggcaaauguggagcugaggccgaaggucccaaggcuuggacuggcguccauugccccucugucccacccugcugcacaguagacuccuaggccagggccugagaacagaagaggcagagggcagcagccuaggccuagcauggcuuuccuuaaccucaccgcagcgcugcaggugugcucaucugucugcuggaguauccccggggaaagaggaaaaagggguccaccauggagcgaugguaagucauuccuacccgagaggccuggggaccugccccaugcagcccacucguccagagcucccagcccaaggccugcccagcugccaggcucaugugcccaggaggaaaaggacccauaacccuggaaggggacagauaaggagugacaagggcuucuagguguggucggugcugacccucugacguuuugucuucccgcugucuaguggacagaaguaccugaccucuguggugaagcuuuucgggccccucaccaggaauuacuacguccgggcugcccuccacuuccugugagucccucuguccauccccaggguaacagaagacuagaaggagacaccccaugggucuauagcuuggacaggaagguaucgcccagccagccaagccucuucuucauugaaguuuauccagauagaaaagcucagcuuuggggcuggagagauugcucagcaguuaggagcacugacugcucuggaagagguccugaguucaauucccagcaaccacaugggcucacaaccaucuguaauagaaucagauacccucucuucuggugugucugcagacagcuacacuguacucauauaaaacaaacaaauaaaucuuagaaaaagaaaaagaaaagcuuuuagagaggccccaaaccugcagugcacaccaagcuuagcaccugagccacaggugcuguacugggcuuguuacaccugcaguuuggggacacacccauauggccacgcuccagcucgggccuuuuccccagcaagaugucuguggcuugaaucaaaggacacaucgucacaaagaggagcuucuacaaaccccaagcuggaccugaugagagcuagccucugcccaucccccguccagggccccggggagggaaucucccucugcgacugugugaccagaugcccacugacugcuaucuguuugcuuccuccugucaugccucaagguugucggugccugcaggcuuccuccuggccaccauccuggggaccgucugcuuggccauugccagugugaucuaucugcugguaaguggcugcccucaauggucugccucccucccgcacccacccucaugaucuuggugcccguggcucucggagcagcuuucucgcucccauuggcugugucgaaugcuccucugcuguauccugggcacuucccugaugaagcuguacuguggcucggagaagcagcgugguugguccaggucauaccuccaagccuccgugugggcccaugucucauccaagccugccugaguuugggugguguuagguggacuucccaggagcucaugacacagaagcaucuauuuuauuuauucuuauuuuuauuuugagaagaagagcagggucucauguagcccagacuagccucaaacuugcucuguaguugaagauggcuuugaacuccugaucuuccugguccuccggcuucugucuccugaugcugggaugacagauaugugcugcuucagcuggccuaguuuguguucauuacaagccuucucuguucuaaggucauacagauaucucgcuguguccucuucugccagcuccauucuuaccaucuggauaaaauauucugguuuguugguuagaaggcguagccacaggugugugcucacaggugugugcucacaggugugugcucacaggugugugcugugcugcagacuuucuaucucucgagcauugugggauaugaaaucgaucugucaauugauucauucuggcuuuuugagacaggguuucucuguguagcuuuggcugucuuagaacucacccuguagaccaggcuggccucggacucagagauccaccugccucugccucccgagugcugggauuaaaggcgggugccaccacuauucagcauuuuuuuuuaaaagaauuguuuauuuauuuuacguauauaaguacacuauuccugucuucagacacaccagaaaaggccaucagaucccauuacaaaugguugugguuugccaugugguuucuggguauugaauucaggacuucugggagagcagcaaucagugccuccagccccaacccauguccacuggagucccuagggacaguaagcagcuucaaccauaacauagccccccucugccccaggcagccauccgaggugagcaguggacucccauugagccuaaacccaaggagcggccacagguuggaggcaccaucaagcaaccaccuaccaaccccccaccccggccacccgcagagguccgaaagaagccgagugagggugaagaggaggcagccucagcuggaggaccccagguuaacccaaugccagugacagaugaggucgugugaccuucaguggcugucuacagcuccugcuugaguuucuguggaguuguccccccccccccagggugguguugcucacuguaauaaacaugauuaauagcugguacggac

SEQ ID NO: 12430 - RNA, 40669 nt, Mus musculus
ggcugggcccgcccgcccagggcgcugugcgccgcgcaggccgcgcucucuccggcgcgaugcggcgcuaggcggccccgggcaaggcaggcgaggccagggcgcgcgcggccucccgcagcgggcggcggccccgggcgggcgccccgacggccccgccgccgccccgcucccggcccgcggcccgcccugccgcggccauggccagugacagcggcgggcccggcgugcugagcgccagcgagcgcgaccggcaguacugcgagcugugcgggaagauggagaaccugcugcgcugcggccgcugccgcagcuccuucuacugcugcaaagagcaccagcgccaggacuggaagaagcacaagcuggugugccagggcggcgaggccccccgcgcgcagcccgcgccggcgcagccccgcgucgcgcccccgcccgguggggcccccggagccgcgcgcgccggcggggcggcccggcgcggggacagcgcggcggccucgcgcguaccgggcccggaggacgcggcgcaggcccggagcggccccggcccagcagagcccggcuccgaggauccuccgcuuagccggucuccgggccccgagcgcgccagccugugcccagcggguggcggccccggggaggcgcugagucccgguggagggcugcggcccaacgggcagaccaagccguugcccgcguugaagcuggcucuggaguacaucgugccgugcaugaacaagcacggcaucugcgugguggacgacuuccugggcagggagaccgggcagcagaucggcgaugaggugcgcgcccugcacgacaccggcaaguucacggacgggcagcuggucagccagaagagugacucuuccaaggacauccggggggaccagaucaccuggaucgagggcaaagagcccggcugcgaaaccaucggccugcucaugagcagcauggacgaccugauccgccacugcagcgggaagcugggcaacuacaggauaaacggccgaacgaaaguaaguggcuggggcucuugcgaccggaggagggucugugaggaccaccccccgcccccgcagacccggggcccggcgcucugucuuagcguggcuccuuuuguccuuguacugucugccacagugcacagugcagagccugccggagcccuggucacucgugggggucguugggguaccagcuacaccgggucugggugaugcaucuuaucuugccugugugccugagcuaguuaaaagccccgcgguuuuuagcgcgcacccggcucugauugagagccagacacuguguuuagcuaggacucugucagcugcccccagaaagguucauuuaaaagccuguggucggaaaacucccuguauucaggaaaagcuuggcggccugcuccccucccccguguagcuuuaucuugcuggcugucccuaccguuuugaaacccacuaccaaaccaggaaagcgguguuuccguucccagggcucauaguaggucgguugcacucggagcacagguuuucucuauucgcuuuguuaaugagacucuccuguugaaaaagggcugcuucuguggcuuccugguuuguuuguuuguuuguuuauuuauuuauuuauuuauuuauuuauuuauuuauuuugaaaacaaaaccaacacggaauuggaggucggagggcuccuuuuaaccuuggguuuggugggauuuucuucuucuuucucuuacuguggcaguuccuuccagucugcugcucccucccuccuguggcagacagugacucucuccacucucuucccagauguaaaucuguucuuuguauucucaccuccccggggcacccugauccacccuccgucuacagucaguccgaguuuuuggggagguuuuaggaaacccggacacacaaguuuguacacacaagcucuucccgguaauuauugguuguguggguuuugaacuacguugacagccguagggcacugucagacugagcauguuuacgaggaaaaaaacaacgaaugcaaugggaagccuaauuuacugcaaacucaguacuggaugggggcaccugucuuaagaucaagugaccuccagaaaaaguugcuuaaaaugaagccucggguggagauguagcacagguggucgugugcuugccuggcauggagagaaacccgaguuuggucgccagcagugugccaggacgccugugaucccguuucucuggagaacuaucaggugggggcuuaaggucacauucugccacaucuccaguugaagggugguuuggucuacaugagguccugucuccaaaaguacaguaaaccugggaaggggauagaagucugacuggaccccaguuugggcuuucuaugcaguuuucauaggcaacagacagcuuggcucugagggcaguguggcucuccuggggaauccguugggaaacagaugcccucuuuccucacagguugagguagcugaaagaacaguccugauuuaaguugcuugccuggaggucuaggggaccagcccagcggcagggaccugcuucgaaucggagcucacacuuucauucauucggggucuguggggacagucuuaaugacuuccuuucacugacccucacaucuuaaaaauuacauuuauuacugagugugugugugugugugugugcgcgcgcgugcgggaguguguccacgcggagguuggaggacagcuuuccagaauugauucuccuguggagugagugugugugugugugugugugugugugugcaugcaugcgugugcgugagugcagacaugcguccacgcggagguuggaggacagcuuuccagaauugauucuccuguggagugagugugugugugugugugugugugcaugcgugugcgugcgugugcgugcaugcgggcaugcguccacgcggagguuggaggacagcuuuccagaauugauucuccuguggagugagugugugugugugugugugugugugcaugcgugugcaugcgugugcgugagugcggacaugcguccacgcggagguuggaggacagcuuuucagaauugauucuccuguggagugaguggguccuggggauagaaccuaagacuuggcacacauaccuuuaccuccugagucaccacaccagccccucguugaacuuuuuaacuaaaaagauuagguaaccauguuugaacauguaaauuuuaauuacuuauuaaaaagaagaaaaagaaauacugcuuuugagcacuaagacaccagucacacacuccuuccaaauacugaggaagcaggcugcuucaggcuucccaguagacuccacacagccaguggcaucgugacagggacuucucugacuuacacuuggggguaaaagucaggauauaagaggccagggcccaccauuuaggcaccugggucagguucaagccagauuugaagccucuguuugccugcauuucuaaggggauuuuuuuuuuuuuuuuuuuuuuugagcccgggucucacuagguagcucuggguguguccuggaacucacuauuuagaccaggcuagccuugaauucauagcccugccucugccucccaagggcuggguuuaaaggcacguggcacuuucuaguuuugauaguuaucucuguugauggugaggggacaugacauuggcgcucugggucuggcucugcaaacguuuuugacgguacaaucuuuacuucacauacucaaaagcagcuguguguuuagucacuaagcugugcuguuuuaagucugucucucuaagggguuccccaaaggaggccauuaugguugguugucuuggggaguguuaucucucguccuugucuuguuagagcuguuuccuaccaguguguauugcucacuucagcuacuggagcgguagccguugucagugccugguucccgccucagaguuagaagagcuugaggggaccaccucucucacucgaaguucuguaagacaccaggaguaccuuuuauuuauuuauuuauuuuaaauugugugcacagguguuuugucugcaugucugucugucugugccccacacauguacaguacccaaugcaggccagacgaggacauggaucccucuggacuggaauuauagauacucgcuagcuguggugguguuggggcugggaauugaaccgagguccucuagaagugcucuuaaccacugagccauugcuucaacccccaaauacggggauuuaagucgggucuuccagccaaguuccgaguuuucugucacaucuucuauguauacaugaggacauggucaucaaguugugagacuucacagguugcccuuccccagugucugccucagacucuggcaacugcuuguccucccucuuaaaaagaggacccccccccccccccaccaagggaaggugaaguaacacgggagaagaccagaaacgugauuguuguggcugcuguacccaccuccacucucuacccucucagggauccucucacccuuuucuugcccuuaagcugcccuuugaccucuuagccuuucucacauccuuccuuccaucugguuggcucacggugacaucaguggcagggagccacagucuucccuuguacagagcaaugucugagcacugucagagggcacaggcucuguagcuggguagagagaagggaugcugagggacggaacccccgggggagcaccgugcuugggcuugucugcugcucgucauuaagauuacugcaacaccagguguguggcgcaccagguguuuaaucccagaggcagagagaggcacagacaucucugugagcucaaggccuugcaaaaaaaacaaaacaaaacaaaacaaaacaaaaaaaggaggcugaggcaggagaauaguguccgaggccagccuggguggcacagagauagauaccuguguccaaaaaaaccccauggcaaaccaguaaagagugaaauugccagaauuacaacauguauaauaauuuuuuuaaaggcucauguuuguauaaaggaaagauauuggggcuauagaugauugggggagcaccuacccgggagcacuuacuucgaagaaagagaaggagagagacagacucuguguguguguguguguguguguguguguguguguguguguguguaauaggaugagggcagcaagcaccuuaugcuacucagaguucucugugcugcgguuaauuaguccgcucuggaaggcuuuuggagcaaggaauaggaugagcacaaucccgcugcuuuguugcggcugccacagagagagguggcaauccucuuagaugacaaagcccuacauggagaggcagaugcaucccuggacugugccacccuuggguucagagaaaagccucuagacccaaagaaaaguaaaucuguuugugggccuggaaagaacagaaccagacagggcuuccuucgcccacaccucugcccuccucucauuccuccgggaauucccaacacugcgaccccuuuaaugcagucccccaugugguggucaucuccaacucauucuguugguacuccauaacuaauuucgcuauuguuaggagucauaauguagauaucggaugugcgacaccccaacgaggucgaaauccacagauggagaaccacugucccagcaccuuggccauagaaauaagagcagcuggccggugcaguaucagauggaagcgugaagucaguuguccggugugcagaaaggcugaaaaguuaggggccagcugaucccugccagcugaauagaagauggucguaaagaaguugagagguuaccguggggauggauaugaugguucacaccuuuaaacccagcauuuaggaggcagcgguggguggaucucugaguuugaagccagccuggucuguauagggaguuccaggccagccaggaccauaaagugagacccugccucacagaaacaccucuagggggacugaggagggaagaugggcguucuaacaggguagugggugugugucucuguuagaucuugguuuugaugugguccugcuucuggggcucuaccacugugguugugucuuuggguuaauggcuuagugucuuugagccucggguugguauucacagcacugucugucugccccuugcgcuugccuuggggagucuguggcuugcaccacaagcagugcacuuugacugccgaacuguuacuaaguauuacuccugccauguuaaaaaaauaauaaucaauuuuaugauucuuuucuuaguuuauuugagagagagucucaauguggagccccagcuggguuggaacuugcuuguagagcaggcuagacucacacuuagagaucuagccacgauccucucuuuaagagaucacuguuuucccugucuguccaccucuugugaguuggaggaaaaaaaaaaggcuuagguggguuuugacccaaccaccacuauccuggcacaugugugugcauacacacacaacacacacaagcaugcauacauaugcuugcacauacaugaacacguauuugagcauguacagguaugcacacacacuuuuaauuuuuuuccucccaaagagaaagugaguucuggagagggcuaaguaagugacuuuuucaaggagggacuuuggagcuguuagugacacagcaguggguguacccccucuucugucugcagugcgcccuuuccuacagaacugacuuggcccaucuuugccguuucuggucauaugugacucuccuugccaaagcuucguccagccaggcugacacuuuagcuugacaauuucccacagugucuguugcuguuggagcugccucaccugaagcagggccuccuggucuugcucuguaaugaaagcugucuucucucccccuuccuccugcaggcauugaauccuuggguuuuuuguuuuuuuuuuuaaagauuuauuuauuauauauguaaguacaguguagcuguuucuagacacucagaagagggcgucagaucucauuacagaugguugugagccaccaugugguugcuggggaauugaacucaggacuucuggaagagcagucggugcucuuaaccacugagccaucucuccagcccuacguccuugguuuugaagcccauacauucugguaucuugggguugauguuaucagcuugguuguuuaauuucucaccauucacucuaacagauucuuagacacuuuucuggugcaggggacugaacuuccuugugaaugcccagagagcucucuuacgcugagaugggguuucacguagcccagaccggccucagacuuguuaagcagccugagcuggccuugaacucccgauccuucuuccuccaccucuggagugcugggauuacaggcauccaccaccaugcuccuagacaguuuucauagcugcuuuguacggcugcuugucccugucgucuuuccugcagggugcccuguuccacacuuggugucaucggcagcugcuugggaugcucuugucauucacuguguuguccuccuguugcccuuggcucugcuuccagccacccagaucuuguugugagguaaacccaccagagaccaccgcacagacacauuaaagccgagaggaaaaucucgagccuuccagcucuuugucuuuccugguucacacacaucaguuagcacgaaguggguggagccacagaagccucuaacauggcggggaccuguugcauucuaaaacaaaaccaucacacaugugucaccagauucucuuccucccgguuuauuucauuucacauucccgagcucaaacuugaugucuuuugggguuauacacagcugagggauguccugggcuagggucuuguugccacaugcugugccugcagaaggaccuacaccugucccccacaucccuucuggcagguucugcuauugccaggcagggaugggguuccuggaugcaaagggggcaagucaaaaagacacagagaagcuucccagggccuaagcaccccgucuuuccaacuaaucuuggggaguauccccuccccugcacccuguuguuguuauaauugguuuaugcuguaucaguuaaugauagcuuacccuuaagugugugcccgugaugaugcuuggucugcaguucaucucagucuuccaugucucuuucuguuuagagagagggccucgagcaguaguagaucuccugccucagccuuuggagugcuggggauuacaggugugcaccacuguuauuguuccuggggguuacaggugugcaccacuguuauuguuccuggggguuacaggugugcaccacuguuauuguuccuggggguuacaggugugcaccacuguuauuguuccuagagauuacaugugugcaccacuguuccuguuccuggggguuacaggagugcaccacuauuucuguuuucucuggucugugcuuggccagggugaccacagguguuagcaaacauagggucugggguuugcuguuuucagacucuuguucugucuuugauugccaggguuuuagacauguucuguauagcaggggaugugucaccuuccugcuaggugcaucaguguaccuguaguagaugugaccaggacaguagagcgcaaguaccuggcuucuuuguauauaccugcagcagccacaacaggauguacagacuccuacaucagucucccacccuagcaacugacucuacagggaugagacacagcccccccccccccauuuuuagaaggcuugacaaacacagcgugguucauuuugaguuccccuguguuagaagaagugagggcuaguagggcaggacaggagucaguggauggaggaacagguuuaaacuggauucugugugugaccuguuucuauaguaucuaucuacauacacuaugaaucugccuuuugugggccccagaugccaggucaaucucuguccucucagcucagcuguuggagggaaagcuccuagcuggguuggacggauugcuguuuugggggcgcucagaagcugaacccugguaguccauaggcuaggaaagcuuaccagagaaacugucauuuuggagaaagcaucgaguuuggggauuucagaagccuccccuccccucugucagugguccgaauaucuccuagaguugugccucacucgagagcaaaaccuccugguccaugaucucagaaacugagguagcagcaugacaguaaacccugcacuuaggggggaggaggcaggaggaucaggaauucaaggcuauccucagccacccagugaguucagcgcuagccugggcuacuucauucccaguucuauuccuguucaaacccagcuucaucucuacccugaaggauuucagagaccucucccuuuccuauagcucuccuuucuagucuuuugucccuuuggaaaagaacauuuuacucccugccacacacuuucuguguggccuccuuugucccuucccucuguggcucccuccacucuugccaccuggaggugguucaguguccugcuguggccuugacagcuccuauccccagugacacaauucucacagugggaagccuugugguccuagcaccuugucuuaucaaaagaguguuccagcugcuuguaacucagacucagugagcguuagaucugagauucuuccuggcccccccccgguugagauuuuuaaucauuuuauaugcagcccgucuuacguacaucuguguuacuguuuuuuugguuuuguuuuguuugacgauuucuuugcuaugcacaaccuaucauaaguguugacccaacacugaagacugcggagacagcacaaugguuaaacugcucagccugcagguaaagggaaccuauguaaccaccauaaagcagguagcuggccugugauuccggccucgggcacugaugagaucaagaaaguaagcuggccagagagaccagaguuucccgugagcucuugguuugauucggagaugccacaaggugggagggcuguggggaagauuccuaacauccaccucagaccuguacacacacgugugccauaugugaugacaaaauacauacgugcacucugccacagauggguacgugaaaaggaaggucauugccaacacucacaaaacuuuacuuaaaagccucgggcacguguguggauuucaagucugagaacuacacaguggggggcauggccucucaucguguuggaaguaaguuuaucuuuuaauguugggcuacgcucaccacuguccuggggcaggugugacugugggccacagauuggacaaguucagaaggauguggucugauuucuuugaauugauuauuggaggcugucuuagucaggguuucuauuccugcacaaaacauccugaccaagaagcaaguuggagaggaaaggauuuauucagcuuacacuuccacauugcuguucaucaucaaaggaagucaggacuggaacucaagcaggucaggaagcaggagcugaugcagaggccauggagggauguugcucacuggcuugcuuccccuggcuugcucagcuugcuuucuuauagaacccaggacuaccagcccagggauggcaccacccacaaaggguugggcccuccccccuugaucacuaauugagaaaaugccuugcagcuggaucucauggaggcauuuccucaagggaggcuccuuucugugugauaacuccagcuugugucaaguugacacacaaaaccagccaguacaggggcugugaaaacugagccuucuccauguuuugguccccagcacaccagugaaucaggucucugaugggccuccauccugauccugcgccagccauugagaccuuccaccuccuuuagugucugggcuaagucuccuucacagaagugugguucccuccaccucaaacgaauucagaucucuacugaucuuucugaaagaaaaacaaacaggaaaaaaaaaacaaaacaaaacaaaacaaccucuaauccagggcuggggcuaugauggcucagugggugagagcgcaaacgugaagagcauccccagcaugcucguuacaaaacuguauggccacacgugcucguaauccugaugcugagacaagacuuacuugggcuugcuggcuggcagccuagcucuugguucacugagagacccccaugucaaggcaguaagguaccagggguauagcagagucucacacaucuuccucuggccuuugcacaugcagauucagucauaugcacacuccagauggacacacacacacacacacuucaaguccacugugguggcacacaccuauaauccuagcaugugggagguggagacaggagggcagggguucaaugucauccucagcugcauagggaguucagggcuagccugggcuauaagagaccucacaagucuauaagcacaaaacaauugugauuacuguguggagcuccgcaagccuuugcuuucuguguuaggcacaugcugcuagcacccagugacuuaaccuucacuguccucuggccuagaugucaccuuccuuuuaccaccugcccaaacuguuaaucucuaggagcccuuuucacccccgagccuguggguguucuuuccaauuguggucaacuccccucucuguguacuauguuguuccugaccccuaauuuuccagauaaaaauagcccaggccagccuggucuuaaacuauuuuuaacuccaaguacugggagaaaggucugcuuugaaggugaaaugaagcucugugccagucccuaugacaggagccaggcaggguucuaauggccugccccuugcagagggguggccugugugcuugccuccucgggccccuauuccccuagugccugagacucugcagggcaugcuuguguccccaaagcucgcagcgcuuaagguaugauguuauguugaaaaugaccucagacauagguuacaaggugaccccccaagagagagguacaccaucagaguuaacuucaacacgugacaucacucugugguguugauauguuuuuaaaacugucacgcccagucgcuaagcaguagggcaagcugaagaguuuauuuaacggggcuggagcauuggguguucugaggaccugcgaucgauucucagcacagcacccaccuugugcagcucacagccaaugcaacuccagcucuggggaaccugaugucccucuggcgaccccguuaaaggguuuuuuaacaaaggacguggccuuaccuaggcaugaccaucucucucagggucagggagccugguuccgagcgcguguucuggauuccaguguuuaccucacuucugaagcagcuggcggggcugcguguggcaggaacccaacugggcauuuacuucauuuugacuuugauaaacuuuuuacccugaaacauuucaccuauuagugcugaggagaugcgguaaaucuccagccccaguuagccuguucaaggaaaaugcaacucaguuauauauuuauaagcuguacuccucuauugggcagauaggccucuacaccacuuucuuccccagcuaugaagucccugccacuugcaguuucuccaggccaugugcuucccuucugucuuccagcuucucucccucuguccuccuccaucuguccucuccuucuuuuccugucucgccugggaaaccugccuccucauuuuugcccagugaucagcuauuugucaucuuuauuagccagucagauaauugagggaaauuccucuacaccuccgugguugaaaggcgauguugccucuugcagaggaccuggguucaguucccaguacccacaagccuauuauuccaguuucagagcaucugacaugcucuucuggccuuaugggucaagguacucacaugguguacauacauuuaugccagcaagacacucacacacaaucacuaaauaaacuauauauauaaaguuccaccuuaauugugcauaauuuugaccuugaaacugcguucauucucugaguacugaguuguugaggcaguuauccacagagcaagucauuucugugguaacaacaguuaccuggacagugucucacugugcagcuuauacuagccuuggacucacgucuuuuugugccuuagucucgaauacuggcauuacaggcaugcgcugccauaauuaccauaaaccugccgggugugguagcgcaugccuuuaauccuagcacuugacagaggcaggcagauuuuugaguuggaggccagccuggucuacagagugaguuccaggacagccaggacuacacagagaaacccugucucgaaaaacgaaaaaaaaaaaaaaauauauauauauauauauguauguauauauauaauuggcauaaaccaucuugaguaaagguguauauagagacugaggguguuuuuguuuguuuguuuuuguuuuuuuaaggauuuauuuauuuauuauauguaaguacacuguagcugucuucagacaccccagaagaucuuguuaccaaugguugugagccaucauguugaugcugggauuugaacucaggaccucuggaagagcagccagugcucuuauccacugagccaucucucgccagccccaaauauguuuuacuuuuggguuugauccuacaagggaugggcaccgcaggacaacucgucugaauuuuuauagauuaaaaagcuuuaguaguuaucacagugugccugagcuaagauacccuuacuaacuaaacaaaacugagacucaugccacucuccucugcuuauguuaaaggaaguuccugugauuguuagcucggaagcaucccuuggaaguuuggguggaaaaggucuuuaaaacguguaggaaccauuuuguucucugggcugguuuccagggacuguguucaguguuacacaguauggaaaguguucaguccugcugaugucucccccacccccccaucauugucggggaaagggaggguaccagccaagaggcccugccgguuccuaagcagcuucagcuaugcauacucguuuuaaagacagugucucccauugggaccugaccuugccaguuggguuagugaggcuggccagugagcccaagaaucuacuguuuucagcgccccccccccaucuuuuuauauggguguuggggauugaacucacaccuccauggcaggugcuuuacuaacuuagcuauuuccugagcccuggagucagaauucuugguuggauuucaguagaacauaaagcuuuauuuuuuuuaaauauauuuuuuuaagauuuauuuauuuauuauauguaaguacacuguagcugucuucagacacaccagaagagggcgucagaucuuguuacgggugguugugagccaccauaugguugcugggauuugaacucaugaccuuuagaagagcagucugugcuuuuacccguugagccaucucaccagcccaaagcuuuauuuuuaacuaagccuaucuguuguugcuugggcaguuggcccauggccugggccugguugaggggaaagcuggucccugguuaagggcauuguauacacacacagccuguuacaguaugggugccaggcaaagaacgcuggaucucggauccccucucuggcccucccccuucacggcuucaagucagguggcaguacauguucuauugguaaugguaaauuuauuaggucuguauucaaaaacugaauaucgcagacauuaauguugaaagcuaaucacuuguacagauaagcugugguguguguguguaugucugugugggggugucagguccugauuggaugcccuaggucuuugauaaacauguaggcuugauuguaauugucagcgaacguauuuuuaaagaauuauuuuuugaauguuuaccugcauguauguauguauguugugcacuguggacaugcuuggugcccuugacgcccagaagaguccuggcagcuugaguuauagacaguugugagcugccauuuagguuuggggacuggaacucagcagguguucuuaaccacugagggaucccagcccuuaagguagguagguagguagguugguugguugguuuauuuauugguuguuguugguuuuguuuguuuguuuguuugagacaggguuucucuguguagcccuggcuguccuggagcucacucuguagaccaggcuggccucaaacucagaaauccgccugccucugccucccaagugcugggauuaaaggcaugcaccaccacgguccagccccuaagguuuauuuuaagguguguagacuccuacucuguuuuuguuccuugcugagaaucaaucccagggucacacccagucugaggaagcuuuggaaacuaaauuauaaaauaauggcugcuacuuugggguagcuuugccaugucccacuccgccccgcccccgugugacuucuuuagccuuagucacaccugccauuggcuuauugucagacuuguagacugacuugauguuaauucauaugguaacuguuuucucucaucaaaaaaaauugcauuuugagaagccuguguuacuuuggacuuuaagacauuucuugugggaccaaguuugguuugauuuucuuuuaguaucuauucuuuauauauauauauauuguauuuauaugaauacacuguaacugucuucagacacaccagaagagggcaucaggucccauuacagauagcugugagcuaccaugugggugcugggaauugaacucaggaccucuggaagagcaguugguguucuuaaccacugagccaucucuccagcccaagaauccauucuuuuaaacuaugcguauguaugugcaaaugaguguuggugcccagggguccaauccccuuggagcuagaguuguaagugguugugaacugccuaacauggaaacuugaguucagguccucuggaagaacaguacucgcccuucacugaugagcucugucucuagccccuaguuggguuugugugugucucuuuguuuguuuguugugcuuuguacaggagauaacaaucgccuggucuugaacuuaaguauauagcugaggcuggccuugaacuuggggugguucuccugcuucauccuucugagugggagccacugugcccacuuggucugcacaguggaaacgacagaccuggaagguguagucuacucugcuuacguauuuuaaaaauagcuuuuguugacaauggguaaagcugugucaucuguuuacaaaacagcucuuuaggccaugugugcauauauauuuauuuguuguagaaauauaugcuauauacacguuugugugugugugugugugugugugacaguuaguauggccuuaguccuuugucuuuggagauaucacuucuuuagaauuuggauauugcacguguguauuucagcuguagaaucuugccugucacagggaaagguugcugcuuugugacuuuguaagguuuacuauuacuauaaauauaccacuaagcuguaaacuguagggaaaaaaagggaacugaaauggccagugggcugauggccaguuguggcaucgggagaccuuaguacucauuguuaggacaaauaaaccucagcuuaucaccuggccuggccugugcucauccugcaguaacagugggacauugaacaccaugucccgagcugugacucaagucucaggaaacacagaggaucaaagucaugcagaguaggaauagaucuuggcaguucuagggacuccuugguaacagugagucaaauaucugcauugaugggacucuguacuggaguucagaaguagauacacacucacaggaucaguugugugugugugugugugugugugugugugugugucuggaugaaagcucaaacaggccucaaacuuaaauguagcccaggaugaccccaaacuuguggcaguccucaguuucagccuccaaagugcugguacaacagaugcgagccaccaugcuugguucaauugauuuuuuuuuuucuauuuaaaaaaacuuuauauguauggguguuuuacugccauguuaugcugggugcccucagaggucaggcugggccauuggguccuccgagggaacuggaguuaguaacaauugugaguuucuguauaggugcuggaaauugaacucagguccucugcaagaacaguaaauaaauguucacugagccaccucuccagcccagauuauucuuuuuuuuuuuaacuaaaaaaacaagaaaccaagacaauucagugcagugcaguuuuuguuaugucuccuucugguggauaauucuagagagccaucuccauggacaccuugacccuguacauaccaguauuagcucagaaugggucccacgccuccagugaaccccagaccuauaacauuuacaagaaaauguaagagcaaaucuuugugaacucuagauaaagguaucuuagaacacacauacacacacaccacagaugaccucuagagaaaaacauugaagaauugggcuuugucaauauuaaaauauuuugcuucccuaaggaugccauuaaggagccaguggcugucgggggcagggggacagccagugggauggcaaagcugguagacacagaccuggucuugcacagaccugguggucaguccuaggauugcacaaggaggcagaacagaagucuccugagagcugucucugacuucacacacaucucauggcaccagggcaccuagaucacucaaguaauagaaauacauauuuuaaaaaauaucccagucugguaagggacagaagagauggccuagugguuaagaacacuuguugcucuugcagaguaccuggguuuuguucccagcacucguaugguggcucacaaccgucugcgacucaguucugggugauccgaugaccucuucugacccccucagcagauguacauacuuacgugcaggcaaagugcucauacacauaaaacaacaggauuaaaaagagaucauuuucugggcgugguggcgcacaccuuugaucccaucacuugggaggcagaggcaggcggauuucugaguucgaggccagccuggucuacagagugaguuccagaacagccagggcuacacagagaaacccugucucgaaaaaaaaaaaaaaaaaacgaggaaaaaaaaagagagagaucauuaagaacacagacaaauuagggcgaaaauaauuacaaaaugugagagacuugcaugugagauuugcauaacauuuuuuuauaaccaagaaguuagauaaauggucuggagagaugguugaguggauaaguggucucccacaggaagcucauucaguuaguuccuggcucccuugucuggugucucaguuaccugcaaguccagcugugugggaucuaaugcccucuucuggccucugugggcaacuucacucacgugcacaaaccacacagacacauuaaaaagacagcaagacaaacaaaccaaagaugucagagaaacaguccaacagaaagauuugaaaagcuguuucacagaaggggauaaacagccguggucgaggguguuaaaagauccucagggggcaggggauguggcuuacucagccuugagcuugcucagcaugaaugaagcugggaguucaaucccuagagccucauaaacaggucuggugucacacaccuguaauccuagaauguuggagcuggaggcaggaggaccgggaauuuggcgccacgugggcuucauaaaguccugucucucaucugacugguuguuagggaagcagaaaccacagcgggaggcuaguacacaugcaugcacgcaggcaggcaccgugcaccaggaugaaggcucgggguaccagggauguggauagagcugaugaccguacagaagguugucacacauguguucauugcuuagaggaaugcaaaaugguaccgccacucuagaaaaacaggcuggcugugucucagagaguuaaauauaaacccaugaugugagccaggaauucgauugcugagcggcugcaaagagaagugagaacuggcccauguggccauggggguuucguucauccuugccuacgacagcauggccguuucauugauccucacccguguggccaugggcgcuuuucauuuaccacagcacaaaauagaaggcagcccaagugucuaccaucugcaaguagauaagcugaggcagggggaugacaucucaguaaaaggacgccuuguccuugauaaagcagcgugguacuccuugugcagcuaagagaggccacacugcuggggccccugcugagaucuggugcugucacgguaguucagcacgugugcauguuugcaugcccaugcacgaggaccucagggcucaaccucaggugucguggucacccuccaucacuuucugagauggagucucccguuggccuggagcucacugguuuugcuggaguagcuagucaguaggcgucagggcuauaccugucuuugccucuuugguguugggauggcgggcugacagccaggcuuucucgugggugcuggggacccaaaaucagaucuggcauuuacccuugugcagcgagcauuuucucccuggcuccuuucugaaaucuuuauuuuuuuuuuuuuauuuuuauuuuuuuuugguuuuucgagacagaguuucucaguguagcccuggcuguccuggaacucacuuuguagaccaggcuggccucgaacucagaaauucaccugccucugccucccgagugcugggacuaaaagcggacgccaccacacccggccugaaaucacuuuuuuagcaaggucccauugaaauguuauuugagccaagacgggcaaauucucaaggaaaaauaucuaucagucacugagggaguucgcucguguggaugugguuguuugaacggaucacucucucagucacaggcugcaucagguagugugggcugcacgggcagaguggugacugucagcucugaggccgugaaaguugagaucccuccagugaguccaaggcugaggcuggcaaggugacucggcagcuaaaccugcuugucccucaagcccgaugaccagaguuguuucauccccgggaccuacauacgacggggagaaaacuaaccccuaaaaguuguucuuucaccuacacacaacuucucucuccucucucucucucucucucucucucucucucucucucucuuucuccuccccccuccauccugccuucucucaguaaauuaaaacaaaaucccuggggauuaucacauacucagcugaaagucuaccaaguucgguuucugccucaggcaugcauccagaaugcuuaguuccucuucugagcaccucuccuaaccaguaaguuuacauagaagaaagacuuuaaucccccaaaccaccgacacuguguucuucaccacacugacccccguuuuaaugcuugggcuuuccccgggguaucugcaguaugaacacugucuaccuguguuuacucuguuccuuacacuuccugaugugcgccuuccuucaggugcuguugggagacagaucugccuuccucuguccagcccuucugccuccucagccccucggccgcucucgucccuggaggaggguccguuggcgcugugccgcagacugaggaacucaggaaccggacgauacgggauuuggugucaggcagcugggauucugaaccuguccugcugcuguacagugccggcgagucuccugccucagugucucauuagugcuuugaugacccccauguuguggucaucgggagaguagaugugcaaagcacaauaccugccuuccccucugccuucucuccuguugguucacaggauucgggaacagccuuggcuuucuguaauugauuguucuuucucuguuaccuuucuucucagcgguuuggaggacacacugguacagugucagccucgcugucuuauauagcauguagugaugugucaagaagguggguggcuggcgagauggcucagugcucaagagcaaugccuacucuuucaaagaacccaggauagagccccagcaaccaccaagguggcucacaaccacuuuaauucuaguuccagggggucuggugcccuccuuuggccuucacagguaccaggacaguauaugacacacagacaggcaugcaggcaaaacacccagacacaugaaauaaacaaaugucuugucaaagaaauaaaaauaaaacagcuaucaaagagccagaagaccugggauuccuuggcgaggacuugggucugagcucuagauagcacccaucugcucucuaaccugggauuugcuccagauccaguuuccagucugggagguuucuuuuauugcaagauuaugaaggugaucagagaugacagggucugagucuugguggcuucugaguaaacugugacacagaugcagucagcucacuaaccaguggugaucauuaacauugacuacuaacuugacuggcucuagagucaccuacgggacaaaccccuggacaugcccaugagggaaugucuaguuuggguuagcugagacaggacaaugaauccugaguguggguagcaccaucccaugcgcugggaccuuggacugagaauauaagugagcugagcgccagcagccaucucccucugcuuccucaccauggacacggugugaccagcugccuugguugggcuccugucaccaugccuucccuguauggcagacucuacauucaggcugcaagccaauaaaccuuuccuuauuuaaguugguuuucuuaggcauuuugucacagcagcaagaaaaguaagauuccgccaaucaaaugagacacuagggccagcaucacacagcaagccagcagcagcaggcaggauuugguuuggaccagugcauaguaucuguucuucccaucuuccacugauauuucuuguccucauuguagugguggguauugaacccaacaccuagcaucaguugccaggugcucuagcaccgaaccucauccccaguccacugcuauuuuguuuucaagacaggguuucucuguguaacccuggcuguccuggaacuuacuccguagaccaggcuggccuugaacucagagauccaccugccucugccucccaagugcugggcuuaaagcaugcgccaccuccacccagcuacuguugguuccuaauuccacuuaucuagucguguccuucuugcuccaccaggacagagccaagcuaccacugaacauagucagugccuugcuggcaucuuagguuuucugucauaggagagccugcugacuguuguguucuguguuguagcucgugguggagagagagacagccucccagucacaguaccucagcccugacucauuugggcucuugucacugauccugcuuccucucugccuucuccaccacaccaagccuccuacagccuucuuuggacauuugcacuuccagcagccucccaggcaugcgugugcucaggcucgggacuccuuuaaccgacucuuucccaaacacugcucccagacaccccagagcucuggcaaacuccuagagcgucuguggguauguuugcauuccaagcagauaccaucauuauguugggcagguggccacgaaccucugggucaugucaugucuuugugaagcuggguuuucagggcucauacagaugcauagcaaguagagcccaacaguccacgugggacaggaauccaggcugccaguguccagucugacgccaagcuuugaagcacccaauaggcauacguuguuaaagcuuaagacucauucagcgcuuaccagggaagaucacugcugccuauuuauuuuggccugaacguuguagguuuuagccaaguaaguuuggggacgguaggauagacuugccuucacagaaaccugccugcggagccuguguagagcugcaaagcuuguggcuggaaggacaguacaagauuuauuuuaaaauagauaaaacgucugucuguuuuacguucaggaaggaagucacugauggagagacaguuacugaaggucacgugaaggaggucauggcuugggcuucgaguagcagggcucugaggagaggcagggugcgaugagacagugcuucucagacagggugagacgaggcccugcuccucagggccgcccgcacaccagcugcagggcuuuauugaaggaaaugcaaaaccacaggccaccgucaacccagacucaggacacacauguuaaacaagggucucuggugaugugcuugcagcuaaaaucucugaagcccugggggaggcacagccuucuguggagagaauaacuucaugccaugugcccucugccgugggcugagacaguggcaggagagagagugauaagaggguugagggaaccauuccgaggaaacaagaggauaagaguggccaagaaggucugcagggucagggucaggcacacugaguuguaaacaugcaugcagucauagauaaccccugcuggugccaagcagccucggggcaguugcugcaaagauagggcuccucugaaagagugugcuugcugggugaggaugaggaaaggccagcuagcauucgucugucauaggugcggagagaaagggaggcacaaggaggugagauacagggaaggggugaggaagggguuccccugaagccaguggaaagaaaggcugcaccuauggguggaagcagaugguuccugguuuacuucugucuuagcuaggguuuuacugcugugaacagacaccaugaccaaggcaacucuuauaaggacaacauuuaauccaggcuggcuuacagguucagagauucagcccauugucaucaaggugggagcacagcagcaucuaggcaggcaugguacaggaggagcugaaaguucuacgucuucaucugaaggcugcuagcagaagacuggcuuccaggcagcuaggaugaggguccgaaagcccacacccacaaugacacaccuacuccaacaaagccacaccuccuaauagugccacucccugggccaagcauauacaaaccaucacacuauacauucggggagaugcauacuuugcuacuagacugcaguaggauauugggauugucagguuucccaggguucuagugucaagggcagaggucuggccccacugcuaguacuuuguacggggagaccuuaggaggaggccugggagauuaggagaugcuggauuugaaguuggaaaauggggugggggauaagggguugguaggagggugggguggagagauggcucagagguuaagaacacugaucgcucuuccaaagguccugaguucaauuccgagcgacuacgugguggcucacaaccaucuguaaugggauccagugcccucuucgguuugucugaagacagcaaucguggauucauaugcauacaauaaauaaauaacucuuugaaguuggaaagcaaucuguugcugugugggguuuugacaccacuggaagugagauuuggcaccuugaaggccgagauugagaauugcucggggaucggcagccgcuccugugcgucgcggucaggcggaggcugagcagcuggugcacauuggcgcacccuccaggcugccucuggggccaugucaagucagguuacagaugaggaaaugccucggcaaaugcccacagucacguagcugcuaauuggcagaaccaggauuaggaacaagagccagguccuuuaagcugagcugcucuguucugagucaccugcuccugggugcugacugagaccagggugugaaggguuguuaaauggaggaggccagagcccagcgcuccggcuuucaaacuggcuucugcaauccugaaggaaauugaccaauaaccuggcuguugucgcuggcagagagcuuugagccucucugguucuguucugugacaucaggguagccucaguggucuuaaagugauacccgggagcuaggagaagagacaaacaugucuguuccaaugaccuuggcagaaacccucgucugaggucagcaagauggcucagcaggugacggugcuugccguguaagcccagugaccuguguucaauccaaacacuccagaguugcccucugaccugcacuggcacacaguggcacacaggaucacacccacacacacauaauaauaaauugaacuuuuaaagggucuauuuagguauguauguuauguguguggcuuuugucugcaugugugcacaccagaaggcggcauuggaucccauggguugcagucgguugugagccaccaucaggugcugggaaucuggaagagcagccggugcucuaacugcugagcaucucuccagccccaacaaguugagguucuaagaguuaaaaucucagggugcgccccagccucuuacagucuucagcucugagcuccucuuagcccagugguucuauaauucugcuacugucaugagucguaaugcagauaucuguguauucugauggucuuaggcaaccccuuucaaaggguugguugacccccaaaggggucaugacccagauugaggaccacuugauuagccucuagcaaaucugagcaucgaauuuuacccaaauggagcucugaggacgagggucaggaaucccccagucucugacacagcucaugacaguggguaggugcugggcaguccaccggcuguuuagagguggcaggacccugcagggacugagggaugguggcagugagacccacacugaagagucacaggcagaugcugguggggagagggucuuguuaguuuguucacaguugcccuguaaaugugugugcuauuggcuccaagcauagugcaaagugggacugaaguuugccccggccuggccagcuucuagcuguacccucucuacugccaugaccuuggguggcacuggucuaucacagugcaggaagccugaggggugacagcaugggagauaaggauagcucaguguucucccuuuacauuuuuuucuguuugcuuuauauacaugaauauuacuuugcuuuguuuguuuguuugguugguugguugguuacugagacaaggucucucuguguacccaucuguucuggaacucuuuguugagcagaccggccuugaccucacagagcucugccugccucugccucugcccgccaggcgcugagauuucaggugugugcugccaugccuggcugaauguuuugccuguuuguacccguggaagccaaaggaggggcaucagauccccuaggacugcaguuauaaauggcuaugagccacguggcugcuggcaauagaacccgaguucucuggaaaugcggccagugggcucaaccacugacacugagccaucuugccggccgggugguucucagccuguuuguugugacuccuuugggagucccccauucagauauccugcacaucagauauuuacguuaugauucauaacagcagaaaaauuacaguuguaaaauagcaaugaaauaguuuuaugguugggggaggggcaccacaaaugaggaacugaauuaaaggguugcggcauuaggaaggcugagagccacuguuccaacccaucucccuaauauaucuuaacccaaaaauuugaagguagcuuauauaacauuuuuggguuuugagacaagguuucacucuguaucccaggcugaccuggaacuuacuguuguagcccaggcugcucucggacuccagagugcuguauuuagaggcauguuaaaccaccauacccagcuuuuaaaauguuucugcuuuaugcuuuaacccuauaaacagccuuuagcuuuauagauggccaugcaagucuuuauuucugacagucuuugggucuguggaauucuaguuggauuguuucauuuucaguuuaucucuagggacugugaaaugucucugauuuuguuugacuucugugauaauaguugcaaaaccauacccaguauuuacauaauaccuuugaaggaggaaauaaaaagcccaguccuauuucgggcauuuucuuaucaggacgagcuucucugaggcuguccuguuaggauugaguaaucucaaaaggaagagauaacacucaggcuaugcucagcugggccacagcagggcgaucgcugccaggcuggccgggcaggugauccaggcccccuccacauggggcagacauugggcacggugcccuccuccuccuccuccugcauggcagcggugcccagcugggggcagccaucuucugccucucauuugagaaauaaacguuuauauuaugcuaggcgugugcuuagccucagaguugccugaacaggaaggcacacagacccaggucagguuggcucaccaucuggccaggugucugggcuguguguccucaggucggcuugcuguucuggccaugccuccacagaacaggcucuuauccagucacugugaggaucgggugggccugggccuggcaagaccucucagagguuauaaugacgaugaaugccuaccuggcucccaugcccgcuccccuccgggcaggucagugaagaaagagcccaggauggagaccgacuccucagaggcccugcagcuguuaggugcagcugcugucccuguggucuuugcaccaggcacagugacuagcacuucucacgggcugguuugcucgagugccuagcaggcaguuugcuguuguuguuuguacaggggaacaaguaaucgguccagaaugaccugaccagugaggaauggugcagacauuacucaggugcaggcuguggcagacccucuguuccuaauugucuuuccuuucacacucccuuccuggaaagcacacacgcuuuaaauaauuguacacagccagccgugguccuguggucuguccgaccuggucucggggccagagaacacagcuaugaacugucuucgcggcccuucccugauauucugugcuguguccuucucugcuuuaaaaacucuuaacauuucuuuuaauuuuuauuuuauguguauaaauguuuugccuaaguauauguuccaugcacugcaugugugcaguguccaaggagaccagaagagcgcguuagguccccuggauuuaaagauggcugugagcugccagguggguagagagaauugaacccagguccucugcaauagccacaagugcucuuuaagauuuauuuacuuauuuuauacgagugcacugucgcuguccucagacacaccagaagaaggcaucggaucccaguacagaugguugugagccaccaugugguugcugggauuugaacucaggaccucuggaagagcagucagugcucuucaccgcugagccaccuaucucuuggcccugugugaggcugauggccagccagaggccuaagucuuguugccuacgucuugcuugcuagguuucauuuuuguuguuggaaggguggagcuggggauguuguaguuggagcgcuugucaaggauucagggaucucugaguucaagccccagcaucacaugaaacccuggugaugcaugcuuacaaccucagcaauggggagaugcgggcgcggggagcaggcauccgagcuacguuuggcuaaccagugacuuugagacaagucugggguaccuaagacccugucucaaaagcaaagaaaacucaaagagguggcuacucuuccagacugucugcuccccuuuuacagcuggcuuugaaaaugagagccaaucccucuaggagcucugggauuaaugaagaauucugugaagguuuuuuguuuugguuugguuugguuuuuuuaauucguuuauuauauguaaguacacugugcugucuucagacacaccagaacagggcaucagauuccauuacgaaugguugugagccgagccaccaugugguugcagggauuugaacuuaggaccuucagaagagcagucagugcucuuaaccacugagccaucucuccagcccaugcugugaaggucucauguaaugauagcugcaaacuuguaucuugagaaauccugauuguuaucuguuaccuuugguugguuuugaguuuuuugguuugguuugguuugguuugguuugguuugguuugguuugguuuaguuguuguuguuugaugcagguuuucucaguguagcccuggcuguccuggaauucacacuguagaccaggcuggccuugaaaucagauccaucugccucugccuccagagugcugggauuaaaggcauuuuugcuuuguuuuguuguuuguuuuugccauuuaaaaagcagacucuaagccagauguggugacguguacaugugagccuagaacucggaagauugagacggggaucgguaggaaaguuaggucggggaguuccuucacugcugugacuuauugaaggaaacagaagcuggggcaugcucaguuccuccaggccgacagguccugggugugggcucuguaaagaaggaagccgggauuuaauuugugcagauuguauuucacugucuaguagccacacgagugagugguuuuucagguucucuagaucauguaguugguucuuccucuguuauuaauuuguuuacagcuuaguuauuagucauucuuguccuuacagccuuggcccccaauucuuauaccccaucggucacucuggugagccugggcugaugggauauccagaugugaugggauauccagaugugaugcuguauagcggcggcaucgcagcucugcccgaagacacgacacacccugcuguuggucaggcgaccaggguggaggagcuauuggucuuaagggucuuugggcuauggagauuaaaccugggcuaacagaaacgcaugacccccaaaccacagauggcuccgaagaaagaggaugagggccccagagcauugcuuuggauguagugagaaugaggggucaagagacuuggaaggcugcuggcugcuggcggugcacugagucaccagcgaggugaggccuuaggaaacuacuuaauccucccugcagucgagggcugugugcagccacuugcagcauguucucgaacauucuuacagauacccaugaguuagugccaaauggaaccacagcacacugggugaaacgagucugcagaccuagcuaguaugugcuuccgucugugcauguaugugugugcauggucgguaccuagaaccccagcacucgggugggucccacacagaaggcucuucacugugacgacauccugggcuaacauagggagacuuucauaaagagcaaaagaaguucgcucacaagcaagccagcacagcuacagguuuggcugugaggaccagaugggggugugcuugaccugagugaaggccgcagccucucgugagugcaucugccgcaugcuggagacaggcgcuuggacaggaugaacugucagccgccaaccuuuuccucucauuuauagugggaauaauuucauagccugucagcaucacacaaucuguuuccaaguaauuuacucccgaaauaagggguuaggggugggcaaagaugaguuacucaguucagcuucacguggaagcuguccagggccugaagugaauacaccaugggcuccugcgacagccggccggccucuucuuuccuuuuagucccugggugagaggagacagcuucaugguguuucucucgugagaaggucuucuaucuuguguauuugcaucgcuugccuccucugggguuuuccuccuggagagcggggacauccagcauugcugucugcagcguuaggucagggacaggacacugacgggaccacggggcacucacacugucacucuuccggcuuuuugauugacagguuuguuuaggacucaguguagcuuuccauaguuguagcuguggccugcugccuguccuagagcuggcacaggcaaggugguugagguggcaggccaacugccgccuguuaucucagggacuagaaagcuaauuagcguaauuaaauggacuucauugaauugaaacuuucuuuaaagcugucccauccaacucuguccccuguguggucuauccuccccucuuugauccuuuaccgggcuucuugagaaagcagaguugggucucccugccugggcuccugucacuccaaucucucuuagagacugcauuggcccuucagugcuguacuccagccuugcuucggggaccagauucuccgugucucugaggacacuagccuuucuggccuugguuuccuugacagguggaggaagaugagagagagcuaaggcccugcaccugguguguuggaugcacuugccuacagugcacuuggcagguggcgaugucaagucucugcaguccuugucgugcagggauggaucucauugaguucgugagugugcccgcuugccggguccugucacuuccggcccucauuucuguucuguuugaggcggugccucucucucuccccaggccggccuguaauuaucugacccuccugccucugucuccugagugcuggaauuucagauguguaccacaccccuggcuuuccuugacguucagaauagcauccacaguccuguguuucuugauucucgcccugguuuuuugggcuccucuuguucugccacagugucccagccuuccguucuccuguguggugcacccacuuuacuuuuuguuuugcuuuucgagacaggauuugucuguagaccaagcuggccuugaacucagagaucacccaucugcuccagugcugggauuaaaggcgugcgccaccuccuccuggcucggcuuuaccuuuugaaaugagaucacaccaggagacaguucagacuuuagguuauuccuaacccacucugauucagauucucaguuaaccccagguggcagcaggaucuugcaguugaguugguauccagugacagucaccaugagcgcuguguugucugugucuuuagcagcuggugacagaccccuuugcugagcagucuggauacccccccuccccccgcuguuuugucaucucuaaacacuaacaguaaaacaaagguuugugaaguccauccuaagucaggaagaauggagauguaacaugcacggucgggucgucccaccugugauggggagcaggagggcagggcaucuagggaggugugguguugguguuuaaggauucaggcuuaacaugucucccagucucuaagagaugacugacugacugaauagccagugacugcauucuaagauuagccuuuguuacauaccuaaaucucauaguagaagucuugaaaacacuagguaaccaaccauuccuagagagucaucccaaugcccucucccuuaccaguggauaagaauuccccaccccaccccaccucugcccagaucugagccaccaugacucugaugggaagacaguggcugauacaugucacaguggcacugcagcucacagacccgcucacuacacuccuucucaggacuuuuucaccuuugacauggcugcuugccuuuuuucugacuggugugaauuuuggggaaaaaaaaaagacacccaagucacacuuuaaagucacacauuuguucccuugaaggguugacaaaagaagaaugcagauaccaaggaggaagaagcuagcacuugucacauggcuaagucccaucauagaggacuugaugucuacugguagcuuccuucgaucccuccacgugagcacagcaguggugugcgcugaagccugacagcacaguuuuccuccccacugcagggcuucuggcauuaguugaccacacacagauacccagagcucuacucagcgccucugugggugcagucccuugguauaccgugcugacuagucugagcugagccuugauaagccgaguagagcacguguuccuuuucagagggcuuauucuccauccagucugaguuucuuuccuucacugacaugacaugggaggggauuuguaguuggccguucagaguggggcagcaccagguaguucauuccccagguuuugguuccaaggccagcucagaagacaacuccgccaagcaggucagaagccugccuucuuaguuugcagugugcaacagucaggacagugaagccuagaaacucuccuaacuucuguuacuuaaagcaugggcuaauggcuugggacaacucgggcucuccacuauugggaccccugaccuuccauguuggcucauuccauugcugcaaagcuuccacugagcuagguucucccgaccugggguugcucacugaccuacgccguguuuuuuauaauggcuuagaaugguuuuaccucuccuuaccacagaauggaucuuacaacagucacucuuggguaugaaucagaguuccccgugcucacucauggacuguuaucuuguuuuucaggccaugguugcuuguuacccaggcaacggaacaggcuauguccgucacguugauaacccaaauggagauggaagaugcgugacauguauauauuaucuaaauaaagacugggacgccaagguaugcaacucaauucagcagagauguuuuuuuucgacgaugugguuuuuuucccucauggauaucuguagaccucucucgagucugcuucagucuggacacucagaguggacuuuugugauaugauaccuauaaugcugugcuugaaaacaagcacuaauacgaacacauagcagcaugccuugugcaguacgcaccuauggguggugcuguggugucagugggcccaguggaacacaccaggaaucccggugccugggagguggaggcagaagauucagaaguucaaggccgcccaguucagggaagguuuccagcucgaguugagugucaaccagccagcucuccuugagcagcggggugaggagaaggaggauguguuugucaucccaaucugucucuaagaguuugcaaggugccuugggauucaguaaccuacaaaagcaaagaagcaggccauauuccuacuggcugacauuagucuacugucuaacgaguucuaggucaggcaacgcacucaacugcccuucaacuuugaguccacccgcucaggagcagcaguguguugggcuugcuggugcauaccuaugaucucagcauuugggaggcucagagguuaacguuggucauccuuggcuacaugaggaauccaaggccagccuugguuauuugagaccuuguuucaaagugacuaaauaucucuagauuggugauuuuggucuagugcuuuuccucauagucggaaacacaagggccagaucuauaugcaugucccccacuccucauuuagggucccugugauauucaguggacuccguguacugccugugauguguauccaguccccgcagagagcggagguugagguacacgggugggaugaauggaguugagcucacaucagcuacgauuagaauuuagacccaggcuacacagggauagcugaguacagaauggguuaggaugggagaugacucagcaggcuaggguaacugccaccaagccugaggaucuaaguucaaucccugggacuuaccaacucccaaacguuguccccccccuccuccccagcuuccuuauguaaugaguguagauuaaaaaaacagagaccgccagcucaccugcuugcuaagcaucuguugaaaguuuaaagcaccgugguuguuuuccugauaguacauuacuagguaagcuacugggcaaauguggcuucaugccuuccuuagcaugacuagaaauacucacugguuuucaaaccuuacaaauaggguuggaaauugugcauauuugucuauggcaagggcuuacaacaaaaaggcauuuucccaugcaucugucugcccuauccguggagucucggcucaccgucacaccuugcuaguuacaacauaacuguaucuacaaauaguccuguuaaucauuuugaguccuuuaacucugccugcugccuguuuaaccuggugccauucuugguggcgcauacugacauacucugcucuuuucccagguaaguggagguauucuucgaauuuuuccagaaggcaaagcccaguuugcugacauugaacccaaauuugauagacugcuguuuuucuggucugaccggcguaacccucaugaaguacagccagcauacgccacaagguaguguuccacucacgggaacuugguugacagugugacagggcagggagaguucgaagggugacccugaaguuucuguggagcagccgccugcuguccaggcccucuuucggcguuaggaccuucuugagugaucaugaguaucugaacaugcuccugggaaugucagucugcaauaagccauccuuugccugagaugaccuccccaacucugcuacucccaaccccaccccaccccuauccccaacaugguugcaccuguuaucacugcccacuccaggauucuguggguguuuucagagcgcucuuagaaaacuaguaaagggggcuggagagauggcucagagguuaagagcacugacugcucuuccagaggucccgaguucaauucccagcaaccacauggugguucacaaccaucuguagugaggucuggugcccucuucuggcuugcaagcauaaauggaggcagaacacuguauauauaauaaauaaauaaaucuuaaaaagaaaagggcaguuuuucagaaguaauucagagagcagaagugaggagagaaggaauugucagacggggugguggccauauguguguggugcaugcugggaagacagaccagaaucacucuccacaucuguggccauguguggugugugcccgacaucgcagcgccagaacuguugcaaguuuaucgccagcccaggcuacauauuaaacuccaggcuaugugauagcagcacaaagcaaucggucuguuuuuuucuucaugucucuuucauuggacuuuaagguuuagauucuaaacugacuauguuaauccauacacucucuugagggugguggugguuucccauguggcaucaguuaaugagaagauucagaagacccugaaagcacagugugaagcgcaggcuugcagggagugugccugcuuuuaucagggaaaguggcaggaaagguucccccaccccccucuggcuuagaagcagccaacugcuggugagauggacccuccccaguguugggguacaguggccaagguugguggccauggaugagguccuggagccugcauggcaucuguccucuuccugcuucugacccgugcggcuuucaucacugaaucacaguggguggcagcugccugguggagccuggagucauagggacccugacaggaaaccugggaaccaggcacggcacaugcagugaggccagaggugcagucaggagaggggccaccgggccagauuccaggugggugagagaggaggcugucgagucuggggcugugaggaaggcagcuuggggaaguagcagagucugcucgugaggacucagggcucagggaaacgcuuaucagauaucagacuucggaucggcaguugacagacagccugggacgugggcaagagcuguucagaacuagcuguauagccguguucccugaaaaagaccaugguaggaaugggagcagcccgggcagagcgagucagcugcuggcuaguguuaggacacaagcacuguggugccugccgccggcucugcucuguauuugagucuucaagcaaggugcugugauuguguagccaauuacucgggcuguugcuuuucccaugaacuuuggccuggauccucagauucugucugaccuaaugauggcucucuccugagggaccaguggccugaggcauaugcucacaaacacagcgucuguuccuuugcgccacuguuuacaagugcuggcugccacaugcuguuagcucuggagucagacacagugagacacacuucuguugugccaugaagucaccugcuuuuagcucugaacagaccugucacaccacauuuauuuguguucaguuagaugagggcuuuuggggaaggaacccuagaagucuaugaguguugcauaacuuccucagagacgcagucaaagaugguggacugcuggacuauguuccuuugucccaaucacugucccuccuggguacuugcccuuccucuaucugucccugaccaugcaggcuggguggacauggagagaggcuaugagccucccuuggcugcuguagcucaucugcgggauggacaggacccgcuugccaguuaacaccucugucuuagaggcugcuucacgcauuacaauugucaggaacacuuucuucccagggaccauucugauccugucuuaaauuuccuucuagguacgcaauaacuguuugguauuuugaugcagaugagcgagcgagagcuaaaguaaaauaucuaacagguaaacgcagcugggcguggcuggcaaggucggggaugguaucuuccaaaagccacaguacaguccaggaauguuucugccagauuccugaagucccuauuuuaaacaggauuucucuaguuggccuucauucugacuuguugaaauuguccagugcuuaccgguuugaugcaugucugaguuagauagcucaaacacaggcagagcuuuucugcgaugccacccugagccugaagcuccuuggugcucuucagguucccugguccccuccccuugucuuucagauagacggauaucucuuccuuucacaacauucacucuaaagaauguguggcgggcuggagagauggcuccguuguuaagagcauugacugcucuucgagagguccugcguucaauucccaccaacucuaugguagcucaccgccaucuguaaugggauguggugccuucuucugucaugcaggcauucaugcaaauugagcacucauauucauaaauaaauuuuaaaaucuuaaaaaagagagagagagagagaauguguggccauaaggaaagucuguacagaaggggcagaccagcuccgcagacaggugugcggauucccaggugccagcucuguguguaggccauggacgugugcaccuguguguccugggaccugaagcauacccaguagucccaggacccacucaguggguucuaaggagcuggacucagagcugugccuuauguacuuucacuggcucaguacuuuucaguacucggguggcuuuaaauuaaagaugucacuguuucugacgaggugucugugcuugucacagaggcaacgggaacagccacuaggguagaccgaugagaagagccgcuggagaagugagguguuuccggcgccaucacgggcucucuggugcuuuaugauuggcugcagucucagagccuguugcuucaugagugaaugccucuuuuucuugcaggugagaaaggugugaggguugaacucaagcccaauucagucagcaaagacgucuaguggggccuuggguccggcaguacccacgucaccuacagccucucaguugccuucuguggacucguggacaggauggacagagagacaccugccugguauuucagcugggagccaggcgacuucgccgggugucauccaacagagggcuccaucugcugggacuguacuguggggucagcuccagaucugugacugcucuuggcugcugacccaagaggagacgcugucggaggagaguagcuuuuccaucuggacacgaaacaagggcccuuuguaggaauuucuucagucuucuauuuugccagaccugucaccuaacugaguucauuucaucucuuuuuuauaucaaguuuugaauucggggaauuuuuguauuagguacaauuuaucaaaacugaauuaagaaaaaaaaauuuacaguauuauucucaaaauaacaucaaucuauuuuuguaaaccucuucaugcuauuaaauuuugcccucaaggccuccugcgaugauuguugccagugagugacgacguguugcuucugccugaacguaaaggacgggcgggcgcugugucccagcccgagugcacgagguuuuucuuggcccgucucucagugauuccaaccuguaaaggucacugcucucgcgcuucgaccgaccuaacaguagaugguugccacuggcacucaacuaacucaacauaguuacaagaggaaacaagccacaggagaggguuugucucuucaguuaauuuuuuuaaagcgaagugacgggcacuaaaugaacucggggcucucccucagcuucggguuccugagacaaagggcuuucuucugcggcaggucuagccugccuacagccgugucccacugccgcagguuuccuuguggcuucuccguaguuuugacugugcuuccagacccuuccaggucagggcuguguucuuguggcagggcaccugguggacccaggcacgugaaugugguaugugguuguagccucaaucguggccaucggcuccuuggacagccacgagccauuuucauacccaauaaugaaagcugugugcuagcuuagaaaucaaaggggguguaaaagcacacauucuuuguuuuauggguuuuucucuuuuuagaggacagagggacaaccacacgaggcugccagacuccugucaccucuacaguccccuuagaaagccagaguuugcacagauuguggguauaacuccuguccccuuagguguucuaucuccgaccuugaucuuugccaaaauguguguaugcagaacuauuucuguguauuuuccuugacacccgucuuagcaccuguguaguuuguauccgguuagaaaccuuuucuauggaaagcucaguaauucuuauuaagagauugcuauuguucauguaaaacaugaaaacaaccaaguagagccguguguggaugagggcccacucagcacugugcuugcuugaggggcucucggcaggaagucuccuucugacccauauccgcugaccacaccucuccagcaagugccucugccgcuggccagcucaagguuugcccaccuggccccgaagcaccguguuucggaguugggaggaacuguuuggcauuguuggcagaaggugugauugccuggagcagcagccuuuuaaauucuggagacccuguaguccuuuguaucucagaccuuuacugauguaccaggucccagauucuguggcaggggaugggguggggugugcuugccagacgaaauuuaaauuaucuaucuuuugggaagugugugcuuuccuggaggucacugugaaaacaaacaaacaaaucaggaccguuaaccccuuaaugcccacuuaaacucaauuucauguuaggacucuuguuuaaaaccauuuguggccuguauguguucauccugguuagagagaaagcuuuaugacgcuguuucuguucaacacauuaaccagcuguggaacagcccuuuuugcacgacaggcagggcacuucaggauucgcagagagacucgugugguuuggaagugguauuuccuaugaaagccucucacguugcuuguaaagcuaaucuaauuaaaaagauguauaaauguucuugaaaaaaauca

SEQ ID NO: 12431 - RNA, 68780 nt, Mus musculus
ccagucuagacugucacuaucagucuuuguaguauuuacgggugcgaggauucugacauucugcuaacuucucuuagcuuuacuagagcaaccugcaaccagaacucgcugggauuguagagaaccuagggagccauagagacugucgcugcaggagaacgaguaagaaugggcuacgucuuagccccagguuuuuggugaggacuguaaagcaaacuuccuaggaugucuagguuucaacaaacauaagaaguccggagauagcgggaguccuuuuuuucagcaccggccacaccaguuccgggucucccauucaagaagaaacacgaaaaaaagucucucgaauaacucccaguucucagaccagaccagcuugcuccagcuacuucuuccuguccucaccccaccgcgaccgggacagcgcgacuaccacccuuccucugcgucuggguggaggguaaggacaggagcugaccaagaccgccccucccaaccaggagguggagaucccacggguccugcgacucuacacccacuuccuccucccucugccccuauaucaccggcacccccuccuccuucccuuuucccuccucccaggagacaggggaggagaaaaggggagcuugggucgucaugacugagcugcaggcaaaggauccgcagguucuccacacgucuggcgcuucgcccucccccccacacaucgggucccccuugcuugcacgcuuggacucaggucccuuccaagggagccagcacucggacgugucgucuguagucucgccuauaccgaucucccuggacgggcugcuuuuuccucgguccugccggggucccgagcucccagacggaaagacaggggaccagcagucgcuguccgacguggagggagcuuucucugggguagaagccacucauagggaaggaggcagaaauuccagagccccggagaaggacagcagacucuuagacagugucuuagacucguuguugacucccuccgggaccgaacagagucacgccagcccuccagccugcgaggccaucacuuccuggugucucuuugggccagagcuuccagaagacccccgcagugucccugcuaccaaaggguuguuguccccgcucaugagucggccagagaucaaggcuggcgacagcuccgggacaggagcaggacagaaggugcugcccaaaggacugucaccacccaggcagcuguugcucccuaccucggggagugcucacuggcccggggcaggggugaagccguccccgcagccagcugcaggggagguggaagaggacaguggccuggagaccgagggcucugcagcuccgcuucuaaagagcaaaccucgagcacuggaaggcaccggcagcggaggaggagucgcagccaacgcggccucagcggccccaggcggugucacucuggucccaaaggaagauucacgguuuucugcuccuagggucuccuuggagcaagacucucccauugcccccgggcgcuccccacuggccaccacagugguggauuucauccaugugcccauccugccucugaaccacgcacuccuggccgcccgcacccggcagcugcuggagggggacagcuacgacggcggggccacagcccagggcccuuuugccccgccuaggggcucgcccuccgcgccauccccgccggugcccugcggugacuucccagacugcaccuacccucuggaaggcgaccccaaagaggacguguucccucuuuacggcgacuuccagacgccuggcuugaagaucaaggaggaggaggagggcgcggaugcugcugugcgcucgccgcgccccuaccugucggcuggagccagcuccuccaccuucccagacuucccgcuggcacccgcgccgcagcgagcgccauccuccaggcccggagaagcggcgguggccggcggacccagcagcgccgcggugucgccagcguccuccuccggcuccgcgcuggagugcauccuguacaaagcggagggcgcgccgcccacgcaggguucguucgcgccacugccgugcaagcccccagccgccggcuccugccuacuaccccgggacagccugccggccgccccggccaccgccgcagcacccgccaucuaccagccgcucggccucaaugggcucccgcagcugggcuaccaggccgcggugcucaaggacagccugccccaggucuacccgccauaccuuaacuaccugaggugagcacuugcaggcagcccugcccugcuccauucccccaucaucucuggguggcaggauggccgcgggggcuuguggagcuggucuuuggagacccaacaggcauuguccauugccucccuuuuucuuacauuuguguguguggugcgggcauaaaagggagugcagauauaccauuuuauuguguaccauucucccaaacauugccugcaaacuuccugaagccugagcacccagguucaaacccugaggccucgcucuaagaucuuugauugugcugaggauuuguuggggacuucauuaaauacuuuguaagaaggacacccccccccuccguguguguguguguguguguguguguguguguguguguguguguguguguuggggaggcugagauguaaaagccaguuuuucuggaagggguggggcuuaacuguggcuucagaacugaaaucagaaagcccuuagggaucuaucugcacaggucucuggccugauuuuccuaggaacaucaagagugugguaaacugcaggagggaaguguuugaaugguggguuuaaacaacaauugcaggcgaccagagcauggaacgcucacacuggugcagacaacuuuacuccccucauauaugucuucaagagcauuuuccccacauacugaaguaauggacuugaaaaggaaaaaacaugcucaaguuuuagagucucagaugcagugacuaggcaaaauaaugucaauguguuaacaaugccuugaagucacaacuauauuuauauguuggagcaaucaacuguuccagaguuuucaaaccggaaccagugcuaauuccaguuaaauuccuaacgcucagccguguuuguugugacccagcauugaggaaggaggucauauuucaucugccaaaggcaaaaucacuucuguauaaggagcucuuuuuaaaggaguguuucuagcauuugugaacauggaaggaugcaccuguuccccuuuuauuaauguuaaugauuuguguguucaaggaauccauuauagggaguuuaagauaucaagcaccaaguuuagugcacugaaauucaaauauguguguauacguauguauguguauauguguguaugcauguaaguauauauguauuuuguauguuuaugguccuaggagcuggggauguagaucaguuccuagaaacuuugcuuaccuaccauacacugagcccagaguucuguccccagcaccuuagaaacugggaaugguggcaaaugcuucuguuuccagcacuuggaagcugggaauucaugaguucaaggccaggcuuugauauggaacaaguuuaaagucaacccaauuacaugaggagaccuuuagcaaaaaacuaaaacacaaacaaaaaaccuauaaauaaauacuaugauucuauuuuaaagauacucauagauaccaguuuagaaaagcuuucuucaucagauagcaguguaccuaaaacuaaacagaaucuguuugcauuucaaggccagauucagaagccagccagagcccacaguauggcuuugauuccuuaccucagaagaucugcuuaaucugcggggaugaagcaucuggcugucacuauggcgugcuuaccugugggagcugcaaggucuucuuuaagagggcaauggaagguaggaagcuuccuccucauucucccuucccucucauugucauggagaccauccaauccuuuauccacuuaguuaugcucguuucuaagaaaugauggccuuucuuuccaccugaaauuaugaugcucuuuuaaccaguugcauugccuacaguacccaagagugaacgugguuugcuauuauaaguguaugcugugacucacacuuucaacaguacucaagccaugacacuggcgagagauucucuuccucucaacagcuuuacucuagugauguguucauauauaucuccugaauaaacaaaacacuggguuuauaguaaucaaagcuacauaugugugcauauuuguauaugugugcauacauuuacauacauaugucacacguucacagaauacauacaaauauaugggauauauauacauauguauauauauguauguauauauauaucauauaauacaauugcaaauuaucuacauuuguccuuuccauaaaucauuuugguauaauauugauauaauaauuuuaaacaacaguuuagugaguagaucuuuuuguguagcauagcuucauguguaugagaggacaggaauaauugcuuggaauaaaugaacaaucugaauuucaaaguaacacgguuuuccugagacuaucaugcuuucaguaaaaugugcacuuuuuuguuuuuguuuuuguuuuuuuuucaagacaggguuucucuguauagcccuggcuguccuggaacucacucuguagaccaggcuggccucgaacucagaaauccaccugccucugccuccuaagugcugggauuaaaggugugugcccccaugcccagcuaagaacauuuuauuuacauacuuagccaaugguuuugcaauaguuuguaggguaucuuucagacuuuaccuuccauagaaacauuuuaaaauuccuuccaccucaguaaacaccaagccaaacacguuugccuuugaagguaagaaugcauuuacagaugugucacaguuuguugcuggagagaaagauauuuucuaagaagcugacauggagugcagagauggcgugugggcugaaggucagcaguaggcucuccugguuucuuggguucuaaguucuaacagccccccccucucauaagcagcccauaaggggcuggaacauucauacuucagagacuuccagggaggcucuucuggaaauuugugugcuuuguuuacuuuuagaggcuuguuuugguuuugguuuugguucugacuaaguaacuaaauucuuaagugauauggacugcaugcagcuucaaggagcugaguucacugugcaccauccaagagcacaugugagaauggggcaagugggaggacuuuaugaaucuggacucauuaguggagucuugacuccuuucauguuaguauuucuuguauucuauaguaucccuagaacacuguaaacuuauaaucgaccagccccuuuagaaucuuccaaaggccaauuauucuauccuacuuccaguuuacuguuaagcaagucucaaagucauaaauauggguaauuggcagcugauuccuaguagccauauauauuaaguggauauauauuaaauggauacacaguaaguggauacauauuaaauggauacauauuaaguggauauauauuaaauggauacacaguaaguggauacauauuaaauggauacauauuaaguggauauauuaaauggauacacacuagguggauacauauuaaauagauacauauuaaauggaugcucaagggcaaccgaggugucugaguacugaaggaaggugacuaaucacaugcucaggaaagacagaguuagguugcuaggguauggaugaauugagaaucagugagcaaaugcaagugaauagaauagacacacccuucuggggguucccaggaaugagagguaaucagaggacguuagugacugggaagaugcuguaacugagcuggguugugaauuaguucaaaguagagggcugcugugcagauggcaggaggaccagaggggaauggcagcugaguuaaccgaaccaaugaugugacugaccaccuuggaauuacaaagugcuucuuacaauccagugccuguuucuuagguuccacuggacucaucucaucuccacaacagaggcaaguuaguacucacucuuuacucagaggaaauauagcuguccucaugacaguuaggaaguggugaagucaggauucaaacccggauggugcgcuccaggucucagcccucaaccacagugcuuccuuucucauaauaggaaacacaguuaaacauguuugccaagugaggaaacaucuagaaugcuaaauaugaauauuaagaaagaauguaaagaacagaauaugugauagaaagauauagaucacauuagcuucacacuuggugaagcacccugagaaaaggcucauccaggugccaagucaguguucugaguguucuuuccuagggugagagugagagacacagucaacuagcacaacugguuuuaauugguucuacugguuuuauguggaagaguaagaagagggagaaaaaacauaacauucaggaaauagagaacacaaaugaggagaaagucaauucaguugguugaaaagccuauugcacuccuuugacaagacacuggcagagucagugugagccaggacauggucaggaauuacacaaugucuaucagaggugaaaauagcacuuuccaauucuacuaauuuaggccagcaauuuggucuugugggggacaaagacauuuuuauuggcucacuuuaauaugcauaaugaccagaaaacuauuagacauucaguaaaucaauauuuugcucuguaaacuggucaucauaacuaauuaugcuacauucuuauuuggaugggucacugugugacaacauugguaggagagacauugaaugcaguaugauuaaacaaauauuauaauagaacuguauuauuuauaauacucaagacugcaacaugaaugcauuuguaauuguuuuguuauauuauaacacuuucauuuggguauuaauuauuccugaauuaguuaccugaagucccuuagcucacacacuaauguacugaguaccuguccuacccaggcccuaggcuaaguacaggagggaggucaauaaagcagaauauacacugcuggccacugcuugagaggugacaugcagaaaaggauaugcuaccaguagucacaauuaacuacauauaugcuaaaugguuuaugcgugcagugcuuuacugccugaagcacuggcccuugucagaaacaaugggguuuagaaaacuuuuauaggagaauugucauggguaggccaugguaaaaacaggacagaaaugaaauugcuuuuauuuuauuaagaacguguuucuuucacuuggugaugauaauugagcaucuaaacaagacugacuuagaaccagacuuucccacaauaucauuucaugaagagaaauaagagcaggcuguccccuaacagcugcguagguucaggaaugcuuugucaucuguaguccacaaaauuccccaacaaucuccuccgcuguaauuuaugugauuaacauuugggggcuugaaauaauucaccaaucaucguauuugauuuaaugugaucucagaacguuuacccugggcaguuuucccauuauccuaaaaauaaauguguagucauucccuggacuucauuucaaaacucuacagccaguuucuucucaagcaggaggucuuucugucuaacgcugaaaauaaaugaacauagguagagcuugacacacugaaguaaggaggaaguagaaagaugcauuguguggcauauguuugacagugccauuaagaacuguaugccauuaacaccacuguacugaggaaagcagagcuaucagacauccauauuaaccauggcagcuguguccgcgagcacugaggccagaauuucuccuaacugcccaaggaacaugacaguguaauguacuuuaaaaaauuaaaucauuacugguaaagcuuaaguccucaugcucaacacuguuaaucuccuaccauggauucuucagugcaucuauguuaaugcuuuacaauaugugcuauaauaugaggagcuguuuaaaacauaagcaguaucauuuacuagaauguaugugccauuaaaucauuaucuauaaugcuucuuuucaucuaaugauguguauacacuugcauaugcauguguacaucuggacaugugugugugcuucuuaugaauguguauguacauaaguguaccuguaugggagugggggaaucauguguguaugcauucaaauguauguguuugugcauguguuuguauacauguaugucuaagucauacucuauugcugugaaaagacacaaugaauauggcagcucaauaaagguaagcacuuaauuuggacuugcuuaugguuucagagguuuaggccauuauucucaugguggggagcauggcagcacacagacagacaugacagcugagaguucaauaucuggaucugaaggcagcaggaagagagagauacuggaccugcuugagcaucucaaacccuacaguuccugccccaacaaggacucaccuacuccaacaaggcuauacauccuaauuccuuccaaguagugacaucccugaugacuaagcauucaaagauaugcgccucugugagcuaugccuauucaugcuaccacaaugugugugcaugcuuguauucauucauaugugaauggcauuuacaugcuuauauacauauauauuuguguguacacauaugcauacugguguguguaccacuguguguccauacauguguaugccuuacacauacauuuguauauaugcuuguguguacuguacguaugcauacgugcaugugggggauacaugugugaguggauugguguaguucuaacuugcucuuugaaacuuucucuaaugauuuagaauuaaaauucuucucuccaagcauugcuggaguuagcauuucuugugcuugguaaaugccugccucauucucuggguuuaaguccuuugaugaagcuccuaaaacaucaaauccuccuacugccaacaugacuucauucauuuuauaggugucuauuuauguuacauuuaagaaaaaauuguauuaggacuacagagauaaauauguauguagggccugccuucaaucacugcaaacguaggaagugaaaacucaaaugcaaaucuagccuauucaauguacaaaaaacuacaaugcauguaugaaugaacacauaaaagcauacauauguauguauacacucaugaaccuccacugccauauagacacacaaauguacacagaagcauucacacauauguauacaugcacaugcauacacaugugcauaugcacaacauuauaugaaaagaauaugagaauguucuggugugggcauccuagaacuacagaagacaacacuacauugcagaaggucaggacggauguaggauguccaacuaaaauaucugaugcuacacaaagggaucacucaucuaacaaacccugacuggccuugacuauaucugggcacuugucuaacacauguaacuucuuuaugaauacaauaaaguagagauacuauauuauaucuaaauuuuaccaagaaaugcacaaagaauuaccacuaccccuuaagucugacuguaaugucuccgucuuuuaacuccuaccuccccuaaugucuuaccagauuauuuuggauuugaauaaagauuaauuaugucuuuuagaaguaagcaugguuucuaccuggagacuggcuccuuaacacugucccaauccuuucucugcucagaguggcucugcacugugcuuuucuuugauuuauguuuccacugcaaaguuuauauaaacaaauuauuauaaaccaacacacuaauacacacacacacacacacacaucuucuaugacaggaaauucuuacgucucaauugagugauugugguggcagaacaauuccuuggcaggucuuuuuaugugaggaaaucuuugacaucugaaaaaagauaggcgaacaccauuuggugaagauuaaacaccaccugaaaaccaugccugguauauauggcugacacucuuuucaucuccaaugaucuuaagacagacuuuaauguagacacauuggucacuuuuuuuugguuuuaaaacccugucaucauuuaaugcauuugaaaaucaccuuugaaagugguuguuuacgccuguaauuuaagccuuaggagacugacacaggaaagccguggguuuaaagacauccuaaucuacacagaaggcccuguuuucuagaagaaguaagucauauauucugugcuggauccacagcuaccuaacaacauauggaagggaacaugaauccaaauucuacuguugcuggauauguuugugcauuuaaauauagaugcacaccccauuuaauuucucuuugggaaguuugucccauuucagugaacuguucuauguuauuuuauacugcgaugauccuuacaaagucuuucucguuucuucuucuuuuuucacuuuaucuucuacagaacaaagaaacaaaauuccuuuccaaaaaguuuuagcauauuacuaauuuaguuuuaaauucagcaacugcugcuacaucaucuguuauucccuugacuuauuuucaugacuaugcauuuuucuggaggcacauuaugcaauauaauaacaucuucuacaaaaaaucauacauagacuuaccacauucuuuacuguuuugcaaccaagggacuuauacaacuggccaaacacuuagugaauaugaaucacugacccaaagcuguucucaaauaucuguagacuauaugauagaaagaauagaaugguuaucauuaauuuauaaaugaaggaacucuccuugaucucuuuccguggacuaaugcaugguuagccaucagaaccagauuuugaggcagguucucuuuccuccauauaaaauggcaucgaggaacagcagagcugauucccucuaggagcccugcgauuguagaucagccaaauaccaccucuguagcagaagacacuaucauugguuuuaaggacuguggggaaguggccaguuaacacacagaucuguagugugguggaauggagacuuggagagccauagucaguaaaaguggaggagaguaaaaacggucaacauuacugucuuucuaugguagaaaccauacuuuggauuugugucuucuauccuucacaacauccuucaauagaauuuaccauuccuacuucagagguaaauaggccagggcucagauguugaucaauuuccccaaauaagagagaacauuggaagagaacacacauuucaucuuacaaaacuuuaugucuuuauugaagcagaacuuaggagacaucaaaacuaugucacaguucaucuuaugcuauuguuaacccaguccucaaugacuucagcuagcuucuccccaaaaaggcaaaggaaaggcaaguugaguagagcaaaagaagagauccccaaggaguuaauuuaccaaucuucccaggugaauggcagaacagaaacuaagcagaaguguccuacuguccgggagucaagaacauuuuccauuuguuuggucauagccugugacuguggcugagagcagaugcauuuagguuccuuuucagugggcuccaguuuuuccaaguggagguggccuguuucuacaaagaaguauauggggaugagugaugaauuaaugaaguugacaugucaauacaagauauuguucuaauacuuguugauucuuauacugugaagaauaucuuauggaugugacugcaaagagaugugaggugcuugaaggaugcaaacagagauuucaagcuuagguuagucgucacaugacauggaauaacaugacugaaaugacaauaugaagaagauccuccuucagagaagugaaccauuucgaagggcagcuugggccuugcaggagccauuguagguaauuuaaacagaaggcagaggagaaccauuagaauguugaugagugugaugcuaaacacucuuucaccccacucagccauuucuucuuugcauuguacuuaaaauagcuuuacauuuuaaaggcaagcuuugugugucucuugauagaagaauaugugcucuaaaaugaccuuuuccaugacccgcccaggagacuguugccuggaagauacugagcuaacagcacauauaauguggcuuugagauaaaaauuauauuuuugacagaaaaaaguaacucuccauuaggagccaucuuuguuguacagagaagguuuuaaaaagcaaaagugccuggccaugauuuccuaagauagaggcacuccaaaaugucaagggucccagaguuacaugcuuaaacacuuguaaacagauauuuuagauggcuaaucugccuaagaguuucaccacuuagguuaugagaagguuuaacaagaguggcauuuaugaauacuuccuaagugccaggaacuuucucaggcaaacuguggaaauggcagugcugagacaggagcuggagccuucucuucuaaccaugaugacaugucuuguccaucuguaaugucuacugcucaucagcauuuugauaaaaaccuccugacgucaaggaaggaacauguuaguuaccugaauuuuugagaagaaaaauucauuuuggggguaagagguauuaaaaauauauuaacuaaggaucuuucccugugagcagaccaucaagucuucacauugucugguagguuccuugcccucccuuuccuacuccuccccgccucuccccucuccuccccuucccuuccuucccuuuccuucccuccccuuugcuucccuucccuugccuuccacuuuuccccuuucaugucuuuccccacagagauggcuaacugcuaaauaaaauguaaaaugcugggaaguguuuccaaguagguuucuguaaaugacuuggccccacauucagcaugugucuaaaaaggucucaucuguucuaacgcccugacugaccacauugcuguaguccccaguagcuguuauacuugagguuuauugcaggagcuggaaguggucuuaucucuacccuugcuuccagguucuguucccauuguagaugccaaagucaugcuaauuaaacagaacucagaacacaccaucucucuccucaagccaucccacuccugugcacucugcuucugcugaaagcagucacagcucugaugguggcugccugucugucuggcagucucuuuuguacauucugcccauacccugccuggaagccucacaggcagccauggaccaacccugcauggagucucaguaucuuuguuuuguuuuguuuuguuuuguuuuguuuuguuuuguuuuguuuuauuuuguuuuguuuuuuguuuuuuuguuuuguugagacaggguuucucuguguagcccuggcuguccuggaacacacucuguagaccaggcuggccuugaacucagaaaucugccugccucugccucugccuccuaagugcugggauuaaagucaggcaccaccacugcccagcgagucucaggauguugauacuuagcucucucuucucugguuuccucucuacauuucccucucacucagacucauuuaggauaccagcuuggaugcaugaccugaagugugucaaguuuuggugaccaccaauaucucauuccauguucuccucucugccaugcuaacagguuauauauuuuaacagaguuuccagaaagaagcacacuagaccuuagaaaaacauacuuaauaugcauuuccugggagaaacagaagaaaaauguaaagaauacacuucagcuuacuauaaaugagaacagcaucugagaaaaaagaauuaaugucagaaacaaagaacuggacgagguuaaaaaagguacuuagauaagagaaauucaacaguaagguccaaugaugaaauuuaaaucuauauggaagcuagagaguucagaaggugaccccaacuaugcagaccucagagugaagguguuacuucagaauggucagaaaauagcaaacugauggaaauuaugugauaaguuauugcuuuugcuacacaucagucauugugagagccucuuacuuagcuccuuucaucaauacagaggcauguauaacauuuaucuucaucucuaacugcacaugcaaaauagacugaacagauaauuucccuaugggguagauacuguucaaagugaauuugcguaaaacucuauugcgcuguaaugaaugugguguguuugcuuuguaguuagaaaacaaaucaggugaacagaaaauggguauuuaacucaauaaaaaauaggucucuggaggagauaaugagaaccaacuccaguaaaagcauuuaaugguuacagaaaauaaacuucuggggauaaaaaauuauacaggcacauaguagauagucaauaaguauuugcuuauugaaccaucagaauuacuacccagugagcauuuacugccgaugaggugcggaagguuuuauuuacaucacuguacacugaaguccuguuuuauagauaaggaaaggaaagcaccaggagauuaaaugaguuguucaaggccaaguucuaauagguggaaacuuggauagcaaaaguaaguuuaauagcaauauaaaaauuguuuuuaguagaucaaagagacucagagcguccuagaaacauuagcauuauugagaccuccaaagaucuuguguauauauggauuauacauaccuacuauauuagaaacaaaaacugacaucacagaaauugaaaaaauggcucagugguuaugagcacaugcuaggguaggaguuuagauacaagcacccucaugccuggcaacucacaaauagucugugugugugugugugugugucugcaugucugugugugugucugcaugucucugugugugugugugugucuaugucucucucucucucucucucucugucucucucucucucucucucucucucugugugugugugugugugugugugcgcgugucugugcguguguaugccagguaccuguggaggucagaagagagcacucacuccccuggaguuauacuuauaggugguugugagucaccaaugugggugcugagagccccuguccgauccucuaggagagcaagaaucacucuuaagcucugagccaucucuucagccccaugauuuuguacauucugaaauucugcuuuccucauuucaaacauaauaauccauuagauauuggguuuuuuuuuucugaacaaagaauccaauggcaaguaaaauugugcuuacaagaaucuuugauuagcagcaugauucuuuuguucauguuucaugaaucucuggcaggauacaugcacaacaaauccuacuuguuucauauuaaagugagauuaagauaugcuuguaagcugcaagaagaauggcauuguuuuacaaguuuguaagucacuuuaauauuggccuucauaaaagacugauagagucuccuuucugcaauuacauccaaucugcuguuuuggcugaagucuauaaagaggugguuccacaaagacacaaaguuguaaaauggacaaguguuuugauggccuuuuuagacauuacaaggagugguuauuucuuuggacacagcaaaaggaugcuuuuccacuuuuauuguccuuucugauuuuaucuccuacaaaucacucuccuguuucuuucuuccaaaaggaaauuuucuauuuuuaaaguacaauuuauaauggaagccuugagcugggcaaguuuuuuaauuuaauuaucaaauuccaaagugaguaguuuauaucuuaaaaucuagaauuuuccagugaguuuugugucuuucucucauuuguuccuuuuaacauuaucaugaucuuuauacauucaaugugcuuuaaucauaugaguuuauuuaaauuauguuuagccacugucuuaguucauuuccuguugcuaacaacauaauaccacaggcuggaugaauuauaaggaaagugauuuguuucuagaucaugguucugguccaaguugaggggacacaccuaauaccuucuugguuucugaguccugagacaaagagcuaaacugaguuccagaaaacuggauguuauaguagagacccucuccugaaguaauccaugaaaucacuauucucuuaagucuugaauggcaugcacagguuagcccacuguuaugacaaagcucuauucagccaucccaucugcucccaccucuucaugucucucuaugauauuaaauaucagcauaaauucuggagggcagaaacagucuucacgccauagcaccagcauggcuuuagcacaguuuucucagacuuccauaaaaaucauuuuuuuuuuuugcuguaaaagagcaucccauuuguuugccuauuauuucaucaauaauuucuccaaugacugcagguuauuuuggaugauaagauuagauuugaauaaucugauuccuaguaucuguuguagccaacacuggacagaaguagaaaauacaguuuuugaaaaguuauggggccaaaacuuaauaccauuauuucacaaacaguuguacagauauuuggauaccacaaaguuuuucauugugagggauuuucuauccauuguaggaugcuuggcagagugucagaacccuucuccauaagcaccuacuuaaguuuaucaaucaaaauucuguucauuuauuguggaauaccuugcagaggguugaggaaaaucaacucuagcugcuccuguuucuguuaagagcauauaaagcuuuuaaauucuacaaaauaugcuuuaguuaaaaauaauuugcaaguaucuauauuucuaguagcauugaaauaaacugcauuguacuaaccaguacaauguagaguuguaacuaaauaacugacagaaugacuuaaagagagagugguuuacuuuggcucagaguuucagagggcucuguacauggaaauugggcccaaguugagccccaaauuauggaagaauuuuggaggaauaagccauucuucaccuugcagaaacaaaguagaaaaggacaaaaaaaguccugcauagccguccaagggaaggcuccagccacccacuacauacagcugcacugcucuauguccaacgauuuauuuugucuggguuuuaguccuagaauuaaguuugccuucauuggccuuccugugcugugucuucuauuuucaugguugcgguagccuugugaaagucuacucuuuaagcagaguucaguuuuuaguguucucuuuaagccuucuuaguuuaccuguuuuuuuuccauuagaaauuuuauucauucaauauguauuuaaucauacuuuuucucccugucucagauccucuucaucuuucuaccuauccaaccuuaugcucucuuucuucaccucucuugcuuucucuugcuuugucaagcacacacacacgaaaaacaaaauaaauaaguaaaaaauauaguaagacaaaaaggauacugaaacaaaaucaacaacaacaagaugaagcaaaaucccacagaaaaaacauggaguucgcuuuguguugaucaacuauuccugggcauggagccugcuuuggggugagguugauauacccagugacacucauccaugggcuuuaaagcucaguucuuagagccuaggcuccacauaugccuuuugagauuauaucucugcccuuuucuuucuccauuucuggguuauagaaauugagucuuuauaaaaaaguagcccaaauuaauaagcaauaugcuuauauuguauuuuaucuaagacuucuguguaucuguggugggaagacauucuucaugugcaccaauucauggcaccucaguuucuaccuccugggucauaguuccugagauauacuacacuuacuuuuuuuuuuuuugguuuuucgagacaggguuucucuguguagcccuggcuguccuggaacucacuuuguagaccagacugaccucgaacucagaaauccgccugccucugcuucccaagugcugggauuaaaggcaugugccaucaugcccggcuacuacacuuacucuuauagauucauuucuguguaguuucuucugauuuacaaaagaaaaccaugauacccuguaaauucuccuauacacaaacgacauuuggucacuugugcucuuacuaaaaggcagcucaaaugcuagaguaauggcucaauguuuaggaccaugcacucuucuuacaaaggauauaaguuugguuccaagcauccaugucaggaagcuuguaacugccuagaacuccagcuccuggaaucuggcacucauggcuuccaagggcaguucuacucaugugggcauccuucuuccuuacucagauaauccuaaccaaaaaaacaaaaaacaaaaaacaaaaaucaaaaacaaaaacaaaaaacaaaaaaacaaaacaaaacaaaaaaccucuucaaaaaugaccaacaccauacagacuuuuuuuuuuacuuuauaggagauucuucuucuaauuuacaguguaaaaguuuuauuucaguuaaaacggaaccaugcaacauaauuaaaauauuaugaauaaaaauucacuagacagugaaguuaccuagucacauuuuuuuaaauaauaugaauguuuuuaaauaauuaaaacagcagggaguuuaauauagggagaaguuagaaacaauauguaagugcaaauacucagccacacacacacacacacacacacacacacacacacacacacacacacacacacacacaugcaggcaugcacacaugcacacacaggguaccuaaugcaguugcuaauucccuuugacuuagaaggucuuauuucccucuggcucuuauauucuuucugccuccucuuucauggguuuccugagcucugaggggaggaauuugauggggacauuuaaaucugagugucucaaggucucugacucucuauguaauaucuggcuaugggucucuguauuuguuucuguauguugcaggaggaggccucucuggugauagaugaacuaggcacugaaaaaaaauacagaggaauaucauuaggggacauuuuaucucuacauuauuuuuccuuuuuuagaccaguauuaugugggauuuccauaaucauugggcugucuagucuuagguucuugaucacacaaucagugcuacguauggcuacaucugguagauugggcccuaaaucaaauuaguuauugguuaguuacuuccacaaguuuugugucaccauugccucaacauaucaggcaguauacccuuguaguaaagggguuugugguugccuugguguuuauguuacuuuuuuuauugcacgcagauuacuuuccuguaccaaaggagcauggcaugaaggcucuauguagacacuagcucacuaucauguucaauauagguauugucuucagcaauguguccuugcuaacuguggagagcaacccuauagcacuggcaacagacuguguuguuuggggauucccacuagucccuuuggccaacaacuuaauuagaugcaaccuaaucccaguacugggagcuuggcugggugacaagagauggccaauggggauucugucucccccaauacuuggagauuuuauuuagauuaucuucaugcauguauauauuuuaagaaguuucuacugcauuagguugccauacuaccccucaaaugccccuuaauuuuagcugucucuucccauagucucucccacaacuccccauggccuccaacuccccacuuuugugaaaugagugggucucugauuccagugccuucuuuuccaucuguugguuugacuuguccaacugugaugugauaguuuuuguuuuaucuuacuauauuuuauuuuguauuuuaaaaaaaaugaaugaaugaaugaaugaaugaaugaaugaaugaaaaccuagcuacaagaguaaaaguugacaacugaacugccauuuauacaugcugggagagggaaaaucuguuuucucuauuaguguggacacugguuauaucagucacgcaaagacaguccuuauguucaggaguaguugacuaacacacauggaucccauguacuucagugugguuuucuuuugugacagguuuguuuuuucuuuuuccuuuucguguaugguuuuauuuuguugucuuaguuggggguuguugcuguauaggggguuugagagagaacugaaaucugaguguguuggcaggagcagaggcuuuggagggacuugagggcaggggaaauaugaucagaguauauuuaaauuuaaaaguuguuuuaaacaagaaaaauauaauuuaaaaaucaccauggcaaaaaaacgaaaaggauguuugagauaucugcuaugaucuaugcugauagaaugaaugauuuuaaaaugacaaaguaaauacauagucaacugugaaaaauaaaagccagaaagauacccgagaaauccaaaguuguuaucucacuuccaugugcauguacccacccaacaccaauacacacauacacagaugcacacauguacacacacagacaaacacacacaugcacacacacacaugcaucugcacacacaaacacacacauacacagacacucaugcaugcacacaugcaugcacacaugcacuuacagacaugcacacacauacacacacauaugcauacacauacacacaaaugcacacauguguauucuuauauuguacucaugaauuauauuguaauucaugguauaguauuauaaaaggcaguggguuauauauaaaaugguauauaauaaaaaugcuuggagaggaaaaaauaaccaucuuaauuuacuaugccuaacaauacauucaauuguauaggucacaccccuguguauaacuauauucggauggccauaugggaacaauaagcauuaagaugcauauauuuauccaacaaauguuuaucaacauuuuauuagauaaauguguuaaagcauuaaaauucagcuuccaccaugaaaaauaggcaugcaauuguaugaacaagcauuuggccuauagaaaaacaccaaagguuuucugggaucauucagguuagacuauauggaaaaggauaagcagauccuuaaaggaugagucagaggagggaagggagucaagaagugugggagacacuuguaagauagggauaguuagcaugcuagacucugaagaacacaaaaagauauacauaauuuaaaugaaaagggggggcugagguagcauaaggacccagccauguaugauggugugagccuuuaaucacagugcuggagaggcagagacaaauggcuccaggagcuuacuagaccagccaaccuaguauauuaggugagcaccaggacucagagggagaucuuuuguaagacacuaaagguugacuuauagccuucaacugcacccacugauacacacacauacacacacacacacacacacacacacacacacacacacacacacaaauaaauacaaaggaaaaacauaauauaauguaauaguugcuauuucuucccuucuuuucccauucugaaauagaugauaaauuuccccaggagaaauaucauguugugucauacaauucaggaaauucuuccucaaguuucaacauagacaggugcuguaaacauuaauugggagcuagacagcaucuccuauugggguuaucauuaugacaugcaugugguuaacuccuguuggagaauugugcggguagauagcuaaauaguuuaauagauugccuuguuauagacaugcagaauaaccauguaauauuggaccaaggcaaaguuauguuguacaagaaacaagcaaauagauguagcaaaugcuacaucuuaaaaccugcauauaagcugggaaagauuguuauuagaaaaguggaggcaacagauguuuuacuggacugucauccccaaaguuuaagacuguauagauuuccauacuaacacuggaacaaauccaguccauuuguucuugacuuuuuaaaaccuaaacaugcacccagguaccuaaagaaaugauaccuguaaugaagucccuuacauucuuaaugccuggaaguucugggcaguuauugagcuacagaggcagugucugggcuccaugcuacauucauaggcaacucuuguugggacugcgugagugccauguuccuuuagccaaacagacuacauggagacuaaccuguaacuguaccuuaggggaugguguuucugcuuccaaguucugauggcccagcacuuaguugcaaagauacucaucauuagaaugaacugagcuuccaggcccuauggauccacuaauaccauuugugcauccaguccagucuucuguaguugccauuagaguggcacauuagaggaaauguggguuaugucaacccauuaagauuguaacuucaugucagugugcucaacuaucagaaugccccuugccacuuaaaauuaaaugcuggacuacccagcucuuuaccugccaugacauaaaaauuguauucaguuuaauagucauggcuuccuuauuuagauguaaacuucuguuuaaauguuuuuagcacucacuauuaucucauucagacccugaacucaaaggugaggucucucucauuugcagcauacagugguggccagcaaaaggcaggcuauaaggaccaugagccugaugcucuguguagaccuuuugacucugagucuuuauaacuugugaauaacuuguacuuuuucauuuuuagggcagcauaacuauuuaugugcuggaagaaaugacugcauuguugauaaaauucgcagaaaaaacugcccagcaugucgucugagaaaguguugucaggcuggcaugguccuuggagguaauguugauguuuucaucaauaguauaguguggcuugcacuuuacuauaacacugagucagaaggaucucaauauuuuuauuuauuuauugauuuauugauugauugauugauugauuuauucacuuugcaucuuaaucacagcaucucuccccuccuuccucccagacucacccuuacaaauccaucucacauuacccccaucccuuuuccucagagaaggggcaguccuccuuggguaccacccuguccugggacauccaaucuuagcaagacuaagcacauccucucccauugagguccaaccagauauuaggggaagggaauacaauggcagagucagagacagccccuucucugcuucaauucuuagggggccgacauaaagcccaagcugcacaucugcugcaaaugaguagggagcuuaagucuagccacuacaugcucuuugguugcuauuucagucucugugagccaauaugggcccagguuaguugacucuguaggucuucuugugguguccuugaccuccauggcucccucaauccuaccccccuacucuucaauaagacuucaaaguucuacaugguguuuugguuaugguauauggguuuauuucuggaaagcagcugugcaucuguuuugaucagccacuggauaaagccucucaagggauagguauguuagguuccugacugcaggcauagcagaguaucauuaagugucagggguuggcucuugcuagucucagacauguuccccaccaauuuuuguucucacacccagcccucucccauccucuccccacaccugauucccauccuuguucuccuccuuaccuccucccucauccuggucccuuccuucacccaccucugaugucuauuuuauuuucccuucugagugggauucacacauccucccuugggucuucuuuauuacucaguuucuuugguugcaacaugguuauccuguacuuuauggcuaaugucuacuuagauguaagugcauaccaugggugucuuucugggucuggguuacgucacuugaguugguauuuucuaguuccauccauuuagcugaaaauuucaugaugucuuugcuuuucauaucugaguaguuuuucaucguguaaauauaccacauuuucuuuauccauucuucaguagagggacauguggguuguuucuguacauguccuugcuauuaugaaaaaagcugcuacaaacauaauugagcaaguauccuugugguauaauagagcaucuuuugguuauauacccaggagugauauagcugggucuuggaauagaacuaauccaaauuuucugaaaaaccaccaaauugguauccaaagugguuguacaaguuuguacucccaucagcaauggaggaguguuucucuugcuccacagucuugccagcaugugcugucacuugaguuuuugaucuuagccauuuugacagguguaagauggccucuuaugguuguuuugaauugccugaugaccaaagaaguugaacauuuuuaaguguuuuuccaucauuagagaauccacuguugagaauucccuauuuagcugugugcuccaguuuauaauuggguuauuuagucuguuugugucuaauuuuauguguucuuuauguauuuuguauauuuacccucugucagaguuaguguuguugaugauguuuucccauuccguaggcugcuguuuuguccuauugaugguguccuuagccuugcaaaagcuuuuccacuucaagaggucccauuuauuguuuaucuuagugccugagccauugauguucuguucaugaauuugucuccuauuccaauauguuuaaggcaauuccccacuuucucuucauuauagugugucugguuuuguauuuguguuuuucuacaugaagacauccaguuagaccaacaccauuuguugaagaugcucuuccuguuccauuguauggauuuggcuucuuuguaaaaaaucaagugucuauuucugggucuucaauuauauucucuugaucaaucuguauguuuuuaugccaguaccaugcaauuuuuauuacuauugcucuguaauauagcuaauauucaggauuguuuuaguuuuccugaauuuuuuuuccauaugaaguugagacuuucucuuucaaggucuguaaagcguuguguuagaauuuugaccagaacugcauugcaucuguagauugcuuuugauaagaugugcauuuuuacuauguuaaucuuacugacccauaaggaugagaagaaucccaguuuuucccuauuaauagauuauuuuucauuucagguacuuuccauucuuuuuaaaaaucuuaauuauuuauuucauauaauuauauuucaaauguuaucccacuuccuggcuuucccuucacaaacugccauuccaucccccuacucccugcuucuaugagggggcuccucccacccccuacuccugccucaccacucuagcauuccccuaugcuggggcauagagccuucacaggaccaauggccuccccucccauugacaccaaacaaugccauccucugcuacauaugcagcuagagccaugggucccuccauguauacacuuugguuggugguuuaaucccugggagcucaggagggugggcauuuguugauugauauuguuguucuuccuaugggguuacaaaucccuucagcuccuucggucuuuccccuaacuccucuuuuggguuccccaugcucagucugaugauuggcugcaagcauucgaaucuguauugguaaggcuuuagcagagccucucaggaaacagauauauuagacuccgaucagcaagcacuucuuggcauaagcaauaguuucuggguuuggugguuacauauggaauggaucccaagguggggcagucucuggaugaccuuuccuucaaucucugcuccacucuuuguuccuguauuuccuuuagacagaagcaauucuggguuaauaucuuugagauggguggguggccuuaucccucaacagggagcugugccuaaucucuggauauggucucuauagguucucucuccccuuugaugaguauuguagcuaauaucauccucuuuggauccugggagccucuugcuuuucuggcaucugccacuuucugguugcuacucccaguucccaauccccguugcuacacauuucuguucaauuuccugacccuguauacaucuccccccaucuccucccauaccugauccuguacuccuuucccccuaccccccuucucuuccuuccaaguccuucuuacccucuaucucccaugauuauuuuguuccuccuucuaaguaguacugaaacauccacacuuugaucuuccuucuucuugagcuucauauggucugugaguuguauagugggaauucugaguuuuguuucuuaauaucaacuuaucagugaguacauaccauguguguguuuuugugaccagguuaccucacucaggauuguauuuucuagguucaugcauuugccugcaaauuucuugaauucauuguuuuugcauuuuuuauccauuuuuauucuuguuuuuucuuguuuguugguggugaccauucauacuccaguuugaagcaaccaacaauacaaucucauuaauucuguggaucuccggcaugcugaguccuguuguguaucaguagacuuuaugguggaacgugguccugucuuuagguagauggguuggaggcuagccacugcugcuuacuacuuguuugauuuuuaaaugauuuucgagccucuugggggccuuaggcuccuugaauaaagagugagagaucagagguaucaucaagcuuagaacuugauccugaagguuuaucagaugcagauuaaacagugagaaauuaaaugaccauaaccaccauuggacugaaaauccacuugauggacauguaguuauucccuguacauguuuuugcuauuaggcucccuaaggcuuuuaauaauauggcaauaaauacauuaagguuggaccuggcagaugacugaguagguaaagaugcuugccacuaagccuaaugacucaaguucaaacccuaaagcucaugugguggaagggaaaaaccaauguuccauaguaguacuuuacguuaaccauauauacagcaugguauauggauaugccacucaaucagacauauugaaguuaugaacuguaggaauaguaaaauacuugucuugcaaaugugaguuugacccccagaauccaccuuuuuuaaaaggcuggguaugguaacucugacuuaugacccaaguucuugggagacaaagaccaaaaugugacagaggcuugguggcuaaccagugcagcaaguucccggucuguuagcagaaaucaucuaacaaaagaagaggagaaacucccaugguuauccuuuaacuuccacaaacacacacacacacacacacacacacacacacacacacacacacagaugcacucacacauauacccaaaaauauugucagacuucaaaauaaugguuuguuuauucuuuggguauuucauauauuuugaucauauucauuacuucuauaacauuucccagaguuccccugguucccuaccuacacagcuucuaccuuuuucucccuuccucuuuuucucucucuuaaaaauaaaaauauguggaauccaaggccuggccugguguaugguugguggacccaaauggcauuccauugugggguaacaguuauauccuacguaagaaugcuuaggaaucaguuuuguauguggauaaaacccuuaaaaacccaauggaacaugcauuauauguugacauuaaaagauuucuucuuccucgugcugccuaaggcaagcuugcuuguguucccucaauguuccauauuucuuccuucaggagguguuauuuuuagaccaauguucuucagauuuaaaaccucacccaagugcuauuuccucccuaaaauuuugccaguguucuugggcaaaauuaacacccgcucaacacacuucccacuuugcuagcucacugaguuagagcauuccugguauuuuauggucucaugauuacuguuuuccccaagucaacacccaggucucaaaugugcucauacaaugccuggcugggaaggcacucagaaggcagugacuacauuaguacacccacuuuucaaauccugcaccucaauuuccuccucccuuugugccaauguuaucuccagaagucuuugugaccuuccauguuuuagaaagucagcuuuucucacaagucacacaucucgcuugcuuucugagaaagacuuggagaugcuguggcuucuucugccucuaccucugcuuuuucuauggcacugggaucucuaauacaauggccuuccuccaucaugauuauaaugauuccucaauucacuggcaauuucauaauggguuuugaugauacuuaacaccugcuccucucccaacuccuccuaucuuuauccuacucaacuuuguauucucucucucucucucucucucucucucucucucucucucucucucucucucucccccccccucucucucucucucucuccuuaaauuaauuaucuacauuucuacagaguccuguuugacugcccauauaccucuggguauuaggucauccacugaagcuuggcuggcccaucugucaggaacuuuaaucauauuauucuuuaaaugccuuuaaauuuuucccuucaaccacagauuagauauagggaauaauagauuaaaccaauaugguuuuuguuuagcguguuacacacccugcuuagacccaucuuugcugcucuuacccacagaacagucuaaucucuacuaagauaauuauguuguaaaaggugugagucugagucuggagaacaagggcagauuuuaccagcguaagaucuagaggagccuggagguaugcuacuuacugccuguggccuaguuuccaggggauagaaguggggagagaagagaagcagcugcacccagaccgucuguguagcacuuucauagugccauguccccuccaaguucauaucauuggcaugucagagcccuucuacucagugaagccaagguaaauaagggcuuccuuugccaacugguuuccuccagaugauggucuuuauggagcugucucuaguccuaacacucccaccucuccaggagggcagcuugcagacccgaugucuccacagugcuaugcucaggauaagggaagagcaccuucuaagagacauggccaaaguuuucaaggagagacccagagugugaacccuuuaggagaaaaaugaagagugcuguuuauaaaauaauacuguccaaaaaaguacaauauuauacaccuuggugaggaucuuuuuaggaaguaacucaguggaacuggaagaaguuagcuugcagcagcaggaauguggaguuugaccuucacucaucagagagaacagcagugaucuuuuaaagcaauuacucuugaucugucugugaauaaaccccccauuuucauaugcaaugcaucuucuaccccugaaacugucuuucucuucuccucaaccaucuccaccaccacuuuugaagccugugaucugggucacuuccuucugugucuauccauuguuugccucugccugacuucucuguuuacuacucacgagcucugacuugcacuuuauucuaaguucagaugugacauucgacagaguuucuagcaucugaggagagacacugaggcugaucucuggugcaugugugcuugcaguugcuccagauuucuuuguaauucucuuguuuacaggugagaguaguuuuuacauuggaguuaacaguucacugcccaguugcugcaguuucguggaucagaaaaagaugcagagcuaagagccuguuggcaaagcuucuuuguccaugcuuuuauuucccuguuuuuauugccguccuaugacuuagaucucaaaucauagagaaucugauuccuuugcauagcacgcuuccaucagugaaccucuuuuauguauaauggucuuugagaaugaacggaaacuagcaaaauuuaaaaugugacaaagaauauaaaugggaacuuuuacgggcuagcugacaugaggguguguccuccauuuuccuaauacaaaguagccaaaaacaaauauauauccucuuagguauguggaugaaacauuaaguauuuuguuauaaaguauccaaugcauaaagucaacuaaaugaugauauguagauuaaauacaggaauuaguucuuuaaaguggcauuuaaaguauauuuuacuaagugcucuucccugcuuauucugugcaugaggucuugccccaagaaauaauuaaagauauauauuuuuacucuuuaagagccagauauuuucaacaauguuauaaaccaccacugaaguuuuuuguccuuuuuaguuugucuuuucaaacaacaugcuuucuucaaaauaaucaagugucaugguauggaugggcaguaaaaauuaacacaguauaucuucuuuguuuuguuuuguuuugcuuuguuuuguuuuguuuuguuuguguuuuaguuacaauguuucuccuuucccuucuuccucucaaagggcccucccugcauuuugcuauuuguuauugcaugcuuauauguauuuguauauauaucuauauuccuaaauauaaccuaguaaucacaauuaguguuacuuguauacauguuucauggauggccauuuggcucuccaacauuugguguucuuucccggggaagauucccucucccacucccagcuugucucaguugccuaggguugagcccucuugggcauuuccaauccagcuuguuguguucauugguaucaucuuuguaucaucuuuguucaacucacguuugggcaaccauguugaugacacuugaagauguguugcuaggagaaauacgcucaaagugaacugccugguccucuagcucuuagacgcuuucagccuccuugucuacagugcuccaugagcuauaggugcgggagucuggucuccacaacucugcaucuugguugguuguaaauuucuguaacacucucuguugcaaagagaaguuugcacgagaggugaggaguacacuuaacgguguguaagggcagcuguuuauagaugacuguuagggcuuaugcuggauuagcaaacuguggauacuuuuccagcaaccaugguuuuacuagcacugaguaguuacguaggcucccagcaccaggaauagagcaguuuuugaaagauaauuuugagauuaaaaaacuuaguauaucacagggcuauauauuagaaaggaacauugaaauguaucuuuauaauacacaguggcucaauacugugaggaauagaaacacaacaguggccuacauuuuuauaccauaaauggauuuauacagaaguuuauuagcacaguaugcugagauucaaacauugcuaauucuuuccuagagucauugacaagaaucuguacaauaaauuauccagguuccuuccaucagcaccagugucaggucaccuuggccacuaacucaguggacagucccauaguccccagaggacucuccacuccgcuggugcccuagcaugcccaggaucuuaggaucacuggugaguggaacacaaaaucuguuccaaugacaccagaagugccuggugccagcaggaacagugacacgggaacccugcccaaccaguggcucggguuccuuccagucuuccuaccuuggcuucaaacucaguggacagucccacugcccgcagagcagguaccacuucuagucacucuaacaugcucaggaucuuagaauuccaggaucccaggagcuuggucaaaccaagaucucagggucuuggaggaagauugacugccaagaacucugacacacccagaaucucaggaucacagagaaagcuggacucugaggaguucugacucaaccgggauuaaaggagggacaggcuucaaucagauauagcaagggcugggagcacuugagauaaucugauggugguagacaagaauaagaacagaagcaacaaaaaccaagguuacuuggcaucaucagaacccaacucucccaccauagcaaguccuggauacaccaucacaccagaaaagcaagauauggauguaaagucacuucucauaaugaugauggaggacauaaauaacucccuuaaagaaauacaggagaauaacacagguaaacagguagaagcccuuaaagaggaaauccaaaaaucccuuaaaaauuacagggaaacauaucaaaauaggugaaagaauugaacaaaaccaucuaggaucuaaaaauggaaguagaaacaauaaagagacaacaacaaagggagacacucuggagcuagaaaaccuagggaagaaggcaggagccauagaugcaagcaucaccaacagaauacaagagauacaagagagaaucucaggugcagaagaugccauagaaaacaucgacacaacaaucaaagaaaauuugaaauacaaaaagcuccuaaccccuaggaaauccaggauacaaugagaagaccaaaccuaaggauaauagguauagacaagaaggaagauuuccaacugaaaggaccaguaaauaucuucaacaaaauuauagaugaaaacuucuccaaccuaaagaaagagaugaccaugaacauacaaagcaccuacagaacuccaaauacucuggaccacaaaagaaauucaucccaucauauaauaaugaaaacacaaaaugcacaaaacaaagaaagaauauuaaaagcacuaaggaaaaaagguaaaguaacauauaaagccagagcuaucagaguuacaccuaacuucuccccagagacuaugcaagccagaagauccugggcagaugucauacagacccuaagagaaugaaaauacaagcccaggcuacuauacccagcaaaacucucaauugccauagaugagaaaccaagguauuccaugacaaaaccaaauucacacuauaucuuuccacaaaucuagcccuucaaaaaauaauaaagggaaaacuccaacacaaggauggaaauuacacccuacaaaaagcaagaaaguaauccuuuaaaaaaccuaaaagaagauagcuucaagaacagaaucccaacaaaaaagauaaagagggaaacuucagauucaucaaagauaaaaucuaucaagaugaacucucaauucuuaccaucuaugcuccaaaugcaagggcauccccauucauuaaagaaauguugcuaaagaucaaagcacacauagcauugcacacaauaauagugggagacuucaacaccacacucucaucaauggacagauccuggaaacagaaacugaacagagacacagugaaacuaacagaaguuaugacaguaauggaguuaacagauaucuauagagcauuuuauccuaaaacaaaagacuauaccuccuucucagcaccucaugauaccuucuccaaaacugaccguauaaucagccacaaaccaggccucaacagauacaagaaaauugaaauaaacucaugcauccuaucagaucaccaaggacuaaggcugaucuucaauaacaacauaaauaauagaaagcucacauacauaacacguggaagcugaacaacacucuacucaaugauaacuuggucaaggaagaaauuaagaaauucaagacuuuuuaaaguuuaaugaaaauggagccacagcauacucaaacuuaugagacaaugaaaacagucccaagaggaaagcucauagcuuugagauagcuccgagugccuccaaaaagaaacuggaaagagcauacaguagcagcuuuacagcaaaccugaaagcuuuagaacuaaaggaaacaaauucacccaagaggaguagauugcaggaaauaaucaaacucagggcugaaaucaaccaaguggaauaaaaaagaaccauagaaucaaacaaaccagaagcuggcuauuugagaaaaaucaacaaaauagauaaacccuuagccagauuaacuagagggcacaaagacagcauccuaauuaaaaagaaaaaucagaaaugaaaagggagacauaacaacggaaacugaggaaauccaaaaaaaaaaucaucagauccuacuacaaaagccuuuacucaacaaaacuggaaaaccuggaugaaauggacuauuuucuauauagauaccagguaaaaaaguuaagucaggaucagauuaaugauuaaaacagucccauauccccuaaaaaaauagaaaucgucauuaauagucucccaaccaaaaaaugcccaagaccugauggguuuagugcagaguucaaucaaaucuucaaagaagacccaauaccaauacuccucaaacuauuccacacaauagaaacagaaagugcucuacccaauuuguucuaugaagccacaauuacucugaaaccuaaaccacacaaagaaccaaaaaagaaagagaacucagaccaguaucuguuaugaauaucgaugcaaauauacucaauaaaauuuucacaaacugaauccaagaacacauuaaaaggauaauccaucaugaucaaguaggcuucaucccagggaugcaggaaugguucaauauauggaaauccauuaauguaauccacuauauauaaacaaacucaaagaaaaaaaaccauaugaucaccuuauuagaugcugagaaagcauuugacaaaauccaacacccugucaugaaaaaagguuggaaagaucaggaauucaaggcccauaccuaaacacaguaaaagcaacauacagcaaacuaauagccaacauuaaacuaaauagagagaaacuugaagcaaucccacuaaaaucagggacuggacaaggcugaccacucucucccuaccuauucaauauagugcuugaauuucuagccagagcaauuagaccacaaaaagagaucaaagggauauaaauuggaaagaaagaagucuaaauaucauuauuugcagaugauaugauaguuuaauuaagugaccccaaaaauuucaccagagaacuccuaaaccugauaaacaacuucagcaaaguaaaaggauauaaaauuaauucaaacaaaucaguggccuuccucuacacaaaggauaaacagacugagaaagaaauuaaggaaacaacacccuucacaauuuucacaaauaauauaaaauaucuuggugugaaucuaacuaaagaagugaaagaucugucuguuaagaacuucaagucucugaagaaagaaaucgaagaagaucucagaagauggaaauaucucccaugcucauggauuggcaggauuaauauaguaaaaauggucaucuugccaaaagcuaucuaccuauucaaugcaaucccuaucagaauuucaaugcaauucuucauagauuuagaaagagcaauuuacaaauugaucuggaauaagaaaaaaacccaggauaucaaaaacuguucugaacaauaaaagaacuucugggggaaacaccaucccugaccugaagcuguacuacagagcauuugugauuaaaaaaaccaaaaaaaaaaaaaaaaaaacaaaaaaccaaaaaacaaaaaacugcaugguauugguacagugacaggcagguaguucaauggaauagaacugaagauccagaaaagaacccacacaccuauggucacuugaucuuggacaaagaagcuaaaaccauccagagaaaaauagcauuuucaacaaauggugcugggcucaaccgguagaagaagacaaaucaaccauucuuauauucuucuacaaagcuuaaguccaagcagauuaaggaccaucacauaaaaccagauacacugaggcuuauagaagagaaaguagagaagagccccaaagauauuggcacaggggaaaaauuccugaacagaaaaacaauggcuugugauauaugaucaaggaucgacaaaugggaccucauaaaauugcaaagcuucuguaaggaaaaggacacugucaagaagauuaaaaaggccaccaacagauugagaaauuucuucaccaguccuacauccgauagagggcuaauauccaauauauacaaaguacucaaaaaguuagacuacaaagaaacaaauuacccuauuaaaaugggguacagugcucaacaaagaauucucaacugaggaauaccaaauggcugagaagcaccugaaaaaaaaauucaacauccuuagucauuagggaaaugcaaauuaaaacaacccugagauuucaacucacaccagucagaauggauaagaucaaaaacucaggugacacagaugcuggcaaagauguggagaaagaggaacacuccuccauugcuaguggaauuggaagcugguacaagcacucuggaaaucagcuuggugguuccucagaaaauuuggcauaguaguaccugaggacccaguaauaccacuccugggcauauacccagaagaugcuccaacauuuaauaaggacacaugcuucacuauguuuguagcagccauauuuauaauagccaggaacuggaaagaaaccagaugucccucaacaaaggaauggauacagaauggauacagugguacauuuacacucagcuauuaaaaacaauaaauugaugaaauucuucagcaaauggauggaucuggaggauuucauucugagugagguaacccaaucacaaaagaacacacaugauaugcacucacugauaaguggauauuagcucagaagcccagaagcuccgaauacccaagauacaauucacaaaccacaugaaacucaagaagaaggaagaccauaguguugacacuucuaugcaucuuagaaggggggggggacaaaacauccauggcaggcauuacagagacaaagugugcaauagaaacugaagaaaugaucaucuagagacugucucacguggggauccaucccauuuacaaucaccagacccagacacuguuguggaugccaacaagugcuugccucucuccugaaaggcucugccagugccucacaaauacagagguggauacucacggucauccauuggacugagcauaggauccccaaggaaggagcuagagaaaggacccaaggaucugaaguaguuugcagccccauaggaggaacaacaauaugaacuagccaguacuccagggcucacagggacuaaacccucaaccaaagagcacacauggugagacucacggcuccagcugcauaugcagcagaggauggccuuguuagacaucaaugagaggagagguccuuuguccuaugaaggcucuaugccccugggagaaugccagggccaggaagcgggaguggguggguuggugagcagagagaagggggaugggauaaggggaggguguuuuuuggaggggaaaccaggaaaacggauaacauuugaaauguaaauaaagaaaauaucgaauuuuuaaaaaagaaaaaacuuaaauuauccuuaaaucauccaacucaugucacccaggaaggaggucauuauugaagaggauuagauucaaaguaucagcgcaaguuaaguuuaguucaaguuucugcaguagaggagcucucaaguuucugugagaugcaggagaugcauucuccuuugagugacaucugaguuauuaguagcuggguccucccacaucaaguggagaauacuguagaauuaauuacagcuugcacacugauggagacuagaauacuccuucuccuuccaucuuucuuuccuuccuuccucuacucucuucuuccuuccccaucuuccuucaguuagcucauccuuccuaagguuucugauuucauauacaaaucuucugaagaaaggugaaauaugagaggauacuggaaaaaucuugcccagaauuuaauacaauccuauuggggaaugucagaagaaauaugauuuugacaugccaagacauagauucugcuaaugggcuguuuguuccuaucugcuccaaugacuguguucucguccuaggaaugaugucaaggcucucugaucuucucagugcaugugauucuuguuuuuaugaaucauuuccccagcuuuucacaggucacagugaacuuuuacauuuaguucacugcugugcauuacugaguaggaagauaauuccaccccuaaguauggugauauaucuucucacuaaggcuucauuuggcuaaauucuugccuuuagaaaaaacauuucugcauaaugacucauacacacagagagagggcagggagagagagagagagagagagagagagagagagagagagagagagagagagauucuuguuacauuuguagaaagaaugcuauaguacuacaaauagacuaguucuuugaaaacuaaagaguuucugcauagagcaauagguaaaugaacauguuacuaauuaaauggauguuuuguggaauguuauuguagcuaaguuucuuuuguagaaagucauacacucgauauuuaaugaggaaaccaguuucugcccgacuuuccucaccucuccuucacucacaguuaacccauuugucuucauguagaggaggauguccugggauguagaggauaagccguaugaaaauucuccuauacugcacugccacccacacuuucucuggauaauccacaaauaugaauuucuggucucuaaaaugugccuacauauguucaaaagucuaggaacuuguucuguccauugaagaagaagaagaagaagaagaagaagaagaagaagaagaagaagaagaagaagaagaagaagaagaagaagaagaagaagaagaagaagaaaggaaggaggaggaggguggaggagaggaggagggggaggagggagaaaccuugaagcuacaguucccuucuuaaugcaaguugcuguggaugaugacuacguccuauuucucuggacuucaccccaucuuccccucacagagaaauccuuuuauaugcuuugagccagcauuucaguaggaaaccaccacaccuuacucccuauccacuucccugaauucugcagucucaagaugucuucugaucacugucuaggugugucugcuacauagcaucucacacaugugagccagagaacuguguggaguaucuaccagaauuguucauucuucagguccauauugaguagagauacagggguucaaguuuaaauuuuucaagugacauugagugauugagagaagauguauauuuguaacucaacucuuaaauaauuguauaaaugauuacacugacauguuuauuuucuuugaauuuaugucgucacauuuuugggacuggaaauuguaggugaguccuaacaugaaaaugagggaccaagugguaucaggacacuaguugcugcuagagucuggucggaagcugaauuccugaccuuguacaguggccacugugcccuguuaaucugaagucauaacuuuaccaaaaacacucuuccaaaauuccuuacaaguacugaggagagacaucuaaaaagucucccagacuagagugaugugaauuaugacacucaugaagucagaggacucacagugauccuuaaugacugcuaagccucaugcccugugucugcauccuuuuccccgaagcucagggaccucuucaaggcuguguuuuagcuuuugacaucuugcuggugcuucacuuccugcaacaauauugagugcugucacuugaaggugucacaccacacuuucaaaaucagauguuugcagcagggauaaagaaaagcagcggcaagagagagagugggcaaguacauaaauaagcaacaggcauucagagcugucuccaucacucaucuuguuuauuuaugcacagcccaguaguuugaggaccacaccagaccagcaucuuucuaacagcucuuucugauuuauuuccucuuucagagaagacuuagaugcaccaucucaccguuaucucccccuguucauuuccaguuauucauaccauugcuauugauugcauacuuuaguugguucuguguuuuaguucaugauucuucuauggguuguguaguucagguuuuuuuuuauuuuauuuuaaugggaauuuuaaaaauauggguguugguauguauguacaauguauacauguuuguguguaugcacguuuucaugugucugugaaggccuaaaguuaaugccuggugauguucucaaucucuucccacuuaauuuauucagcuuauugaaccugaagcuuucuaauucaagcuggacucgcuagccagcuugccccuaggauccagucucugcuuaagcacucuaauuauaauagccaccaugaaugccugguuaacccuugaagauaccaaacugucucuucuccauaccuaguauuucuuuuauaucagacacuguucuuguuuauuuaaaaaaaaaaaguugucucuuuuuugagaauagcuuuuauguucuugucuuuuaaauuccuuauuaauuauauggcaaacaauaacucuaagauucaaauauucaguuaacuauuuaacacuauuauagcaugcugguaaacccaaucuauuucccacugauaaugaugccaguauuccaucuggcuuccauuggucacaugggauuuuuaaccaucagcgcuuuaaaguucuugaauagcuagcaaucaaauauuuuuaauuuaauuaauuaaguuuuuuacauuccauauuuuauccccccccccccgcccgccgaucuacccuucaacuguuccacaucccauaccuccuccccaacccgucuccauguagaucuccccaccccccacucuaccugacuucuaaacucccuggggccuccaguuuccugaggguuaggugcaucuucucugaaugaacacagacccagcaguccucuacuguauguguguugggagccuccuaucagcugguauaugcugccuguuugaugguccagugucugagagaucucagggguccagauuaauugagacugcuguuccucccacaggaucgcccuucucaucagcuucuuucagccuuuccuaauucaacaacaggggucagcugcuucuguccauugguugggugcaaauaucugcaucugacucuuucagcuguuuguugcaucuuuuggagggcucacgccgauaggauuugcuaaaggaggcagaggcaggaggaucaccaguuugagaccagccuggacaauaagucagucacacuagagugagccaaggacagcacaguugugacugugccguuccuuacuucuuguacuuuuaaauuuuggaccccaggcucauuuucgguagaauuuaguccuguguggcuuuaaugcgaggugugucuuucauagagaauuuacauuguggugucccaggaacuuggggauagcaucaguguaggacaacuguuagcacuuacucuuugcucuugguuucccaugucuugcaaguaggaugaucacaagccucagagcugcaugagacuaugaauaugaacuaugaacuucuacacauucacguggagaaagaaagaauugcuucaccgacagucccauuagucccacaaaguguccuuuauuaggggccuccaggcaacuuacugacauuuccaagagcuaagacacacaacaauagagguauuugauuuaaugacuguuggaugguauaaaguauauacuucuauccacaaauuaauuuacauaaagaagcauaaucuuaagagcaguguguauauuuuucaaaagguagaaaaaauauguaaaugaguaaacuuaucugucaguuggagacuuuguuuccuuuagagaacagcaucaugcacauauuuauuuuagaagugccuuguugagcuacuuagaauagagucuaugacuucaggagcauuaugaaguuaaaguauuugcuaauuugacauacugaagaaaagagguaggaaucuaugcuguugggggaggugcacauaagaaagaagagguaagggugaaagcagcugugugugcaucuucuuuaacuucccagaucugaacuaaaguuuucugggaagaacacacgacaugaucugcacauuuaucuaauacuagugaacaaagccccaggagacuauguuguuuccuuuccuugaugaccuacugugucuugucaaaugcacgcacgcgcgcgcacacacacacacacacacacacacacacacacacacacauauauauauuccuugaaguucaggaagugacuuugucaagauuuaucucugccaggccuguuuuucuuuaccagugauaagcccuuuugagcuaaaacuggagucuuuguagaugcccugguaucugccuuaaagacaagcccauuucuuuuccuucuccuggucucuggucagaaucugggaguucacacuccauuuuugacucuacacccauugucuuuccucugcucccaugagucuuagaccuucaacaaacuaaugcgguaagucuucuccuuuaaaauuuacaagacugacauaauuucuuacacugauaaauucccauuuagguuuuccaaguguguucuuaaauucccgauuguccccauguuuguccggccaccucauuuugccuuauuauuguuuauaguuguuuuuuauuuguuucucuuuaacacuuaagugucucuuaacacuuagaugcaccgugucuuucccacguacugaaugaucuaagggaaaguuggcuuuucuaaucaaacauugaucaccuacgacaaaagaugugacauuauguguagguguuagagacaauuaauaaauaggaaaaugaaaacaaacacaaauaauuuuccuucaccucucauuucuuucccaucaaguaucaaacacaauuaaggguucugggcagacgacuucaaaguuaaagugcuuacugccuaagaaugaggacuggaguuugcaugccccaaacccuugaaaguguugugaaggugaagcaacccugcucuaauuccagccucaagcuggcuggugagauugagacaccuuaugucugugaaugauauggggaacaacugaggaugauuccaaacacuaaccuugggcuuucgugcguauguacacagaccuguacaggcacaagcacacacauaaacauagauacacaccuaugcauguaucccuguauauaugcuacacauacacauacauacacacacacacacacuuauacaugugucccuauacauacacaccacaagcacauacccuuuuuguacaugcuuccauacauacauaacacauacauaagauacauacacaaacacaagcacacacacacacacacaccuauacauaucuucccacacauaaacaacacacacacacacacacacacacacacacacacacacacacacaguggggaagugauuacuauuagugacugucauuauauaugagccaucuaagaugcauaauuauaccuuauccugugguaaauauauacacuaauuuaaaaaugaguagcuuugaucagguaaaauaaugaacacuagaaaucaagcuuuuauaaaaugacagaauugauaugcagacauggccaguccagagucauuauuuauuauuauauacuacuguaacugcagacaagaaaagggccaucacaucucuucuaagcacuuuuggaagaauaggcuggcacccauagcaggagguauguuguagaguuaggaagauucuaacaauuuagcucuuuaagaaaagauuccccaagaacacuauacuuuauuuuacaccuuaaaauuaauucuccugauguucaaagucguccauuagaugaauugcuugacuuguucauaaagagucaucagccugaagguuucaacguaaaggcaguuaggaagaccucaguggggucaagugcaaauguuucucugacuguauuagcugagauugcuguauuuucucagcucacugcgcauugugcuauuucucuguccaguguuuaccguaaguuuccuuuuuguuuaaggaacuuuuugggggguuuuuagcaucaaaauaaaauacccauuaaagaagucucuguguuauucgaugcugugaacuuggauucuuacucaagacagcgcaugacaccacuaaacauuuaacuagaaagcaaaagaauaaaugaaaauggccuucgaguggaacauuuucucugcuccauauuucccucauaaaguuggcaagucacuagauuuccauaaaucucaucccuaaaaugcaaacacuaauauuuguccaaacauuugaucuauuaaucaggacacuggaauggcacaguuaucaauauuagguaacucuuugacucaugaaaacacugggcauaaccaugagugcauccuauauuuauucaaguuauauuugaaauaaucaucaauaugucagaaaguugggguuuuuauuuggggaaguuuuuuuuuuuuuuuuuuuuuuuuagaaaauuccagucaguuuguaaaacauuuauucugguuuucaaaaaggcaccaguauuucaauguauucaaauacugaugaauucagaauggugagggaggggcagacaaaaaaaggagaaagagggggaaaucugcauuguaauaaaaagugaaagauuguggguugccauagaaaacaaagugccugucacagggagaggacuaagguuuaaaaugguuuucuguggugcuggccacauuucguauuuaucuuuuuaucugagcauuuacuuuucagugaccuguauugcucuacacuuuucuugcguucuuagauaaugaaguguaacuaaauacuuggaaagaaaaacuuaagaugauugugugcugaggaugguuagagaagagaggagauuauggucauucccauaucauuccuucugcuucccucucucugucucucucuuugugacacacacauguguccauguaugagucaggcuguuugucugucucacacaugccagacaagugccuuccaacugacuugcauuucugauguccuuauaguuuauauucugagacaccaaagaauuuucauuugcucacuaaguuacccaaguuggccuugcauuccagcauuuuauauuaagugucgauuugaaacucugcuguuuaagccaugcaauuaaaauguuaagcauauaauuaucauuguaaguuaaaauaugcuaaaagagauaagaauucgaaaggaaaaccauaugguguuaucauuagaguugagugaggguaugucauauuagcuauuaacuauuucauuguuaaauuggaaccaaccauuaaaauguauuggaaucaaagucugugcucuugcuugcaaauucuucccuaaauauccucacaaaaccucaccccaugagaacuaagcccacaguaaaucccagagggaggggcaaggagcagggagagccaggguuuuaacaucuuauauacccugagcuccugagcuaaacucugcucuacugcuccaacaucagguguaaagcccccauuauaccaucaccaaccuacaaauggaaucauuaguuuucacuugagacugcagugagacuagauuacacaucugcaaacuucccaguuuacucugagagcuuuguaagucugaccuuucuucuccuuacugacauauuccuuucccaagaacccugucugccuucugcacaggauucugccuccuguugacucugggaacucucccacugugaccuacacauuuuuguugauguucaugggguuucacagcacaacucucauccuuugucauuaugacaacaccugaaacaagaauuaaguacccuggcauuuucuacugcuaguauauaguaggagccauccaugucucaccaaaaauagcaguaucuuccacucagguccccagucuaacgccuaauccagguggguguuuucuuaacucagcucagugcuguaggagcaaauagaugucugagucacaucaaguguguugugugacacuauucucagggagacaugaacaagugccugcuugucccagaaaagaacugacaauagacaaauauaaugauacuuucaaaguccaauuugcugaaccagugaguuuauuggggccauguaaagaaccauugacaauccagaggcagcuauaucaccaaaggccacccuagcauggugaccgcucaggaaagauagaacccuaaaguauucugcuugacuuacaggcagcucaacagguugaagaguuccucuucaagguauuuaggaagagcuuccucccuggcaguuauucacugcaucucauggaucuucuaaguuucaauucucccaaacuuacuaaugguuuuaccuccucagugucaaaagccuccuccagggaggaaaguuuccacuuagagaaaauugcugcgcaacuaccuaccaucuagagauguguuuggauacagugauugcucucccaaacacauguagccuauuggccagaaguggacaugccuggaccauuacaguagccaugcuucucuagagccauggcacacgccuuucacauuaaaaguuaugccuguuuugcagauuguaucuugaguguucuauguuucugagcuaauguccacuuaucagugaaagcacccaaggagcuaaagaggucugcaacccuauagguggaacaacaauaugaacuaaucaguacccccagagaucguaucucuagcugcauaugcagcagaagauggccuagucagccaucacugggaagagaggccccuugguauugcaaacuuuauauggcuuuguuucauuuccagauugaugaugagugacagcacagugauuauaaagucuuuaaaaaauacccugcuaggauaauuaauuccuaugcguuuacaugaaguucuuuccuuuuugucuucuccacaggucguaaguuuaagaaguuuaauaaaguccgaguuaugagaacccuugacgguguugcucucccccagucggugggccuuccuaacgagagccaggcccugggccagagaaucaccuuuucaccaaaucaagaaauucaacuggucccgccacucaucaaccugcucaugagcauugagccugauguggucuaugcagggcaugacaacacaaagccugacacuuccagcucuuugcugaccagucucaaccaacuaggcgagagacaacugcuuucaguagucaaauggucuaaaucucugccagguaauuuguacaugguaucaugcauuaaaagguacuauguuuguggcacuaucugaaugugaaaauagucuguacgaaaagucaacuaccauguaaagagcaccauauguuuuaguaauucaaaaugcuuggugaaucuccugugugggcuugguuuaauugguagagcccuaggucagcaugcaucagcccuuggaucaguccccaucaacaccugcacacaagcaagacucauguaagcuauaggagcccagagaaggaggaagcacauuaaugcuggcugauugcugccuacaugaaacaauuagcagcuaaguguauguguuaaaucacacaaauacaguaauuuagaaaacaacauguuagccaucuccugagagugucuaguuuuuaaaccuaacugaagcuucgagccuguuggagauaaaaaccaaacgucccuacucauguaacaaaucauaacagcauugaaaguaccuauauaaagucagugaagaguacagaaguucugagguuaggaaagucagacagaccucaaucccuugcucuucucaccacaccaacagaaggauauggcccagcgauacugagaaauuguguauuuuuauggaagugcuucacugacuuuacuggcaauauuugucccucagugaagcucuuuagcggccacguggauggucaaauuacaaaaauccauuucucacuugguugaaccuuagauggcagacacaggugaaggcuugcaguuguuuguguaggccuuaaccucaugauuagaagcagaauaauucuuucaaagaucaccuguuucucauaccauuaacauccuuguaauguucauuuuucugacacauggucaaaaauuaaacacauuauguccuuuuuauccuggaagaaauucaauuauuauuuuuuuaaagaucccuucuuaauuugccugaguacauuucucggcuauuauucuaccugaaaguuuugaaauauaauagaugaauugcuauugaauauccaagguuauaugaaacaguacagauucuuguuuguuagaccuucaaacggaucugacagaugagucagacuacccagcuuuucauuugcuuuacuguagcugacaggccuuggacagguaauguuuuccuucagaaaaaaaguuuagaauauuuaaaacuuagugugaaguggcuaucaaauuugauagaucuuuacuaaguaaaugucauaguagcauugauaaaauaacucugauuuuaaaauuggcguuuagcggugcgaugcuuuucucuuuccauuaucuggaaaucugcuuuccuugaccaccauugcuaugggucaauauuucucucgcuuguauuuuuggaagcucuuuauuuuuaagaagauuuuauaguuagcuaguaaauuuuaaaaagaaagcaauuaaaaagaacauuuauucauugaagauaaaagcuguuuuuaaguuuaaauguuuauaaaucaagauauuuugaccuccacacguuguugaagaaauaaugagaagaaauauauguacugaauuugguagcaacuuuuuaagugcugcagaacauaauuuauguguggcaaauggaaauggucacaccuuuaugauucucucaguuucuauuaauaaugcucaagggcagcauugagaugaucaaaauuuuguguggacucugcucucuuuaagccauauuugcaaacagugaauucaaaagggacacugugaaauggaugcagagaugcucagugaaauaugauuaauuuuccucugagaagagcugaaggggacauaaguuuaauauugcucucauugccuuucucaccgcugugacaugcuaacagaaguaaccuaaggaaacagaggguugcuuuggcuuauaagaugguacagcccaccucaaaggggaaggcauugcgguaggagugcaggacaacuggucacauugugcccagucaagagggaggaagagaucaaugcuggugugcagugaacuuucaccuuuguguccaguuggaaauuccaggcaugaauggugaugcugauguugaguagaucuucucucuccaauuaacacuauggaaauguccucaaagacaggcccaggguuuuggucccuagcugguuuggaauccaggcaaguuauuugagaguaaacaugacacugauccaguguuauuagauacucugaacuaaugucaucugccuucacauaagguuaugguucuuauuuagugacuaauugaaugccuaccacaugccugcugagugcagaucuuaacaauuaaaucgugcugcuaggacaaaaagccagaaagcgggcuuacagugugaaugcauucgaugcugcacaccuuugcaucugggcaccgguuuugcacagaagagaaauguuuuugauucaguuacucauuuucaacaauauuauuauguggaagauggccuuuuguuaaaggagcccuaacaauaagccagauugugaaaauguagaacuuauccauuguauacauaugcuguuggacaaccuguugacagagcaacucauuccuuugagacaguaagguguacaacaaugucuggugaaaagaacaaguucaaaggcaaaucaaucagugaagacccuggccgugaugcugcaggggccaugagguucuuuacuucccagucagggaauccucuuuuccucuuugucuucauucucauggucauugaccuguuaccauaauuacaacuaauuuuacuucucuucaauaauauuucagagacucuuuuuaauuuaaugggaacauguaagaugccauagacucaagguguuauauuuauagaccaccucauagauaaucuccauuugacguuuagcaucugcauaugaaugacuuuguguaguauuuuuguuguuguugucuugagugagcacuguauuccucguuaagacaugaagcagggcauuaccuaugaaauuucaaaacuuaacaguacacguuuccucuauuaaagaacuuucaacccagagagagaucugagacaccugacaauagcaucagacaccgaacuuauaaaaacggacagacguguaacuuuagcauuggguucuaaaggaaugaacaaggagacucauuaacuguguaaagaaaaagcacauucauuagaacaggugugccugagguauaggaaaggaaaacugugagugaaauuugguuagugauaaauggaaauacauagaagacagucgguugcucugcaccuuuuaaauguggggauucuuaaauaaaaucagaaauuuaauuauucaguuacccauaaaacugcaaugaaagguuuuaguaguuagugagaaaaaugcaucugcauagaugagcacuuguauacuuuuuccuuuguaaguguuggccuucuuaggauuucacuaauuuacucugaaacaaauggcaauagauguacuuggggauuaguaguggaaaguaauggcacagaugaaagucauaagcuugucaaauagggucuugaaagucgaaggaagacaaaaauuaauaaguacuaauucaaaaagcaaggucaccuucucuaccagugaguuguacaagaauuaaagcaauagagaaguguagagcaaacauuuucuugugaugaauuugucuugcuguuucccuuuacuuguugaaauauucaucccaggccaugcugugaaauuccaacuauugcccauuggagugcauuccuuccugcuuuaaacuacccagacugcgugccaugaugaggagcugaagauagggacaaacuuuccuucauuuucuagcucugcagugugagucagugacagugugaaaagggacuuuuucuuucuucccaaaugcaaugaauaaggcaaauuaucaccuucaaagcaugaggagaagagugaagguggccuuccaucuuagaccugaccagagcuucuauaacaacagucaaaauuccuuaacuguauuccacugaaacuaccaucaccaauguuaaugucuucaaauugucaaguugcauauguguucucuuucaugcaacuucacugccuugggggguacugguagaguaaccacuuccuaaugaaacucauccuuugguguccauccauuccuuccagguacaugguuucucccacaaaguuuuagucacuauacauuugugcuucuuccuacacuauacauuuuacuguccugaguucuguucucucuuccacuggcuucuuauguugcauauuugggaugaacagauguauauccuugauguucuuacuccacuccaaugacauguaaguaauggcaucaguccagcuccuucagucauguauuccaaaugcucuuaacacagcuccacccagaucaccucucaagucagcaugaccuuacugcucauaugccaaaaccauuuuucuguauccugaaauaaguccucagccagccccuucagaaccaucuuuagcucucuccuccuuuguauccugccugggugguugucaguucuuucaacaccucauauucaauacaagguuggcuuacuacaaugcuacuuacuucuauggcugcugauccagcuuaguuuggucaccacccuuucuugguuuaccuagguuucagcucucaaacaauuuaacccaagauucuaacccaagaaucauuuuucuaaaaauaauuguaaccaacuauguuuuucuuuuuccauuucugaauaaacccuaaacucuguggccuuacaauucaaggcaguucugcauuccgguuccgaaauuaacagcacuccucuuucccucccuucaauucauggaauuuaagcagcacuugcugaaaggcucuuugcuccauuucccaucuuuuucuucucauuuugguguuguuuucuguauguagaggaucuucacacacauagucuccugucugacuuucuaacaacucuccaucauucauacuaaucuaaucugcccugcaucuucccagacugaaucccaauacuugggaagagauaaaggcaaggaagagucuuagguucaagaccagcuucugacagaaguaagacccuaucccaggaaagacaaauaaaaaggcguagaaaucucaaguguggaauguauaacuaagagcuauguuaucuuagaugaacucugucauucuugaucagauuaagccacugaagguauuggugguguauugccuaugucucccuuugaucuggaaauauacacacauauugacauuaaugucuuguaauacaagguccugagauauguaauucuccaucuugguugaggcucaucauuucaacuguaugacacuuugacacuuuuuuucaaaaacagagauagaacuuaugcauuuuuaucagaaccuuggaagcacagcaagucucaugagucaucuuuuguccucuccuuuauccuuuuuuuuaaguagugagaauuggaaaauccacagcaauauuuuucaaggauuauuaagccaagacacuuacagaaaaguacauuuuuuacacuacuuguuaaacacaauuagcggucauccaucacuucccauagguuguucaguuugcuuaugaucucaagugcaugaaaucucucuaaucauuaucaucacaggaaucugaucucuauuuuccuagcuuuguuucaguauaaaauaauggaauggugucacagucaauggggagaaacugcuugugagcuagccauguacaaguuauuuaacauuggacuuuuuccacagcuacaccuccaaaagguggaguaaggagguuauuuucugaguucuauucuguuagauggaaauauauguucugcuaugaauguuaguaacugaguaaacuuugaaauauuucaauaaaaguuaccuuuuauacuacaaaaaaaguguuccuuuauuucaagacacugauaagcuuagaauccagaagcgcgagagaaugagauuaaaaauaaagauaaagugaauauauacacagagucugauuuucagaaaacagaaucauguauguacaucuuuauagaaaauuuaaaacuagucauagauuaauauaaaacaaugacaaaaugaaaaaaaaccuagcguaguuaugucaaauauuuagauguuuuaaaaacauauuagaaagguuagaaauuagaaccaauuuacagaaugagugaauuacuaaagauaauauugaacauucuguuaauacuuuauuaugucuaauuaauugaaucucacuuucuaccaaccugucacuuuauauaugauaaaguucauauauggauaugauacaagcuaauaaauaauauauaugaaauuaauguucugaaaauauacuaaauauacauuucauuacuguuuauuuguacagauauguguaauugguaugaaucuauucauaucuuuauguccaugugcacauaaaaguguaugugugcauguguggaguucagagguuaccacugagugucuucccagcuauucucuuccuuacuuuuaagggcaggguuucucacugagccuggcuagacuggcuggcagugagcucugagaauucacuuguuggggcuuguccuuagcucuaggauuaugcaacagaacccuuuuuaguaaagugcuggaagaaaaagcuugcucccuuugcuucuuggagaagcacuuugcuggcugagcuguuuucucaggcuauuggugccuaauuugucuucugaauuuauugucauuugcagcauuuauauuuuaauuauauguauguuuuccauaacauaaaggauaauguuuucuagcuuauaauuuugaucucauuuuguuugggagcauauuuuuucuucuuuuuuauuuauuuauuuuuuauauuguuauuuugacacagcuaugguuagccuagaacuuacucugaagucaaggauaaacuugaacucuugaucuuccugccaccagcuccucagugcugaaauuauuagaugauacuacuacaguguguuucauuuguuuuaaauuggagauuucucucaauuugauuagugguuuuccuauagccauuaauccaauuagugcucuguuacacgauccaugguuggaauaaaaauauuugcauauuccucaacaaaaauucaguuauccugaaucuuuaauucaguuauauuuaguuaccuuuauccucaugaccuaauuuguucaagguagcauucaguugcuagagucaggaguggaccugaggccucucugaucaacccuugaggucacaccaacacacacccuugaggucacaccaacacacagugcuucaugugcuuucauuggguaaucgucauguuuuacaaagaauuuguucaucaucaauugauucugauuuuuaucaaagaauuauucauuugcucaauauucaaugacaagcaguacuuaugcucuagguaagcuguguuaagauucacacuuuuucuaaaaugacauaccauauagauaugcacuuuaaggaguaaagucauaugaaaauaugaaacuuaaaaaaacacaaaacauuuuuuucuuggcaaguuggagucuuucugccacaaaguaaauuggauuugugggugauaacaguaucaaaacaaaggaaaauaacuauucuaaucauaaaaaagaaaaccugggcucccaaaacagaaaugaaagaaaacaaccucuggagggcaccaggaauucacucagcuggagugaaggacagguuuggaauuccacacaaacugagagaugcggugggagggaaaaugaauaaguaucauagauacaucccuuggaugccuugguacccucuaggccucucacaguacauaaccacaccuugucuuugcugacucacagucagagucuugguggugacugcuucacagccuuucuccaggcaccacacagagggcagcaaggguugugugcauuuccccugauagcagcaucugcuguucuaccaaacuccaaguggagggacucauuagucaagcagaaauaagaaggaauaaugagaaacaguagucagacauugaagagagugccucaaaagucaggagguugcugcuuuaccauuaacuaaggaggcacacuugaucuuucaucuccaaggaggcuaaaaaacagacaaaugccauuucccagcugcugguggggcuauuaggagcaagugcagagaauuucagugucuaacagaaggaagugcccucucucucaguagcuaacagauuaaguauuacucuggcuugauuucugaauuagucauuuauaaauggguagcaguggacuuuuaaggaaaguaaguauuuucgaaagagcuucauggaaaggguuugaugcucccauuaaaacaauuauuuuuacuuaaucuuaaacaaaauauuaaauccaguuuuguuauucaacuguuguaaguuacaguaacauccacauucauagucuuuccuugauauauccccaggcucaaguccauguacccaagugcaaucaauacucuuaaggucucucaaauauguccaaaaugugcuacuuuuaucccaacuuauuucuuuguccuuauuucagauuuggggagagcuaaauccucuuaaauccuucuugccuccauaggaaaaccaagugucuuauauuuucuucuuuaaguguuuggaugaugcaaagucaaccucacuucucugccuaacuccucucacaucaacuccccuccuuccaugcccuuuccaacacuguguccucuuuuucuuuuucaacaauaacccacuugcucaaauuggugcugcucauauacucauuguuaugggagcaaccauuggcguaagguugaccuaucagggaccauaucuuuaaugaaauugagccucccuuccccagaaaccaucaguugucuauaggucuucagcuagggguagggcuucugagucugucccucuccaugcuggaaugccuacagcaugcuugcucuuguacagguguugcauacgcaccacagaagcuauggcucaugaugagagaauaucaugucaagaagacaccaaaagaguggauucuagcauuuauuucuaucauguuaacauagugccuaccauggaaauggguguucaugaauccagaauggguaguuaauucaauuaaugauucucaccagcauuaaaccacagugacaauguuaaugacuuauaaaauggcuauccauuugucuccuuauaggcuguugugagcauuuucugaauuuuagggaaacauuuaguaucuaguuuugacuucuuacaaaauguuaacaugguucacaugauuucuuugauuguuuucuuccaaaacauuuguagguuuccggaacuuacacauugaugaccagauaacccugauucaguacuccuggaugagccugaugguguuuggccugggguggaggucguacaagcaugucaguggacagaugcuauauuuugcaccugaucuaauccuaaaugaguaaguuguuacuuuuggugcugucauuguuaucacaaguacaucauaugauuuggaaaacugcauuucaauuguuaaucauguggcaauauccauugauguaaggucucuauaauauguugacuaagagaccuuugggugccuacucaggaguguguuagguggguaauagguaggucuauuuuuaguguuuuggaaagccucuagacugauuuccaugguggccagacuggauuauaugcccaucagcaugauguuuucuaacugccauccugacugugguaagauagacucucaauguagcuguaauuaacuuuuccugggugacucaucagggugaacauuuuuauguauuuauuggccauuuuacuccaucauuaggaaauuguucauuucacaauaaguucauuaacugauuuacugauuaagugcuuucauuucuugauuuuuuuuaguuuaugauccuugcauauucuagauauuaaauguaguauuaguguaauaaauaauguaauauuaauuagauucuccuguuaaauguuuaguuagaaaauauuuuuaccuauuuuuuuagucuuucucuucacucaauuaaguuuuucucuugcuauacagaagcaauuuaauuucauuuaaucccacuugccaacucucuuuacuauuucuugagaauuugaagacuuuucagaaagauuuuugucuauguuuauuugcuuaaaaauuuuaguuaaauccuuugauugcuuauuugguauuuggaucccauuccccuugucuugaaaaaaaaaguuuuuauccaaacuaauauuuuuauuuauuuuucaaaaucugauauguacaauucaauauaucauguuauuauacuaaaugcuuaucauauuaauuuaaguuuucagacuuguacuugugauaauguacuugagauaaugaaaucaaauauuuuugcuugacaguagacuuacuuuuuaaaauuaaaaaauguucuaugacuaauccaauuugauuuaucaauuuaaguaaauaguuuucaacauguagucuuuagaugauaagaauuuauccaagguaaugucuacacuguucuaauggugaaugucaaguugugaacaucuaaguuaauaacugacacuaauguuuucacaguugacaaucuucaugcuucacucauuccuuuuuaacugauagucccuugaaauaggcaaggacucagcauuauccaccuuaguaguugaagaaacuggggcucaggagaaauggauaaccuggcacaaaccugagggucuuaauccuucagugugggugucuugucuuccaccauuaauacuagacacagugacuaaugcuggucuuacaaaauggcacaugcugagagaaucccucaaaucagggaaccaucuacagagccuguacuaacuuuuucaauuacauucacuaccauucuuuaauuuguuuuucugugucaccauacauaucaucuagaaaaagucacaggguuguaaauuuuuaugaacugaagcaauccauuaacuugugcacaaaauuauaucuacacauacaaauacauauacuagucucucaauaaagcuguuccuggcuccaaaugcuccaauuccuucaagauugcucucaguagauuuagguauuuaaagcgauauaauaaaagcacgaaacaauaugaacuuuaaucaauguguauguaauauuauuuuauaagucuaaauuuucuuuaccuuaaaaauguagugcuaccauguaaaaaaguuuagagacuuuaaaaauuccaaauauuacuuuguuuauuaaauauaucagaaaauucaacaacaggaaagagaguuccugaacuccuauucacugacacguuguaucacugccuggcugacuagcaaugguuuccaugcuuaugcuuguuuuucuuuuguguacugugugugguacaaggcagaggaugaaggagcugucauucuacucgcugugccuuaccauguggcaaaucccacaggaguuugucaaacuccaggugacccaugaggaauuccucuguaugaaagucuuacuacuucuuaacacaagugaguacccaaguguaaagacacuuggcaccuuacuuuuuaauuuccaagauaaaugucaaaauaucaucauauagucacauacaagauauacaauuuagauuguaacugugaaggaggaauuuccaauauauugcuacuaguuugacauuauuaauauauagccauauaagacuaaaauagcauauccaguuuauuuuauaugaaauaugaucacaaacuaauuugcuuauucaguuuuuauaagccaguuaauaggaacucgagcuaugcuuuccacuacaccuaccacacaugcacuaaaguacuuacucucuuugcaguacagacacucuuguuuggaacucuuuucagugagugagaacaguuugacuguuacagcagauggccucagggaccauugacuugggacaucagcagaguguguguuacucaaauaguccuggauguaagcaagaaagucucagcuuccucccacauaaugcccacacugugucauggggccugcagccuuuauuuccucugacuagaaacaaucagauaaggaguggguggaaguuuagggguaagaccugagaggcacaggauagccaugggagaaggcagcaaaggagaguaugcgugcacugagccuuccugugcccuccccacacacaugacacaugcaugcacugagccuuccugugcccuccccacacacaugacacauccaugcacugagccuuccugugcccuucccacacacaugacacaugcaugcacugagccuuucuguggccuuaccauacacggaaaguucagccugacacugauugauucuuugauuugcaaguaagucacugggagcuaagacuuuaugauaaguucgccuaaguguuuuucucagcagugucuuuucagggacuucugcuaguugcacaaauuucagaugucugaguaaaggagcuugggaugggaaggaauauacagcuccuuugauaauuucuuacaaacuuaaagcuccuguguaccauggaaaaacaaaggaaaccuuucuaggaauagguaucagagucacacagacuuucaugaguuuccuaaugaagggauuacaaacaaaaaauaauuucauguucuccugucagggugaguuagcuguaaggauuaguuuggaaguucuagaaguacauggauuugaaauaacuagagacugaaguaacuagacuagagacugaaguaacuggagagaagagacuaaguauuuuaugcauguauacaguacauccauagugauguguaaaaaucuucagugaauuuugcaagaauuacuccuuagaaaccccuguauauuuaggaucugagcagccgcaaacugaaaaccaaagcauuauuucuuugauuucucuuugguuugcauucuuaucccagagacguugaaagcagcaucucaguagaugcaggggaaguuguggguuuuaaaguuagguauguacaguaucuuuaaccugagugcaugucuuuacagaaauagugcagaguaaauaccacuaagguggagugccaucaauugaggagguuuucuauuuuucacuuggaucuauccauggcuucagaaaaauguugcuuaaggcuggagguuuguguguagggaugcaaagaaggaaaaggugucaucuguggccucuggaagcaggggguguggaauggggagaguggaugaugauguacuuguaugugagauccauggagaauuuggacggaaaggagcuaaaacuuuguguauagcugaggagucaacagcaaugcucaucuuagucccagcacacaaauacacaugaaggcaggccaaagauuuauauccaaauuguuugcuaauguacaugacaaaguacguuaaaauaaauaaucaaacguacgcaucuaccaucccuauuguuaguuaauaaugcuaugugaguauugaacaguacaaugaauugauugacaagugaaaucuagaagagcugagcauauugucucauguuuauaauccaaaauuugaaaaguaaaggcacgaagauaaacucaaggucauuuccaguugcauaaugaguuuugagugcagccugggcuaaauaagacccucccugucaggaagggaggaagagagggagggaaaaaugaggaggaaggaaggaaggaagcgagggagggagggagggagggagaggagaggagaggagaggagaggagaggagaggagaggagaggagaggagaggagaggagaggagaggagaggagaggagaggagaggaacuacaguugacagcuauaauuacaggaaagaggacauuagaaacacuauuagaaauauaaacaagaaaaccaaauggccuguuauaagaguuaagucaaugaauauaaaauaaauacucaaauaugaucaccauuucccacagcagcaggaaagcaguaguaaauauaacaacgugauguuaaaauuacaacaaaaagaucaaguuuccaagaccaaucuucauaagaaauauuucagauuuacaugaaaacaaagcuauauaaagaaacacagauaguugcuuaaaagcgaaaaauaaaauaaaaagguacaaaauaaagucauaagugaaauaaaacuagauauuuaaagaaagacuauguaguaaugccaagaccucuuuggagcaaaugcuacauuaaaugcauaguucacauaaaagucugaaauguaaguuguucacauauucuuuaacaauuaaaagauuucuauguccugauuuugucuuucacuauuguuuuccuuucuuaauuguuucuauuuaaaauuaaauguguguguguauguuuauguaaacucagaaauuauguauaaaauguuaguugccuagcucaggaauauauucauuucuagugucauauuuuuaacauaacugcuacuucuuguuaauuuuauacaguuccuuuggaaggacugaggagucaaagccaguuugaagagaugagaucaagcuauauccgcgaauugaucaaggcaauugguuuaagacagaaagggguuguccccagcucacagcgcuucuaccaacucacaaaacuucucgacagcuugcaugauguaaauaucuuuguuuuacagauuauugaugaaaacucuuaugaauuucuugucuuaguugggguuuuacugcugugagggggcaccaugaccacggcaacuguuauaaaggagaacauuuaauugggaauuguuuacagguucacagguucaguccauuaucaucauggugaguagcaagacaguguccaggcagacacagugcuggaggaggagcugagaauucuacaucuugaaaccaaggcagccaggaggaaggucucuuccacacuggguagagugugagcuuagagaccucaaaguccagucccccaaugacacacuuccuccaacaaggccacacuuccuccaauaaugccauaucuccuaauaaugccacuucccauuggucaagcauuugaaaccacgacauuucucuaaucucuaguuacaggaugaacucuggagcucuguaagcauuuuccuuuuuagacaguucaggcuccaagccuaggaaaugguaccauuaacccaaucuuucacaguguaccuaaaaacuaauauaaaguagacaaucccucuuagauguguccaaaggcuuaucuuuugggucauucuagaucuuguuaguugaugacuaauguuagucaucucaguguaguuuccccaaauucuuucuugaaguuggcuuuuaaaagacaauaugauacuguuguguucaauacggaccauauguugaucaauguugaccauauguugaccauacaaccauacuauaugcacacacacacacauacauaugugguuaucugagacauuuuuguuacaagcuuuuauuucuagcauauaaaaaacacauaaaaugagagucaaagucauuuuaaaaaagcuacccacaaucaacuugaagaauaaagcaccagugcugaagaccaaagaaaauacacagagccucaaagaaacacaauguuacugugucaaagaaagaacagagagccuucagaaagguacaguuagcaaaacuagcuaacugucuuagucaggguuucuauuccuggacaaaacaucaugaccaagaagcaaguuggggaggaaaggguuuauucagcuuacacuuccacauugcuguucaucacuaaggaagucaggacuggaacucaagcaggucaggaagcagaagcugaugcagaggcaauggagggauguaucuuacaggcuugccucuccuggcuugcucagccuccucucuuauagaaccaagacuaccagcccagagaugguaccacccagaaggggcccuucccuccuugaucacuaauugagaaaaugccuuacaccuggaucucguggaggcacuuccccaacugaagcuccuuucucugugauaacuccagcuugugucaaguugacacaaaacuagucaguacacuaauaaauaaauaaauaaauaaauaaauaaaacuuugggauuacuaaguucaaaauuguaaacaucuaaauucauauuucauguauuucacaaaggacauucuuaguagaaaaucauuuaaaacuuaagacauaaaaaaucagacaggaaaagguaggagucuuaggagaucagucaugcagauuucauccucaaauuuaauuuaauaggaauuuacagaagaaaaacuccauucagggaaauuauuauaaaaguugcugaaacugaaggauaugaguucucuuuucucauuuuuuuuugagacacggauuuuuuuguagcuuauacugcucuucagcugguagcaguccuccaggcuugcaugccugcucuuugcuaaagaugugaguuuucuaacuauaaaggaacagaauaugggcacugaguaauugacucaagguacacuauaaaaguucaucauaccaagaucgagaagacuaucccaaguauacaaaugagaaaagaagcaaaucauauuaaauuaccagcauucugaaugacauuggaucuauaacaaugacauaugacaaugagcagugucuucagaauccugaugaaaguaaaaccaucagccaaacaaucaaacaaaugacauugccaccuaaagagucuuuucauacaugcaaagucuuacagaguuuaucucaaauauaacuuuuccuagaaacuacuuuaggguguguuacaaugaaacaagcugaaggcagaggauucaggcuagaagguggugucccugcauaauaaugggaaggaucagucagaagccuguacuggaccaggaaaauaucaugagucuccagggcacccgcucugggaugaaaauggagcuaagggauuguugaaaugcacaaucauauuggggugauuucuuacagucuuucagagaacuugauuaugguuuugugacaaacgagaagaaaaaugaagaaaauaaaauaaaauaaaauaaaaugaaaauggucaagaaaagaagugaaaugccaugcaucaggaaguaauaccaacuuuacuaguaaaaauguaggauacggauuuagucaaaacuggaaauauaauagagcaagaugccuaucgaggagcuucuggacuuugcuuccucuguuucuuuugugauucaucuuuaaguaguaugauacuuuaaaaauuguguacauaacauauuuaauuaaacuagaaguugauccuguugguguaggccugguuuccccaagaagcucacauguucacagacuccucugggcuauagggaaagauuucaguggucugggacacuuagcaaagcccugucucaaaauaaagucaauaguaacgaaaggccauguugcucagcaaugcacuguuuagauaacgugccugaggcccuuggcuucaagauugauguuggguucuugacauagaaacaguacauuugugaaaaauucucgugagcaaguaggauuuaugaaauaauugcauuuugaaaauguauaacuuuagguauuuaauacucgguauauaucugcauacaugcauagaaaagaaaaaguguugaaaauuaaaucaugagaauguaacuaauuuuauuacuuuaaaauacugaagauuggggccuguagaggagacucagcaguuaagagccaucgcugcucuuacagaagaacuggguucaggucucaggacauacauauaugguggcucgcaagcaucuguaauuccaauucgaguggcucugaugccaucugcuggcuacuaugggcaguucauucaagggaugcaugucuacacacaagacaaaaauaaguaaacaccauacuaucaucaugcucccuuauguauauaaaccauuuccacauuacccuggagcauggagagaguuauuugcauucugguaagaagaagcaucuagauagguacuuacagcauuagaaaaauguuaucauauuugcacagugugugauuguauuguuugucuuucauuuucuacccacguguugaacuaacagcuugugaaacagcuccaccuguacugcuugaauacauucauccaaucccggacacuggcuguggaauuuccggaaaugaugucugaaguuauugcugcccaguugcccaagauccuggcgggcauggugaagccgcuccucuuucacaaaaagugaugacuuuucuuuguuuucuuugugaaaauugaaucuuguggugugccaucuuuuucucagucaggauggucaggucaugugucuuuauaaugccuuucugauagccuuacauguaugcacuaucacacuguaaaguuaggagaaaaccaaugacauucugacuuucuuuuguaaugucuaagcagaguuuuuuuuuaaguguugugugcacccauauuuuaagaguuuacaugguuuuuaaaaaaugacuaaaauugauuguacgaguaaacuauauuucacccauuauuucaaacuuuucagaugaguguaaucaacuuuuucaucugacagaucuccaugagaagggaagaaacaccccucccuaccuuuaauuacaacaggcuacuacacaggcuauggcuauguaguuccuuuggucuccaugcuuauauuuccaaaaaugacucuuaaaauggcagucaaaaugugaugugcaauagauuuucagagggcuuuuagugaaaaacaaaacaaaacaaacaacaacaacaacaaaacagagaugaaauggguugauguuuuuaacucuaggcaaacuguguucagggugccugccugauaacagauugaugacagaguuaauggcagcuauacaguugcugugacauuauugagggcagguuuagggggaggaugucuuuaaauaagaccugugaauagacagaaauugugagaucuguuuucucauuggaauuccugcgguuggcugaccuuacaaagucggucuccauugguaguuccauguccuugcuuuuaaaaaugauaugcagcauuucucuugacaaauguuucuuuggccauauagucuuauugaaauuuaccaaagaagacggggggggggggaggagggagaaaggcaagggugggagauaaagacaauuucuuucuuggggauaguguuuuucucuaggaaaauguauagagcgaaucagcgaaucucagguggaaauuauuuuuagugccucuaaaucugagagaugcuuuagaaauagacaagucucaguggaaaguuuugagugccuaugacccaauucuaagugagauacuucaggaaauccuagauacuugcuuaaaaaucacacaaccagguacaacacaacagauaaaacacaguuccguuugucauuucuacuuaaaauauuccuuugaaagacaaauaauaguucuuuucuaagaugagucacuggagauauauuaauuuaaaaaauaacucaaacauauaaacauacaccauuaugguauauacauaaauagugaguucuuuagcacauuuggaaaagggauuaaaguggagucuaaucagaacccgugacuugugcucccuucacgcauguggaaaucauaauggcuuuccugcacagcaguaccuuuauuagagcaguccgaguuuuccccaaguacugcaauggucagcacuaguaaauagaugcucuuccuauuggucuacaugccuccuacaaugugucugaaaugcauuauguucuuuacuggugcuuggcucuucguaaucuccauacacacaagcauacuucaucuuucaggccaaaaugagaucagauuccuugggcuauauccuaagaguuauuuuuuuaauuccucaacuuacccugcugccauuauguuccugcuaugccaaucuuuacguaagaaaaagaaagaaagcaauuuucuaccagaacuugacuccagacucuugcauguguugaccuucaagaucugcuuuaucacuccuguaaagucuuucucagucucucauacugugauuugaccccucaucuguuuccaagaaguuguuuaaauuacauuaguauguagcugcaccauucuaaugguccacaggucuagggcucgugcuaaggaaagaccauaguguuuugugacagaguugacugugacauucguccugcugagggucuucugagugacauugauaaaccucuucuugugucuuuauuauuccuuuuaucugcaacuuuguuuuucuucauuuccaagcuauauuuuccccauccugugguaacuugccuuuuuugacuacgucaugggagcacauuuuauaugcaauuagaagaaaacgguccauuuccuguucugagcugaaugaauggaauauuaauuccuucccuauaaaagauucuauaaacucugacauguuuuauauugcaaaccucaauguaaaaauuucccugcauuuuuuuuauuuucuucaacaaauauuuuugaguguguaaugugagcacaagaaaucauaugaauaagcuuuaauagaaacuggagcuaaaggaaauuguauauaacucaagaaguuauagcccaggaguuguacaaauaugucugguaagugcagggucacuagauauuuguaguauauaaacuacaucguuaagguuuaauaugugcaaggcauuacagcauuacuuauaugcaacuugaaugagauaagugcuaaaaaauaguauuuuaaaauuaauaauuauuuaaucuaggcaacugccagcaauuaauuugcuuuaaacuuuuguguauauuuguauauuggaaaaguuuuaauaccauuuuucaaaaauauaaauaaaauaaaauauuuuuaagaucucucaaauagaauaccugggaacuuuuguucuguggcaguuguauucguugugagagauuggugacccaaaaacaaugucaugaguccuuuuaguaaaguaaugaacccugaaacacuagauacaaucauuauucaguuauucauuauucaauuaguuuuccuuugaauuaaaggauuaguuugauaguaguuaucuuuguauaucagcacaguuuaacuuucaaaauaaugaaaaguuucuaauuucauuuaacagugaggaaauagaguauguuggccccaggacugaauuuuauagugucccuuguuuuggaacugucuaaaaacacuugacagucuugaccuugaucuccauggguaguuuaaaugucuaaacaccagguuuuaauauuuaaggcuaagcuuagaaagaaaaauauucccagaagaacaugacaugagcaaauggaaguuaucucaucuccaaaucuuuuaaucuacaauuccaacugccgagacuccaugccuguguagucaucauaaccuuuaucuccacucugaagaccaugcucuuuggguugcucuaaacuaaaauaaaagcuuaagaacaaaggaaauacuugaagcuuagaugauuuuguuuacugacauauuuaaaaaaaaaaaaaaagaaaaaugauuugugucuaaagagaugucaugcccaguauuguuuuguggaacuauuuuguuucugguguauaaacacauggcauguuuaguuaggcaaugcuuuuccauuguacuuuuucacacuuaacuuuaaguuuuacuauuguacauuguaugaaauaaaauauuuuuaaauagccacagu

SEQ ID NO: 12432 - RNA, 45666 nt, Mus musculus
ugcgccgcccccucccaauugguuuccgcgcgcgcgaaaaagccggggucucguucagagcuguucugucgucugcaaccugcaagaugccagcgcgaacagcuccagcccgagugccugcgcuugccuccccggcaggcucgcucccggaccauguccgcaggcgguaggugccacgcagggugggggugaggggcgggaccgaugccgaggcauauauuggggguaucuccggguggcccugcggccgcugacagccagggcgcgcaugcgcggggcagcguuuggcgcgggcugugcuuccugucgcgcgugcccuuagcuguuggcgccaaaaugggugggggccggggugcuggcaagcccauugacugggagcuugagggagcaaggggaucagcccucugaaauagaacaagcuuggggacacccucagggguuccccucuuuggucagccaggcuccugggugugcaggaagugccccucucccggccuguggacacccugaagcccccacuccgcuccagccuccacuuccggugcccugcagaucccgccgcgcccacccgagggucccuccgccgguuccccuggcccugguucagaagggcccuccuucccagccccgcugucaaguccuaggaccuuuucucucucauccugccgggccgggccugggcagcuugaagcccucgugggauuuuguuuuguuuucauccuaacguaaaggagcuccugcgauccuggagcuaucaaagagacucugccuggaaagagcuggugcugcagaaugggcccuccacuuuggcagugacauaacucugucccgagaucccagagcaaucgaggaaaccuuuaacuccauucaaaguguuuaucagggggaaggaaagaugaaugguagugagaugucucggcccccgcccuauuauuuuagccccuguaaaccaguucuuucgguccuggcgccaucgaggaagcuuuuuacauuguccaguguuuauuucgaggagugagggauggcagguaaagucccccauuucagugcauaugaauccccccucuccccccccccuccccaagcaaucaaggaagaccuggguaaugggcccuccacuaguaccuuccacgccuccaugaggacggcugugugcaaggauuggcgggaacacuggaucccgcuuccuguuccagaagggcaucgucaauccguucauuccugaaagcuugucccgcgcgucauugagcauuagucauaggugcccugcuagugcuggacacaucccaacccgauucugagucugcuuuugcuaucccggggguuaguuuacuggggugaugccaggccgauucccauuugagcuuugggggauaaagugggagaagcggcugaauuccccuugucaaacaccccugcccccagcucgcccccaggguuggaccugaagcucuguacugagcuacaccuucagcccuuucacuuguauuggagacuggccugggauucucucucucucucucugccugugucuucucagugcugggauuacugacaugugccaucaugaugguuuggguucguuuuuugaaugcuuguuuuuugauuguauaggcauaaaaaucugaagccuuugugagacaccucaacagauuucuuuuuacuaccaaaaaauacauacauaauuaaaguauuugguuuuuuaaaguuagacagucuguaaccugccuuucugucuuuugucuuuccuguucucggguugguugguuuaccuguguaugcuuuguuuucauuuccaggaagggauuccuguaggccaagcuagccuccggcuggccgucuaacccaggcuagccuuggucuuuuguaucuacccaagugcugggauuacaggaaugugacacugugccuagcuuagcuuuucuugauuuagaaaaacuuacuagcaaaauaucuacaguaugagauuugagagguaccugcauuugggaggauaguccaggagcugaguaggccucgagguagcuuccguccaugcugcuauucuguauuuaaauggcaguuuguuuaaauagaagugugcauaguuccucuggauauauaaaauauaguaucuucaacauuuggauuguaagucuuuaaguguguaugugggucuaugcuacagcuuguguggcagucaggaccccuugcaggaacuggccuuuccacaagauucuggguaugggaacucagaccaucaagcuugguagcauuccucuuaucucaccagccccagacugacaguuucucugaaauauaguaaaccuugugucauucaaaaaucaaaucaugcuuuuuagugagauguuguggccauggccuguaacaucaggaggcaggagcaggagggucacaaguuagaauucaacuaaggucucauuucagacauucacaccuugcaaggugagggauuucuuuuccugagcaggggguguccuuuccauagcugagauuccuugguuggcauggguuuuucauuucuuucaguuuuuuuaaauuaaaacuuguuuuccaggcacgguuucuguguaguucaucuggucuugaucuugccacgcucgugccucuggagugaugcguguuacaugcuuggcuugcuuuuaacuuauuuuuuguuaaaccuguguauaaguggugugugugauauacauauauacacauauauauguacauauacacgaagguauguguuaggggacagcuuuuuaauuuucugugcauaugcaccacaguggcauauagaggucuucguggcaguuaggggucuuugugguguuuauuacucucucaccucuauguggauuugggaucaaacugaggcuugucaagaauguguaacaagugcccgucucaccaagccauggguaacuacguuuaucuguuugucuguacaguguauggauggaguuggaaaacgccuuucuugagucaguucuuagggguccuggagauggaucucaggucgugggacgugacaaccugugucuuugucuguggagccauuucaucugaccguaaacuuuuauuucauuuugagacagggucuuaccauguagccucagcuaacuuggaacucuguagaccagauugcccuugaacucaaauauccaccugccuuugccucuugaauacugggcuuagagacaugugcuauuauggccagcuuaaaaagcuuuaucuaucuaucuaccuaucuaucuaucuauuuuagaauuacauuugaacuuuuuggaauugguuucuugccuucuaccuuaugcugagaggggggggggugguggaggaggcagguugauuacuuguguaggugcuuugcugugagucucugugcaccacgugugugccuggugcuggagcccuacaaauggauuuucacuuucaaccuuacuugcuuuuuggauuuuguuuguuugagacaagguuucacuauagaaccccagcuguuguagaacuuggccuggagcuaacaaacccuucuccuaccugugccucugaguaggggacugauaaccuuugcuuugggaccauuugcuuauaaccuugcagcacuugauucaguuagucugccuggccagcaggcucaggggaccuuucucagguccaugccugucuuuuugaguuuugagauccaaacuccuguccuugugcuugugugacagucacuucacugaccuccgaagcccuuuucugauggaguuuuccagacaguuggguagcuggggcuggccucccauuuccuguguagcuuaagacggcaugaacuccucauccuccugccuccacuacaggcgcuggcguccguggcuucuguggagccucagcugcgcuaagcaagcgcuccaggugcugauuuucucccucucuguauuuaggaucacgcugcagaaggcugauacagcauggcuuaacucauuaggaggcgggccgaguucuaggacuuaaacuuuauuuuugcugugcugaaguugaucucaggccuguauaucuguuagcucucugguggaggggguggggaguggggguaccucucucugcagcagauccuaugcugucccuuacagugguguaguugucauuuuuuguuuguuuguuuucgagacaggguuucucuguauagcccuggcuguccuggaacucacuuuguagaccaggcuggccucgaacucagaaaucccccugccucugccucccgagugcugggauuaaaggccugcgccaccacgcccggcugcaguugucaucuuaaucuuggugcccuguccauguccauuuauuuaucugugugugucaugugcaugcaugugcccauuagagaccacaggaagggguugggucccucggagcuggaguuacauagggagagggugcuugcuguaagcugccugacccaggugcagagcaaugcggccacgaagcagucucucuagggcuccccauccauucugggcgggggugggggguuacugggguuagaacucagggcagcuauuuuaccacucagugagcuaucugaaaaauggggcuggggcugacugcuccucaggguucuguaggccugcugaacucgugguaguagguuaggucuccacccugggccaucgcagcagugagcagggagugucuacaauauauucagguacgcugugcaguagacuguuggauuuuauuccaagcucgcuuguagaaugaucuaggcuuguucuuucugcaguuugccuaggcgguuugugugccagaucucaagucacccuucuguuuuuaaacugggucuuuguagcccaguccauuuaacucucugaccugcugccucagccuucugagugcugcugggguugccggcaugagccgccaagccugguuuagcauguagcucuuuucucagagguugaggugacuuucugucuaucuucucaguguggcaguggagcuggggcucucagacaugccaggcaggugcugugccucugagccacaccuugggacagacacuugcuguucucuugcucucguucuguaggucaggaauugagggguaggauggguagagaagaaaccuagauguccugggcuggauuccuucuggaaacgggcagggagucuguccuccuggggagcugacuucuaguuucuugcuguuugugggaaauguuuuuguuuuucauggcaggguuuaucucuguagcccuggcugagaauguagaucaggcuggccuugaacucggaucaccugccugcuugccacugccucccaagugcuggaaacaaggcaugugccaccgugcuuggcccuaauuucuuuuuuguaauuucaaggcagggucuaguuguauacuuccaggugaucuugaacucggcuucccuccugcagccuugugagccugugccagguguguauuacaucugcauacguaugccuguguaugagggcagcugugcuccucagcaugcauauagacaucugagggcuauccuaacauaauuuuuauuaacuaaauuguaguuacuacacuggggggguuguuacuguacugggguaugugugaaggucagaggucagauuguuggcauugacacacuuucaucuuuguguggauucugaggaucaaauuuaaguuuuuggacuuguacgguaaacucuuaacgacugagcuagcucucccccccccacgcacacacacacacacacacacacacagaguacauuuauugguauauuuagugugugcgugugcauguguugccaggccagaggucacuguugguugucuuccaaaauuaucuccauuuuauuuuuugagaucuuucucacaugggcuggagagauggcucagaaguuaagaggacugcuuucucuuccagaggucccaaguucaauuuccagcaagcacauggugacuuacaaccaucucuaaugagaucuggugcucucuucuggccugcaggcaugcaugcuguauacauaaauaaccuuuuuaaaaaaaucuucucggugagcccagagcucuucuuugaucagguuggcuagcugucgaaccuagggucauuuucuccgcuugcagguuuuaacguggguccaggaauccucacuugggcccuugcugagucaucccgucccucuucauuguggcuucagacuuguuauguaacugagggugaccugagccucgugauguuccugccucggccucuugaguguuggaguugcgggugugcaccgcugugucuggcuaaguccaaacugaguagucuccagcuucugaaacugucugacagggugacuccuaucccucagucuuuccugccaccaccuccacuuuagagccagccucuuaggccaagucccugucucugacccuuccuccauguuuuaguaccuuuugcagugcagcuagaagguucugugccgauggagcggagugauuaggccaugcugauugucccugauaagcuucccaucuuucauucgaaaaugcuggaaucuuagucacaucugcagagucgcuguugccaaauaaguuagagucaugaguccuggguucugagcaacagcaucuugugagaagggacgacaucauuuugcuacccaagauauuaucugauucaucagccggccucaccccauuugccuugucagaggcagggggccggguguagcugggugggagagagugcuucagcauauucaaggcccugacuuccaccccagcagcagacagaaaaggcagggcucuagaacaggcccuguuguguuaccaaguuggguuucagacgagcauuucugguuuaggauguugaaauaacaaccuuugcaaucucuccaguucauguuucugucagacaaauuuucccuaaaaguauggcuccgauguggucuuuccucucaugugguucuuuugauggccuugcaacaagaugacuacugagugucucccacaguugcuggccccucucuggacuuaccuuuucuguccgacacuguuagggcuguuuucggguugucuuagaagcagcuuccacccuggggccaccuaggucaccccuucaugcuguagggcuuguuccuucuccagggaagaguguuuuauguuuuguuguuuuuccuuuugagacaggguuucuguguagcccuggcuguccuagaacuugcccuguagaccaggcuggucuugagcucagagcugccugccucugccucccgagugcugggguuaaaggcgcgugccacuguggccccacuaaagagcucaagauuuaacuguucaucuuccuuagaugugcuaagauugggucugguguguguguguacacggcaugcauguggagggucagggcugcaguaggagguccuucccacccccuugguugcacucuggucaggcuuggugggaggugccuauaccucaacacuggcugcucuccgggaacccuacauuaucuugagguaggauggagccauacaauccaggcuggucuggaacuugucauccuccugccucuaccucuuugaguguuagcauuccaguucagugcugcugcaccuggcuauguuugccugccuuuucaagguuuauguauaguuuaucuucuuagaugacuagcuuguugaaaguaguuaugaaugaaucauagccuguaagguccgcauggggcuaagguggacuuugucauucaguguguuugcuuuuuguagccugggcuagcccaugaacuccccauccugagugcuaggauccaggccuguacuaccaugccugacugagucugucuuggaggaaucucaggaucuagaggcugcugagcaauggucacaguagcugugucccaccacgauuuuaagugcacaucacuggguuugggagugugacucaguagugggccucuugcccaacacauaggaguuucugauuucauccgagcucagguggggcauaaaagggacaagacagucacaugggcuguuguagcagcuguguuuaugccucuggccacaaagguccacuugugcagcugccuuucuuugagucuugccuuuggcuaagaacuguagguuacuuacugugggaugacuguugccgggcuggccugagcuccuuccuggaagaguuuucuuuucaucugggugcugggauagaacucgggguguuguguguguuaggcagugugcucugccacacucuagccugagcuaaaacaaucaccuuauuuuaguuauuuacgugaagccagacuagucuuaagcucaauagguagucuagguggcccuguauucuuguaucucuuucccccucuaacucccaagagcugggcucacagguguguguuaccacaccuggguuacugggugcuggggauggaacccaaaaugugcauccccggcaagcauucucaaggccccagcugccaggagcuaagucccugcucuacuguagcuagccacgguccagcugcaggguauagagcaucuuuccuaagcaaagaccugggggcugacugucaggcugguaggcaggucccuaucugcuaauaugagucuaguuacccagcuuguugccuacuuccucucucaggggucuagcaugaaugcagugggcaccccgguacaggagugguacuagaaggagggggcaggaccugccaguaacaguaauuagaguaaccauggugacccugguccugcagcugccgggaaggcuggaucugccuucuaguuacugaaaccugagaagccagacuuggaagcugcugagaugggacagagaugcacaggccaggcccuuguggugcuucucugacagacacccaccuagcugguuagaccuguucacccucuacugcccccaggcucccaggcugaguaacagguggccucuucugggucuuuuccuuuuccuucuagucuuucuccccugaccagagaggcaagagagucuucagcaguugggaccaguucuuugcagacaagcccaguagaaugcugugcggcugugcuuagauacacauucuggaggcugaguuccgggauccuggccuacaguauugugucucccugugcagugcggugcguggaaucccaggccuccacaugccugccgggccaccgcacucuuacuccugagcugcguucucagcucgccaguucaccuccagcuccucaguguguggcugugggcaagcccgauggccugggccuccuuucccauuuauucaguucugcaggagagggcugccagccauacauggccuugaggagccaucagcuggcuggguccuacaaugcagccaugacucaugcugacaucaugcaugcuguggcaggccuuuuaggagcugacccaguuagggaagacagcuguaggucauccagguuagagauggacccugacugacagcuccucaugucuuuucuuguauauuuucccucugcuuggaaacagggucuccuguaguccaagcuagccucaaacucacaguacaaccaaggaugacucugaauuuuugaaccaaccccuucaugcugaguccuggaauuauaggaaguaccacaauaccuaguuuaugaagagcuagggcuggaacccagugccucaugcgugcucugcaagcacucuucuggcugagcccuaucuccagcccuguuguuugagggauggucucacuauguaauccaggccaugaucugugugccagucuggcagugugagcagcuaucuaauauagcuccugggcugaccuuaccccuuucugguagaaugcugugugcgcuugcucagguuacuaaggacaucguaggaaggcgcagcagaacguacuagaaauucaggugugguggggcaugauuguaguauuagcauuugggagguggaggcaggaggaguaggagaugaagacagucucggccacacagcugugagacucaccucuauacaacagccaaaaaaguugaugcuagacaccaggugcaggggcagaagagggggccguguugccgcaacacucaaacauguucauuccucuuuccccuuuuucuuucccuuuucuuuuugaggauacaauucucacuguuacccagguuggcugcaaaguuacaggcuugagugauccuccugccucagcaggaggcuaaugccauaccacaccccacgccccccaguuuuuuguuuuagauugauuuucagagguaaaugaaguuacuuauuuauuuccuuuacccaggcucaaagacuuggaaagagauggcuuaacagaaaagguaaacugcucuuccuguguguacuuugugugcuuuugcguguguucaugugugcgugugugugcgcgugugugaguaggugugugugcgugugugaguagcugcgugugugugugugugugugugugugugugugugugugaggugugugugcgugugugaguaggugugugugcgugugugaguagcugcguguguaaguagcuauaugcaauuagguggguacagaggcuaggggguuggcauugggucacugugcacuuuauuuacugagguagagaccacugagucggaaacucauggguucagcuagucuaaagcaucagcuuggucugggaauccuaucugcccaaaugcugagauuguaggcuggcuacucugucugccaagcuuuuaugcuagcccuaggcuucaugcuuacacagcacgugucugaguguccgagcuguugcccgaggccucugggguugguuggguuuuuguuguuguugguuuuguuuugaggcaggauuuugauccauaguugggcugaccuggaacuuaguagguaguucagacuggcuuuaaauuuacagcaccccuccuugucuaagcuaccugaguguugagaucucgggcauccuacacuaugcgugccugaccuguauuuaguuuuuagcagagccagggcugccuuuggccccagcugcuggggcaguuaggcaucuuaguuaugcauuaguuuguuaauugcuagcuuggaaguuugggguuccucagcucuguucuuccuacaggagugugugagggagaaauuaaacuuacugcaugaauuccugcaaacagaaauaaaaagccaguugugugacuuggaaaccaaauuacauaaagaggaauuaucugagguaagucuguccuuuuucccaguuuccagaaagcuaccugcuugugaccagaggcagaggccccuguguguccuacugugaugucuuccuacuaagauauccuuuccuguuguaggaaggcuaccuggcuaaagucaagucccucuuaaauaaggauuuguccuuggagaacggaacacacacucucacucaaaaagccaacgguugucccgccaacgggagccggccaaccuggagagcagaaauggcagacucaaauagauccccaagauccaggcccaagccucggggacccaggagaagcaagucggacagugacacccuuuguaaggacacgagacauacugguuuguugguuguuuuggguuuucugguuguuuuuaagacgguaccugucaguauaggucagccuggccuuagaagucuguccugcuucagcccccugagugcuggugugauaggccuaugcugucucacaggucucaguugacuuguuugcaucuuggaggcugugguucauuugaagagucaggccacuugaaccauggcacguaccacauguauucuaguuguuuguuucuggugcugagaaggaagccuaaggccucgaacacuaagcccaugcugacacucagcugcgugucugugccccugccucuggagugcuagugguauaacccaggaccugggugugcuagggaagggcacaucuaucugccaagcccuggcuggcuuuuucaggggagggaggagcucuggugcuggagauggagcgcggguguacaggugcucugccacagagcuguacuggccucuggcuuaguuucugugcacuucuaccuagcuuggacucccacagauggucccuacaugagguuucauucaguuuaggguuuugcgguuuauaaugguguagacaugguagguagguggucacuguaaaccguucuuggauucugggcuguaugcuacuguugcuggauacuaagcaauggcaguucuaaggggcugccugcugacccauguaaacugcuaggcaguuuauaguccagcugagagccaagaagugugcauucuugcagugccugccaccugcagucacuuguucuugaaguaugccaugucacuuucucuuguuuuuaagcaguugaaacuucaccuaguuccguggcuacgaggagaaccaccaggcagaccaccaucacggcucacuucacgaaggggugaguaguaaggaguggccggcuggcguucuuggggccuaagaaccuuggggagagaaugagucugagcggaugucccugccuuccauaacucauaaguguuguauuucuugccuuuguuuuaguacugaggcuagaacccagggucugguuuauguuagggccucuaccacugagccaugcccuacccacucaucagggguuuuaggcaggggcugucccacugggccaagccccuacccucucccugggggauucuaggcagagaauuccccacugaaccacaccguggcuucgcauagacauucauuuuguagguuuuuguuucuuuuucaccuugugagauaacuuaaagcauacauauacaaagcuauagaauacaguccaagaacccuuaugcugagucagaugucucagcaguuagagcacuggcugcacuugcagaggacccagguuugauucucuaccagcacauggugguuaacgaccaucuguaacucuaguccuggcgaucugcugcccucuugcagcguccuuccuuccgcacugcaugcauauggugcacagacacacacgcaggcgaaacgccuauacacaugaagcuugaacaaaacaaagaacccucguacuggccaccgguggccaccggguaguagaaaaauuggacacgaugcugcuuucacgccuuuaugaacuacuuuuguaauggaaccuugcuccauaaaguuauaccagccaacuucauagcagcauaaacuuaaggcaaaacauauauuguggguuuguuuauuuauuuuuaaagauuuaaucucaugcauauggguguuuugcuugcauguguguaugcaccacaucguacagugccuguggaaaucagaguauuggaucuccuggaacuggaguuaccgaugcugggcccugagcccagguucucugccagaggaggaagugcucuuaagcaccaagcugucucuccagcugcacacaucuguuccuaugcaugcauacauaguguguguauggcauguguauguauuugugcaaugugaucacucauccagccagccauggccuagguggaacuugggucuuugagagcagugggcgcccuucaucacugagccagcucuccaggacacaauguuucucugaaacauuagagccuugccugccacuuugcaagucucaaagaaguggaucuagacagcaauagcuucuuacaaagagaacagguuuuugacaaagauaacuguucuuugagucagccucaaaguaugaagcuggguagcucuuuuaaagaagaccugguuuuaauuuccagaaccuacauggugguucacaaccaccuauaacucaggggucugauguccucuucugaccugugcaggcaccaggcacacaguucauagauacacaugcaaaacaaagcauccacaaauccuuagagcugaaaacggggagacgaccuaguaggcaaaguguuugcuugcuuugcaagcacaagaaccuguguucugauccccaacacauguuaaaagccaggaaugccaguucuuguuuguaaucuuagcauggaugggguggacacaggcaaauccugugcccuggcuggcuagguaguguagccaagccagugaguuccaggaucagugagagacaacugucucaaaaaauaaagggauggccagugguggcgcacaccuuugaucccagcacuuaagaggcugaggcagguggaucucuggaguucaagacuaaccuggucuacaagaauuccaggacagccagggcuacagagaaacccugucucaggggggaaaaaaagggcagcuucacucaguuccagguggcucacuucuuaacaccugcuccucuuacagaggaggaccuggguucagggcccagcacccauggugccucacagccacugguaccuccaguucgaggggaccugacacccucugacuuccacaggcacuguacaauguggugcauagucacacuuacauacaggcaaagcacucauggacaggacauuaaaucuaaacuuuuuuguuuaaaaacaaauacaugggucugagcacuguacucacaacugccuguaaccccagcucuagggggccuaacucuccuggucucucaaagcacacgcacguauacacuaauacaagucauuauuaaagcccuucaguccuggauaggugggccccuccuggcagggaagauaccuggacguuuaagagguucuucugugagcgaagggaagucauugaggaccaccagacagcaggggggucucggcacuaacagucuccucacugugugacagccccacuaaacggaaacccaaggaagagucggaagaggggaacucggcugagucggcugcagaggagagagaccaggugggccagcccugucggcucuggacacucugauuuacuugcuagcagagugagcaaagguggucuaucugaaggcagucuccuuauauauaguagggguguuucagagucuguggcuagacgagggcgaggggcaaccuguugauggacugugcuacauggugguggaccccgguggguuugaaaauaguagcccagcaggcugagugcugggacagcugacgcuguagaucugaucugacagcauuaggaggcagcucuacuuaguuuauuuuuuccaauguugggaucaaaccuagggccucauucauccuagguaagcauuguaccguugaacucauucugggccccaguguuggacacguacaaauauauugacaguauuauguagcccaggcugggcuugaacucuugaucuuccuggcuccaucucccaaguacuaggaugauaaaugaggaccaccaucaccagcugguugggauuucuauguauauuuuggguuuuguguguggguuugugcacaugugugcaggugcacaagaagccagaguuagaggaguuaugagccaugugagaugggugcugggaacugaagucugccgcucuagaagagcaacauacacucucuagugacugagccaucucuccacacacccugcgccucuuugagacaggaugucccuguguaauccaggcugcccugaagcuguagcucagggugggcacgaucuuacggugguccuccugccucagcuucuugaauaccgaguugcaggucugggcuagcacgccuggcucuccccacuuguuuaacuuguguuuguuguuggucugcuuuucgaaccaacguugucuucucuuccucccucugcccaggauaagaaacgcagaguuguagacacagagagguaagaauccauguagucuccucugauuugucucacuuacagaaauugccuucugaauaguugaaagaguucuguaguaacuauaaaccuauucauggugcugaauuuggagccaaauuauuacuuuuguuuuguuuugcuuuuuuguuuuguuuuguuuuguuuuguuguuguuguuguuuuuuguuuuccaagacaggguuucucuguguagcucuggcuguccuggaacucacucuguagaucagacuggccucgaacucagaaaucugccugccucugccucccaagugcugggauuaaaggcgugugccaccacugccuggcuuggggccaaauuaugaaucuuucaauuccuuccuccucacagaaggagaugaggucuccuggugucaugaggccuggguugguaagagaucauuuggcuguuaguucuggcguggcagcuucuguugguguaggaaguuggguucaugaagcugcuuccggggcucgggcugcuuggguccugccuagguaauauucuacuuuaccugacaguggugcugcagcugcuguggagaaacuggaagagguaacagcgggaacccagcuggguccggaagagccaugugaacagguaaagcccccccuuccuugagcacaucucugguggaggugggggagcagaagagggguacgugacaccuggcuuagggugacgagauggaaagccucccaggagggcuccuuugugagccgagagguggugcuuacagguuagagguuccguagcagcauccacacacgaaguugccuucagggcugggcucuggcucaguggcagaggguuugcauagcgugcuugacgcucccgucccauccccaguauccucaccagaaagaccccucccuaccuagcauggccuccuuggcugggaugaggucagcucuuuccuucaagccacccuggggggaaaugaaggugaaggcucugagcugcacagaugcuuuuugauaaccguguagcuucguugguggagcacuugccuggcguguauaugcagccuuggguuuuauccucgccaggaacaacaacaaauuuccaggccacuuagucuguacuugggaaagagaggccauccuuuucucucucucucucucucucucucucucucucucuuucuuccuuucuuucugauugguuuauuuuauguauaugggcacacuguagcugagcagcugguugugagccuucaugugguugguuauugggaauugaauuuuaggacuugcuugcucuggucagccacaauugcucaggucaacuccacuggcucagucccugcucgcucaggcccaaagauuuauuucuuauuauacauaaguacauuguagcuacaccgggcgguggugacacacgccuuuaaucccagcacuugggaggcagaggcaggcagguuucugaguucgaggccagccuggucuauacggugaguuccagaacagccaaggcuacgcacagaaacccuguuuccaaaaaccaaaaaaaacccaaaaaacaaaaaaacacccaaaaaguacacuguagcugucuucagacuugccagaagaaggcaucagaucucauuacaggugguugugagccaccaugugguugcugggauuugaacucaggaccuuuggaagagcagucagugcucuuuccugcugagccaucucgcagccggaggucauccuuuuuuacauagcaaguucaagaucagccugggcuacgugagacuuaucucaaaaggcacccaaaaaauuacauuuauugugucuguuagaguccauacauguggaugugaaaaacagcuuuuagguguucuuuuuuaucauggagcccaggaaacucgggucaucagucuagacagcaagugccuucagccacagagcaucucgcuggcccuagauuuguccuuuucuguucagggaacucuaacuugggucauuagacuuguauggcgggcuuuugugcuugccaagauauuucccuagcccuuuaaaacucuuuacuuuugugugugugaacugcagcaccuccccugccccaggguuugucuccuaaggaugccuuugcugucugcugacuccacuagaagacaguuuuauuauuuauuuauuuuccccugagacaggguuucuuuuguguaggagaaaacuuggcugucccagaacuagcucaguaguucuagacuggccuccugagugcuggguuacaggccuguggcaucaccgcggggcauaaggaagcaggguugggagguacuuuaaugcaggcuugugugugaguugagaaaggcaaccuccuagagacuggguguggcucccccagaauuggaguaagacaaaacuaagugugguccgggcuccaggaagagccacccaaaacauucacuuaccaaucuuacuaacuagaaccuaguaggguuacugccggucugucaauucaggacaaauuggggaauugacuuuucuuagugguagugccagggucucaguuuguauguauauguggccgacgucaaacucaauauguagaccagacuggcuuuuuauuaacucuucuuuccucuccuaggaagaugacaacaggagucuucgacgucacaccagagagcuguaagugcagcugucaugccuccgugcccuaaaguggugcuugcuugcagugucgcugcugugaacaggggccugggacugagcacuaguguauuuuguagccugagaaguuccacugagaaaaccuagaccaaggugggcuggagagauggcucagcaguugagaacucuagcuccuuuuguaaaagaugcuggguuuuguuccuggcauguggaagccaacugcugccuguaacuccagaucccaggggguuacuccuccggcacauguauacagaugacaugcuggcggaacacccauauacauaaaauacggauagcugaagaacagacccaaggaccucacccagugagguggcucacuggguaaaggugcuuguucgcaagucugacaguugagcucaacccuggagccugcaugaugaagguugucuucugaccuccauaugugucuauacuuguacauacagauaacuaaaguccaaccaagcuggccauggugagacacaucuggaaccucaccuuguguuggaggcuaaggcaggaagguucucaugaguucaaggccagccugagcuagagugagccacuguuucaaaaagaaaugagaaaccauuaagaaauaagagcauuguggugcacaccuuuaauccuagcacucaggacacagguguaucucugaguucugagucaaccagguuucaggacagccaggacuauagugagacacccugcuucaacaacaaaagguagucugccuacccuagaaaaggguagccugcgaccuucuccuuacucagacccugccucagcagucacguugccauccaucacguuacuaguggcuguuuaagugagcuugugcuccaagugucuuggcugacggugugaaagcuuagcagccacugagcucgucauugagccuugcaccuggcagcugauucuggcugacagugggcuaacuuaauuguccaccacuuaguccacaugaagacauccuuauguccauagaagggcacaagcaacuagugcuggccuucaauacuaaguuuugauucugguguuuguauauauuuuuuguuuucgagacagggcuucucuauguaguccuggcugcccuggaacucgcucuguagaucaaacuggcuuugaacuuugagcagagauuugccugcuucugccucccgagugcuagagauaaugcugugcaccacgaccuggcuuauuuggagguuuuuaauagauaggaucuccuauguaauucagacuugaucucugcuucaggaucaagaauacaagaauuucaggccuguucuaucacauccagauagagaugauccucgugacaugucuuaacaugugggugucucgaauccagacaggggauuucuuacuggcaugcaucuaugaguucagaugggagucccaauugacucuggaggucacacuagggcuagacucacaccuccuaagcacuggagucacaggcccugcccagucagugcuuauguaggugcugggcagucugaacuucaguccuuuucugagcuaguccagucuugagaugguaucgguggugguuuucggguuuuuuguuguuguuuuuguuuuuaaagcuucuguuaacacucacuugacucaugcaaauauugaaggcccaagugcagagggcagccuggugccugauccacagaugcgcaggguggaggguagggugcagaagaguaagacagucgggcuccugugggauggaggccagccuucugugcuugcugaugcuggccucgccacucauuucaucacgacaguccugucugccuccaggaccgccagugaaggccugcuaguuguuuguccuaaccuuuggcaucucugauuaucguucauuugaagagcuaaguggugugguugauagacucggggugugcacgggcgcacaccaguguguuuaucugguguauacccaugcuccaucuugccugcagagguaaggggagagcucccagguuucacuucacuccucccauugugcauuguggggauggaacucggaucaucaggccuacgugguaaaaucuuuccucuguucagacgucuggugggccccagcugagugcuuguuaucggcucaugaaugcuguaggcuugagccccaguucugcaaaaugcauaaaaucaugaaggauaaacagguggcggguaggaagggugaccuggucucgaacugagaggacacauuuaaacccgcauuugacugcccagagcauugaugaucaguguccaugugugagguuuuuuuuuugcuuuuuuacuuggcagaucauugaggcggaaaucaaaggaggauccagacagagaagcaagaccggaaacucacuuggacgaggacgaggacggaaaaaaggcaaaguccuuacuaucuaagugggcugugcugcacuccccuggauuggcagagauggugcugggcaggggucugggcgcagcaccugcuccucaguacucgggcagguuucccuggucuccuuuggguguugguugucacugcacguuggagccugucaauucagcaagccugccugcuccuuuaaguccuaaguucaguucuugacucuccaucugucuuugcuuacucagcugagcaucuuccuauccuaaacaggccuggcuaauggaacacaccuguaaucucagcaggaggguagaggcaggagcaugauccuaaacaggaggaucccggccagccugaguuaaaaacuguuucagaacaaccauaguccuuccugcaaagcaagagcauacaguuagacgucggugcaaggauucucucaguaaaauacguggagauugaacaacccagcguuugcuugggugcucauguccucuguaauccccucuagugcauguguguuaccuagcacccugucugugcuguuugcuuugcugguaugguccuguuuaaaaggggauagaaaaggacagucugugggcugaggacagguuucugagccucuugcaucuacagucgguugacucuugagggauauggaagacugauugccuuaggugccaaggccucugauagggcacagugcucgcucuguggaucucuagggcagugagugaggccacagacucaugucucagguguccaccuuaggagaagccugaaauagcuaccugguuuccuccccauugagauuuauagaguggaguuugagcccaggcgagccggcuugcgaguguucucacugcuugucuaagaaugcaacagaaguucucauagucgccucaggugcaguaauauuucugugugucucccucuuugcccggaugccaguggaucacugucgaugcuuaccugaaagcagggaguuuuugucuguauucuguuuuuuucaugaguguguguggacaucaagaggacagcuugugggaacugguucuugucuaccauagggaccccugcaauggucaggcugguuugcaggagucaucuuguuggcuagcucuugguuugggauaaguucucacucugcgacccggauggccugaagcuugucaccuaucccaccaugccucacagcugccuugauaugagagcaauacucaaguuguuauguauagacccacucauaccagauagguaucagugaaggacuccucauuuauaagcucagaaaugcuacacuggcuagugucuguuuggaacacaacuguguaauccccuugcccuccuggcuuuccugccucucgcuccauccccagugcugggaucgcaggucugugccaccucccccaagaccucacgcuguccacugaguccacuguuugguuuugagacagugucucacuguguagucccggcuggcuucaaauucagagcaacaccugccucucccucccaagugauaauuaaagaugggugucaccgugcucagcugugguuuugucuuuguuuuuaggucuuuugagacaggguuucucuauaucccuggcuguccuggaacucacucuguagaccaggcuggccucaaacucagaaaucugccugcuucugcuucccaagugcugggauuaaaggcgugugacgccacacccggcuugucuuuguauuuuacggcaaggucucaggcuucauccucccccaagugcuagguuauagcaugaccaccaugacuagaaaguucuguagugccuguggaucgugaagccucugguuuccccguuuuggcucaggagagaaucugucuuguguucagaaccaagaugcugaaccuaugcucuucuugcauucacucugcuuggccucugaaguaacguuguuguuuucucuccaugguuugcugucaggauaaaagaaguuccagacccaggagccagcccagagauccguaagugucaaaagugcuugcaccuugcuaacuguuaacuccuaaaggcucugcuagggagagucugaguagacagggagaccagggagucuggggcccuagcuggggacccugugaggguucgcugggccaccugcagaccuuucagaaggguuucugccuucagagccuuuaugauuuuugguuuaggggugaaaguguugaacugucuuauggagcccauggugaccuugagucccugauccacucacugccucuacuuucccugggcugagauuacaggugugcaccacugugaccuuaaaaguuuauguguuugggcauuauggccgcauacgugccauucuucagaucccuggguuuaaagaauuaaacauuuuauuuauauauacauguuagaauuggcuggaugcaugaagugcucucagaggccccaagcaguuguuggauuucuuggagcuggagucguaggcuagugggaacugaacuuggguccucuagaagagcagcagguacucagcuguugagccgucuccccagccucuugguuuauguuuguuuuguuuuucucuuuuguuacuacugagaaacuaaugcuaccaagaagucccauguguugcccaggcuaaccuggaacucaugauucuccuuuuagccuuguaaguguuaggggugcaagugugaacuaccaucuauggcggugcuugcuuguguguguuuguguguagucacaagguugacacagggucucucacugaaccugaagcucauggauaugcuuauguuagcuggccaguaaguccuguggauccuccugucucucccucuccagcacugggauucccgccgugugccucucgugccggcuuuggacgcugaugaucaaagccgguccuuacgcuuguaaggcaucuuaggcugccucagcugcccguguccuucagaaguggaagcugguuuucagagcuaacguuugguguguuacuuguuuguagagcugccaaacggagacccaaggaagcagagccagagcagguagcuccagagacucccgaggacagagacgaggaugagaggguaagugcucugccccuucucuucuugacuuuuucuuuaggaaaagauuggauguguaugagugucuugccugcguguauguuuguauaccacauuugcgcagugcccacagaagacgguguuagauggccuggaacuggcugugggggcuaggacuugaaccuuggcuccucuguaagaacagcaguguucuggcucgugauugcauuuguuucagauuugguacaaauaauguagaaggucuacucagcgugggcuguaauuuguggaagauguccugugguuuuccagcucgacugucgcuucucuggcguguuucuugcucuuguuccccuguggggauucuggagguggcgagcugagacuuuagcugagcccgggcaccgcgggcuucaccugucuguucagccgcuuauaucauucgucuuuaaguaugggggugagagccaggcccucugcuacugagccccaacaucgguccuaacucaguguuguuguucuuugcuguuggcuuuuugaaguaaggucuuucuucauaguccagguuuacccgugucccucacuggguugugaccugagccaccauaccugccucgccuaacaucuuuagugcuuuuaccuaaaacugacuggaagcugcagagggcaagaaacucggucucuccuucgcuuguuugugggaauucauuuaaaaccgcugccuguguguagccucuguuugaagcuugagcccauauuuauuuccuguugcuugaaauaacgggugucuggggacaacagaucuccauggaucauugccguugaggccacucuggucaucuagccugugcaaggcucuggauuccaucacccagcauugcaaaggggaaaaguugggcgaaagcagcugcaaucccuaaccaaagggcaagaggcaggcagaucucuugaugugaggcucucaaaguugcaaccugacucucucuucaguuagcacuggacugauucucugucaccuugcucagaggugccucuggcaagcaccuccagugagucauguauucuuuugaacuuggugauuuuaagaggucauuguuuaggagagccccacaguuagcuacuagagaggcugcuucuggcucccagaccacgcccauauuguuguggccucauguagcugugcauggcauaaggagagacugggcucugauagccuccuuuccacaaaauggcuuauuugagcuggcaguuguggcgcacgucuuuaauccuacuauuugggaggcagaggcaggccaaucucuugaguucgaggccaguguggucuauagagugaguucuaggacagacagcagcccagagaaacccuguuuccaaaacuaaaacacaaaagguacagcuuuuggaccagggccucuguugggacuuuuuuaagccuugcuuacaucccuaagugcccuggcuccuaaugugcccaugcugggggugcuugcuuggucuuuuucuguuugauuuuagagacaugguuucucuguccuggaacucgcucucuaagccaggcugaccucaaacucggauucucugucucugccucucaagugcugggauaaaggugugugccaccaccgccuggcuuuuuuuuuuuuuuuuaauauaaguauaaaaguauaaauauauauauaaauaaauugaauagggucucaccaaguaucucaggcugacuucuaacucaugguucuaggcuucugagaagugggguuagggcagacuuguccugggauuuggacauuagcauaauuugggccucauugccugaccuuaaccaccuuccuuccuggguaaguucuuaacccuaaagugcuguccaaaccaagagagguccuguuccuuuguuuaggaggagaagagacgaaaaacgacacguaaaaaacuggagucacacaccguucccguucagagcaggugaugguguuagacagucccagaaagcggggugagagauggguucgugaacugucacagcagccuuagcuucuggugggagugcagaccaggauauucggcuucugcugggcacguugguagagggucccuuagaccuccucguccugacagucaucgacgugcaugggguggcuuagggggggagagugagcgcaaggcugcugcugguguauuucaagcugaugaaauggccaacaaccuugcgcuuccuuccagaucggagagaaaagccgcucaaagcaaaagugugaucccgaagguaagugcaucugugggagccuggccggcagggaggguacagcaguuccugaugcugggggcugcccucaggccgugccuguuccuucccacagaucaacucaccaaagugccccgaguguggccagcaccuagacgacccuaaccugaaguaccagcagcacccugaggaugcugugagucccuuucugcccucacccuuuuaccccccugccaccuggugcccacgucucacuguccccuguccuucagguggaugaaccccagauguugaccagugagaaacuguccaucuacgacuccaccucgaccugguuugauacuuaugaagauucucccaugcauagguucacuuccuucagguaaucgccgugcuuggcugccugugaugauguccuacugguagaugccccuauucggggcauccauguauaaaguccuucagccuaaccacagggcucuggagaugcucacccuguaaagagccaagaggccgauuaaguucggguagacauuagccacaugagacgggguuucacuugauaggcgguugugggugaccuugccuuuugugcaguucugggaugccagaccucacguacgcuaggcgggcacuucaccggcugagucacauuuccagccccgguuuuugcuuuuguuguuuucuguuuuguuuuuccagacaggguuucucuguaauccuggcuguccuagaacucacucugcagaccaggcuggcuuugaacucccugagaucugccugccucugcuuccagggugcugggguuaaaggugugugcuaccaccuccaguccugcuuuugucuuuugaggcccagggucuuuagucuuuaacuaugucacuggacugucugucggcucccuuucaucccaaguaugccaccacacagagcaucauuuuucuuucguuuuuuuuuuuuuuuuuuuuuuuuccuuuuugaaaccaggacucacuauauagcccuggcuagaacucuugaaauugaucaggcuagacucaacuuggaucugccagccucugccuccugaguacuggcacuaaaggugugcaccacugugccuggcuacaaagucuagcuuuguuccaaugcuguuucacugugcucgagccuaggcccuucugcgcucuaggcgagugagcuccucccagcggccccacaccccccacacccccagguuuguuugccgcuuugagguuggugcggcucugagucuuuagucugugccagucugaagcccauuccugugcucacacaaggaccagcucugagcugugcagggagccaaguccacagacguagcacgcagagccuugccuuccugucacagaaaaccagugagugcucucacaugauuugguaaugcuugcaacccaaaagcacuuuggauuugcauuguuuugcaguaucuguguguaucucgcaagguauccugggacccacaucuagagaugagacucccuagggcucggguucaccaccugcuguggacccagcaguccgggccaggcuagcucugaguuuuugguuguccucuuaccuccuuucaagugcuggaguuccaggcaugcccgccaucuauagcucagacaguaucuccuuagugcacuagcgguuugccuugacuuuguuuggaaggcucggaauggcaauucccgugugcuguagacuuucaugcucaaugugggauuguggagguuggguuaguaaucgucaggcuaacagcuccaggcagugaagagagccugacuggcagagaaauggcagaagcaaaguugcagucggaauggaggcuugccaugaagaaaggcuuugugaaggccaguggggcacagagugggccgaggcccucggcugugcuuggugugccugaaggcuugggcugggccugaucugaccgggcugcaguaaaugcagaggcuauagcggcugguggagaggcaggccuagguugugaccaggcugggacacacgaguccugggcugugugguggaaggacgcccucaggaagcaccauuggcacugcagcaggcaucauuccugggcugaacccaccgugggcuggaaugccuagggccauuuguguccagaucccugaguguggcuguggcuguccucccuaccagguggcuggucacuguuaucucuucccugcugcuggaacacugauucccauagaggauacuguccgccaguaaucuagagggcuaggccuuaauaagcaggagaccucugaggggcccguugaagccugcccugugauggcagucaggaguggugucucuguggcagccucgggguugaggccaggcuuccaucagugaguuauucagccaccuuccugguaggggaaggucugagggcacacagcccuugugcuagaagcugggcgccauaagggacuccguguuaacugagugacuaguagaaacaaaccuugggcaggaucaggccgggcacuacaauguucuuuuuagucuggagaguaaauucggguucgguuccugauaccuauguaggagcccucugaccuuggugugugugcuuguagugcaggggagggagcgagaguccgggugggugaagggcggucuuggcucucaguguuggguuuggugguaaagugauguuuguugccuauucaguguguacugcagucgcgggcaccuguguccugucgacaccggucucauugagaagaauguagagcucuacuuuucugggugugccaaagcaauucaugacgagaauccaucuauggaagguaugugaagugcucaaacaaggguugucccaagaagcaagcacaucuaggaggcgagauaucccuccuaugggagguacugcuucaagaaagagcuugaaguucugccauuaaccgacaaaaugacuuuggaaaggcagccugcuggcugggucgcuggcggggauaugaguugugagucaccauguuuuuagucuuguuucuuauagaaagacaucuuuucuacaggugguauuaauggcaaaaaccucgggccaaucaaucagugguggcucaguggcuuugaugguggcgagaaggugcucauuggcuucuccacuggugagugucugcaggcacagcauccuggaaccacccgccugccugccugggcuugcugggcucugggcagagguuuccucgggccuggggaaucugguggcuaguguugaucauaacuggccuggaagcggguccuccacacguaggacagucaaaugcuuacaauuugaauggguccaaaacuuagcuaaguucccuuuuuuucuggcccaagugguucuagcuaauggagaaguugggcuguugagguuugguugugggcuuuuugguuuuuuuuuuuuuuagguuguaggauaaauuuuagacuggaugcugggaggauucauacuugcccuguguucagccuggaggccaucagcuuugagauggccuuaaguuucuuucucuacacuucccugugaauguuguguacuguaccaugcauguggggucauauaggacaacuuguaguugauucucuuccucuaccaugucagucccuaggcucaaacucaggucgucaagcuuacaaauuagugcccuuacuggugagccaucucauuggccuugaaacggcuuuuucaaaugucuuaccugcuggacaaagcagguaccgguuguccuagcuauucaggagguuugaggaauucagggccagccugggcaacgugaccagagcccauuacucaaaccaagcagcugucugcauaaacgacagggguuggagguggaaaugcuggucagccuaacuggacugaucauuccuccacauucuugaaaaacacgaguccugcuuucuuccuagcauuugcugaauacauuuugauggagcccagcaaagaguaugagccaauauuugggcugaugcaggagaaaauuuacaucagcaagauuguuguugaguuccugcaaaacaauccugaugcuguauaugaagaccugaucaauaagauugaggugcgagcuuugccuucccuuuggguuuggauccacauagaagaauggguacaaucuucugcuaccacuagaagagcuuugauauagaugaauggagcaggccuuagggcauggcacaguuguagaaccccugccuagaacuccccagcgaggggcucagguacacugcggcuuagugguacauugcuugccuagcaugcgugaaguacuaggcucuuccucccccaguauuacaaggaagcaaaauauucaaaacaucugaucuucuuuucuucccuuuaaagaccacuguuccuccuucuaccauuaaugugaaccgguucacagaggacucccucuuacgccacgcccaguuuguagugagccagguagagaguuacgacgaagccaaggacgaugaugagacccccaucuucuugucucccuguaugagagcccugauccauuuggcuggugucucccugggacagagguaaggauguagcaagaaucagauuggaggcuugagaccagaggaggcaaucuccuguguuugguucucugaaacgguggccaucucccucaggcgagcaacaaggcgcgucaugggugcuaccaaggagaaggacaaagcacccacgaaagccaccaccaccaagcuggucuaucagaucuuugacacuuucuucucagagcagauugagaaguaugauaaggaggacaaggagaaugccaugaagcgccgccgcuguggugucugugaggugagccggcuauccuuggcaccccuuccuuagaugugaaggagagcacuccaugcuuugggguagccuccugacccucucuguccaucugggguugaagucggaguguccaagaccuuuggucuugcugaugcuaggcuacagauccuggguuuccugagagaugcuagcuccgccucuauuuccuguggguguugagagagcagacgcugaccccaggagccaaagcuguccccuccacccccacccccgggcacauuuccugggauucuaucuagaacugaaagugcacauuucucucaguuuagacuuauggcugcagaagccucuugcuuugaccuccaagagcuggccuuacagaccugugccaccgugccuggcucuugugaauuauaaauccuuuucauauagauagccuuggaaucaaccuacauuacacuaaacaagcaaacacaaacuucaaauaaugugguaaagcuacacauggaggcgccggccugugauccuggcccaggcugagaaguggaggcaggaggaucgggacugcagggucaugcucaguuuaucgugaguuugaggucagccugggcugaauuuauccuaaaccauagccuacacgugcauguguguucugaggcgcuucuguguccagggcugacugaaacuccucgugugcacuggguauccagguaugcacugccguggccagaccugugacgucaguguguccugccugacagcagcuugcagggcucgccuuggcccaggcuguacagggacuuggguauccuguggcuuugaaugggugaggagacuccugcgugugcuguucugagcauccagggggcagcuggggguuuauuuucuucagagaaagucaccuuuugcaauuuaguguuuugacuuucccuggguagagccuggcugguuuccacacaccacaguagcauguccucuacucucuuggcagcccucgugaggaugcccuguccucgcugugccucgacuuugcucacuguccuuguaucugguguuuguuuuaaaggugccccuuuuuuggcaguggugugggagugugguugcaguggugguggguuuuuuuaggugaagucggguacuugaugguccuguuugguuaccuuauucucaugguucguuuuuguuaggggcuguccccacugacugguggggacucugguagcucugugacacucaacagagcugcuugugagcuucuaaggugccgucagcacccuguucaccuccggauucucagaugcacacgccccuucugcacguguccucugugagcagccggauggccugguaccuaauacagguuaaggccauguguggcugccacacuauugcucaggggaagggucaacacacucuguucagcacaaggccaguauguuuucagaguuucauuagagagcugucugcaugggccacagugcauaugaaggucaggaggaacucuguagaguuggguuucugccuuccugugggccuuggguauugaacuuggguuauaaggcuuggcaccaagugccuuuacccacuggcccaacaugcagauuuuugaaaguuauaauuaaaaauuccugggccugggugugguggcacacaccucuaaucccagcauucagcugcagaggcaggaguaucugaguucaaggccagccuggucuacauaguugcaugacagccagaguuuuguagagagagaccgucuccaaaacaaaaacaaaaaggccaaacaaaguuucuaguugagaauugcugauugaucgacuuguuugcuauuuuucaggucugucagcagccugagugugggaagugcaaggcgugcaaagauauggugaaguuugguggcacuggacggaguaagcaggcuugccucaagaggagguaggcugugcuguauucuacucggauaacagagcagccagggugccagggcgugcugcagggacgggguguggagcugacaugcgcuuugcugggguugacugcaguguguguucugcagguguccuaacuuggcggugaaggaggcagacgacgaugaagaggcugaugaugaugugucagagaugccaucacccaaaaagcugcaucaggggaagaagaagaagcagaacaaggaccgcaucuccuggcuugggcagccuaugaaggugaggccccuuccucuucaugcuucuucucuucgcgccucugagcccagccgugcagccaggaaccugcuggcagccucccgagagaggaggacugucguccagcugcuguccccuuucccucccucguuccugauacugggaguggaaugcaaggccccagacugcuggacuagagcucugcaccugagcugugccucacuccucaugguggacccugagccgaggcugcagcacagguagcccauccgcuugugcccuuuguggugcuccauugccaccucucaggcgcuaagccgcgugcugcccugucagacucuguuuuguugcuauaaaaaccaagccugauggugguggcacacagccuuuaaucucagcacgcgggaggcagaggcaggcauggcaggcauagcuugaguucugggcuacccugguuuacacagcauauuccaagacagcaguuccaagaauggggaaaggucagaagccuuguggguuugguuugguuuggagaugggaucuuacuguauaaguuagaacuucuauuuucauuaguuuuuuuagauugauuuaucacauguagauggcugggguuagaagaagauauggaaucaucuagaccugcaguuaagguugguucugagccacugugggugccgggacccgaauccagguucccuguaagagcagugagugcucuuuguggaguugcuuucuuuuuagccuuuccaaagugaggauuacaggcaugcgcuaccaaucucagcggcucaugccuuuugagucaagguuuuuuacuguguagcucuggcuggccuggaacucaaugcagccugccucugccuccagagugcuggaauuaaagaugugugccaugacaccuggcuuuuuuucuuaauuugauuacauuuacucauggaugccgcagcacggugugucaggacaggucguguaagucgccaaucuccaucucccauguuggucccagagaucaaccuuuggucaucugccuuggaagcgagcuucuuuguuuauccacugagccaucccauccuccaugacuuaguaaaucaaaaguugugguugguugguuugucuguuuguuuauuaaggguugcuagggauggagcccagagccugguaucucuuaaguacacuuugcacugcugacccacacacccuuagucccaaguaauuuucauaggaagucagggagagccgccacccagguuaaaucuagugagagccuuggaugugacuaucaccugggcuccaucgcuugcuuucagauugaagagaauagaacuuacuaucagaaggugagcaucgaugaggagaugcuagaggugggcgacugcgucucggucauuccagaugauuccuccaaaccacucuaucuagccagguaugcaugccugccuuuucucuugaacaccucaaguccaacuuugucagaacagaccccagguucugcugguuacaugagacauuucuuccccguccugucuuaugacugcagggucacagcucugugggaagacaaaaauggucagaugauguuccaugcgcacugguucugcgcugggacagacacaguccugggagccaccuccgacccccuggaacuguuccuggugggcgagugcgaaaacaugcagcuuuccuacauccacagcaaggucaaggucaucuacaaagccccuucugaaaacugggccauggaggugaguuccuccuuucgucccuauguucugucccaccguuagagccgaggcugacacgagucugucuccauagggaggcacagacccugagaccacacugccuggggcugaggauggcaagacuuacuucuuccagcucugguacaaccaggaguacgcaagguuugaauccccacccaagacccagccgaccgaggacaacaagcacaagugagugugggagccaauagcaggccuccccgugcccacccugcucuguggcgucaagaaaguuuuacuucccaguugugcucuuugcugaccaaagaggccuaacauauggaaauguuuaaaauguauggaccgguuggagguuaccuugagcaagguguggccuucuguuuaaaaauccucauuuguggugcugcguuguagcccugggccuuggacacgcuggcagaacacaccucugcuguucacagccucggccuuguuucuaguauugauuucuaucuuugagcugugguccccaagagcugucuacaaagugcagacauaaagaaggggggcaauuauccagauaccugcagauguucuuggguuucaguggcugcuccugccacuucagagccucgagcuuuucugcucuugccuuggcuucugcagguucugccuaucuuguauccggcuggcugagcugagacaaaaagaaaugcccaagguccuggaacaaauugaggagguggauggccgggucuacugcaguuccaucaccaagaaugguguugucuaccgacugggugacaguguguaccuuccucccgaggccuuuacuuucaagugagugucccaugucccauaccagucagcuggcuuugugauaucccagcugauccuauaagccaguguuagaccaucauucugguuucuagugagaagccaauaaccuaaugacugcauuucaguuucagagcuauuagcuauauuacuauagcaaaguaccugauguagcugaguuguaauauggaagccauauucuggcucauuuuggaaguuccagcacaagccugagggugacagagcucgugucaucugguuagggagugaaggagagaagagguucuguugccacugucgcagccccuugagggcaacagagggcguaucuccagggacauuccuagccuuguaaaugcucauggcuugcuaauagugcagcccuggggaccuuuagcacacugccucgggagccuucuuucugcaucugagcugugagugucgugagccugggugagacccaccaugcuggacagucuguuccucccucagcucagccucucagcagccgggaggccucaggcuuggguuucucccugcagucuuuuuccugaagcugauggggucuugucugccaggacucgaagccuguugaagaugcagugcucuacccacggucuggcaaaugagaucuuuuacuguggacaggauaccucagacuccacguguuggauguugggacaucaucaccuucacucuccauccacuuuguccucaacacuagcaaaaguuggaauugccguuuguguuuaccaaacuauaccucaggaucuagacuugaggacccauuuuccucgugcccagugggaccuuaacccccaaauucagcuuagucguuugacccauggaacugaggcauuggguggggccucugugcuacugguguuagguguuuuaccagucuaguacugcuugucuuuggugcccucuauagguugcccccuguaaaguuccgugccagguagaggcacagcauggaggucacacacaguucucagaggggccucugggacuagagcagacuguagagcccagauaagaaagucaaggcaacugcuacccagagugggcagccagcuuugucauaaguuagaccaaguucaggcuuucucaggguccauccuucaccaucacauuuacagccuuacaucuguucuccauaguccaggaagugaaagucguguccaagcggaaagcauccacacccaccugagcucugggaauuggguggcaugagauuuuuuuugcguuaucuuuccuugacgguacuuggaugugacgaggaaucggcucacuccaaccaaucaucuaggcucuagccccaagcucaguuguacccuuuacuauuccucucugcagcaucaaaguggcuagccccgugaaacgcccaaagaaggauccugugaacgagacccuguacccugagcacuaccgcaaguauucugacuacaucaaggggagcaaccuggaugcuccagagcccuaucgcaucggucggauaaaagagauccacuguggcaagaagaaaggcaaggucaacgaggcagacaucaagcugaggcucuacaaguucuacaggugggcgugggcucugccugcccagaggccuuccaggaggcucugcugguggggguggcugcuucugguuauccugagggcacgaguguguuugcagagcuggagcuuuucaggcauuccuaguuguagaccaguggggaaccuaugucugacaaggaccaagagcuggugucaaugacuguguccugauuugucuggguccuccuucccaaaccacagucccuuucucugcucuugcaucgcccucccugagccugcucugcaccuuccuugcugguucuggaguuuguuuuccaguccuuggcuugacucaacacuccccuacacacacacacacacacacacacacuccccuacgcacgcacgcacacgcgcgcucacacacacacacacacacacacacacacacaucuuauaccuuugugcauuugugggugcuuucugcuucuuugauugugaauggguguuaacugguugacaaaggcaguucgaucccuaggguuugaggcuagcuuggucuacauagugaguucaaggauagccagagcuacagagaaacaaaacagaacuggguuucauucuggaguucaggcuccccuaaaacauacucugugguccacuccugccuuaauacuauauugauccuccugccucagcccucacugucuuucccuuguaaaaauccuguagcuggaagugaugaggggcuucugugaaagaaaacuaccagguagaccagccagcacagcuggaacgugagaccagccagcacagcuggaaccugagauccuugucugugcaucccaaggguuggauagcaggcaccugcuacuacaccugauuuuccuagagucuuuguaauaaugggugugguaaacaaaagagcagggcacccagcauugaugggugggaugaaggcagagaguacaccagucccugguggugcccaggaauccuauuccugcugugguauuggggccaaguaaggguugguggccaccaagcugacuggacugggauguggucuuuucuauggugcaguuugguugagcauccucaaaccaaaauacugaaaauucuacaacugaucucuucuuacaggcugccacagguguacuuaaugcuacguagagaccagagagauggcucagugcuuaagauuugauguuuguuuucuagcacccagauagaugguggccacggucaucuguaacuccaaauuccacaggaccugcugccauucucugcccuccgugggcauuguacacaccuguagccauacauacacggacggaaauuacccauucacacuaaauaaaaaugaauaaauaguuuuuaaaugcugccugaagugaccugggugacggggaugguagcugaugucugugauccugguaguugaagugcuguggcaggaggaucacugaguuggaggucggcuugggcagcagagcaagacacucucaacaaauaaaaggccuugaagcuguggugugagguguacaagacuaauaagauuccuguucucagacucggcucucaguugcugguccaggcauuucagaggagggugcucggccggggauuauaaaucugugguaaaguaguauuccccugguauccuccucacaggccugagaauacccacagguccuacaacggauccuaucacacugacaucaacaugcuuuacuggagcgacgaggaagcuguggugaacuucagcgacgugcagggccgcuguaccguggaguacggggaagaccuacuugagagcauccaggauuauucacaagggggcccugaccgcuucuacuuccucgagguggagccaagcuucaggggcaaaugugcaggagcagggugcccaagacaguggcucgggcuggggcagggcucagugagacagggccuuuguucagcagacgcuaggcuaauccugggugugucuuucgacaggagaagcuaaggaggcagcuaauucauguguagaucuguuuuuuauuuuguuuuuuuuuagugaauuuuuaaaaaaauuuuuauuuucaugagaauuaauugguauuuugcccacaugauauaugucugugugauggcaucagauccuugaaacuggaguucaagacaauugugagcuaccgugugggugcuaggaauugauccuggguccuuagagagagcagcugcuaccucaucuccccagagcugucuguuuggucuuuugagauagggucucacuguauagcccuagaguucuguaugcagauuagguugaccuugaacugacagaaauucuccugucuccuccaagugcuggaauuaagacuuguacucacaagucuuaauuccagcaccucccccaccuccaauugagucuuaggugugggauuuuggcuuuuaaaggaaagagugcagcuggggauauggcuugaucuguagaguuccugccuagcacacaugaagcccugggcuggguucccacacggcauaaacuggccgugaugcccagcgagcgggcgguggaggcgguguugggcauugacacagagagagguaguggcuagcaggccaauuguuaacauguaagguguuggggcugagcugcacauccuugcucacugcacguccgugcgcacaggucugauuucaggugcucugcaaagucaacacucgcuuuuuaagaguaguaauggagaaugcaacauuuuauugucuuaacagcauuaaaauuuauccgagacuguuuuuguaggcgucuaauaaccaugccuaggguuuugauauguauugagagcgucccccuucuuggaggaguacauuucagucccguguugguuguauguagucagcuucucuguagcguggacuggccucaaauucauacuugugccucagcaccucuuccagcugacuguagguuuugucuguuuccauuggugagaucaaauuccauugguggcuaauuggcuguggcugaacuccgauuaagagacugucggucagcucuuaaacagugugaggggauccaugcauuucuucucuacuaacguggcuucucucugcaggccuacaauucaaagaccaagaacuuugaagacccaccaaaccaugcccgcagcccugggaacaaagggaaagggaaggggaaagguguguccuugucccaucugucaguccuccugaguaugguucugagagagaaagcgugugccgucuaggcagcacugaagcccagaaacuucugccuccaccugccaaauucuggggucauagacgccagcgcuuggguggcugagucgggagggucucccaaaaggcggcucuaggucacauagcauggcagagaaagaucucccgaguaggccugaggagagcacucugcuggcucuccucauuaacuguuccuccuccagggaaggggaaggggaagcaucaggugucagagcccaaagagccugaggcagccaucaaacugcccaagcuccggacccuggauguguuuuccggcuguggaggguuaucggaaggauuccaccaagcagguaagcaggagcuggugcugacucuggccuggcuuuaggguggcuuucaggcauggccggccggccggccaagguggcugucaaguggugcgaugcauguuugagcaaauagaauugauuaaaauagauuuaaaauggcacucgucuggcuuugugucuaccaggcaucucggaaacgcugugggccaucgagaugugggacccggcagcccaggcauuucggcugaacaaccccggcaccacaguguucacagaggacugcaacgugcuucuuaagcuggucauggcuggggaggugaccaacucucugggccaaaggcugccacagaagggcgauguggagaugcuguguggugggccacccugccagggcuucaguggcaugaaccgcuucaacucccgcacuuacuccaaguucaaaaacucccuaguggucuccuuccucagguaagcauggaccacagcccucugccauuugcuguggaggggcugacucccagucuagauucagguuugugggagcaaccccaacgccgcucccaugggagcugcccaugcccuguuaccgguugccugggcauggagggguuugcaaugacugugucccuccugccccuacagcuacugugacuacuaccggccucgguucuuccuucuggagaacgucaggaacuucguguccuacagacgcuccauggugcugaagcucacacugcgcugccugguccgcaugggcuaccagugcaccuuuggugugcuccaggugggcaccacgcgggcagagggacagaaauggccucucgugggacagucccuggccugcuguggacaacagagggcaacagaggucugcaugaccaccacugaggcucagcucagacagaaaaagcauagggcuagccaggaaccuuuaaucccagcacuagggaggcagguaggcaagucugaguuugaggcuugucuggucuacagagaguucuaggacaaccagagcuacacggagaaagccugucuugaaaaagacaguaaagagcauggggugacgaggugcgguggcacaggccugucuuuucaaguccuggaaggcuggaguaggauccauggauugaaggccagcaucucaggauucagaguuggccauagcucagugugauacauccacuagcagcacauuuccuugguccugucccuggcacccaaaguuaaucggguagcugggaccaaguugguagagcacuuguuuaaucuucaggaagccuggguuccauucuuaccaccacacagacgugguugcacacgcuaaucaucccaacaaauaaaaaggggggguguagguagcaucagcacuugauuugccuacauagcaaguuugugccuggucagcagcuauggucuuccaugacugucggggagggagggcugggauugccagcagcggaguagauguaaggucaauaaaacacagggugagaaguggcccagcagaaccggguuuauccagagcaaacccaggacaggagcgcuccuguuggucgccgaggucuugccauccacuuacagaugcaggaguuacuaaagacauggugauggguuagcauuccugguggucagcccuuaacugagcuugacacaauuggcaauggcaggagccuacgcagacaagugauuuuaguaguuacuguagucuuggggguugucuccacuuaaccaaaauggggguuuugcaaaugguguggccauggcuaacuggggcaagcuguugugucauuuggugaguugcagauauguguugccgcuuuccaguucagcucuccgagaagaggccagcugggcagacacucuaccuaaagccaccucucuuccucuggugcaggcuggacaguauggcguggcccagacacgaaggagggccaucaucuuggcugcagccccaggagaaaagcugccucuguucccagagccucugcauguguuugcgccccgugccugccagcugagcguugugguggaugacaagaaguuuguuagcaacauaacgagguaggaacugugcuccgcccccauguguggcacgguggcugggaugcugccaagcucuguguguucuguagaguggcagugggucauguugccuggcucacugaggagaucugcgccagagccuggcuggaaggucugcaccauuccaccucaagccugcacacaaggcagaaccugagcagagcccauaccacagcugccccucccucacuuccuaaguuccagcagaggccaccugccugacaucuaauagagcaccucugcugcaggcugagcucggggcccuuccgaaccaucaccgugcgagacaccaugucugaccuccccgagauccagaauggagccucgaauucugagauccccuacaauggagagccacuguccugguuccagaggcagcugcgaggaucacacuaccagcccauccucagggaccauaucugcaagguagcugcccugcggccgugccgugccgugccggugccuggcccagcuucuuuccugagcuugcuugcacuuccacgggccucaaggcucaacaucucugaucuacccgcaugcugucaucuuugaauacucccuggaugacauccaauguccccacaacacacccucucuuaauagcguuucuguaugggcuucucauacaucagaccucacguugugugugcuccccuccuuguccugugcauuuaucucagcugucccuccauagguguccucggucacauguucuuacgugaccaucucucagcuaggguugugugguugucucuuccugacaagaucugagccucuaggugcccuucugugcuuccagaaccggguuucagcugggcuucucuuuguucuaggacaugagcccacugguggcugcccgcaugcggcacaucccacuguucccaggaucagauuggcgugaccugcccaacauacaggugcggcugggagauggcgucauagcccauaagcuacaguacaccuuucaugaugugaaaaauggcuacagcagcaccggugcccugcguggagucuguuccugugcagaaggugggaccccaagcuuuagucccccccuuccacuuggucuucccgaaaaacaagagucucccuuauggcagcccuuugugagggcuggcuguucaguggggcuuccugggguuuuguagccguccccauucaacucaucuacgugauaagccagaggccuggccacaccuccgugcuaauuaaauggcugcauggugugagguuacaacagcguaggggggcccaaaucaaacacccguaagagcucccuuuggaagccccucugcagagaugagagaugagaugccucagucucuggcagcagccuuguccauagcucaguguuccauugcaacaggcaaggccugcgacccugaguccaggcaauucagcacccucauccccuggugccugccgcacacugggaaccggcacaaccacugggcuggccucuacgggcgucuggagugggauggcuucuucagcaccacugucaccaacccugagcccaugggcaagcagggucgggugcuccacccggagcagcaccgggucgugaguguucgggaaugugcccgcucccagggcuuuccagauagcuaccgguucuucggcaacauccuggacagacaccggcaggucaguucaucaccagagcuuaucaucgaguggccucagcucucacauugggggugggggccaccgcuuucgagucagguuguguaacagaguaugggucagcaacaacaacacuggcccaaaugugcccuuucuacacuggcuauuccugguugggaauugcuguugagaaaaaggcccgugccagaaacaucgaccugaccugggcuccaugcagaccauucccauguuccagacccuuggcuccuaaugggacucacauuggcucuggguggguccagauuuugcuuccagacuuuccuaaagcuuuuaaaaaguucacuguuagccaggugugguagugcaugccuuuaguccuagcacuggggaggcaagcagguggcucuaaaacuaccuguuagugaccugaggguguguggacaucacaacaagggcuguaccacaaagcccaggccacuggucaugguccggccacuggugagccugguguuacguccuuccuucccgcagguggguaaugcugugccaccaccccuggccaaagccauuggccuggagauuaagcucugccugcuguccagugcucgggagagcgcaucagguacgugccccguuccucgugggcagcucucgucccuggggccugugugugccaaguccauacaagguuagaggaguagggccagggcagauggcacaggugugagcuucuguugacuggucaguccaagucagcaggcaccgaucucaagggcuaccccagcaccuacgugcagaaacauccgggagcuaugucucaguccugaauguuuccagcggugugcaugugcucaagaccagccgugagcgagcgccugcugccgcgagcgccugcugcccuguucucaagugacuuuuccuuucuccucagcugcaguuaaagcaaaagaggaggcugcuaccaaggacuagugcucucacccagagccccacgugcacugauguuuuuaacccuuugagccccaucauuugaagucuugugcucagugucuguggccauggcugacacuaagcuguuuguaugagguuuguuuugugaccaagcuguguaguacuuugugcauucugaauuuuaagguuuuuuuuuuuguuugguuugguuugguuugguuuuuuucuuauccuguauucuaucagaucugccacugugcagguggcaagugagacuugauguaguuuuauauguuguaauauuucuucaaaauaaagcgcuucugucaagcac

SEQ ID NO: 12433 - RNA, 8132 nt, Mus musculus
cgaaacugccaggauauauuuauuacugaaaguacaagcaacugagguuuacccugggaacacccacaaugaaacguguaucuucccuguuucucagaugcugccuccuuccacagagugaguuuucguuuaaaacucauaaugaggagaaggcagggggcuccaccccuuuccuguucaaucugaagacugaauugggcuacacugggauggagauuucaggugcugcaggucagugucaaccaaggguucgugugucaggaacucuggcugguaagaugacacaaaggcuucaugcugaagcucagggagguccagggagccuggaaaaagagaauucuuuaauggaaccauugucugggaaucucaggccuauuuugcugggaugcauacacagccucuaauuccuuacacuuguaaaagccaacccuauuuugcccuuaguugguaaaauaagcaaacagcuauuuacuuuaaaaaaaaaaaaaaaaaaaagaauaacucuggugauuugucacacacacacauccugcaagacccuaauauuccuugagccccugaucacuuuccauuuaugagaaauaauccagacaucacagguagggccaaagccaccacugaucuuugacuucaccucaagucaaacccuccccguuuccaugcagugucacuuaagcuauagaaggaggcacugaaguuucgcagcauguucuguaacaugggagccccaggcuggcuucagaucucccuuacuccagucuauggcuggcucaguuacuaccuagcaacgugugaugaggauacagaaggcuaaagauggucaguuuucaaaccagaaaggcaaagauaccuggcagaauggaaucaucauggucaucaucaaacgucugugucuggaaggcuucaaggcucauaguugcaucauucucuggcaguuccugagagagcugccccuuccuggguuugcacgcaucaaauuucacccacugguaacugugaaccaaggggcaucauucuugacagcuguuuguuaguccauaauaaauaacccuuucuaucaaagggaucagguuauuauucuuuuuaauuaggucuucucugcuauauacacaagaaacaccagcuaagaaaaacaacccaagcaaacuugaacaggcaagccucuggugacagacaacaguguuccugaguacacacagaaaaugguguaaguugagcagccuuaaccugagaauucaaaauacuccaaaacauccuuagcaauuaugaaaagcuauagauguguaauuguauaccucacaggauggucacaguuaaaaugaagugcacuaaacuacuauguccaggguauauauguaauguguacaucuggauuucuuguaacucuuaucugaagaccaggcuggcucugaauucagagauccaccugccucugcucccugagugggaauuuaagguaggcaccaccaugccugguucaccauauaaaguauuuagaaacccauaacuaguaaaccgcaucugaaacacuucucaucucaagcauuauggguaaggagcaaucacccuacuuaaagcacaccagguaacuggcuccuacucaccugucuagaugaguaagugggucaauguugcaacacacugguuaagaagcaagcauaccguugacacagaaaugcauaugccaacaagcaguagcugccaguuuugggcacucguuaguuggcaaguggguaccuaccaaugaaacaggcuugcucacacuuacuugacacaguuuugagcuucuggacaacucugaaucagguuguggaugguuggaugagaaaacccaaagaagucggcaccgcaugaaaguggguugggcaucaguuucccucugcaaaagagagagagcuuuaacuugacagcuuaggagaugaagacaggcuuaagacaugagcggauguuaccuuuaagcauuccuacuauacugggaggcuaguuacuaaggagucugaaggauauagcuuacuuagguuucuauaaagcagaucuccaggcacugagggaaaaggucucaacuguaccaauccuuuuaguguguucucaagcugguggccaacuuacguuguggcacugauggcccugagcaguucuucauaacaggcaucugcagaggagccgacgaugguauucugggggucaucuucaggaacaauuucaaacugaagugacagaggaacaauuaggucaauuugcaagggaggagaagagccacaugaugccuauaaacauccccaguguccagagcugaacugcagcacagccugcuaggagacgggcgcaggcgcuccuuauaaugcugcaaaagccaaaugcaaggacacaaucccaggacgucugguucuccacaucucugacuuuggccauggucagcccugaauuuugcuccauaccuuucuuuccgcuuauaucccuaaguaaauacaaaugguacuuuaaagaaaugagauacacugcucuaugcuauccucuauuucucugggaaacaaaagaguacuuauguauuuguuuuucuuuaucuuugucaauacuagauauuaauaaacuaaaguuacuccauguagggaaaaauucaagcugcauuuuuaucacaaaucauauuaauacguaagaauagaaucucguuuggugaccuaagaacauuauuauuaguaguaguaguauuuuaggguuuuuuuuuucuuuugucccuaagaagaaauuaagaaucauguugugaauuuucauuaaaauucuacugagacccugacugcuaauaaacugaacuuacagauguuaagacaugguacacugcacaaugcuaaguuuuccuauccguguacuuucuguggggcacugcugugugacugagaugaugucgaccagcucugccugccagagcuccaacagagaugcacuaucccacauaggcaguguagcuccuccuccuacucaaggguccuuacucugcuuucagcucagauuucuugauugggcgcuuuuucagaaagugagccaagcaagccugagauugcuguuuuugccugaggguccuuguaucuuaaugugaagcaacaauauaccaaauaaucuuuccuguaugaacucgcacauacccuaagcuucaccguuacauugugugucauagaaauacuaugguuuaaggagaagacaacaccuagagaauuaaacacagauucguaccccaggucaaacacacagaaaaguacaggugugacaggcuagccaguuuuccugcaucucuguguuguauaaauggugagcagaguaucuuaaaguaugucagaauuagccacauagcuaaaaagccaggggucaaggagguucuccaaacagcaagaaaaaacagaaccaagaaaggaaaauaagaaucauaaugcagugaguaccugaggcuguacaccgccguccuugaucugacagguauacagacacuucuggucugggcacuucaugcuagcauacacucggguacugcaguagcccacaggauagauggcauucucaucauggaagccaggucgguuggugaugaucuauaaaagauuccuuaaucuggaacuuaaggcuuuagagcccaguuuacuaugguagccuuuagaggaacuuuggggcugacaaagagugauacaacaaacauagaaggugauggcugugagaagagaaaacugaccugguuuggaagggacuagagauuuucuggggucaguauggaucaacaaaggggugcugccagugggaacagggaaaggcucaaccccacucucaugguucucauuagccuggccauaugcuggucucacucaccucccccagacuguauacugucagacccccuaguccgauggggaacacaggcuguccugaaggauccagggcaaugggucgaaccaguuuucgagcaccucccuccauuuucuuuuucuuggauguuuucuucagaacugaaacgaaaaucuggggucacccacuuaggucucuuccagugccaagggguagggaaauuuacacaugaaugauaaagguagaaagccaaucuugauugauauggaugcucuuugugaugggauuuuauuccauaagcccaagguaagucgaaaauacaguauguuaaugcgugugauauaccuaacuuaacaaacaucaggcaacugaguacacuguggagugucaaguaucacuacaaaugugggucugugugggagcuauggcuucacaccauuagcuaauauuacugauauuacacugcguaucacuguucuaagauaagaacaaaaccaaaaguccgauuuuuauugaaugcacccugcuuuucuuuuuuucuuuuuugguuuuucaagacaggguuucucuguguagcccuggcuguucuggaacucacuuuguagaccaggcuggccucaaacucagaaaucugccugccucugccucccgagugcuuggauuaaaggcgugcaccaccacgccuggcugcacccugcuuuuuauaacauuguaaaggugagaaaaucucuaaguugaacaucuggcuguaggugagguaucaucuguauucacgaaauagccaucugggccuuucccccaaagcccaaguaucuaacuugccuacaaaccaguuuaauaugcugcuuacauaucuuaagaacuuuuaaguucucuucaacuguagaagcagcugagcuagcagcguguugagaaggcuggcuugcucauuucccugccccuaggaaagccugcagugaauacaguccagagagcaggggcacaaaacgaggggcagaggccucaagccugcuuauccucaucugucacgucuaaucagaaucucuccaaagcagcuccaaugagacacuugcuucucaagggacuucagggggugcuaugaaacacaagcggcuacuuguuacucagucagaaccaguuaguucuaccaggccuuugcuaucaguagagccuccgaggccacugcuacacuaucuucuuaaaauaccuuccaguuugcuguucuccuugcccuuuucuuucuucuccuucuuggauuucuucgcaaaugguuccucggccccagugcugggcccggcucccugcauaguucccacagagcuggugacaccauaaggcaggggcaaacuggagcugugggaaggagcagcggccuguggcuccccuucaguuagagcauguaucuggaggagcuucuucagcaaguaucugagguggagagggaugggaggacaggcaugaacucuggcuuuucucucaauucaacguuucgcuuaagcagugggaauuacagacuaaauacaaagauuaucacacaauaaggcucuuauuggagacagaggccaugaagcccugcaggauaaucaauacuugaagaaaucaagauauuggcuggaacuucucuugucccugcagggaucuucuaccuuuaggguggaaggccugaggugucuggagaauauucauacgaauagaaucagagguauccauauacccacuguaauuugcauagggaaaaacaaagccaauauuaguagaaugagaaacagugguuuuuuuuuuuuuuuuaaaucaucccuugguuuucauaauugggaaguuauuugggugggauauagcacacagguuuagaauuccucuguauugccucaaguggucaaggggcuuugcgaugugcaggaauccagaggagagggaaaaaaaaaaucagccaccauaauaauaucaauccacagcaccaguaauaaugaugacaaugauaaucacagcaacagcaaaaugaagcuggcucaccuucuuucuuccuuugcuuuaagaaauuuuuccucaagacgagcaauuucaucacagauggaagcauuuuccuuuaaggaagaaaaaaaaaaaaaggacuauaaucacauaaaaugaacuuaaaacuugaggcuccuuucuggugacaagaucuauaucucagauugaaagagcccucugugcugcaguguguaagagaagugugguucuacucugcgcaugcuguuaauaaauacagagucuguacagcuggcucagcggggaaaggcaccgaaucggagccccagaacccacaguggaaggagaggaaugaaugacaguuaccugauaacuucuaugcgugcucggcggcacacacacaguaauaagaauaaaaagaaagaaacuucuuuuaaaaaaaaaucugcagggccaaguguuuggguucuauuacagggaggguaauugcauggacaccuuuggaugaagagggacauucuuaaugcucaugccagaacaagaugguacaccagggcuugcacucuuugggcaaaucaauggguguggccacuccaauuaguguggccuuuggcagagaaaggauauaggacuuggacuuaauuuagacccccuacaaaauucuuuuuuguucuccacuacagaauucuaaagacucucuaugcuuacagcuuugaccuugcaaagacaaucugacccacuguaucuuacagaacaauuacagggagagagagagagagagagagagagagagagagagagagagagagagagggagggagggagggagggggaggggaggggaggggaggaggggaggggagagaagagaaaaggaugaaaaguuuugcauguaaaauucuuaauuaaucaucuauuugcauauacccaaguaccaucauucuuuacugauggcucagucugucuugaaaccaguuuugaaggaaaugccuauuuggguguuucacagguggagccucaaauugguguucaaggcaucaguugguuuaaguacacggagacccuuugguuucauaagaucuuuguauacuuaacgaaaccaacacuaucuuuaaaugucgacuuguaagcauuaggcaggcucugacaucaugugacaagagagaacagugaguauaagguguugacuuccugauuuacucauauuucccucgacacauauacaagcguuaaauguuuuagcaacaacaaauugaaagucaaaacuuuucccgauacgucuacaaagaccuuguagaaagaaguguuaaacugcagguucagaugugaggguauauggaccguauaccuauuaccaagcaagcacugaggugacuggcuaagcuagaauagucuauuuauuagacuguuaucagauuuauuagacccuaauacuucuuggcugguaaagaaguuuacucaucaaauccuaaaucccuacaauuaaagcaggaagugucuauacaccucagcaggaggagguagccuguuuccugauguugaguuccacuuucaguuucggauggagggaaggcagaaacaccuagaagccucgucaaagggagcuacaaccaggacaauuuugaaagauuuaggugccuguuuacgaaagcggcagccauggcguuaggguuggguguacuuaggaaacaggcuguguagaguaaauaauaaacuggaaucaggguauccaaguuggaguuagggcacgucaucccucugggcuucauuucagugugcucgccuuaaaagacacuccuuaggcucgaaacgaaaaguagcaagaagguaaugacuaaaguuugcuggcggagcacucuucaguccucauuuauagaggaguugacaggacuagaggaauaacuuaugcaaggauauggaacuaauauucccaagcgaggcaacuaacacuggacggauauucuuucucugagagaguugagguggggaagacaguccccacccaaacccagacucacaaacaccguggccuuagcugcucugcgcagccgcagguacuucagccgguacuucucguucuggcucuuccucgggagccuuuucauccuggccuugcuggacagcggggugcgcggcucggaggccaggccgcucaacacgcucaugaucagaccggguucuggagcuccggggcgcggaggggauggagcgcaggcagaaacagauggcgauccucggcacuucccagucgauuucccaaggaagacccgccggaaguugcgcaaaagcaccgccacguguaacuuccggguuuggaaguugcggugguucgg

SEQ ID NO: 12434 - RNA, 141878 nt, Mus musculus
cggcccggggacauggggcggcgcgaguccggcgcgggacggugugagacgcggcggaggcugcggccacgaguggcccgcagccccagauagagcggggacccgagggccgggccccgccgacucgggaccgaagccgacgcccgucccugagccgauccugccccagcuccggagggaucccgguucccguccuacggcucgcgacuucccucugugacgaaguuuucucuccgugccuugcugaggaucguucuuaguucuugagcucgccuuguggccgacuugcucgguuuguuuggggagauaacuuguuuugccucagcccgcauccccuuuccuugaccccuugcaaucggauguucuagaugacugaauggaguuuugaguuggacuuuugugucccugccgaaauugggccugaucccagagcacugggggugggguguggagguguuacuguaaaaugcaaguuggauaaaaagaagaccucucgccaagggccccaaugaguggcacacagucuacuaucacggacagguggguaugaaguuccucggucgcuaaccuucccuggauucggucccacgcagcaggggagucggugaugcagauuugccuucagcuagugcaauugacaggcauaggaaagaggguuguuucggagcugugcaauuagucuaggguugcugccaaguuaaccgguugauugaauuuggaaaugcagguuuuuuugggagagaaacuuucccccauauucucagaggaaaugaaggaaaaccaugauugugguuuucugucgggugcauuaagauuguguacucguuuuggaaccagagggaggucauuuugggugaaggucagagcuugaggucgguggguacuggugcaucaucggguggauuccuguccugugguaguucuagacucacaauuuuaggaguuucugucugugaacuuaauuuucauccugcugcauugugauuugugacucugaucuuuuuacguguugaccugcacaguguuuaauuauuaauuaccuaauuuuccagaauguugacauuaccaguaaaucacggguucuugcuggggacaguuuccaggagcuaaaggaaaugagggaaaaaucauggggccugcuucuaauuauucuuuuuuuuuuuuuuuuuuuuuuuaacauuucaucuuucagaagcccuagcauuuaaagauguaaacucuagcucugguuuaggcauggcagguggaucuuguuuguuaaucgggugacacggugugguguguagaguauguaguccaaguguaguucuuaaagagguccuuugaguucuuuuuagugaaagcaaguugcuuccuuuagcauauuuuauuccucaacuaaauuaugacauugcauguuacuuccaaauuuuaucuuguuguuuuuuuuucucaaauuguugucauaaaacaaaacaaaacaaagcaaaacaaaguauugaagcagaaggccaaaagucuucaagagcaacauuagugcuccagcggaaagcaguuuaguuuccuaaugagagagucucacccaauugugcgacucauuuguugauuuuuaaaggggccaaauuccauuaucauaccauaacagcuucuccagagacagggcuucccuuuccuguugaugcuuuccagugucacaugaguguucaccuaaaagaugcccuaaauauuuaaaguacuuauguuuauccuuuguuugucugcuuugcuaggcaggguuucauuucgguuuuccugcuaauacaauguacuucuauguagagacaguugucagggcucuuccuguuacaucuaccauccuggucccucuccuggccugacucacagguguccagauaauugugcugcugguucauucaguccuugccugucaguugagccuagaguuaagcagacuuaccagaaacugguguagcccugguuuucauuaagauguugcagaguuuaauaauuuguagaaacagaauuuagagucacugaaucguuccacacaaaagucacacaaaagcacccauggaaggauuuuuuuuuucuuccccagcuuuuuuuccucagggauuuuuguucucuuucugguauauaaacacauuggacauaaacauugaaaucugagucuuuuuuaaaaaaauaacuuaauucuucuuaugaaccguaaacauguacaaaaauaaaucuuaaaaaccccugacugcagguaugugcaccugggauagaagaggcuuuaggauuucaugggagcuugugagcugccuacccugggugcuggauauguaacuuggguccucugccagaacaagaacaguaugggugugcuccuaacuguugagccgucucuuagccccccacccccaccccauuuuucuucuuguaucuggcuguguguagcauggcaguccucccccugccuaagucuccugaagagguggacugccucccugcuggauucuugcucuuagauauuuaugugagaacaguggaugcacauucuguggagucaaguguuguaucugccucccuucccccaagacaggguuucucuguguagcccuggcuguucuaucuguauguaggcuaggcuggccucaaacccagagauccucuugccacugccuucugagugcugggaucagaggcgugcaccaccacugccccaccuuaaguguuucaucuuuuucuuaucuuuuuuuuaaaaaaaaauacuauuuauuuaauguauaugacaguccacgguagcugucuucagacacaccagaagagggcauuggaucccauuacagaugguugaaagccacuaugugguugcugggaauugaacucaggaucucugcaagagcagucagugcucuuaaccacugagccaucucuccaacccaaguguuucaucuuuuaacauagaggaaaaaguuacauuggucaagggaagcagucuaaauauguuaaugcuuuguggggcuuaggccuaaauaacuucucaucauaaaccucuacuauguugcuucagacaacugagccauguaaaauaagauccuggacuaaaacuaauugaaauccaguucuuugucaggcacuggaguuugguggcucucuuuuccccuuuaaaaagagaauuacuaggugaccacuacuuuuuucuucuucuuuccaaacguacuuuguaaauaugaagcagcccuuucucuuuaagaggguaguaauucccgguuugaguauauguugacgugagaucuggaaguacugguuuaauaguacuuaugccaggucuuccuauagacugcagcuucuccuccgcccuguguacauccuuucccacugacuuagcaggagauagauucuuaccaauucuaggacugucggcaaauuaauaaugccagugcagcuuuucugagacccuuucaaguuugaaguacuguaugugguguggcuuuguucuguggagugugcagagccaccagggcagcuguaugaguuggaguucuuucauuguggugcuucugacuacagagucugucuguccucaguggaaaucagacuagcugguuuugggcguuguucuguuuugcaguuuguggcaggcgacacauggcugaacaagauaagaaggguuuuauucuuguguuagggacgugcuggggcugggauggaauucaguucucuguuuaggcucugauuggucacuuuggauacucagaacucucucacauccuguuauuauuuugcaguuagagucacacauccauuggcucccccuuuuccuuucucuuacuuuuuuuuggcucggggugggggguuggggggugcuuuuugagacagaauuucuuuuaauagcccugucuaccuugaacucauuuuguagaucaguuuggcuggaacucacaagagaucugccugccucugccuccagauugcuggcauuaaaggcaagcagcuaccuggcuaacacugcuguuuuuauguaguguaucugaaaagcauuuuuuuuaaagauuuauuuauuuuaauuaauuaauuaauuuuauuuauuuuauuuuaguuuggguauuuuuacuuugaguauuuuauuuauuuugaguauuuugccugcaugcaaagauauguguaccacauguaugcuuggugugauggucuggaacuggaguuagagacaguugugagcugccacaugggugcugggaauugaaucuggguccuuuagaggagcagccacuuaaccacuuaaucacugagccugaaagcugaaagcuuuuuuaaauuaagguuuuuuuuuuuguuuuuguuuuuguuuguuuuuuguuuuuuguuuuuuguuuuuucgagacaggguuucucuguauagcccuggcuguccuggaacucacuuuguagaccagguuggccucgaacucagaaaucugccugccucugccucccgagugcugggauuaaaggcgugcgccaccacacccggcuuaaauuaaauacuuauuuuauggaugcuuucuaguugcuugcuuuguaacuacuaugaagucagaagacucaaaaagugauaagagugucugauugcuguuuucccucugcauuaaugggucuauuuagcccuaagacauccuaauaauuuuuagugcucucuggcuuguuucuauccccagaguggcagauacugaggugauugacauuuaagaaguagaugggagaggauguuuuuucaguggacccagugaaugauuucagaguagauccuguuaacagcaaguguucaggguggugcaguugggagagucagcagggucuuccuugagauguguggacuuuguuuugucuggggcuuacagaucgugcuguuuuugguuuguagcuugacacaaguuuuugauguguuggaauuuacucaguacugaauuuagcuuuaagcugacuuuuaaguagcuuuaaagugaacacagaagucuauaacuuuauauucauauauacagcuaucagucauguuccuuuuuucugggaaaguggucuuaaugguucuucuaguuaauaacaaaauaagcaaccuaccuacucuuuuaggguuguauguuauuuucaagguugcauaagucguuaucuguaagauugaauaauuuguaacauuuucuuagaaaaugaauccauuucaaauacugacuugacacugagaauaaggaguaucauagugccaacuuuauaauauuuugucuuuucuaaguucacaauaaaguccugauucauguaagccuguaauauaguacauguacuccuaacaauuuugccagucaacauggagaauccaaaguaacuuuuuaaaaaagaaggaauuguagucuuucugacuaaaacacacuuacauuguguuucuauuuguuucaugaguugacaaaagacacucuauuugaaaucauuacaaaaguguguuagccugcugauaccacuuaauacauuagugauuguuaacauguuaacacugcagggggggggcucuucccacuuuuuguuacauuauuauacugcaguguuaacauguuaacaucauagaucauagacauagcaggauguuuuauugguucucacaggugauuggagggauccugugcugugguugucugacaguuacuagaagugcuacuugguggcugcaucuagaugaguaccagagagcuuggguuccuccuccagcaaggcaggaacccauaggucuuacuaccuaauuacugaucucucagaaauggacugugcuguuguuuuuaggacuaagagguucaccuuaguuuugucucaucuguuaaaauucggauuugaugacuuaauuuauguggagauaagaucccuucucuuaauuaggagucuuuaaaauaaguguuucaucuucuuuugaauaaguuauucuuucauguauacagugauauuguaugguaguauaauuuuuaauauuucuaauguuuuuuaauuugguauauggcagauuuuuucauuauuuauauauacuuuaauguaacucauaauuuagucaagcuuauaaaacugagacaagcagacauauuauuauuauuauuauuauuauguauuuuaccugugcugcuccugaaacuaaaggcguagugugcuaggcaaaccuuuagauucaagacuuuaaucuguauuuucuggauuuaagcugucaucaucauuauuaaaauuaauuaaacaaauuuuauuuugagacaggguuucccuguguagcccuggcuguccuggaacuugcuuuauauagacuaggcuggucuuaaagucagagaucugccugccucugucuccggagugcugggauuaaagguggucagucaacuccacugccugacuuuuuuuuuaaaccuuaaauuauuuucuuuauauuauguuuuucuguucaccauuguuuagcagcuuuucaaccucaccaaaaaaaaaaaaaaaaaaaaaaaaaaaaaaaagaauaggguauuuuuucuuacaggaugcuuucuuccuggccccuuaucugugcuaacuuuaaauaucucuagagaauaaagcuguugucacuuccuccggagacugaacaacaagcugauagggccuguagucaggaagcuguuccugcucuucagcuccagcuuuccuuugaagucguccugguaacuugugcuuucuugcuggaccaggcuagaugaugcuuuucugccauuuugagcuugcaugccuguaaugguucacgugguuagcggcugcuuucucucuggcucuccuccccuuacuuagucuuuguuuagcugaguuauguuuucucuuguuccauugucuaaaugucagucugucucucaauauuuuauuagcuuugccugacuugcucuccuaguacaguucuuaguuggucucugguacaaaugugauauucuauaugauucauauucuagagaagcaaguuccaacuuauuuuuacugugauuuuugaguucuuugauuucucucuccaggcauagccugagccucgaaauuacagguagagaaagauucucagaaaaaauuuagauaaauagguagaugugugcaugaauguauguauaaauuuuauacuggggauaaauugauggccucaggcuugcugggugaacaguuagcuauauuuucuggcuccauguuuauuuuuaaauguauauaaaagauuguagcagccaaaugaaacaaauauauaaacaacacaauuaucaaaucagcuacuuaaacaacuacucaugauuuagaagacuucuuuacgaagugcuucuuccaaauguaguucccuuaguacaugaaaaaguagaaaaagucaggagccuuugcugagucagaguuagucagaggugaagacaaaguaucacuggagccagugaagagaugcaauuguagcuuagagggaauaugguaagaggcaucugaaaauuguucuucccagugucuuguuucaguccaaguuacuuaaaauguuuuuaaaaaaaacucuuaugucaucauaucaauuuuaagaaauagcucuguagugcuugcuuaguaguaauuucaugguagaauagauuaguguuaaaauuuaaauaauaacuucguucuggcuggagagguggcucuggcuaguguguacugcucuuguaggggacccagguucaguucccagcacccacacaucagaaggcucuuaaccuguuggagguccugcuccauggggaugaguuggcccuggccuccaggcaccuggcucacaugcaggugcccuccagcaagugcauguguaauacaaaugcaucucaggaaaccaugaggguuaucacucaggacgaacuagcaacagaaggaagacuguauuccaauuacuaugucauaucuaagauuaaagaacucuuuaauguuuuauuaguagacuuuucuuugauacuuauuuaauccaaugcuauuuaaguagauauccuugaucuuuuggauuuugcuaguaaguuuugaaauuggaaaauaguuuuauguuuuugacuuagaaugucuggaguaucaaaggcaaccacgugugagauguuugugagauacuuguggagcugacaccuggcagacuguguagaucuggaucuugcagagugguauaugcuggugcugagggucagcuguucucaaagugcuuuccuauguguuuuugacucuuaguagaagaagcacauuaugguuccuguauuaaacugacaugccucagugcagcugugauuucagacucaaagcccgaaugauuuuuaaugaauucaaaugcugauucgugguuuuuaaagucuuagucaggccuggguggcuuccuuguguuuagagacaagcagaucuaauagccagggggggaaaaagucuuucuggcuugggacuguaauaauagucacacagcaauuagaaaugcauaagagaauaugguaguggcacauggcuuuaauuccagcacuuggaggccuaaggcaggagaaucuugaguucuagaccagcucagguuggauaaugagaauguaucucaaaaaaaaaaaaggagagaaggaauggaggagagggaaccaacuuacaguuagccacugaucacguggccucuuauuuugacauuauaaaguauauuguuguuacuaaagauacuacuguuagacuauaauuuuauauauauauauauauuuuuuuuuuaaaccagacggagccucauuuuuuuuuuuuuuuagauguauuuauuuauuauauguaaguacacuguagcugucuucagacacuccagaagagggaaucagaucuuguuacggaugguugugagccaccaugugguugcugggauuugaacuccagaccuucggaagagcaguccggugcccuuacccacuaagccaucucaccagccccaauuuuauauauuauuaaauuucaguuuaaauaauuaauaaagaggauuuuguagaucuuccauggauucagaaaaugucauuauugcauaaaagcaauaucaucugaaggcauuaacuuugaaauugaucacuuaaugcagacaguacccacuagaagaguacaguguccccaaauguacauaaauaugugcaguacaagcaugcuuucuuguagauguuuagauagguuaugggucuuuccugugucaacacacaugcugaucugcugugguuugccuggugucucugugguuuacucagaggaagugguucuugugggugaaggucuagucuucuuggagauuguugguggcacauacacugucagcuuauuuccuguuuuauugguugcuuaggccagacuucucagggugacuacuccugagggguaucuguuuugugggagaaggcuagcugauugcaauguaguauaacacccguaugucaggugaugcgaaggcuaccucaguguuuauaaaguacuuugagaguuuaggauaaaaagugagaaaugacuuguaauuguauuugcagguuauugugauguucagacauugcuuagcugcaguagaaacauguaauacaguguuagucuggcacaguugauuuuuaagaucauucaagugguuuuuagucaccacaagagucauaguuagaaauguuuccuuucugagacugaggggauggcucaauugguaaagugaggacccgaguuuggaucccuagccaccaguguaaaagcuggggggggggcacagugguaauguguagccccagcacuggggugggguagagacaggcaggucucugggguucauuugucaacuagcgugggcaaugaguaaacuccaggucaauaacagaucuugucucugggcuuucgaaauagcacaguggguaauggugcuugucaccagcuuuggaacccacaugacggaaggugagaaccaaaccccaagaguuuccuccagccuccccaugagugccauggcacccaggcuuauacacaccugcacuguaacacucacuuaugcuuucccggugcugugacucucguggguguguaaaugcacgagcacgcacacacacacacaugcagguguggcagagauaccaagagacaaugaauauuaugaguuuaugcuguaaggucaucuuccugcucuuuugccucaauuuccuccauugguuuucagacacacuacucagaaauaacuguauuuauuuccugucauggagacaaggucuugccauaucuaucuaucuaucuaucuaucuaucuaucuaucuaucuaucuauacacacacauauacauauauauguacauauauauacacacauacauauagauacauauauauauacacacacacacauauauauagagagagacagagacagagacagagaguguucagaguaaucuugaacucagaauccucuugucucuacguccugagaguuguaguuagaaguguacuacacuuuaguuagugcaacaccaucccuugcucuuagaaauacuacagaaacacagcaacccaucauuuuaauguucuguucaucuguccugaagugguagaugucaucugccagcuuacucagaauugcagugucagguguggagugccugcaucaucacuuccugggucuuauuuuggaaccuggcugcaggaacauccccguuugaaauucaugguuacugugucagagagaaaggacaaggacauugacggacgcacaugcuggcuuuuuguuuuuuugguuuuuguuuuuuuguuuuuuugagacaggguuucucuguguagcccuggcuguccuugaaacuggaucuauagaccaggcuggccucaaauaucagaggucuaucugugucugccuccugauugcugggacuaaaggcgugcaccaccacaccuggcugcauaugaugacucuuaaagcuuuuguucagucacauguacaucagauuagcucauaggacauagacuaggacaagguaagguucauuaucagugggguagggauguacucugcuacagguggucacugguaaggcgguguaaucuuuguaaggaaggacuaugggggcugaguaaguggggacaauaaugcagccuagcacaggaggugcucaguacacgcuuauucuauaggcucuuaguguaugggacaggcuuauuaacauacagaguguuaugucagcucuguguuccugucagcuucaacagugaucagugcauggacugucuugguuuaucucucucuucccuugccucuccucaugcgguuauagugaagccucuggauauccugaggucaccaguaaauaucucacugagauuccaugugacuucuuguauuauauccucauugucuagugguuagacaguggugcugagaacucuagagcugucaguuggagaggauguucauggaguguguagaguuugacagccagaucuuguuuugauuucauggaguguuccuggaggagguuugcaacaggaucuacuuucuuaaccuugucuuuacucaauuuaggggugugguaaggguggaggaggaggagcaagaggaggaggaggaggaggaggaggaggaggaggaggaggaagaggaggaggaggaggagaugguggugguggugguguguguaaguaacagaagcagguaaucaaccucugggggaaaaauaacauugcaacagauuugauuugcaggagguuuuauuucucacugagcuucuguuggaaugacgccaauugaaaggaaucccaguucuucauggcuccaagucaucugggagcucagugauguuauuuaaucuggaggagaacaucagagucacuuauccaaacccuaagcucaccugugcugucgggugcacggagaaaagagccaucacaccuugggggucaucacagugauaauauaacagagaaaggaagucuaauuuuaguguagagucguuagcaccacucuagcugcucagguuaaugacucugagggccaucgagccacagcuauggcucaggauguccgugcaggcaguaugguuuuuauuucugagguguaaggaguaaggggcauguguuaauauauguaguagcacucaguuuuagggaaaccguggggagcaaauuaagagagaaucccuuuuuaaaauuuguacuuggcaugugaaaauggugccaacagagagagcuuacaguguuuacugaguaauuaaguuuauaaguuuauacacacacacacacacacacacucacacacacacacacacacuuacacacacacacacauucaauauaagauuuuuuaauuggcuucuuaucucuguguagacacuuaagucagucuuuguagguauugaaauagcucuacauuucuuuacuuaaauuguuguuagccugauuucagaaucuauguaggaacuacaaacuauaguuucaaauggcuuuuuucagcuuaaauaaaacuauuuuaauuuuaguuuuucuugcuguugaauugguucuggcucugguugcucacagcaacauagucuauuuaaaauguaaaaaaguaaauuuuauccguggugaguaauucuuugacgugccauucuuauuuguauagugcugucuugcaguugagaauacgagguaauagcuguccuguccuugucuggacaguagugcguagguuagguuuuagugguuucuuguuccugauuuacccagccugcuuagaauccugagacugugugaggugaagaggguccguugucucggugggagcagcagggacgggaagcuccuccccaggccugcacagcccggcacagaugcuuuucuucugagaccaggaagaagccaguuuauaagugagaaguaaucguaucaucaucgucucuucuuccucuucuuccuccuuucuucuuggauuuucaagacaggguuucucuguguaacucuggcugcccugaaacuugcuuuguagaccaugguggccuugaccucggggaguccaccugccucugcuggaucaaaggugugcgccaccaccugacaucauuaccuggcauuauuuuuuuguuuaaaaguagcuuuugaaagaaaaguuaucucagcccugaauuuagugucuguagguguuuauuuuuauuuuugcccauguuagaggaucaguagaaaaaacacugagcugaugcuaagaaaagccuuagguccuggcguguuagguuuguucuaguaacuaccugggcaaauacaguaaccagccaggacuuggacaagcucacuuguuugaauagcaucuguaaaagugggaugaaacaaaguggcugugauugacucaagccuguaaucccagcgcauggacugccugguaaacucacugagagcuuacucagugagaagagagacaguggcagaggcagacugacuucuuuuaaagacauugugaagacuuaauuuaagagaauguuaagaucuauuguuuugagcagguuguaguagcauaaaugucuuuaaucucagcacugaggcagaggcaggucuaucucugaguuuacggccagccuagucuauauagugaguuccaggacagccagggcuguguugagauaccuugucucaaaaaaccaaagagaggcagaagugcuaguguauauagcaugaagucaguaaguuauugauugugacucuuaaaccuuggaaaucauccauuuccuaaacuuuuaaaaaaaugcuaguaaaaugauuuugaauuuauauauauuuucagcuauuuuccccuuacuaaauaauuacuuuuauuuuuguauuuaaaaacuuaaacuuaaaauuaaggaaguuaucuguaauagugauauuuauugauucaugcugaguauuaaagcaagaagucaguuuuauuuguuuuguuuugugagaugagugagauuuugccacguuguuguggcuggcacguccucuggggcucauucuuccagguccaggcauguaccuggcucaagaaggaauuuuuauuugggggaaaugguacaaaguaauagugauuaaauugauuguacuuuccaaguuaaaaauguuaauauaguuauuccuauugcucaccccccccccccccccccccccggcuguccuagaacucacucuguaggccaggcuggccuugaaugcagagaucugauugccucugcuucccaagugcugggauuaaagccaugcuccaucauugcccagccacauuguccuuugguuuuacucuuuauuuuuagcucucacuacauaggcaugcauuaccuacacuugaaaggaacugaaauagcauuggaguagcauuagacuuuuugcuuuuggaauuuugagcccaggucuuggucugcagucugaucuggcuuucaguuugugcaguccuucaggauugccagaguaagccgucauacccagccgucacacccagcacacauuuaggauucuuuacauuugcuguuguuacuuugguugguguuuugagaggcaggauauugcuauguagucauggcuagcauagaauuugauaugcagacuaggcuguccuaaaaaauuuaggaauccugcuuccuagaggcugggauuauaggugugcaccaccacacccugcuaacuaucaucaucguuauuauuaaccuaauccuuguugauaaaucauuuugucacaauuauccuaaaguucuuuuaauauguuuugauacagauauuuuuguuguuagaagagcagaaacuaauuuauuauacugacuauguaagguggaaaaaggcaguaaauguuuuuuaauagaugauucuucguuuugauuuuucugguucuggggauugaacccagggccuuguacuugcugggcguaggcuccauucuccuucccuugguuguuuugucuuuguuuguuuuacuuuuugaaacagggcuucacuauauaaccauaggcugacccucugccuuuggagagcugggauugcuggagugugcucaugagucauggcugaagaggaggcuuuugugauguagaagaaauagaagcagauuuccacuuccuccuuuuuuuuuuuuuuuuuuaaagaaucuacauuaaggauuucuugauauacccuuuuaaaaauauuuucuaccauaaaauauuucuacuuuaaucaucaugccuucuuuguaaauuuuuuuuuuuuuuacuguuacuaaaauucuguaccauguuagcaagaauaguacaggauucaagcuuauuuauguguauauguguuuguuugugugacuuuaugugucccauguguggauaggaggucagaagagccccuggaacuggaguuacagauaguuaugagccauuacguugauccugggaaccaaaccugggucuucuguaagagcaguaagcucucuugacuacugagccaucucuucagcccugguauuauagcauuuagaacaaaagaacagcaagaaagaaauucugugguauggaucacuuaaggacuugcuuaggagagacuuauguguuuauuauuuuuaaguuauagcuguuuuauuauauuuuuaguaacaaacaaacaaacaaacaaacaaccaaaacacagaaguuccuaaaugaagacguuuacugagugaguaaaaaguucuagguaaagaaaggcuacagagguguuguguuaagagucuugcuaggucuaaaauugauaauagauugcauggagaaauuagugcucuuagaagcauuguuaugcaugaggggauuucacagcccuuagggagagcugcaggauuuugaaaaguugcuuuuucccauaauuacagcuccuucacgggguaaaggucuguuaauuuugaauaauuauguacccuaucucauuuuagcuagcacugcuuccucacacuguaagcaauaagagcuuugcuuauacagcuuggaaaauuuacuguuaucaauauugcuaaucuggagaauguuggguugccauggagggcugaugaauuuggucaaauuagagggcugugaacauaacuuaguuguagagcuugccuauugccuagcauaugcaaggucuuagcuucaauccccagaacaauaugaaacaaaaauucaaauuugaaaaaauaacauagguaaaugaccaauucauaaugaugaaauaauuugauuauuuaauauuauuauagguaucuuuaaguuuagauuuuuaaaaauguuauguauauggguguuuuugccugcaugugugucuccacaccaugugcaugccugaugucugaggaggucagcagagggcauuggaguccccagaacuggagucccccaugguuguguguagccuacugugggugaagggagcuguucuccaggccucucccagggcagcagacacgccaaccagugggcgucuuccaguuccaccgcaugugagucuuaggaugauauugucacacaagcaucauugcuauaguuaaaaaauuauccuuuagguaaacuuauguuuacuuuuuuauuauuacacacacacgcgcacacugugugugugugugugugugugugugugugugcgcgcgcgcgcgugugugcgugugugcauguaugauguaugugugugaguacaugagccguggcacacauggagaaguuggaggacaacuuugugaauugguucucuucugucuauguggccaggcccuaugcagcaagcaucuuuaccuguugagccauuuugcugcccuuaugucuguaauuugagaugauuuaaauuugaaucauuuaaauuuguacuuaguaugcuuucauagcuguuucuguauuaaguuaaaauaauuagcuuccguauacgaaaacaucauaggugcuuuauggauauuguaguuaauucuuagaauaacucaacaaggcauugguuauuccuaccuuaccugcagaaaaagcccuuuacauucaaagacaugaaguggcuguccuagugcuuuccugcuagagagauuuuagaaucagacguacagucauucugcacgugauucaccguauuuccuacuguauacaguuuuacauagcacuguguguguguguguguaaauagagacuguaaaacugaagugagaaaauccagcaaaagauuaguuccuugucuuuuuaaaaaauauuuuuauuuguguauguaugugugggucuacuagucugaaggagaccagaagagggugucagaucuccuggaacuggaguuacagguaguugugagcuaccuuaugugagcccucucccuagccuagcugugguuugagagaggaucuuaggauugccugggcucaggcccaccuccuucugccucccaaguacuuagauuacugggauuaauuucuuguuuuuaaauauaaauuaaagcagcaguuucuauauugugugccauggaacaugcaggauacuuuuuauaaggagggaaacauuuuuuucccuuuguuuaugagccccacauucagauacucaaggcaaaaagguagaauguaaaauaauaguucugaauaauccccaaauugggacucaccauuaagaaaaggcaguuuuuuccuugaaaugcucuuuuuauuagucacaaauagcccugcacuugcguucuccuaugauuccucucagacgccacuuagcaccguuggcucacaucuuagacgcugccuuuccugggaagggcucuacuuuccgguuuggugcacuuccuucuguccugcagacuccucucugugcuccgacccuguguggacauccaugggcucugcugucuuagcccaugcaggucuucucuucuuccucagccuuuuauuuauuucugcuugaguuguuuucaucccguguaauaaauacccagaaggcuuccucagucuuccuguaccuuccuaggagauacuaacccagcuaucuucccaaugacugugaggucauggguuucaaauauaauuuaaauucacaaggacagacacagaauccuaggaaguuuaaguaucgcucccugugaguggcagaagucugaauccccagccugcauuagauggacaggcaaaggugaaucaggcacuguuccugacuuguaggagacgcuggugugauagaaggagacagagagcuagacucaaaagaguguacuuggcguuuccuggccagacuagaaaugguuucauagauaagaugaggaguugaugugguucccagacagguggacaggugaggguaugagagcaguugagaggagugaugugaguagagacaggugagaacccccuggcguggcuucccuguagucucagcauuaaggaggcagaggugagaggaugcgguacagaccagaccagucuauauagugagacccugucuuuaaaacaguaugcggugaagcgucuugguuuugaacagacugcaugcgguuugguuugaguagagcaggggcauugauggugaggauggcucaguggguggggcacuggauuccauucccagccccacaugguggcguccagugcucuuacuccaguuccaggggauccgaugcucucuuuuggccuccucaagcaccaggcaugcaaguggugcacagacauacacgcagguaaacaccccacacacagaaauaacuucaaagagagauugaugaugaaacugaaguguuagguggcacuuggugaugucauuuuaaggagguuggguuuaaacccuggguucuggaggccagugauguccuuuagccauagaaguaacaggaucacauggcaaugugaaggagggauuaguugugagaagcaguuucagaagcagagucugauaaagagauuuuuucaguaaucugcaugaaaaaugaaguccuaacaacuccuuaaaccagagcuacucagcaauaugauugaaaagaggcaaaaauacagcucaggagucuugagacuacaauaggaccagaggacgggaggcccaugagaucgcaguaggaccagaggaugggaggcccagugugugugccaggcaugaggaggaggcaaggcauggcugguuuuugcuuggcugacuaauuaaguagaaggaggagacuaacgaauuguaauaagggacaguuaugaugcuguuaaugaagaaaauauacuaguuaucuauugguaugcaauacaugauucccaaagucauagaauuucauucucuagcagaguagauacacaagacaaaauuggcugcuuaaauuaauuaaaauuacauaaaauggaaaauuuaguuccuggggcacaccacaucuuauuguucaguagccacauguagccaauggcuauuguauuguguguuuauaucauagagcauaguaucagugcaaaaaguauauuuuuugaugauaugagggguuaugaggguuucacuuguuaggcaaauaccccagcacuuuuuuuuuuuuaaagaauuauuuauuugcuuuauguaugugaguacacuguagcugucuucagacacaucagaagagggcaucagaucccauuacaggugguugugagccaccaugugguugcuaggaauugaacucaggcccucuggaagaacagucagugcucuuaaccacugagccaucucuccagcccccaagcucucuguuagagacagggucuuuguaguucaagcuggcucugaccuugaggcacuccugccucaacauuccaaguguuggaauuacaugaaugagcuacugcacucagcugcuuuuuaugucucuguugggguuugugccugagugcagugccuguggaggcauuggagaaaaucuccuggagcugcaguuaugcauagcugugaguuacuuaacaucaguucugggaaccaaucucaggugccagcuccuaacugcugagccauccuuccagccuuuucauuucuaagacuugugaucuccucuugccucuggcucccagggauauuugggauuacagggcuaugcucucaugccugguuugcaaaaagaaaaaguuuggacagagcuaccaaauauuaucucaugcaguuaugaucagaaagcuaggcgucacuuagcugaguaguucucaugaagagugucauaguguuuuccccucagagaaagcaugggcuucagguaucugaagguucgguguuagccaaaccuaguccugagguuguucacuuacacugggcaagugacugagacugguaguaggagaggucgguuccuuuucauuuuggggaugucucuagggacacugaaggaaucugcuuugugagauuaagagaucaggauggaggccguauaguuugaugagguaaccucagaagauagacugucauuuucauacuguucuguugguuccaaggugagcuuuguucacccagcguguuuauugucuaccucggucugugguuaaacacucacaaaagguaggcaauuugauaaaaaaaagucauugaaaguaaucuuuauacucauauauuuuauaguucuauuuuuaaagucaucuuuaguuugcuuuauucacagaacacuuauacuugucaagauaauuuaaguuguucacaugaauagauguauuugucaagauaagguuauuugcaaaacuagccuuagucaugcguaagaucucacaaaggaaagacuucucccagaaauauuugaaauucuuccugaagcucgaccgcaugugugaagaguuuuccauuuguucugccaaacuccuuauguagcucuaauuuuaaagcuaaauaaugaauacuuuuagaaaguuuuuuauuuauuuuuauuuuuuuaauuuuugucccuccuuuagagacaagaucucacauauacaccaggcuggcuacuucuaacuucccauuuuucugugacuuguaagugcugggauuauacgagugagcuaccauaccauuccauacccaacucuuuuauuuuuaaguacacacauggaauguucagaggacaacccaagggguuggguucuaggguucaaacucaggucaucagucuuaguggcaaaugacucuacuggcugggccaucuuccuggccuacucugagcuccuucagaagacuuuuacuaagcuguaauaaauguugugaagguacugagaaaaggacauaugcuuaugaugcccggaggugguggccguguauuuaaggaacuacuuggagggaccgucagacaaauggguagccacucaggauuuuaugaagucuuagaacuuuaacagaagagguagccaguuuauuuaagaaguaggaggggugugguggcugggauagcuaaugaauucagaggauuuauucuguucugaaguuuaggacuuuaccuauaguaaguggauugcuggugcagugggcaguuuuguguaucugaggacuccuacuugagugguauaauugcagucuuguacuuauguuggaauuguuuuaguuaaauauugugaaaacagauggaauguaaguaugaaauucaaguauuaucuauggaaaaguuuuuaugauuuggaaaugugaggcagacucugaaaaccugcugagagguuggauggggauaaagacaacuaugaguuauuuguggaaagauuuagugacuguuuuuacgcauauccuguuucuugucccacuguaagcauaaguaaacugaauugguaguuaaucucagugauauauuugguauagcuuauaugagaaagauaugaugauacagucaguaugauuaucuugcuaaagaaaaggccuuuauuccauauuuaagaaguggcagacgaauauacauuucuauauucuaaguugaagcagaguauaagaucuuuacaagugacauuuaauaacuuccugguuugacugcuuuuuuucccauuaaaugaccaacugcuacugguaccagcagaugggcuaagacggguuuuguuuugucacgacuucagcaggugugaaaagaauaggaacugccuccuguuugaggaaaugagcagguuguaguuguacugcgugaguuagugucacuguuccagaaacauugacuagcauuucauugcuaguguuuucaacuagaauucucuucauacacuguuuccuaguguuacuucuuucucucuuuguccuacagcaguaagaacccgguagcuggaggcuuccugcuguggcaagucauugagucuguagagacauagaguagcccugccucuucuccaacacagaccucacacggagguuagaaggugauuggcagaggggauuugaaagcuccgaggacagcauuuugcuuacaggugucuuagaacuuaauuuuuccagcuuuauugaguuuguuugucuucuuuucucuuuugucaguucuuaaaagauguaaauauugcauuagaccagugguucucaaccuucguaaugcugcggcccuuuaauauagcucuuaauggugugcugaccccgacuuuaaaauuccuuuuuugcuacuucacaacuauaauuuugcuaguuaugaaauguaauauaaauaucugauaugcuugaugagcuuagggguuuugacgcacagguugagaaccacugaauuagacuaaugaaugaacagacgaaaccaaauaagaguuacauuagcauaaggccagacuggacacuuaucaaaaaguugaauuccugagucaugcuauacuaggaaugcuaucuuuuuguuuauuaccuauaagaauugaagcaaauuauuauuauucuccuccccuccucuccccuccccuccucuccucuccuuucuuucucuucuuuuuuuuuuuuuccuuuucuuuuuugauacagugccucucuguguagccuugguuguccuggguccugaaccucacaauguagaccagauugggcucaaacucacagaggugugcuugccucugccuccuaaaugcugggauuaaaagugugcacugccauuagucuugaaacuaauucuuaauuugaagggagacuugcgguaguauuuuucaucuggauuugggcaucuaaauaaguuuaaacauuacagaaaauaauuugacaguauaguucaaaaccuaaggaauguuuaaauguucugagcugguaaugacaguuugguauauauuucaagacaugaagggaauaaagacuauaacaauauuuaaaaaaaaaaucagugaugcuguuguuggcaaagagaaauuuaaauugaguuucugguacuagaauuuaaaucuggugccucugagguaccagauuugucuugguacaaagguaaauguaacgcugauggcaaagagcucccaggaaagagaccguacuaaauuauugccugucauucgcuuccuaagcuucaaaaggaacaaaugacccaaagguuccauuguggaauagagaagaugaguccuaggcagaaggacagagaguuggggacuagccuggucaacauagugagcuccaaguuagcccggguuagcaagggagacucuaaccucaaauaaacaaacaagcaaacaaacaaauaaaaaucugggcauucaggaaauagaggaacaggaguccaagguccucuuaguuaucuauauagcaagugggagcccagucugaacuacaugucuuuucccccuccagugcuguggguuggacacgaccuuacccauguuggcaagcacuccacaguucugcuuuauccccagcccuugcauuuuaagucuugcuaugcagccagccuccugaguacuggugucggcugcucagugaacagccauuuuauuaaagggaaccaguauugcauacuaccugagaugcuugacaacagggcuuuguacuuguuuauuuuauccugacagcauugcucuccagcaaguauuuaaucguuuuugaaguccaucauauaaaccauugagugagugugcuauauguugacaaccuucucuuuaccaaaccuacuuuuuucuuagaauauucccucuucagaaacuacugguaagcagaugucaccugcauuugcaguaagguggucauccugaccacuuggcaggguggcuuguuuugucuggaguuuagcucagucuguuggcagcaacaucuuagugacaugugcuuaguacacuuaaguauagcucaugacugaaaacauauuaaguuuaagagauaagagagcaacuuggguacguucuagagaguuaagucagagauguugaugugugccauuuaagcauuauauuuaccucuuuacagauuaauuggagugaugcagcuuccguaaagagaguuuaauggaguguugagcucugagcuaauucuacacccuaagcaggggaagcucuucuugucucugugacuugguggcuuucaauuugucaguagucuauaguuuuaaagauuucuuuuccucuuuguuguacuucauugugaaauucuguaaauacaagacggaaaaggagucuagagccaacagccacguccauaggaccucccaucauucucuguuucugagcuuuccucuuccuguacagccuucaaucacuucagcuccggaagugcagugagacaccucaucuagauuuauccuucaaauguuuaguugauauucuuggccuuuucuuuauaaauuugagauuaacugugagauuucauacaaagucuuaaugagaguuuuaaaaaacuuauugcauauauaauuugguggagagagaagggacaucuuucugacacugccuuucauauguagaugugguauuuaguaguuuuaaaccuuuuaugguaacucuucaguaagcugugagcuuuacgcaggucugaaagcuuucccuacgacgauuaccaggugcuuuauaauuuuuccuguuaugaauugguggucagugacuuucccaucucucccucuccuucuccuuccuucccuguucuugcuucccuuuuccuguucucagguucccucccucccuccuuuuucguucuuaucuaacauuaaacauguacucagucuuggcugagcgucguauuuagaguguuauguaguugagcgugugugaggaucagagucagaguugcugggacugagccccugguuuguuucucaaggauuacagagauaauuaagugaacuuuccugagucuaauucuccaacauagggaggauaauacugcuuuugggggaaaaauuaccucagagaaucaaauggcacacaugugaggugacuuuuaccuaauuaaaacuuccugugcaagggcuggaugcacgugugugacugacugacuaacgggaugcuugccuagcauccuaagaccugcuuucucuuagcacaaagacagcuguaaaaaguacagucagcauuauaaacaaagacacagugguucauaacagcaaauauucagacacacuccaguuaaaggugcuagaauaaaagucucgugaguugggcuggagagauggcuuagcaguuaagaauaucgacuggucuuccagagguacagaguucaaaucccagcaaccacaugguggcucacaaccaucuguaauggggucugaugcccuuuucuggugugucugaagacagcuacaguguacucauauacauaaaauaaauaauuguuuaaaaaaauucuugugaguuuguacuuuacuaauagaacaugugcuuaguguguguguauaaggcccagcagcacacaaaaauuuaaauaaaaaaucaaguuagucuggugaaguuaaugcgaguauaauuaugaggguuaagagagccauugugacagccccuguuugggagaugcugugggaaaaagauaaguaagauuuuguucuauuagugaauguauuuccuuccuugugauaaagaaaccuaguucuauugcuuuuaaauggcugcuuggaauauuaauuucacgcuggucuaaaacuugaguuuguccugccuuacucuaaguucggccacaccaccugacucauguauacugaacuuuuuauuuuuaauuacauuuacauccuuuacauguaugguuauauguacacaucacaauacagguguggcuagaggacagcuuucuggaucaguucuuugcuuucucugugugaggccaugggguuaacuggggucaucaggcuuggugggcaagcauccuuacucccugagccaucucuguggcccugaugcuaaguucuaaugcaaaacuuuggucacauguguuucaaggguugauauuggagacaguguuaauagcguuacauaggugagaguuucuauggcucuuaacccucagugauaacucagggaauuacauuaagugacacuguugugugacuguuucuucuggguaagacaugaucuuugauugaucucuugaaucagagcagcagcggucacaugcaugggacccucaccaaauguggccuauuaacauaacuuuaugguuaauugcuggagauuguggcuuauaccacaaaugacaguagaauucuaaguucaaggcuaaccuggucugcauagccauacccaaguugaaaaagugauuuaaaaaaauuccuuuauggaaggagggagggagaggcucaugagccuuuaccccccugcagccuuuuccauuuagguuaagaggaaaagaguuggcuuugucggacuugguaguacaacugcccgcaaguugcccagagggaugcaccugccuuucugucauccugugaguaaccccaguaagcuuauugguucaccagccuggacuugguggagucucuuuuggcuuuguccauaccuagucugucugagugaauagucuucuuaggaaaagucguauaucgcucaguaaaacuaguucuuugggaaaacuaaacugguguuccagggaggcauuaacuuggauuuuaaccuagagccagaucuuagucacuuucccuguugcugcaauagucugacaaagcaaauuaaagggugauuuauuuggcuuacaguuuaggauacagccugucaugaaauggucaacauggggggagagcuugaggcaguugcucaacugugucuacagucaggaagcagagagugauggaugcuggaguucagccugcuuucuccugcuucuguggucuaggaucucagccucgguggauggugcuuccccccucaguuaaccuaaugaggaccacaggcaugcucagaggccagccucccaggugauucuagaucugucagcuugauaguugagaugaacauggaagcagugaggucuuccagcaauuugaguaaagcaguaauaacuccaggauaaccacuaacauggugaaaugccuuuugguuacagauggguccccagccaucuugguuuagcugaugggcauaaacacugccauugaguuugaguagagcuagguguuucuugauuuggucagaucauguuuucuuuuguauccaggggccaggauuuguaucuucagaugauguucagucuuuuacauguaugugagauuauuuagugucccuccacuguaguuauuucaugcuuuagugucuuguacaucuauuucaguaaaaaauagaaaacguuuucaauagacuuuucuacagucaauuacuaaucauuuuacuuaacagggcuugaaucugucucaaacacaucucguuuucccuaagcaaguggcuaggggagaauuagaaauccuuaacuugguuagcucccugaaauugaaagauuuauuuuaccuuuuucuccccuuugauuuuuugaggcaggauuucuguguguagcccuugauguuuuugaauuuguuuuguagacuaggcuggccuugaacucagagauauaucuaucucuaccugccggguguugggauuaaaggugugugcugccacugccuggcaagauuuauuuuaaaaacacuguauguauguauguauguauguauguauguauguguguguguguguauauauauauauauauauauauauauauauauauauauauauagucgagaucuugcuacguaauucuggcugguauggaauguacuacaucaacuaaacugucuucaagcuuguggugaugcucuugccucagccucucaagagcugggacuauagaugcacaccaccaccccuggcugaaauucuccuuuuagacaguuaagacaggagcuugauagucguaggccuacccgcacaucuuauagaaaucaggcaggcuuuccugucaaguagaccuugguuuugaucucagcuggacuauuuguuaguugagugacuuuggaaaaaguuacauaggucccaaacuuaacuuuuauuuauuauccucaguaucuuuuauaaaauaucagauucaagagacuuucagugugugugugugugugugugugcauauauguguguauguauguguguguguauauauauauuauguguauauauauauacauauacauauaucucuaucuaucuaucuaucuaucuaacuaaauugcagcuuguugaaguuuuuaagaauagucuauuugagggacccgcccuuagaauuacaaaugacuacagaucaggaaagugacucaggaugaacuuggucacaaacaguguuguaauagaaguacuugggcggguugguuuugguguugguggcauaaucuuauucuugucaggcuauucaggaacuugcuuuuccccaggacagcuuugggccagcuucagauugccgcuccuaugaucuugcuucagccuucagagugcuggggucauaggugugugcgacagaaguagcuucauaggaaacauuagcaguacuugaaagucaccgcuacauaaaauuaaaacgaggaacacauagugaaucuguuauaggcucuccuuuagaaguacagcauggucuuuuucagugauccaagugcaaggccccagguuuccuucucugcuucacuuaccuggucuggucuucuagcaguaaccaccauucuguuguuuuacaugaugaauuuaucucauacgaauugagugcagccagaaauuucauuugguaaaguaucguccccuccuucucugagugacugacugcacuguuacuuuagagccaccacacaguauaccuacuuugcacuuuugaauuucuacucuugaauaucaguuguuggcuuaguuggaugcguaacauuuagaauacaugcaccaguccuuuucaggggaagaaauggaagagauugguauuucacuuguaguuuuucaguacaaauuaagagaaggauuaacagugcacagaccuaagaagauaauugaaauaaguauguucagcacaguccggucuguccucccuauggcuggccucagguuguaagaggcugucugcuccuccugcaaacuguggauguugauuagcagcuaguuucacuuugaaacucacacagcaaacacggaagagugaauuaagagugcuuuaacccaggggagucuugagauugacgucaaaacccagugcagcugucuaagcaguggggagaguauuucuaacucccuguuaggucaucgauggcccuccccucuccggcucccuucucagacaccguguaggacagcuuugcccuucuuugcuaagcugcaguggccucuuuacuugagcuugcgcagcucuucaucccucaccugcauuaagucauugugaugagaaccuuuuuuucuaaaaaguuguuuuuguuuuuuguuuuguuuuuuuuuuuuuaaagaaagagaauuacagaucgagacacuaaagaggguacaguuaguccauacauguauucauguuccucaacuuuuguuguuguuuuucaagacaagguuucucuggguagcccuggcuguccuggaacucacucuguaaaacagacuagccuugaacucagaaguccgccugccucugccucccaagugcugggauuaaaggcgugcaccaccacugcccaguguucaacuuuuaacauguuauauuaguaugguacauguaucauauuagugagucaacauuagcauuauuaacuaaguucauaguuuacuuagauuuccuaggauuucuucuucuuuuuugguggugguuguuggguuaagccauugcucuauuucuacccaggauacugucuuaauuagcguuuuauuauggucaacagacaccaugaccaaggcaguucuuauaaaggaaaacauuuagggggcuggcuuacauucagagguuuaguccauugucauggacggggucagggcgaaacauggcauuguccaggcaggcaggcauggugcugaaggaagagcugagaauuguacgucuuaaucugaaggcagcagaaggauacucugugccacacuaggcauagcuugagcauauauuagaucucagacccaccucuaugauaacacacuuccuccaacaaggccauaccuaccaauagugccacucucuauggaccaagcauucgugcacaugaaucuguggggacuauccuuguucaaaccaccauuugaaaucuaguuacuaugucuccuuugauucaucuuggcugugagagacuuuguuuuucaauggucuugacauuucucagaaguccugguuagguaccugcccccaaacuggaguucguguagguuuuccucaugauuagauugcaguugccuguaugacagaggcuguaguguggcucagggguagggguguuacagagccuaucggacagguuacagagaguucaagguacuuaguaaguucuaggcuagcuucaacugccuuacuauccaucccccccauaugcauauacacccaggcacaugugugagcaccuacauacacauaaccuguguacacacagaaauacagaaaccauucaggauuugcuaguuucuuguugcuacaagaaacaagacaaaggagagaaaccauuuaagaaaggggaggagguuugacucacagccuuagugguuucaggccuugauuggcuugcucuguuucugugggccuguggugagaacaaugucauggugcugugaggguaugacaaagcaaacugcucaacuccugcuagcuggggagagguagguagguagauacugauagacugaaaagcacaaggagagagacagcgggaggcuagagauagucuucaguggugaaccugaguuuccucagucagaauugcuaaccuguaauccuuauggcauaacauuuccaaccagaaugcaguauuucuuugcuauuucaagucauaauguuaauuuucagaaguuagguuagccuuccuaauuuuuaaacucauuuugguccuggggauugaaccuaggaccuugugauacuacacugugugcucuguaauuucauuuugcacuuuuuaaguuuugagacagcaucucaguaaggugcccagguugguuuuaaacucguucugcagcccaugaaguccuuaaguauaugaucagccacugagcagcagggaucuuagaccugugcacugagguccagcuagggacauggcuucugcuguugauggguuagacacaugcauaggucaugcauccaccauuauaacaccacacacaauagauucugcaccuuaaauacucccuuuggauuguggguucucucucucucucucucucuuuuuuuucugagacaggguuucucuguauagcccuggcuguccuggaacucacucuguagaccaggcuggccucgaacucagaaauccgccugccucugccucccgagugcugggauuaaaggcgugcauggauucucuuuagaguuaucuguacucucugguaagccuuccacauuuuccagagggugauaugaaugcagugacacaaagcuuaaauuuguagauggcuucuuugacauaauagaaaauuauagaggaauauauuuaagauucaucuaugauucaugaauuaauuguucauucuuuuaaaauuguugaaugguuuuccuuuguguggaugaaucacaguuuguuuuucuauucuccuauuaguacuuaugaauaaauuugcucuaaauguucaugggcaguuauuuguaauuuuuauuuaaguuuauuaucacguguaagcauauguacaggcacacaugugccauguuguacacauguaaaucagaggugaaucucugauuggguuuguucccuccuuguaccaucugaguuuuggggauucaacucagguugccagguuugguggccgucaccugcacucacugaaccguacauuuucagaucacuuaguacaucucuaagugguaacauucaggaguucguuaugagcagcucucacuauguaagccuggcuggcuggaauucgagaugcagagcauaucagguuugagcucagacaucuucuugccuugggagugcucagcccuagucuuuaugucuuuaugaauacgcgacacucuucauuuucauuguccucccucuccauuugccuuuucuacaguggagcauauuuguuuauuacuuuuuuauugugaguguguguccaagugaguguguaugcgagugugcaucguagcacacagaggucagaggacagcuugugggaggugauugcuuccuucugccgugugcacccagagggucauucucaggagcuuuuauccacugagccaucucacuggccucagcaccucuuuauauguuuacugguuauuuggauuuucaagagaaaauuacguacuuuuuggacucugaauuauauacuucuuucuggacacuggguuuugaaagaaggcaugguuuucauuacaaaagucaguaagaaacuguugggggaaagccaaguuauggcuaggaagcugaaguauauucugugaggaagccgagauguugacgugcuugguuugcuauaggaaggggagcaauagagauuuugauuaaaaagagacgcuauaugauuaguagguggcuaaaauuguuucuagugaccucagaugaaaaaugcuaaaauaugaaaucuauuagcuucaaguucuacauugauauaugcuguggaauugcuucaguaauguagaccuaugaagacauagacagaaggggagcuucaugacuuuuaggauagaugagcuuugugggaaagugcuaaccaagccuugagggggagccccaaggccaggcagaggaaguuuaaugguacagcaguuagcagcaguccucuuagcuugacugguuucuuguagauugaggagaacuucuuuaauaacucucaacuuguuaagugcauagaaauacuacccuuaguacuacaccugugcguuaauauuuaagggcaugccuuuaaucccggcacuugggaggcagaggcagguggauuucugaguuugaggccagccugcucuacaaagugaguuucaggacagccagggcuacacaaagaaacccugucuugaaaacccaaaaaaaaaaaaaaaaaaaaaaaaaaaaaaucacuagucuuguuuugaaaagcuacaaaauuauaaaguacauuugccuagguauggguuucuuguaaccugauuuuuagaucauuaauuguuguucugagguucuuuauaaauugaaagaaccuugggcuauaauuuagguaagguguuucugggauugaucuaagagauuauauguuuuauaauagacaggguagcuuucauuuaguacuaguauguugguccuagaaguuaucugcauucauacuugacaguggcauucaugccucaaaacaggaaaguagaggcuaguaaugcuuaguaugcuuuuuguuagagaaguguuugacacagauuacuguuuuaacaaagucaaauugcuucuagggauuagaauggaugagugugucuccuacccccuucauuccacuucgaguggcaagggugaguuaacagugugccagacaucguagugccuggggcaugcuaggagaccugggaagauuuacaguaaucaaacacaaacagacagaauagcaugaagaaauuucagucuucccagcccagcuuacagacuuaauuaggcuuauuggggcagaaaauauuuuucuucccuccccauuuuuuaucuguuucuccuccacucccaccuccuucaugcucagguucucugagucucuuuguggggaucauauugcuaacaaagagaguccuuuucuuguugcuuguuuuuuaauucuaacuugguuucuuuggcuuauuaggaaacagaacagaaaugacaacaaaguaagauguuggaagacuccauuuguguacuguuuucaggaauuuccccauuuaaaaaucugcauugaggaauuuuuugugguucuauacuuagaucuuguucacaucuuugugauuuuauagacucucuuggccugcugcuuaaaaacugucagcugagcuaacuugcucugucugccaucuauaugcauuguaugguauaaugcaggggagugugcacggaugcuguucccugccuuuccauuagcugugcaguguugagcuucaguugaugauggcaaaugauucagaguaggagaagaggugggguuucuuccugucuucccucuuguggucaguaaaaucauugacaaccgccucuccaaggcuugggauguauggauaaaggaaaagccuaggauuucgaggggaggggaggggaggggaggggaggggcgguaggugaggauuucacucuccugugugccauggaaacaagaaacaagccuuuugagcuucugcuugccugcugauuugccggguuauccagguaaucuauggcagucuuuguuuucucuguaguguaaagaauaaggcaaaaugguagaaaauugcuucaguaaaggggauauaccuguaacaugaaugaaaugggcaagggaaaggauuuuuguacaucauuauuauuucuuauaauagcauuuuaauuuuuccucuugcuuuaaaaugcauaucuugaccuaaagaaagaaaauuccuaguuuugaaaacccaugccuuaauggauuagcuugagaacaaagguuuuaacauccagcacgcagggauaucuuuauucagaggacuggcagcgucucccuucugcuaccuuuguaggacugagcuguguaaugaauggcucuugaaucuggacuagggcugaugaauuauuauucugugaauugugauuuaaucaucuugaauuuuuccgaugguugucucccuuugauacccaagggacugugaauggggcacgggggcagggaaucauauuccagugggggaagggaauguuuuuuagaguauucugugugacugucuuuucaguuuauuuuuuucucaugaauugaaacacauggcuauuuggaaaagaugauacccauagcuucaggagcucuugcaucaguuagaauuauuuuauccuuuguucaguuagugguauuuuugcuugugucagcuaaaauguugauuauaacuguaaagcugcugcugagcugcagugguggcauuaggguggcauucuccuuccccgccagugcugucugagugccggggcagagcccugaggcugagggaugcaguguggaaauggauuucuuuuuagggccuuacuaguauuggaaccaggaccucuugugugguagacaggcauuuaaucauugagcucuauccucuauauccccagcuuaggucuuucuuucuucugaagguguuggucauguuagaauuuauuuucuuguagacagaaagaccuagggauauaauuuauaacacugaaauguuuaauauugcagauuucuuuauagauagauuagacucacacuuaggcacauaugguaagcuuucuacucauuuucuuaucuuuuucccagugacaugaguuuccucuguuacauuuggaagacugacccggcaaaaguaucaccaaauuaacaugcucauugcgcauuugcauuauaccuugaacuuuaaauguguacaggcuuagaauugaauagaagaauaaagaaacucaugcauaugguguaccuuuuugggugcacacauauaauaagcaguauauauacugacauguagguguuuuuuuauuaaauacuagguuuuucauuuacugcuaaaauuacccucaucucuuuuaaaccauacuuuauguauagcaauaguuuaucucucaucuauuuuuauagaugagaaauuuuauacuuagacaaauaaguuaguaacuacaaaauaaugaagugaaggccagucagacucuaaaacaucuuuuaacuguuugcauauaagcagauuaaaauauuguauugaauuauugauaucacaaaaaagcgacuaagagauagggauuguagucuguuaaaaacuaagcaguugagccaccgcuugacgguauaggauaaggacuggacuugggcuuaauucucuucucugacauuuccauacuccuuguauggcuucugaagucagcccgcugaggguuucuguuacguugcauuagcuuccuuaaugauucuucauagccaugacuuuauggugugauggacauguggacuguguauaccucucugacuugccuguagaauacucaucuauucaucaagaccuuuuuauggacugguugccuucucccuguccuccucccagacugcaaggccuguguguugccuggcuucacacugugugcugucuucaguuaacuuucugagcuggugaaugaagaacaaacuauacugucugggggaauaagugacuaacucauccccagaggacaaaagguucucuuggggcugacauucaucucacuauacagugauccuucaaggaauuuauguuuaaagaccuuaaaagaagaaaguuacaggacaaguuuagucugguagucuuaaacugcuggaauuucccauggaaaaauaugaguagucuaaaauuuauaacagggagaaaacuguucagaucaccaagucuuuuacauuucauaaauuauaauaauguuuauaggcaagagguucuguaauuguuuaauuuuguguguauauauaguauauaucuauaucuguaugugggaguacacacauuuguaucugugcuuacuguggagguuaaaaauagacuuagguaauuguugagcucuccacuauucuaucuguguguguguuuggugugcauguuugugggugcguguggaggcuagagcuugauguuaggaggcuugcugaguugcucuucacugcauguauugaggagaguaaacccagggcucacuuguucagugagucuaaccucuugaugagcaggauuacaggugggauaccaccccagccaacguuacauggaugcuggagauccaauccuguccucacacuccacggcuagauucccgagcuguuucccaagccugacuucuccaccugucuucugagacagggucuuucugugacccuuggacuaaguuuauauucacugcucagcaagcuuagccugagucugcucaugcuccgacacaaggaucagagcagagcauuaacuuagucugacuuuuaaaauuaaauuaauaauuacuuagugugauuauuuugugugggugcuggggaucugagcuugagccuuucugcuugcauggugugcacuucacugacugagccauuccagccaagaaguguuuauucuucauuuuguaaagauuuauuuaacuuuauggguauugguauuuugcaugccugcacacaugugcgugugcauguguauguguuuguguguaccaugugcacucagugcucaaggucaaaaaagagcccuggaacuggaguuacaggcgguugugagccaccauguagguggguccugggaaccgaaccuggauccucuccaagaucaacaaguguucuuaauugcugagccaucucuccagccuccauguagccuuuguuuuuaagaaaguaucucauguugugcaucuggccuucaacuugguaguucuuuuuuuccuuaacauccuaaaugcugggauuguaggauucugucauugcaccuggcuuuauggguaaacauuuaguuuuauuuuuagaguuuaaaagcuuuguugaaguauaauuaauguguaauaagcuugaaauguuuguguguaggggugugugugaacauguuugcauguguauacauauggcucugaaugcagagaccaacuuuugugugccuuuccuuggaagcauuccaccuuguguuuuaagauagggccucuuaguaggcagacccagggcuugucaaucaggccaggcuggcuggcuaucaagcccuacagaucuaccuuucuuuuucuucccaguacugggggcguuccacgcacagucugccaugccuagcuuuuuauauggauuuggggaccaaacuuagguacacauuuuucucuuuucuuuucuuuccuuuccuuuucuuuucuuuucuuucuuaagauuuauuuauuauuauauguaaguacacuguagcugucuuagacacaccagaauagggcgucagaucucauuuugggugguugcugggauuugaacucaggaccucuggaagagcaaucagugcucuuaccugcuaagccaucucuccagcccagguccaaauuuucauguggcaagcacuuaccugucugugcucucuccagcccuaagcuguauauauuaaguuguacaccuugguagacuuugacaccugcaugugccuggaaaacuaucauugcagucaagaaaauaaauacagcugauagguuagcucuggcugauaauccuagcacucaggaggcugaggaaggaagaccaugaguuagaggccagccuaggguaugcaaugaaacccugucucuaccugaauauaaacagucauuuucuugugcuuuucuugccauccuucccuccaugccccucaccuguuucaugccacaguggguuacuuuguguguguuucauugaaauggucucaaacaguuugugaugucuuguuuggcgauuuuauucucuauguaauucuucuggguuuugucuguguugugccucaaugguucauuucuuuuucuugcugagcaauauauggauauauacucccguuuacucauucaacuguugguagauauaguaugggcaagucuuagacuauuaaguuuacguuggacauucugcuugucuuuguauggacauagguuuacguuucucuaggauggacugcuuggcugugugccuaguguauauuuuagcccuuugagaaaauguuucugaguuaacugugcugggccacacucaccagcaggguuacaguugcuucugauccuuggaauggucaguccuucguuucagccgcuguagugggccugcaggggcaugcuauaguauuuuguauucaccagugucuacuaauauugggcguccuuuaaugugccauucacauacuuucugugaauugucucuucaaaucuugcuuuuaagagucuucuuaccauugaauucauuauaguuucuaaugaaagcccagauuagauaugauuuggaauauuuuuucccacccuguuuuacaugcuuuuauuauuaagguaacucacauuugcaggagcacaaauuuaaacucuggaucccaguuuaucauucuuucauagaucauguauuuuccugugucugagaaguuguguguguguguguguguguguguguguguguguguguguaggcauguguagaccacaguugguguugggucucuuuuccuucuuuuuuuuuuuuuuuuuuuuuugagacaggaucuuucugugaaccuuugggcucuguguuuugacuagguuagcugguggacuacugagcugccagauugccugucuccacccuucaguucugcagucacagaugcaugcuacuacuacacuugucuuuuacauguguguuugcaaucugaacuuagggccucaugccugcacaguaagcgcugcauccauuaaagccuuuagucccagcuuuaguauuucuugugcuaugcaauaguuguugugugggucugaauucaaauauauuauaagaacacgaguaaauagaauuuggggaucaaagaagaggcaaggguuuucugagguagcagagguugggaggcagaggcagguggauuucugaguuccaggccagccuggucuacagagugaguuccaggacagccagggcuacacagagaaacccugucucgaaaaaccaaaaaaccaaaaaaccaaaaaaaaaaccaaacaaaaacaaaaaacccaaaacaaacaagaaaagaucucaguaguuauguuggugacgagagggccucacauagagcaguguuagagauaccacuuucuagggaaagucccuaggagugguccugaaggccacuaggacauacuaacuuaacugagguuagagguaagaaaugccugauuuacccucuuacgucaugcuugguguuuggaugccuguccccaccaccccauuuaauggaaaacgauugaaggaauuuuaaugagagggacuguuugugguuugcaagucuauagcugcucuacaggaaaggaugcuguguguaagacuggaaaaccaaugucauugcaagcaccaggccuagcagagugggucacucucagugagcaauggaggagaccaggagaagaugaauucgaagcauucauuagugauaaagcauuugaauucaaggagagauacaaacaccacagaaaccauuguguuaauaguguguacuucugacucuguaaguacugcuauauaggagaugcucagaaaugacuacuugauagggggauagaauuggggcagagggagagguggauggcauuaauggcuuccaaauuucuaauucaaaaacaaaaauuaugcaucuguguuugccuacacauaugugagccuauauugccuguggaagccagaaaaucuacucacccccuggaauuacagauaauuguaagcuguaauguggaugcugggaauuaaauguuuuuuuuuuaaaaaaaaaaaaaacaaaacaagagcagccagugcucuuaaccacugaacuaucucuucagcccaaauucuagauucuuacuagaccaucuguauggaugauguccauuuguuaaggcagaaaagcaguuuugugggggucaaaguaaauauuuuuaggucuauugaacuugaugucaaugguaaaucuaaguaaacacgauuguauggaacugaagauagacaaguugaccgugacugcggucuguucuuucaguacauagacauuuauugagugccuguccugucuagcacuuugcuaguauguagcgcugaucuaggacccuguugccuuagaacuuacuuccaguguguggaugagauaggaagaaagauucuccuuaaaaaaaaaacaaagcaaacaacaaacacguuuauuuauuuacuguaugucuggacgaggggcaggggcaagcaugcauggaaugcauauggaggucccaggacagcugguuggagucaguucuuuucuucuacaauguauguuuugagauugaacucagucuuaugcuuggugccaggcucuuuuacccccaaguuaucucuccacauucuccuuaaaaagaaaaauucauguguuuagugccuacugugugcagaagugugaacacagauuuaagaguaguuucuuuauugaggaagucaguuuuuauuguugacuagaguggacuugugucaaagauguuucacuggauugcuguuguuugauccagugccugccugccuuccucuuuugugucugcauuauuuuuauuuucuacuguaaggauuuaaucuuuaagcacuuggcuuaugagugcuuuugcuuuuuuuuuuuuuuuuuuuuuaaugucaccugugaauagugacacacaccuguaauuucagcacuuaaggcugaggcaggagaaucacaagcuacaggguuuuuccuguagccucugcugcccuagggcucacucugcagacuaagcugcccucaaacugaaagagauccaccugccuccccagugugggaacugaaggcaugagccacuacugccagucaaaacacucuuaaguuagcagcuagccacacucacaucauguuaaugguuugucucuguuucuuggacacaugauuuuguauuuuuuggaauuuuucucuaguuuguuaauuuuuuaaaauaugcauuuuauuuauuuaguguugaaggagagguuguaacaugugccauaugugugaaggucagaggucaauuaguucaccuacuauuucaguccuggggauuaaacuuaggcugucagcuuugguaggaaguacccuucccugcugagcuaucuugggaacucuuuaguguaucuucgacuuuaaacaauuccuguuaaggggauggaaagauggcuuagugguaaagaaagauagcuugccauuuccccuugcagagaaccuggguuugguuccuagcacccccaugggguuaaaggcauccauaacuccaaccucagggggucugaugcuuucuuuugaccucuaaagguaucaggugcacauguguacaugugugcauauguaugcaggcaaacacacacacacacacacacacacacacacacacacacacacacaaauacauuuaaaagguuuaaacagugccuguuaagcagugguuaaaacuaagagucuagggguggagauggagagcuggcucagggguuaagagcaccugaugcucuuguagaggacccaggcucaauucccagaaccuacaucaugguagcucuguaacuguaauucuggggaucugaugcccuuuucuggccuccgugggcaccaggcacacaugagguacacagauacaaugcaggcagaacacccauacauaugaaauaaaauaaaacaaaacauuuaaaaacagagucuagagcuagcuauaaauccugaauuuacaugucaguuucuguccgacuguagacaagccccuuaaucuuucuaugcaguacauuuucagccacaaaauauguauaauaacgguguuugcugcaaauccaaugagguaauggguguaaugcagcuacagugguuauuagcaugcacuaagcagaguuggcugcuauucuuagcauuuucauuuuucugucauuguccaaauaacagcacacuugaggucauuguuucuguguugugaucagugacaguugcuuugucuuuuugcaucuuuuccauuuuuuuaccuccagcaacauucuaagucugggucugugaguucugaaucucuguaguagauuuucuucuguguuccucuuaacgccuggguauugccuacuaaaucuagggagaguaggaucugcauuucaggucucugauccuuaugcuuaggcaaucugauucuugcuuagagucuacccuguccucuuaggguagaugccaaaccuaacagacauggcaaauucauuuccuagugaguggagguuauaaucauguccuuucuugaaagacgagucugcuuuucagugcugaggagcacugcuguuguagaauugcuuuuuugcuuuccuccuucuuugucuggaguugaauucauguuuauaaagaaguaguugcuguucagguggcaacaugaucccuuuacauguccagcaggcaaguugccuacagggcaaauagauauaaauugaauucuccacugaauuuuuaggauuagaagaagccaauucugcuuguaaccauuuuacauuggcuuaucuuuucuuugaaacuauguagaauaccuuugaaaccccucccaccccccacacacacaaagaagggggaggagagagagagagaaauucaguauaugguauuuuucuugaaagaaugaagaaacauuuguuuugaugguugcaccacuagaauucugcuuucagcacugauggaaaaguaaaucuuguaaucauaaguuuggccaaucauaaucccgcaaccuuccaggguggaguuguagcccucccuccucaggacugaauagcuuuaucuagcagggucuucuagcuuuggcagaggagcaguacaaaggccacauugaccauagcuacuggggaaacccuuuuuccuucucuggccuguaaaugcgguucugucucuguaaaaagcccugacaucagcucuuggaaaaauccaaauacuuguguuggaagagggcagaagcacuugccugggcagugacuaauggcugugcugcaugcagcuuugaguuccagaugucucucagcccugcuacacuugagaaucuccauuuuaaaaaagggcuagagcuuuaacuuuagcagcuccuacagugcuagugucuuuuucuuuuccuugaauaaaauucuacauuaguguagaggaggcugaaccuaguaaggcagagggaugugugcauuuauggcuauccugggauacauaauguuuuaggccagccugggcuacagagagagaccuuaucucguuuguuuguuuguuuguuuguuuguuuguuuguuuuucgagacaggguuuuucuguguagcccuggcuguccuggaacucacuuuguagaccaggcuggccuccaacuuagaaaucugccugccucugccucccgagugcugggauuaaaggcgugugccaccacgcccgcccggaugagaggccuuaucucaaagaacagaaagagauaauggagaauucuuguuugaggggcaaagcauuagcuuuguacacuggguguuuucuuucuaccuguuaggugcuuccuuuuuuuuucuuuuuuuuugacuuuuuuuuaauuagguauuuucuucauuuacauuuccagugcuaucccaaaagucccccauacccuccccccccccacuccccuacccacccacucccauuucuuggcccugguguuccccuguacugaggcauauaaaguuugcaagaccaaugagcuucucuuuccacugauggccuacuaggucaucuucuaauacauaugcagcuagagucaugagcuccgggggguacugauuaguucaauuguuguuccaccuagaggguugcagaccccuuuagcuccuuggguacuuucucuaacuccuccauugggggccccgugauccauccaauagcagacugugaacauccacuucuguguuugcuaggccccagcauagccucacaagagacagcuauguggguccuuucagcaaaauguugcuaguguaugcaauggugucagcguuuggaggcugauuaugggauggauccccggauauggcagucucuagaugguccauccuuucuucucagcuccaaacuuugucucuguaacuccuuccauggguguuuuguucccaguucuaagaaggggcaaaguguccacgcuucggucuucauucuucuugaguuucauguguuucgaaaauuguauccuauaucuuggguauucuaaguuucugggcuaauauccacuuaucagugaguacauaucauaugaguucuuuugugauuggguuaccucacucaggaugaugcccuccagguccacccauuugccuaggaauuucauaaauucauucuuuuuaauagcugaguaguacuccauuguguaaauuuaccacauuuucuguauccauuccucuguugaggggcaucuggguucuuuccagcuucuggcuauuauaaacaaggcugcauguguccuucuuaccgguuggaacaucuucuggauauaugcccaggagagguauugcgggauccuccgguaguacuauguccaauuuucugaggaacugccagauugauuuccggagugguuguacaagcuugcaaucccaccaacaauggagggguguuccucuuucuccacauaaugccagcauuugcugucaccugaauuuuugaucuuagccacucugacuggugugagguggaaucucaggguuguuuugauuugcauuucccugaugauuaagaaugcugaacauuuuuucaggugcuucucagccauucgguauuccucaggugagaauucuuuguuuagcucugagccccauuuuuuaaugggguuauuugauuuucugggguccagcuucuugacuucuuuguauauauuggauauuaguccccuaccugauuuaggauugguaaagauccuuucccaaucuguugguggccuuuuugucuuauugacggugucuuuugccuuacagaagcuuugcaauuuuaugaggucccauuugucgauucuugaucuuacagcauaagccauugcuguucuauucaggaaaauuuccccugugccuguaucuucgaggcuuuuccccacuuucuccucuauaaguuucacugucucugguuuuauguggaguuccuugauccacuuagauuugaccuuaguacaaggagauaggaauggaucaauucucauucuucuacaugauaacugccaguugugccagcaccauuuguugaaaaugcugucuuuuuuccacuggaugguuuuagcucccuugucaaagaucaagugaccauaggugugugcguucauuucugggucuucaauucuauuccauuggucuacuugucugucgcuauaccaguaccaugcaguuuuuaucacaauugcucuguaguacagcuuuaggucaggcauggugauuccaccagagguucuuuuauccuugagaagaguuuuugcuauacuagguuuuuuguuauuccagaugaauuugcagauugcccuuucuaauucguugaagaauugaguuggaguuuugauggggauugcauugaaucuguagauugcuuuuggcaagauagccauuuuuaauauugauccugcuaauccaugagcaugggagaucuuaucaucuucugagaucuuuaauuucuuucuucagagacuugaaguuuuuaucauacagaucuuucacuuccuuaguuagagucacgccaagguauuuuauauuauuugugacuauugugaaggguguuguuucccuaauuucuuucucagccuguuuauccuuuguguacagaaaggccauugacuuguuugaguuaauuuuauauccagcuaccucacugaagcuguuuaucaggcuuaggaguucucugguggaauuuuuaggguuacuuauauauacuaucauaucaucugcaaaaagugauauuuugacuucaucuuuuccaauuuguauccccuugaucuccuuuuguugucgaauugcucuggcuaggacuucaaguacaauguugaauagguagggagaaagugggcagccuugucuagucacugauuuuagugggaaugcuuccagcuucucaccauuuacuuuaauguuggcugcagguuugauguagauugcuuuuaucauguuuagguaugggccuugaauuccugaucuuuccaagacuuaucaugaauggguguugaauuuugucaaaugcuuucuccgcaucuaaugagaugaucaugugguuuuugucuuugaguuuguuuauauaguggauuacguugauggauuuccuuauauuaaaccaucccugcaucccuggaaugaaaccuacuuggucagucaggauggaugauuguuuugauguauucuuggauucgguuagggagaauuuuacugaggauuuuugcaucuauauucauaagggaaauuggucugaaguucucuaucuuuguugggucuuucugugguuuagguaucagaguaauuguggcuucauagaauuaauuggguagaguaccuucugcuucuguuuuguggaauaguuugugcagaacuggaauuagaucuucuuugaaggucugauagaauucugcacuaaacccaucugguccggggcuuuuuuugguugggagacuauugacugcuucuauuucuuuaggggauauaggacuguuuagaucauuaacuugauccugauuuaacuuugguaccugguaucugucuagaaauuuguccauuucauccaguuuuguugaguauagccuuuuguagaaggaucugaugguguuuuggauuucuucaggaucuguuguuaugucucccuuuucauuucugauuuuguuaauuaggaugcugucccugugcccucuagugagucuggcuaaagguuuaucuaucuuguugauuuucucaaagaaccagcuccucauuugguugauucuuugaauaguucuucuuguuuccacuugguugauuucgcccuugaguuugauuauuuccugccgucuacuccucuugggugaauuugcuuccuuuuguucuagagcuuuuagguguguugucaagcugcuaauguguguucucucuaguuucuuuacagaggcacucagagcuaugaguuuuccucuuagaaaugcuuucauugugucccauaaguuuggguauguuguagcuucauuuucauuaaacucaaaaagucuuuaauuucuuucuuuauuccuuccuugaccaagguaucauugagaagaguguuguucaguuuccacgugaauguuggcuuucuauuauuuauguuguuauugaagaucagccuuccuuaguccuuaggugaucugauaggaugcauggggcaauuucaauauuuuuguaucuguugaggccuguuuugugaccaauuaaguggucgauuuuggaaaagguaccauggggugcugagaagaagguauauccuuuuguuuuaggauaaaauguuuuguagauaucuguuaaguccauuuguuucaucacuucugcuaguuucacugugucccuguuuaguuucuguuuccaugaucuguccauugaugagaguggggugaugaagucucccacuauuauugugugaggugcaaugugugcuuugagcuuuacuuaaguuucuguaaugaauguggcugcccuugcauuuggagcauagauauucagaauugagaguucagcuuggaagauuuuaccuuugaugaguaugaagugucccuccuugucuuuuuugauaacuuuggguuggaaguugauuuuguuugauauuagaauggcuacuccagcuuguuucuucagaccauuugcuuggaaaauaguuuuccagccuuucauucugagguagugucugucuuuuucccugagauggauuuccuguaagcagcaaaauguuggguccuguuuguguagccagucuguuagucuaugucuuuuuauuggggaauugaguccauugauauuaagagauauuaaggaaaaguaauuguugcuuccuauuauuuguguuguuagaguuggcauucuuuucuuguggcugucuucuuuuagguuuguugaaggauuacuuuuuugcuuuuucuagggugugguuuccguccuuguauugguuuuuuucuguuauuauccuuugaagggcuggauuaguggaaagauaaugugugaauuugguuuugucauggaauacuuugguuuguccaucuaugguaauugaaaguuuggcugggcuggcauuuguguucucuuagugucuguauaacauaccuguccaggaucuucugacuuucauagucucuggugaaaagucugguguaauucugauagaccugccuuuauauguuacuugacguuuuucccuuacugcuuuuaauauucuaucuuuauuuagugucuuuguuguucugauuauuaugugucaggaggaauuucuuuucugguccaaucuauuuggaguucuguaggcuucuuguauguucaugggcaugucauucuuuagguuugggaaguuuucuucuauaauuuuguugaagauauuugcuggcccuuuaaguugaaaaucuucauugucaucuacuccuauuauccguagguuuguguccuggauuuccuggauguuuugaguuaggauuuuuuuuugcauuuugcauuuuauuugauuguugugcccauguucucuauggauucuucugcaccugagauucucucucccaucucuuuuauucuguugcuaauguuggcaucuaugguuccagauuucuuuccuaggguuucuaucuccagcguugccucacauuggguuuucuuuauuguuucuauuucccuuuuuaggucuaguaugguuuuguucauuuccaucaccuguguggaugugcuuuccuguuuuucuuuaaggauuucuacguguuugguuguguuuuccuguuuuuuuuuaagaacuuguaacucuuuagcaguguucuccuguauuucuuuaagugaguuauuaaaguccuucuugauguccucaaccaucaucaugagauaugcuuuuaaauccaggucuagguuuuuggguguguuggggugcccaggaaugggugaggugggagugcugcguucugaugauggugaguggucuugguuucuguuaguaagauucuuauguuugccuuuagccaucugguaaucucuggaguuaguuguuauaguugucuuugguuagaccuuguuccuccgugauucuguuagccucuaucagcagaccugggagacuagaucucuccugaguuucaguggucugagcacucucugcaggcaagcucuccucuugcagggaaggugcacagauauauuuggcauucggaccucccuccuggcagaagaugaaggccugaaacagggccuguccaagaagcuguuagcuucuguaguccacacucucaccugcgcagacuagucucaaagggauccgggaaccaagauggcuuccccaggugcuccagcaaagcccuccccgguguggagcacaccugucuucuggccgggaaggugcccggaugucuggagcccgaaacggggucugccucagaagcuguccucuaggcaaccuugaggguauuguccgacuccuugcccaggugacccagugcuggagccgaccggaagggacuugugauccuggucaggccggguuuucugcuucccuaaugcuggucccgugugauuggaguggaaaagaaguuguguuccacucaccgguguuccuaagaucacguggagaguccuuucuggaccuugggggugucugccgacuccacgcccaaggugaccgggcgcugacgggaagggccuauuaggugcuucuuaaguauuugcuacuuggggugaaauacacuguuacuauaagcacaauuuaaacuugccuuucuuagugcucuaauuuguggaaugugaagguuuauucauuucuuuuuaauauuuuaaagaccagagacacagaugccuuuuauuuaacuaaaacaacauuuauucuuguuuaguuuuuauucguugaaaauuccaugcauguauaugaaugaauuuucugccuauccccucacuucccuguuuaauuuuuuuauuuuuauuuuuauuuauauuuauuuuuuggcuuuuuugagacaggguuucucuguguagcccuggcuguccuagaacucacuuuguagaccaggcugaccucaaacucagaaauccaccugccucuaccucccaaguguugggauuaaaggcgugugccaccacugcccagcuaauuuuuuuuaaaaaaugauuuauauuuacuuuaugugcauuaauguuuugcuugcauguaugucugugggauggugccaauuuaauuggaacuggauuagagacaguggugaccugcuaugugggugcuggaaauugaaccaagguccucugagcuugguccucaagugcuuuuaaccacugagccauuucucaauccccuaguuuaauuuuugaggacagaaucuugcuauauauagccagggcugguacugaacuuucgacaaucuuguauccucagccucuugauugaugggauuuuagguguuugucaccaugccugauuagaguguucuuuuaaacauaaaucauauuaugauuaaaacuuucuaguugucuuacauuaugaauaaauuucucauauuauugauuucuaucuauuguugacaacaucucaguauuacucucugggccauucucugcacucaggcuacaguggacauggucguuuucaaauacacuaaguuacuuauucuugcagaccuuugucuuaguuauuuuuguuacccacaacuacuucuguggccccagaucaccucauggcuuccacucuuaacccuacugucuuaagucaugcaccuucaggucuuugaauaaacagaauaacuccauucagucacaaacuagugggugaggaagagguguguugggaagagaagugccacacauccucucuagaggaaggaaguuucuuucaucugcaccuccuguagacuuuauuuuguuucucuuuucaucacuucugucuauguagucagcucacucaccagagaguggcacugccauuaggccaaaagcuuguugcuacagcuggaucuguggcacuuugucacuggccuuugaggauccuaguaaacuacuggauaaacuucaaguucuuucuaaggaagacuaagauguccagagucaagaaacacuuauauccucuguuuucaaagaaaauguauugaaugaauaaauucauauagaaaagguauuuaaaauuguuaaguguguucucauaacuaugcugguuaauuaggcuggaaaaucaaauacaugaaauaaucuuucaaauaauuuaaaguaugggaagagaugaguuaacagaauauaaaauuauuuuaaguuaguaaauuuguuuaaauaaaguacuccaguaaaaggaggagacaguuggaaacaacugagaaacccaauaggaugaugauuaaacuuaaaucuaccccaaaucagcaaucuccaaaaaaaccaaaccaagucaagccaaaccaaaccaaaaucaguuaaaggaaugugguaguauauaccuguaauuucaacauuguggaggcugagguaggugggucaugauuuucagauaaacaugggcuacugaguaaaaccccaucuuuaaaaaaguugacuuaagacuagcucaguggugcagugcuugcucaacagguuugagacccaguguucagucucuaaagccauaaaguaguuaaggcagaagucacagauaacaugaaagagcaaagcccaacugugugcugccuuuaagaaacacaucuuacacuagacacgguuugaaguaaaaugacaaaaagaggcacagcaugccaacaguaauaaaaauagagccaaaaugauguaauaccauuacaaaguagauuugugaguauagaauauuacuaacgauagagcagccccucucccucuguguugagguuuauuccugugacgcaaguguacuauguauaugaaagcuaauugucaacccccuagguccuuccuaaggggccaucuacuuugucuuuugagacaggcucuccuauuggccugaaacuagccaaguaguccaggcuuacucauuguugagucccagaaaauugccuuuuuccaccucccuacuguugagauuacaaaugugugccaccuuggcuuucucacccagguccucaugcuuuuguggcaggcaauuuacugaagcauuaguuuccuacugcccugcuccuaauuuuuuuuuuuuuuuuuuuuuaacgaaaugagauaggguuaggguuggccuugaacuaccaagauagcuuuggauuccugauccuuauggguguguugagauuacugaugugagcuacugugcuucauuuaagaaaaccauuucaugauaaaagaaucgacuuaaaaagaagcccaguuaaguauggcgugaagucucaguucagacaggguaauuauagauaaacugucucacaauuuaaaaauuaaggcauuaauuauuaaauugaaaauuaagggguggugcacaccuuuaaucucagcacuugggaagaagaggcaggcagaucucugaauuucagaccagccugaucuacagaaaaaagcaacaaacaaacaaacaaacaaacaaaacaaaaaaauuuaaaaaaccaaauaaaaaauaaaauuaaaaaauuaaauuacgaagaacaaagccauacuucagucaaugguagaagccugcuuagcuggaaaagguuugugauguuuucaggaccuauuaaaaacaaaagcaaagcuucccccauuucuaaccuuuuaugcaucaauaaaagaacuucaaaauucaugcaaacuaaacaauauauaaggacaaacagauccacacucauugucaugacaaugauuucaguauucuuucaauaauuagucagaauaaacccaguaaggguauagaguacuuaacacuauuugccaauuugaucuacuuguauuuuucugguuacacuucagcuaagagcauaauacauacuuucagucuuguccaugcauguggagcauuuaugaagauacaccauauuucaguguugaagcacuguaaaguaaguggaugcaggcuauaucgaguaugcugucugauuauaaguaagcuauaaaugaauacaagaccucaaaucuucaaguauuuggagauuaagcagcauaauuucaaaauaauucacaguucaaagaagacaugaagagggaaaugagaagguuuuuuuuuuuuuuuuuugguugaaggaaaaagugaauacaacacaucagaauuuggaggcugacacugacggagaacuuuauggacauuaaagaugcauuagcagagaagagacuucuaaaaccaucagcaacaacucccauacuaagaaaccaaagaaaaaacaaacaaacaaacaccaccaccaccaccaccaccaaacuagacaaagaagaguaaaccaaagccaaacuaagcauagaggaaaguaauaaugauuggagcagggguucaugaaggagaaaacaguuaaacaacgaaguauuaacccacaaguugguucuuuagagaagauuacuaaaaugcuaaagcuuuagcuaguuagcuagacuagccucgaggugaaucaggaguagagauaagucaagcauuaccaauaacuggaaugaaagugacaucacaacaagcuguacagcuaugaggacaggaagcacaucgggaauaucuuggugccagcuuaaaugagaugugguuugggguuuuauaaaucguaauuagguaacaugaaagcauguaacaauuauacuacauaaaaaaggcagaaaacauuuauguuucaucuauauuuuuaauucccugguuuacgagguugacguagggaauguucuugaauuuuuuagugugcuaaggagccuagaguaccauguagugacagaaacaaagaaguacucagaauacagagggaggagcaugucuuaguaacauaagugccaaccugaaagggcucucaguggcuuaagcuagagcaaugugaacauggaaauaaacauugcaguauuggauuuuaucucagaguauaaaguaaacauacagaguccacauuugguagaugggagaacacagaaacagcucuuccagaaaauuccagagcauguagauuccucuuuguuuggaaaguagagcuuaaugccauuaacuccuaguaggaguuagauuaaaaaaacaaggcuuuaacauuuucagacauuauuauuggugugugugugugugugugugugugugugugugagagagagagagagagagagagagagagagagagagaaagagaaagagagagagauaugagucaugggguccuguguggaggucagaggacuaguuuguagaacuggcucuccuucaacuuuaauguggauucuuggagucagacucaagcugucaggcuuuugcugcaaguucugagcuaccuuacugacccagguuggaguuuuuaaucauuuuuguuuuauuuuaaacccuggcuauucuggaauuugcucuguagagcaggcuggccuccaaacuuagauaucugcaugccucugccuuccaagagcagggauuaaagacaugugcccuacuacuagguuaggauuuguguuuuuaaagcauaaaguauggcaggcuaaaagcaguagccuuacagggagaagcuucgaugauaucaccuuaacaucaugaccaaagcuagcauaacuauuuguagacauaacauguugguaacccguaccucuuaugagguacagaaauggaucuuccacaaacacccaguacauagauggguagcugauuuccgguggcaguccaaaggcaauucagcagagggaaucuuuucugcagugggcuauccauauguaagcagauaaacauuuguugauaaugucuccugcaaaaauuuauaaaacacacuauaucuaaaaguaaaacaaaguuaucgaucagaaaaaaauauaaagaaagccuuugugacuuuggguuaaguaaagguuucuuggaaguuaacaaaauguguguaaagacccagcuucuaaguuggggcgucucagagaaggcggggcuuaggagcucccucaguccuaagcccacauucaaccuauaacaaacaauguaacaacuucaaauguaacaacuucuuaaaccuuguaucauuucaaaccuuuaguucagucaaaucaugacucugcaccucauucuuuucacagauuucauaagaaacaucauuuacucuccugauacacugauaggaaguaaauuacacuuugaucugacaguguucgguguuuguuacagcucucuguuacuuaccaguuuguguauccucuaacuuaggacugcuguugaacggcuuucuugguugguuuguuuguuuuacuuaaaacaagcagggagucucucacacccauauccagucacuugggcagcaaaguaaugcuaucuggucguuugucuuauaagagcuauuguuagaaaaguucugcugcaguccccuuccacaaagguuagacacaaaugguugcauaggauuaaugcaaccagaggcgccccgucuuuccuuuucuguuuauuuagugcugccuuuaucuuuagucuaaacucccauguggguuccuuccuguuaaugaguucauccuaaaacuucaagggggaguuuaggccuagagcuaaguauuuguaauaguguugucccuggacugaaaaacuauaccuagcauaaauaguaacaaaagaaacuggcaauauuaguuaagcagcauauuacagaguagauauuuugcaguaauaaguaauuaugugggguucaguccccaguaaugaaauaaaagagcucacuuuuugagauuuuuauuuggacgcucuaucugaaauagaagccaagccauucugauguacagggagcugaguccucucccuacucuucauccauggugacgucuaaugagccccgagggucuuacauagcauaggcuaaagccagugcuguaaugaaauguuuaaugguguaaaauauguuaaugucuuauuuguuuguuuguuuagagagagagucugccagugguucccaggcuggucuuaaauuccuuggguucaacugguccaagucagccucccaauuggcuagauuacaguggcaugugcugccaacccagcuugaugaaaguuaaaggugauauguuuaguugcuuuacuuuucauaaaagaacuuuuguacuaugugugaaguccauauagagagaaaaggggaugauuucaugguguuacagaguagaaaggcuucgcuucauaggcgacuuuacaucuuggguaggagacacucucauuccucagugacuugggaguuagagucucuugauuguuauuugauauuaguauguaaauuaguauaguaauuuguuuaguuauguuagcuuacauagucuuauguauaaaguguauuagaauaagcucuuuuucuuuugguagcuaagaaagagaaaauagcaguagugaucucugcguuuccgcugcaccuuguauguuccuaguguuucgcuacagaaucacccugcagucuucguggucagagaacucacuguagguccggguuggccuuagacagcaugaacccucuaacucaggcccagagcguugagacgugccugcugaacugaguuuugucagcagaaguucacaguucuggggugaugugggaggaauauuagaauuguuaaaacauuuucccuugcauguaaagucuccuuccucuacuuuuaauuucucuguugagaguaaaacaaaaccauacacaucuggggagauggcuugugagaguaggacuggaagcccaauuaccagaauaagauaaaaagccagguaggcauagaguccccuguaaucccugauuuccaaaggcagagacaaaggauccccuaacuaagcuagucagcuagacuaacugaaacuggggagagacaccggcucaguacaugcaauggugcgugugucugugugccugccugccugccugccugccugccugccugccugacugucucugucuccauguauauggagaaauuaaacaaauagcuuuguaggaacaaguaugaaacaguauuaugaugcuaauuucuuauauuucucauaauguaagaaauuuccauuucccauaaaauuagaggaccuccccacugauccuuugaaagucugagacauuuauauuucacagaaacaacaugguuuugugacucugacagaacgcauuacauuugacacuagacucaaaaacaaaccucuuaguacaaaaccaacacuuuuuaaauacauuuuaaugaaaaauaguuuucuuaauagaaaauaauaaagugcuuucuauggacuugggaaauauauuuguaaaagauguaauuaagcugaagaaauggcucuuuuagaguguucugaguucagauccuagcaacuaaguaaaaauacagguauggccagcacaccuguaucccuggccuauauuggguuaggacagagacaggaaaaucauugggggaccaccuuggguuccacgaaggguccuaucucagaggaaaacugagagucauagagcaggacacccgauguccucaucccaagcucugugcacaggcagccacauacaguguacaccugcccucauuuuaauuguaaugauaauaucuuuuauauucacauacccucuuaaauuucauauauugccgggcgugguggcgaacgccuuuaaucccagcacucgggaggcagaggcaggcagauuucugaguucgaggccagccuggucuacaaagugaguuccaggacagccagggcuauacagagaaacccugucucgggaaaaaaaaaaaaaagaaaaaagaaaaaaaaauuucauauauuuauacaaauauacuuaaccaccuaagguaaaacuaaaaguguauguaggcaaacgucuuaucaacgucuuauuuccuuuguaauuaaaaaaauguaaguauaaacaugaaaucuguacaauuuuuauuccauuaggguucuacuuacagcauucuuccuacagaaaggguuuauuucucuguaagacuuagguagauucacauugcucuaauucccagaaauugcaaacuucuuuagaguuugugggaacugagcuguaauuuccuggcucccuggguaccuuuccugggaguuuggugaagucuuugucuuucugagcuuguauagggaugguggaguuaacuggcuguguauucaggugguaagugcaagcugagcacagggccagaugaauggggaucuuucagugcucugugauuugaaagggauucuagaugaacugcguuucugucuccuaagaugucagaaguaaagguuccucccuucccugugauccuuuugguacuuagagcagguaagguaaacccauugucuuaggguuucuguugcuuuugugaagcaucaugaccauaaaaaacuuggagaggaaaggguuuauguuagcuuagaguuccacgucauaguaguccaucacuggcaauggucagggcaggaacucaaaacagggcgugaaggcagcugugcagaggccaugcuggagugcuguggacuggcuugcccuuaggguuugcucaaccugguuucuuaaagaacacaggaccaucugccuugcuugcuuuaaauagaauuugguaauuagaaaaacugugauuuuugaaguuguuaguuucuuggagcuggaaagauagaucuguuuaagaaugcuagcugcucuuccagaggaccugggcuuaauucccagcacccacauggcagcuccaugugguaacuccagguccagugaaucuaacacauucacacagacacacuuguaggcaaaacaccagugcacauaaaaugaaaaugaaugauuuaaaaauuuuaaaaagaacauguaaguuucucucuguacuguguggcuguaaggaagcagaugugaggucacccugugguugccuuugcucuaguguuccuugcuucauuucugucuccucccauuguccccauuuucuuguaagagaaaacaguccagaaauuguaacagucauacugcaggaaaguucuagaauucuucaccagaguccccugcaugcuacagauucugacaguaagcauugcuuggggugccugcgguugauaggugaaaacaaaggguauauuuugcucuguuuucuucugggguuguguaguucagagaaccaaaggguuuccuuugguugauagacuacugcaggcauuguccuuagcaggcaguccuuuaagaguccaucucugcuaguuuauauucauugauaacgaaaaagccgauuccagucccccuucuucccccaaaaggauuaucaggugacauagggacauuuuuuccugggcugucuuuuggcauuaccuguuuucuagaaguccaucuucuuguuccagaccccuucccgcuuaccacugucuuauguuauccuaccaucccuuaucauggaggcuuauagaugcuuuggccuuuucuguuucaguuugauuuaaauacgaguuaaagugacuuuguaauuaaacuugucuaugaggguuuauuuggcaaucagauugccucuauggugacuggauuucaguucucuguguagcaucucguucucaccaggaagccguucugguaagggugguagugugggccuuuuaucccagcaccauggaggccaaagcagagaauuauggcuucaggguauaaggagacccuugucucagcuccccccauccccaaauaaacaccaaacagaaaaaucagauccacuccuacccacuuugcuuaagacagggucuuaacucuguagcccaggcuggcccaggacuuguuuugugguccacacuaaccuuguacuuggaaacuuccugccucuuccucccaaacugaaggagggcuugugucacugugaucagcuauaauacuuaaaaaaggacaaccugggcacaacaccagggaaccccagaagaacaaagcaaagcaaacacacacuuuguuuucuacuugaggaacauauuuuuaguagcugguaauacucugaagguauuuuuuuuucagaguuucuguuaugaaagcuaaaaauaaaugagaaugagcuuuaaagaacagagcaagaccucugaccccauuguugucuugcuuugggaaaguuagcauaagacuguaaugccuuuugguuuagcauagucaguagcuauaauaacagucuuuacaaguuaaauuaauacgaauaucuguuuuuguuuucccuuuguuacagguuuccccucaaaaaaccuauaagguaaguuguucaguugcuuucauacggaaguuggaguuaaacuuuaauuagaagcauucuuuuaaaauuauggggauuuuugugguuuuugagaguguggauuuaaguaguacaaacuuuuauaaugcuucacagauuucagauacaacagguguugcauauuuuuuucuggaacacagccuuguuuugauaauauuuucaguguuuuuaauguaagcauuuaaaaaguuuauccaaauugacacuuuaaggucacucccuaugaagaaauuuaauuuuaaaaucuggcuguuuugaauuguggguugcuuggggaggugcagauggauugucaguuuggguuguguugucacaugacugccugcugucaccuuuaaaugaacuuugugccgauuuagucuuaguuauuuuaagacaauaagggaaaaaaguauagaaaguauuuagguuuuugugcuucugucugucacacacaguuugagagucccuaacacuccugucuuuuuuuuuuuuuguuuuuugagacaggguuucuuuguagccccggcuguccuggaacucacuuuguagaccaggcuggccuugaacucagaaauccgccugccucugccucccaagugcugggauuaaaggcguugcaccaccaugcccaguuuccugucuuaauauguuuucuucucucuccuuaauugucauaacuauuaucuagaacgcugaggucccauucccaguaacccuaacuuuucaauuagcuggaagucauguaucauagcgucaucuuuuucaguuguccaaccauuaucuggugcuuauaguugauuaaaucauaguaaaaaacaauaauucugguauuauuuugggcccagagguggcuggcuagggcuucaacccuaggaaggcaagccuugccuguguagguuugcuuuuauaacuuguuuuuucauguuuuauuucuguagugauuucaguuugacugugguguauguaaugucagggaguguguugaauucuuuggggcacuguuuucuuguuguuagauggaacuuuaaaauaaguaaauuauaggcaguuguuuuaaggauaaaauuaaccuuaauauuaguaaguuuuacuacuugaggcccuuuuauaaccaagaacauagacuauaguauguauggcaaaaguugaauuuuaaaacucuuugaaaaaaauacaggcuuaugcuauggaagagaaacuuauuuacuuuuuuuuuuuguuuuuguuuuugucccuuugguuccuugagagauggcucaguuguuaagagugcuugcugcucuugcagaggagcaguuuguucucuaucaugcacauuuaggcagcucacagucuccuguaccaccaagugcaaggggcuuuauaacugaagguuauaacagccuucguggguaccugcacacaugggugcauacaugggugcucgcguacacacacacacacacacacacacacacacacacacacacacacacgucacuguaaacagguuccuuuguguaauuuuuauccgagguuuuacuguuaugcuuuucuaauaguaaauauuugauuguuuuaacuuaggcauggaaguauuuugaaccgagagucaccaacagauaagaaacagaaaguugaacgcaguucaucgcaugauuuugaccccacagguaaaauucucuuguucuuucaaagaauguuuuucagauagugacguucagagucauagaacuuauguggauugaggcacucaggcaugguuauuccuacucucgcauacucugcaguuguguaguagugcuggagucagcaggaaugagugcauacuuaacacagcauuguagaugccacagugaagcaucacuguaggacuugugauaguuggagaaauagagauguccugauuggagauugaggguacaccgaggucucaaaaucaagacgaaucguggugcaaguacuagugugucauuaaaugaaggauauugaccacugggaacuucugcauucacuuaaaacucagcugugauuguugugaagugacuaacugcagugcaacuuaaaacauuuaugcuaacugcauuugaauaaacaaacgaauguaaaugcacuuucaucuucucugcccaccuuccuuucucucucucucucucucucucucucccucccucccucccucccucccucccuuccuuccuuccuuccuuccuuccuuccuucuaaaguggggacuggacagagucuuccuuuguaacucagacuggucuccugcugcagccucucaagugcugggauuguaggccugugccauagugcuuagcagagacccugccuuucuucaaguacucaggcugauacaauguauauccuuuauuuuguugugguuuuuguuuuuuguuuuuguuuuuuccgagacaggguuucucuguguagcccuggcuguccuggaacucacucuguagaccaggcuggccuugaacucagaaaucugccugccucugccucccaaguacugggauuaaagacguauaccaccacugcucgacacaauuuauauauuuuuaaaaagauuuuauuuaaguaaguaugcuguagcugucuuuagacacaccagaagagggugucagaucucauuacagaugguugugagccaccauaugguugcugggauuugaacucaggacgccuggaagagcagucagugcucuuaaccacugagccauuucgugagaccacaauuugugcacacgauugaauucugcugcccuuuccuuuccccauguaaucucaguauuugcuuuguagauagugcuuaauaguuuuuuauuagauauuuacauauguucuuugagcaaguauuauuuuguuuaguuauguguuccugugacaaaagauaaacaacaccccaaucugagauagacaacuaugccucuuaaagacauuuuuacuuagaaauguaauuuaaaauauuuaauagaauauuuuuguaugaauuauugaaauauuucauacuuuuagaauaguuuucuuaauuuuaaacaaguauuguaaguauuuaagaagggaaaacuaggauguaauacuuugcuuugcaucuugugucaugguaaagaaauuaauaguuaguuuagaugacuuugguggugugggagccguaacaugucacaggucuccauggagagagaacgcugcacuugugauacccaggauccaggucaugggccagaggcuuuuaguuauuucuauagcuacuuauugucuauaauaauggccaccaguuucacugccauagucucuuuagucuugauagauguguucuguccgcuugccuaugaagugccauuuccacagagaccgcacccuucucaggaaccugggugcagcucucagugcuguuuccaucacuauaguuaucagaugauacacgguguagaccauucaccuguuauuuuuaauugcacucuuuucuuccauaaucuguaaauaugucauucauuaccucugcuguucaugacuguucuaaguguugucaccugugauguucauacuucauguuugcacgauuuaacuugaucaugacucguucuuuuauccccaugaaauuucccccuuacauuggucuccauauuuucuauaucucuccuuuucucccgcucuuguacagauagcuccuccaagaagacaaagucuaguucagaggagaguagauccgagaucuaugguaagcugauguagcuaaugcggccuugcacuucugcagcuugcuucaugcuaucucguuguguuuuugguaacugcagccuuucuugucugcucugcauggcaugaucuccugcagggaaagggagccuggggucccauguggcugugauauggaagcuuaagaugacuagaaacuaacaugguaggcugagaauaggcugcacuaccuauuuccuccuuguuuaucuuaggaaaguggggucaggcucccugaauagcagcgaugggcuuugaauuauuggcugccucucuggucucauccucaggcuuugaguuaaguagaauuuaagcagcucagccauuuccuauucuuauaggaaaugauaucauuucugcauguuagcaguucuuugaaguuucuuguuuuaucuuuuauuuauuaauuuuugguugguuuaucaccuguaaaagucauucuuauaaaauguaucccuaauugcaaaauuuuuuaaguguuuuauuuugaggcuuaaaacauuugugccuucuggaaguuucacugagacuuacuccaaauaggaaaauuucaaaauaccuuuaaaaauaaucuccauaaacaguugguuuaaccugaaugaugagcuguucuagcacauggugaaaauggaguauuuccagacucuccuggaauaugacagacuuuaugacauucauagagcuuugccuuuugguuuuuuucaagcuuuuuggggcaugguuuuacugugcagcuccagacuguccuggacacauuguguaguucagcugaccucagacaugcaguauccuccugccucugcuuccugagugcugggauagcuugccugcccuagcuuacuaaggcgagugaggaaggaggugaggcauugucuguagccagacuaaaagcuuccacugaagacagccgauggggucuucucuaauagagcaagguccaucggaugggaguuuacucaaaugggucuggacuuccauaugaggcccuauaugaggaggaaagugcauggaaugaaugguccauaccuccugagagccuuuggaaauugaugcccgcugaaaggacugaguaccacgaagccuuagugcuugguucugagcaguuuugcuugcguugggcacaugcucaugugcuucucucugcugcguagucaaaaggagauguuugccaggcuugugacuccccaaguuuauacuuuucuuuccuccaaaguaguguucaauaggcuguguuucuguaaguaaggugccuccugucuuuuuuuuugcugaggaaugugaacauuaucugugcaucuccauccuuccuagcagccauuucaguucaccuuguucaccgcuuuucuagauuuugcuguguguaggagcuuguucauguuggauauggauuaaugaucuaggaaucugacagaaaauacuguacuaauauuuuucuuagaacagggagcuuuauacucguccagacauagcuugguagcgacagaagcaucuaagugugcucagggagcaggccugcuucucaguguaucuguccagugagaacccuugaaacaccuuuuuugguugguuguuguuggaggacuugaauuaggaguucccaguaagcacucuguagagggcuaaguaugacagcuagcgugccucucucauugcgaaugugcuuguggaaagcacguuagacugcagucagcuuaggugaagaguaugcucuggggagccaagggacauuuggagaugguaccugacugaguagaguccuagcaaccagggacugcugcucggcaaggguuuguuaacagcccauuuggccuguggacggaggacauucucuuaucuugauaaaguucuuuaguugagugcacaguacagacgucauucaaauaaucucacuuauuuugccguucuuagaguugcuuugaggguuagacugacugugguuguuugaagaggaaagugaaaggguugcuuccuugcacaaguugucggcguagccugggcaacguucuauuuguccccugugcuuuaugggcauauuuucugaacuguagcuuuagugugcucaguuuccuguugcauuagguuuuuuuggagacagguacacauauauauccauuccuaucuggccuugaguuccugaucucugccucuaccucgugaguguggggcuugcaaguauaccccaucaugccugggguuguuauugugagacagagucuugguaugugacgcuggcuggcuuugaauucaguuuguaguccaggauguccuuaaacucaacacagcucuucugugucaacuuccugagugcugggaugacugucauaucucuaauccuguacugaagaacuguuacuguaggguaugagggaaucuguaagaauaagccaugucccuuaaaagccaucauagaccacaugugcugccauagcgaaugccuggaccuguguggcuagaggacagaaguguuauuuucugaggguucuagaagcuggaugucugauauauucaggggaggcuggugagguugcagauggcugccuucuuccucuccuucacauagacuuucuugggaugggggauaaggaggcagggggaaaggggagggagggagggagagagggagggagggagggagggagggagggagggagggagggagggagggagggagggaaagagacugacuucuguuuuugucaugagagucucacccucaucucacuucagacgccugccuccagauagcaucacguuaggaguuagggcaacaacguacagauuuugaggggauaugaacauuuagaccauacuagaggcaaacuguuaacaucaguaucccuucucugaaauccuugagaccagauguguuuuuggguuuuuaaauacuagaauaggggcuggagaaauggcucagcuguugguuugacucuugcucccaccagcuuccuguccucuguguccuccagcuuugugaagaacauugugcaugaacuguucauguucucauaacucuuuucucuucuuacuuuuaagucuggcuucugaacucacagucuuaaggugaccccagauauccugcuugagagccuguugcugucgguguacacuuccugaaccacucaggcagugcugauggcuuuucuugucuucuguaacacuucuuugaucugauuuuuuuuccuccugguuuuuggguugccuguuuauuugauugucaguucacuuuaacccuacagguuuccagguuucuaugugugugcauguguguuugugcccauuaugcugugugugugcaugcguguuuaugucugugcacuugugugugugucuguguguguacgugcucaugcuccugugugugcacacguggauguuggguguugucuuugcuugguuuuuggucucagugagccuggagcucaccgacucagccuuaugggucguccugacuuccccugcacuggggucaaugauaugcaccauagugcugggcgcaggugaaguuggugcuagggaucagagguccucauguuugcauugcaagcacuuuaucaaauaagcucucuugacagccuauuuuuguuuuuugagaaauagucuuucuauguagcucaggcuggccuagaauauauaguuuuccugucucugagucuagugaugggaaaauaagcaagcaucaauaagcuugcuucucccucucucgcucccucccucccugccucccucccucccucucccucacucccugccucccucacucccucccccucccucucucccucucucccugccuccuucccucccucacuaccccccucccucuguccauuuucuuacagaggggcuuguguaggcugccuuugaacucucaggguagcuaaggaugaugcuccauuccuagcccuuuucacuguguuuccauucucccuucuguggcuccagccccgcuuucuucuuuagugcucaccacgucauuacacuauuuuaauagacucauagcuuugucuuuuuauuuuuuuaaauuuuguuuuguuucaaaacaggguuucucuguguagcccuggcuguccugaaacucacucuguagaccaggcuguccuugaacucagaucugccugccucugcuucccaagugcugggauuaaagggaucucccaacacauacagucauagagucauaacuuuguaucacuuuaguuuuauguugauucaccuccuuuucucuauucuccuauagucuguuuuuauuugucagauuaauauuacuaaaauaauggcugugcuuauucgcuugcuagcaaagcacaaauaguuacggaaacauacugugcuuuauuuguagcuugucauccugccccgucuucugcccuccucagaguaccaggcucucuccuugcucacuucaugucgccuugagugcuuaaguuuuccuucugcacuuuccaguuuuguuugucuucuaagacucaguucaggcacugagacaucauguuaauacaaggaguaaguucuagauagcuguugucccucaugccuuaggaagacguguuauucuuuaucugcaagacgaguagauuaagaacuauuaacagaacaauaacuaugugaaggaaaauuuugauuaauuaguuacauuuagccauucugcauuauuuguguacuucagaaccauagacagaaaauaacauacaguuuugucaauuaaaaaguauuccuucacauugcuuuuuuggguugcccagcugagguuguuguuucugaacuuuggcaucugacucugugugcuugaaaccccaugaugccaugcucucuggaagugaguuuugaaugaaugauuguugaaaucaagaugauguauuuuaguagagagaauugauggaauaaaaucuugacucaucuuaauuggcucuucccuuccaaaagacuauagagaagaaaauggaacuuagaaaggggauucgauccuggugggcaucuaaaagaaugaagucaguguacguggagcuugagguuccaauguuggcagccuugugcauucagagugcagagcuucuuaaucaaaggauuaucucaggccuuacucauaaaacacgugugucuggcagcaguuuaaaaccgagcugcuuuuauuagguugcacaugguucucuccacacccuucccugcagcuaauucuuaagaggugagacuuagagaaguuuggucaugcaauaaaauaaaaggugaagaaagacuaauguaugcuuuuuaaagcaaauggaguauagaaggcuuagcauauugccuuacacauuuaacacuucauuuucuuuaaauuuacuaucuggcucuguagguauaguccuuuucaggaauauauuuauaguaaaacucgagaaaaccuucucaacaguuuucagaccucuuacugcuacuucuuuuucccugaagagcauuauuuuuuuucaacuuucaaaaugcucucacugguagucacauguugagggagacaguguccuaggugggcauggcagugugcucuggcagucccagcacaggggggccacagaaagugaggacacggcugucuuccugggccacccggcaagucagaacaugauagacagaaaauaacacacaguuuugucuuaaauuaagcaagcaaacaaaaagcccucccuuccucccucccucccuuccucccucccucccuuccucccucccuuccucccucccuuccucccucccuccuuuucucacucccucccuccccccucucuuccuuuccuuuuuuuguaucugcaucauuauguuggaaauccauguucuuuguuauugugacagaaugcaacuuaggaaaggaacacacacacacacacacacacacacacacacacacacacacauauauauauauauauauauauauguauuucauugggagaauaagccauacacacacacacacacacacacacacacacacacacuucauugggagaauaagccucauaccagcugaucagcuuugagaggaaguuucaggacaggaaaugagaaaaacuuggugaguagaggucuuacuuaguuagggacagauagggaacuaaauuguuauuguuggaauuuugccaggcauaucauucauuaauaugcccuuaaguuguuuuucuacugugaauauucuucagggcuaugauuuuucuuacuaaaaaugguugagugguauuuaaauuuccucuguggaaaauaaauucagacuuaauuuuuuuuuuauuacucguuuuuucccuaagacuugucuuuauuuuguuugugucugugugaguguauauacacauaagugagggcacucacaggggccagaagagaguauuggacuccuugaaaauguaauuaugccgggcagugguggcacacacauuuaaucccagaacuugggaggcagaggcagguggauuucugaguucaaggccagccuggucuacagagugaguuccaggacagccaggacuacacagagaaacccugucucgaaaaaacaaaaaacaaaacaaaacaaaaacaaacaaacaaaaaaaaaaacgaaagaaagaaagaaaguaaguaaguaauuaugugggguugugauagaggugcugggacucaaacucugcucuucgugauuggauaacaaggaugcuuuaccucuaagccaucucuucagccccauagcaaauuaaaaauguguguguguguguguguguguguagucacaguaugggugugaugguuggucagaggacagcuccuaggagcuaguucuucuaccagguggguuccagggauugaauucaaaucgucaaucuugaaguaugcaguuuuaucugcugagccuuccuuuugacccuauuuuuauuuuuauuuauuuuuuguuuuguuuguuuguuuguuuugaagacaagaucuccacacuuuguaacucaaucuggccuugaacuugcaauccuucuguccagcuccuugaauucuagcauuaucugguauaccagauguccaacuuaaauucagauaagaaaaauaaucuaaauuuauuuuaaagauagauguucucauuaaaaaaaaaacacaccuagauuuauuuagugccauggucaccuguuguaugcagacauaaugcaaaggaguacaaagauaggagagugugcuugguuuccagcuaucugcaggcuaggacagaaagaugcauugcagcacuuuuugauaaguauauauagagagauuuauacuuaccagcuguccaauccaaauggauugcuauggggaaagacgaaacaaaacaacccuuuauauaauaauggagaacaaggggagagagagacagugcuaugcuggcuuuaaucaagggcugcaaucaggguuucgcuuuaguacuuuuucccuuguugaacaucugccuguccucauagaaaaugcuagacuauagcucuuaaccuaagagagagcgaccuuauaaacucacucagaguuuguaugauaguugcuuagaaacuucauaguaagauuuaacagcaaaacaaaggauggacuguaugugguagaaaccagaagacuuagugaugagugauagaguuggugguuuggggcuuuuguuuguuuguuuuaauuuauaauuguuguucagacaauaucucauguaguccucacuggccucagauucauucuguagcugggccuggguugacacuccugaucuuccugcucccuacaccucucuagugccagguuuauagccuuuaucaucacacaugaccgaaaauagcuguuuuggaguuaggaugcuguuuuuauuuugcacccucuaacuagugugugacccccugguaccuugucauauaccugcauuguuuucgucuuauuucaguguccuuccugcugagucugagcuguugagcacagcagcuccugguacuucaaugucuuucacaggcaccuaugugcuagugcuucguaauaguagacagaucucaggaaaacugcugcuacaguuggggguugggagugggggggucuuaguuaccauucuauuguugugagaagaugccacgaucaaggcaaacucagugcagggcuauucauggugggagcguggcagccaggaggcaaaguaucugagagcucacaacuuuaccuucaacccugaaggggaugggagagagagagagagagagagagagagagagagagagagaaggaggaggggggaggggggagggggagggaaggggggggagggacacacacacacacacacacacccccaacgacccugagaauggccugauucuuuugaaaccucagagcucucucucucagugauacccaaaaacccaaacaaaagugugucagguagaaucacuucaacagaaggaagcagacuuugcguuuccugcagaaccuugcacaugggaccuuagccaucuuuaagugcacagugggugggcacuuugauguuuuuccugucucuaccuuccuuucugagugucuguccuuuuugagcuucuauccaucuggagacguuuuggaauuuuauuaauuauuuaaucaaauuuuaaagaauuuauucuugcaccaaguagacuuuuggccaguucugaguaaggagaaccagguguccuucccugcccugggagcauggaacagugaggacccggaaacaaacccaggucccugugcagcaccaaugcgcuuuaggagggagcagagggugacuaucuguaaugggagugggaaaaagcuuccaggcagggcaaugaaggaacuuuuuuuggggggggggggcuuccuguugucucauuuucuaaaacugccuguauaauaagaagcccugauccuuggcaguuuuccucucucuuaccuauuaaaaguuaauagccauguuuaaacaaacgguagcacacaccugaaaucccagugcucuggauauaaaggccgaaggaucaggaguucacuucacuggacacaaaaacauaaaggaguucccccuugaggaucuguuacauuaacaucaggaguaaauuagcauacuuguaagcugaggaggcagaggcaggagaacccuugggccuccaggucagcgggucagcugagugguuagcucuggguucagugagagacuaucccaaagaguaaugcggagagcuguugaagaaaauaccugggguuuuucagauguuguaagacuguguguaaaauggggaaacgguugauuuuuauuuuaaagucacaauaccaauuuugaaaauuugagaacuguugaggagaccacagauauuuauuuaucuaaaaacaagcaugagggucagagaauuccuaugaaaugcugccuacuccuuuucuauaucauuuuagauuuauuuuaugugugugaguguuuucccugcauguguaacacauaugugccucauguccaccagggaucauaagagaucauagagccccugaaccauaauuagguaugguuuggaccaccacaugggugcugggaacuaaacucaguugcaaaagcaggugagaaagacugagcccauccucuucccuaacaacucagaaugaccgucugccuuagcuucugguuauuagaggggccgccacaucccacuugcccuccuuuuuugggcauuacugggagcaggaauuaaguaaggucuugcuauauauuccaggauggcucugagcuugcucaucuuccugucacaaccucuugauuugcaacaacaugggagcuggagagauggcucagugguuaagagaaccugcugcucuucuagcagacccagguucgauucccacacucucacaugccaguucagugaccaccuucgagguuuucuggccucugcaggcacuaggcaugcuugaguuacacagacacacauacaugcgcaggcaaaacacuccuagacauuugguugaauucugaugguuuuuguuuguuuguuuuuguuuuguuuuguuuucugcccuguuacaauuuaguauuuuguauggcuggugaguuuaugggaaaaaaaagauuguugacuacuuaggagugaagagaauugaaagauuauaacauuucuuaaugcugaaagcucauuuuguugagguauuauuacaaaaauaagacuucacucuuuaaacuaugugguuugaagcaguuugacaacugaauauccuuauguaaccauuguguuaauuuaaacucagaucauuugcaucacucagaaagauccuguuucucuguugcuguucccaucccugccuuucucaggugauaguucaucugcuucuugaugcuguggccgagccucucuuacucuuucuucccugaguuguagcuuguggacuccuguauuuagcaugauauuuuugcuguccauucauguuuucuguaugugugaaaguauucuucccccaccccuucucccaagauaacauuucucauuauaugacuauaucacuacuucucuuuucaucuguugaugggcauuugagguuuuucuuauguaagugccuuccuacauuuauagaaguuuccacauuguuuucccaagacuuaguacacuccaccaacaauguugagaauucuagucgccccucaucuuugcugauacuuggugugcucagucuuuucauuuuuagcaauucagauugcuguauaguaguuccauucuaguuugaacucagacuuugaugagugaugcaauuguuaaguacguaccuuugcaugugccuuuuagccauuuucuauguucacuuaaauauucuuucuaauaugccuuucauugaaauagauuuuuaagaagaaauauuuauuuuuagaaaauuuauuuuuauguugugcaaaucaaguucuuugccuggaugcauauauguguaccacauuuauuccugguguucuuggaggccagaagagggugucugaucaucuggaacuggaauuacaggaggcugugagcugccaggugggugcugggaacagaacccaggucuucugcaagaauagcuagugcuccagacugcugagcgauuucuguagcuccuggagcugcuuuuaaagaauuaucuggaugcagaguuuuaacuaaauuguauacuccaguuucuuuuucuuucuuucuuuuuuuuuuaaagauuuauuuauuuauuauauguaagacacuguagcugucuucacacacuccagaagagggcaucagauuucaauauggaugguugugagccaccaugugguugcugggauuugaacucaggaccuuuagaagagcagucauugcucuuaacuucugagccaucucuccugccccuuacaguuucuuuagaauuuuuuucuuucugucuuauaaaguauuugcuuacccccucaggcagugauuuuuaacauguggguuauagcucccacagagguugcauaucagauauccugaauaucagauauuugcauuaugauuuacgaauucauaacagcagcaaaauugcacuuauaaaauagcaaugaaaauaauauucugguuggggguccccaggacaggaggaacuuuauaaagggucucagcaucaggaagguugagacugacuguccucaggucuugacauuuuucuaugccuucuaaauauuuuuuaggcguuuguuuuguuuuguuuuauuuugacacaggguuucucuguguagccuuggcucuccugggacucacucuguauaccagccuggccuugaacucagagaucugcugccucugcuucuugagggcugggauuaaaggugugugccaccacugcccauaauuuuaguuuuuaaaaacaguuuuuuaaacuuuaaaggcuugagacucccuauguagaccaggcuagccuugaccucauuagacuuuccugcuucuguguccggacagucaggaguaaaggugggugccaccauggucuuaauuuagaccuuuggccuguuuuugugaugaccccacccgauuccuggcaagugcuggagcucaagcccagggauuuguaccgguagggaaagcagucucagccggcagaguguuuuaaaguucguuuuguguaggguacaugcacagacucaugcuuucuauguggagauuugguuucuccacuauuuagauuacguauacaagcacgcugucaucagaagcauauagagacgagaauguaacuucccacauccuucaugcuuuggaagcuuuguuuucuaaccaccauuaccuucuguuauuuuacauucccacccuuuggcuuucgaugagcugcugugucuguaaagcugaaagcacccacugggucucugcagacucaggucagggucuucagguccgucucuagcaagaggaugaaugaggcucugcucugggacauuacucuuuuauuuuugaguuccucuuucucucuuuuuaaaguauuuuucuucuguauauauguguaugucuggauaaguguaugucacauaugugugcaggccagaagaggguguuagauucccuggagcugcgguuauaggcauugugaacuuccugacaguagaggacagccauaagcacuauuaccugcccagccgguucucuagcccgcagggcuccccuuucucuuaucucccugcuuagcuuaguuaacauucguuguuuagauagaaugaauuagcugagugggugcuggagaggaauaguugagcucacaugcucacuugcuucugcuucucuccccuucgugaguagaacucucucucuauucuucccccuggaugcauguguucugugcauaccuccugccuuuggacagccucuuuuccugaguauauucuucugagauuaacauuggauuucucuggauuucccauaugcugucucuaaccaaaagccuauaauauuugauuuucuuagguuaaguaccaguuaaaccauauaguuacggggaggauuuuauaucauaauuaauggcauagcugagaacuggcuuuccuuuuaauugucuuaucucucaaauuuguucucucaaauccucucaaguuuguuguagcugucugcaauagucuacucugcuccaugagacacugguacccacggugcuuugugauauuauuauauuuguuuuauggaacuaguguucauaggggcuucaugaguuaccuuuuaguuuucuagacagaagacaguugaucgucauaaucguucuuuccuucuguuuuccuccuuccuuuacucugugguuguucugcaggucuuguucagcgcugugugaucauccagaaagacgacaauggcuucgggcugacagucaguggagacaauccggucuucguacaaucugucaaagaaggcaaggcauuuaaaaaguuuuguugcuaggcauaguugcacaugccuuuaaucucugcacucggaaggcagaggcauggggaucuccaaucucugaauuuucucccagccucguuuacauagugaguuccaggcuaccugaggcuacauagugagacccugucuuaaaaacaaaaccgcgccgggcgugguggugcaugccuuuaaucccagcacuugggaggcagaggcaggcggauuucugaguucgaggccagccuggucuacagagugaguuccaggacagccagggcuacacagagaaacccugucucgaaaaacaaaaacaaaaccaaaaaaaccaaaaaacaaaaaaaccaaaaccaguuuugucucugagaagcaaguagaguaagcaugacaaagcugacaugacgguccuugcuuagauagaauuauacagacugcaugauguggacccuugugcuaugucugucuaugggguuccaaaauuaauuugccgcaggugacuuucucuauagaaaguaaacaguucauuuauagcuaucgaaacuacacgguuucuggguguuuuccaugcuaucacuuaacagacauuucuucaauuugauuucuuuguagaauuaaagugauguuuuaauagagauagauuaaagagauaaggacccuugucccaaacgacuaucauaucuuuugcuauuaucauacaauggauucuuuuuugggggguucuguaauuucagguagauaauauuauauuaaaggagauaacacuuuagagaugugauugagucuucagcuaaaaaaaucauauaucaagucugacucacacuacaguggggagaagaagcaggauuugaacccaggucugccauacuuuauagccuguguuguagcuguguuauauuacuucucuuuaaagaagauuaccagcgaaucacaugcuaagcaguucguuucuuacacagauggagcagccaugcgugcuggaguacaaacaggugaucgaaucaucaagguaaagcagucggugucgugggaguccugugggcugcagcgccugccucggcuguaggccucuuuccaccugguucuuuagaaaaagcagcucccugccuuucauacaagcuuucuccauuuguuucaaaguucacauuaacccuuacugaaaggcacaauaaaggcuuguuuaaauggagucaccuuuguucuugaguaggaaagaaacucauuuuuaaaaacucauuucugcauaaauuaacguauuagcaaggagcagucacacagcuaggacugugcuggugaguugucacuugcagguugauuauuguugcagaugaacuuuuaaagaagcugauacagagucccuaguauuugucaggcuccgaguuugauauccauuaccaggaaaacaacaaagaguaaaaaaccaaacgacaaguagcugaggaaagaaguguugugugugaggggaggugacggagguuaguuuuaacugaguuaaacugaguuaguuucaguggagaccagaaacaggccuugaggacuugggguuugagauaagguuucauguaccccaggcugggcagaaauuucugauuuuccugccuacaaaguauugguauuacaggugcucaucaccaugugcaauuuggaugguccuggggagcaagcccugggcuucaugccugauagccaagcgcucucccacugagcuccuucuccagcccaagcccugugaacucugauuguuagaaggaguacauuucccaggaauuucuguugaaacuguugaauaauuugauuaccuaaaaguaauuauauagguaaagagaauauucuugaaaguauuuaaaagaauuaagagcaugauacucuuuauuguaaagaacacugugugugugugguauauacauacaggucuguauguugcagguauguauauauguacaugcgugaagaccaaaggcguucucuaucagugccugccccauuaucugaccaaaucucucacuugcuguccacugugccccuacccucuccgcuaggcuugcagucaugaagccccagcaauccuccuuuuuuaccuccuguccuccucucugaacuccuccaaacuauaccuggugccaggacacaggccugggaagccacgccaggcuuuucuucauugauggcggaucaagacuugugcagcaagcacucuuacccacugugccaucuucccagcccaagagcacuguuuaguuacaagaaaaaaaaaaaauuaaauuaaauggcuugguggggcacugggaaaguaggcaggaggagcaucuacagauuugaggaggccagccugaucuacauaguaggucccagaacuacaggcccugucugaaaauacaacaaaaauuaagugaauaaauuauuacaaaaaaauaguaauucuuauagaaaaauuagcaaauaauuucaucagaaaauucuucagaguaauugaaguaacuaaauuacucauggguauauggucagugucauugaugacaaugaaauagaaauuaaaaugggacgugaaaaaugcguuuccuugucaggaagugugaugcuugaagauucagaccugacauaaaauagaugcaguagaauggcuuccuucguuggcuucagcaucaguuaugaaaaaccuguugauuagaaauuguaagccaggcauggugacgcacgccuuccuuuaaucccagcacucgggaggcagaggcagguggauuucugaguucaaggccagccugguuuacaaagugaguuccaggacagccagagcuauauagagaaacccuaucucgaaaaaccaaaaaaaaaaaaaaaagaaauuguaaauauugauggcucagcggguaagagcacugacugcucuucugaagguccugaguucaaaucccagcaaccacaugguggcucacaaccacccauaaugagaucugacccccucuucuggugcgucggaagucagcuacagugugcuuauguauaauaauaaauaaaucuuugggccagagcaaacagggacugagcaagcgggguugaccagaucaagcagaguuccuaaaaauucaauucccaacaaccacaugaaggcucacaaccaucuguacagcuacaguguacucauauauaaaauaaauuaauuaauuaaaaaaauuguaaauauguauuaaaguuuuuuaucuaaggaaauaacguguacagaugcaccacaugagauuugucagacacugaaaacucauaaucuaucaucuaagugugcaugaacugaggauagagcaaaagcccugucucuuuaagagagacuggauuaaagcagcagaaugccucccugugaucccagcacucaggacagucagggagagucaggagcucacggccaucuguauaauaagacugugucaaagaauaccaguuagaaaggcuggagucauuggguucacuggugucuauugagagauggcaguaugauaaaaagaaagcaguuacugucugucacccauguuugcauugaaaauauugaaaauguuaaaugucaaaguuaacagcaacaacucugagagaccugaagcauacugcuguauuuuuuuccuuguguguauugugcauauguuguauaugugugugugcaugagcacauguguacacauguauguucagccaagagagccacucaggugcuguuccuuuggugcuguuagccugauuuugagacaggcuuuuguuggucggcuugcuuauuacacugagcuggcuagccugugguccagggcucauccugucccugcuuccccagcaguuggacugaccguaagugccugcagcagccuggcauuuucauguggguucuggggacccagcucagguccucaugcuugcuuggcacagcaggcacuuuauggacagagaucuccccacagcucccuacucauggaguucaacuguaaguugggguuaaaaaguugcaugagaaaaaguauaaaauuaaugugaaaucuguugauuauguugcaguuaucaauguucgacucuuuuacauugcaguaugucauugucaucuauaaauagauugggcuugucuucucagcuauccuaggaugcuguagccaaguggccacggguuagauauaccaccuuuaaaugaaggucuuguuuuguguuuaaguucauuuuguugcugaauauauaguggaaaagugaauuuuggaccaaguguuuauuauaauuaauacacaguacauccugaagucacucugugucuguuguuuuauuugaugcauauuguuuaaauuuucuuacaggugaaugguacucuggugacucauucaaaucaucuggagguggugaaacuaaucagauguaggugaauguuauuuuuuaaauuguuuucucaaaccauuaaaaaagggucaccaagcauuuuucuguaacuggccaaauaccaaguauuuuaggcuuugugaacuacauaguuacuacugcagcuuguuacugucccacaaaagcauauguggacaauauacaaaugaguggauauggcuuaguuccaauaaaacauuauuuggcaaaacggucugugaucuagcccuguagcuugguguuuuccaugcccccaaccccacuggaaggucuaagguaaaaauuuacuaguuauuuugugucagcucccagcuuuaguacaucuguuugaaaguauauaaauccugacaaucaagcagcuugagaaucugauacaguguccugagaagaacuuuagaaauccuguagugcagucgcuugaccuuagaucaguaaaugguugugacauccagccgaucuuuuggagaagcacagggcucuggauuuacagcauucaggucuguacauuacaacaguagggcuggaaguggguggugcucuucuaagcugacagcaagguagggguuggccaaguuccaguaccagcagggccucaguuucucuauuuuuacagguucaugagaggauucagugguuuugugaguuucccuucuguuggugauagugguggguauuugggauauugggauucagugagguccugaaguccuccucccccacccugcuauggucuguuguuacuuucuagcuccacccacucuggaaaagaagcugugcguuugugaugacuugacucuuugcauggaugguagcaugacaguucuccagaagcagagaaaggcauguuuaugucucaucauauaaacagcucugcucucuguucuggccaggcguggguguuagguguuugucauguuuuuaaagaaauauaaaagugcaaagagaaagcugaaaauaaauggcauguagcagaaaaggaaugugugauugugucaggccauuucauaguaaguacagucuaaaaaaggagagcuauuucuagccaagcagaaucacuuacugagcagacagacuuuauauagucaguguggcucugcugugcagguuagguuagacuuaccuaguacaccuugcauaaucuaagugcgugugagcuugagaccugccucagcgcugagugaugacaguuacguguguguuacaugccaugucugccucaauaaacuaaguuccuuuaaggccuuuuuugagggaugaggauuggaguagggguucaaacugaguuguauguagccuaggguagccuugaaccuauuguacagcuaaggcuggccuugacauuuugauacuauugucuuuaucugccuagugcugauauuauaagcauaaaccucauaccugacuuauuuagucccaggauuguaacccaaggcaucacacaugauagacaagcacucuaccgacauaacuauaccccagccucagugaugaccuuuuuaaaaagcuguauccuaguucuuucauugccuccucauugcucauguaauccugguuacuuauggccuacuuuuuaaugcccacuccaaacaucaucagagugauugcauuuugguuuccuuugaaccaguuaaagaauagaaagagcuagagugaggugagcauuuggacuaguaagauggaguaaauggcuuucucacaaagaauauuaagacugaaagcuuuauuucaaagaauacuugcugggcauuguggugcauaguugugauaccagcacuugggaggcucaggcaggagcaucacaaguucaaacguuaccuugcugcagaaugaguucaaggucaucuugggcaacuuagagagguugucucaagauaaaaaauaucuuaaaagguucaauaagucacuggacaaguaugcauucccuggguacaguccucacuaccacagauaaagagaaaagaguuuuuuaaaaaguuucucaacaguguuacuuuuucuuuucuucuuuucuccccaccuccccaccuccagcugguuccuauguagcucucacuguccagggacgcccaccugggucgccccagaucccacuugcugauucugaaguagagccaucagucacuggacauaugucucccauuaugacauccccucauuccccuggagcagccgggaauauggagagaaucaccaguccugugcucguggggguaagaucagagcguuguaguagaugcucaggcauacaaagaucucuuugaguuguauaaagaauucuguguauuuaacuuaucaguaaacuuccauucaagauucuagaauauacuuacuuauagaaguuacauaauuuucuggaauaauuguuauugugguaaauuuaguugaacuauuagauaccugucauguauaaaacaguguccaauccacagagauaugcuuauauuuuuagucuaugcucaaaguuguuagucaucugacagugucugcuuuuugaagauaagaguggguguuuguuuguuuguuuaccuuuguguuccuaaugccugaaauacugcucaacauauuggaggggcuuaauaaaccuuuguugaaugaaguuaagacucuauaaguaaccauaaaaagagaaacagaauguagaccaaggggggaaaugcuaaguugugugaggcuuucaaggaggagaaagcacauccaacugugauggucagggucaucaaagacugguuguguugaguuuagccguuuauagugggugacggugguugucacggugagaaaggcagacagguggagaagauagaauaaacccguuugaaagccaagacaguaccagaacuuucagaaaagcaagacuuuuguuuagcuagugccaguuaaggaggugaguggugggauguggcuuaacgaaaggucguguguguauucacagucggugagcaaguggacaccaguaagugaguaagcaggaaggauccuuugacugggagagggguguggcuguuacggcaguauaggacgacacagaaauuuguaaaacaaaagugaugaguugggaguugucucagauuuccggcaaguuggaguggaaauggaaggaagugugggauugggggugcacugggagggauggauggauggauggauggauggauggagggauggauggauggauggagggauggaugcaugagauggauggauggauggauggauggagggaugagauggauggauggauggauggauggauggagggauggagggauggaugcaugagauggauggaugcaugagauggagggauggauggauggauggauggauggagggaugcaugagauggauggaugggugcauggauggauggauggauggagggaugcaugagauggaugcaugagauggauggauggauggauggagggauggauggauggauggaugcaugagauggaugcauaagauggaugcaugagauggauggauggauggauggauggagggauggauggauggauggaugcaugagauggauggauggauggauggauggauggaugcaugagauggauggauggauggaugcaugagauggauggguggauggauggagggaugcaugagauggauggauggauggauggauggaugcaugagauggauggauggauggauggauggagggaugcaugagauggauggauggauggauggauggaugcaugagauggauggauggauggauggauggaugcaugagauggauggauggauggauggauggaugcaugagauggauggauggauggauggagggaugcaugagauggauggauggauggauggauggaugcaugagauggauggauggauggauggagggaugcauggagggauggaugcaugagauggauggauggauggagggaugcaugagauggauggauggauggauggauggaugcaugagauggauggauggauggauggagggaugcauggagggauggaugcaugagauggauggauggauggagggaugcaugagauggauggauggauggauggauggauggagggaugcaugagauggauggauggaugggugcauggaagcauguuagguaguaaugucucaacugggagaguagaaucaacagauuuguacuucuguaaucccagcucuucagcugauacccacauuuacuguucuugugaacauaguuuagugaaggcaaaacuguuccugccuuccuguuuucuuaaugaaaugagccaccuucauucauaacuuccaggaguaagaacuaaaggauaccucgcugacaaggaacaccaucucucuuggcuuucaguuuuagccucaucucuccugugcuguguucucauccuuuucuaggaggaaaacaaugugguccauaaccagaaaguagagauucugagaaagauguuacagaaggaacaggaacggcugcagguaaggagguagccugggcucuucguaggccagaggaccugggagguacuugcccauagucaguggauagucugucccgugccagcggcuguugugcuagcagugggucuuuucuccaccugacauggauaauuaguuucuaaggugguguuauaacuuucaguugcugcaggaagauuacaaccgaacggcuacccaaagauugcucaaggagauccaggaggccaagaagcacaucccgcagcugcaggagcagcuguccaaagccacgggcucugcucagguaguggcauuauugaaaguucugcccaguguuugcagaacuucugggauugggucagaguaugugguaguuucccuuugaaagugauguuuuuagcaaaggauaacaggauguucuguguaggauguuacagauguaaugauuaacagaaguaaguguaggcuuccgauuguuugcuuguguugguuccauugaaauuuaggagaguugaguacuuuugauuugcugugacaaaccagaaauguaguuaaaaguagcuauacuuuugugguucacacugucacagugacaacugauaauguuuuuuaaagagggaugugaaguuuuugcaaacuaaagggcauuguggcaaauacaugggcaggcauucuauaguauccugaagcuacuguugaucuccucuguuuuacaaauguacuuaagacugacugcacaaaaguguaagacuugaggucaagaccaggcauagcauagcacugaggccaggggaggcagaggcaagaggauugcaccuuagaggccagccugggcuacaagguaagagacugacucuaggaaaagaaaaugagagagauaaagaaauucugaaauccaaacucauuaagaucucgaagcuucaauauuuauuuuucuuuuauaggcaggaugucacuuuuauaacgcuuccuggcuuacccuuccaaaugccaggauuacaguugugcccugucauaaguguacauugucauagucuuuguuuuucuucacggaugcagagucuaacuguaucuuccugacuagccucacacuuggcuauguagcccaggcuggccuugaacuuagcucaauccuccugccuuaggccccugagagauggaaucguaggcauaugccaugucugucuaguuucauauuucuggccuuagugacccuaauuuuuauuguaacuuuaggccagguuuuaguagaacuugcucuaaaggcaaaguuauggaggugauauacuagagguuagaaaccucagccuuaaugucagccgcacauccuguaauguuccuguugagauccacacagcuuccuguauuucauuucaaaggaaugugggugacuggcccaugcuuacuuaccuuuugccugugcguguaagauggguaaaagcugaugaguuguuaccguuuuugaauuaguaaaagucaucuuuacagaacugaaaagaguauuuggagaccauuuaucuuccuuugcuaauuuuaaagugaaauacuauuuugugguugggaaagaagacaucgcugagguucugugauacaagaggucuccugguuugguguacuucaucacacagucuuuugcauuuugauuacuaugcuccaguaaugguaucuguguuucugugugcaugcaugcaugugcccuuguaugcacacacacacauauuugguagcuuugugacugaggcuugugaauauuagucuggcuauaccacugagcuauauuagaagccuuuuauauuuuuauauugaauaaaacaaggaauuuacccaauaugaacagugaaaauguagcuuuaguaauuuaccuuuauagcuugugaccaauauugaacacuuuaaugaaacucagaagcagugagaaggcauuuaaauagaaguaguauaauagucuuuacuaauggcagacaaucuaaaugauguaaguuaaugcucuuggauauauauauguauauauguauuuguguauauauauguguguguguguguguguggggggugauaguugcuuuuguaacauuucuucugugcuaaagcauugcuuucucuaucuuuacaguuguucauuuuagguaucuagaccucauaguuguuuaugcuuuuuacuuuaaguacuuugaccguaaguauuuuuagucauauugguagccagcccuuaacuguauccauguagaauguaugggcacuguucccuuaacagucaguaaucaccauucucuccuaugaucgagucuguaugauucuucaaucuguuuuaggacggagcuguaauugcacccuccaggccauuaggugaugcccuaacacucagugaggcagaagcagauccuggagauggccugugcaggacugacuggagcaguggagaugcuucucggcccaguagugacagugcugauguaagcuuuaaucuuuucaaucguaucuucuuguauucuccucaugucccuuucuuaagcuauguguguuuccaauguugucuuuuauaguaaaaguuuuuauauaguaauuggugaacagaaguucugcacacucuucugugugagcuuguaauuccagaguucacuuuuccccuaggcauucacugcgaagugcuucuuguagugauggaauuucccagcaggcuucuuguuuguagauagagaggcaaauacuugugcuuuuuagcucaaaugagaggccaacuguuggugucuuuaaaagcauguuaauauuccaauuguggccagaaugacucagucuugaaucaugaggcacuuugccauuacaaagagaagcagccuuuauccuguuagacuuaguuacuagccugguuuuacugacaguucuguccugauucacacagagacuaccagauggauguauuuguucauaaaaacauguuagguucauccaggcagugguggcacacgccuuuaaucccagcacuugggaggcagaugcaaguggauuucugaguucaaggccagccugguuuacagaaugaguuucaggacagccagagcuacacagagaaacccugucucaaaaaaaccaaaccaaacuaaacugaaccaaaccaaaaacauguuagguugaaaaugauguagaacuauaguuucaugaauacuaaaagcuaaaccaagcuaaguauuguagcacauaaacuuuaaucuuaguacuuggaaggcaaaggcagcaggaucucugugagucagaggguaccccggucuaaauagagaauuccaggcuagccagugcuacauagugacucaggcuaucagcauugcuuauguaacauuauuuuaugcauaguccuggugauagaaaagaaauagguugucucuuuuaaggacaaugaggucauaguuuuguaucugugggcucuggaaucaaguuaguaaguugugacuagugaugguuuuaagacaagcacaggacauuagguuuguuguguauggaagagaugcuguuacaucuugugacuugugggcacaaguacuggugaguuguuuaagaggaggggaaacugaggccugugcucuaaggcauuaucuaggauaccuuuuuuuuuuaaagauuuauuuauuuaauuuauaugagucuucagacacaccagaagagugcaucagaccccauuacagaugguugugagccaucaugugguugcugggaauugaauacaggaccucuagaagagcaagcagccaguguucuuaaucagugagucgucucuccaucccugucuaggcuaacuuugaggccuggcuuacugguuccguuucuaaaggaagcaaaauuugagaaccuuuuuugaaagaugaugauaaccagauuuuagaacuucaauuuucaaggaaauuuauaauagcuaauauuguucaagcauuauaauaauguuggaaaauuuuuuguuaguuaauucugaagacagcuuuguggaguauugccauugucacauuauaaaagaaguucugagggcaaagggagguugcuggcuugcccaccuuauucaggcacuaaaugauuugccucuaccuagcuccaguggacugauccucuaaauauacacaaaagaacugacacaugagaacauggcauauuuuaagagaaugaagguuuuagggcaacauagaauaucaggagugaaaagcuagagaugaaaugagacagacuggagggcaggugugaaggcucucccacucauccuggcagcacuguuucaggaacagucugcccucugcccuauguauauuaucugccguuucauuuccagaguaugggcauucagaccaaaugguauggauuggaaauuagaaauuuauuuuguauuuaaggaaauauuagaaccaaaaccugugcuuuccaaauacagauauauaaaauggaguuaauugaugaguuuggaauuaggcauuacagcaaauuaauucuguuguguaauugguaaauauuagaguacauaguauccuaguuucucuugcugugaugaagcaccaguuggcuuacacuuccacaucauaguccaucauuggaggaagucaggacaggaauacaagcagggauggaacccagagacaggaccugaugcagaggccauggagaggugcugcuuccugucuugcuguccaugguuugcucggccuguuuuguuacagagcccaggaccuccagcccagggauagacccacgaacaauggccugggccucacacaucaaucacugguuaagaaaauguuccacagaguugccuacagcauggucuuauguagacauuuucucaguugaaguuccauccucucagaugacucuaguuugugucaaguugacacaaaacucucggcaagacaauuaguaaacugacagaguacaguauuuaggcucuaacauguauguaaauaaggagcaccaccagaaaugcaccaguguagaagacagauuggaauaaagagacagggguaucaaaauacaaggagaguggcuucuuaggaauuuaaaagaugaaugcugaauggaugacagucaccauuuagugaguguucacuuugugcuggaaguuacacuaaugccuugagauacucuuuuuauucuuaaaguaucuuaaguaguauugccauuguauagauaaacuaagaccaaauaacuaaauauugugaaacccugaggaauaaccuaguccagauuuaucuacugagcacauagcaaacuuguuuaauucccacaagugucaguuugagguaaaaguagcuuaugaauuuccauauuucuuugaacuguacugcagugaauuuggaaggaucagucuucuuuugaguuagcauauuuugcuuuuaaaauuuguuaucuguguguuuaugucugucugucugguaggcacacacauuuauaugugcauaugggugcauaaagccaaaaauugucacugguggucuuucuucuaucgcuguccaucuuacuuuuugagacagucuuuacugaaccugagcuuaccaacugguuagucugggccgucacggggcucccaggaucuguuugucuugccuccuagauccuggcuuacaaguagucuguggccagcuuuugcauggaugcuggcugggcuccaggauucauacucacgucuuuaugguuauggaacaagcacuuugcucacugagcccuucccagcucucuucucaguuuuauaaaucagucuucuaguauuugugaguuaaaaaauauaacugguugcucaguuccgugaagacuuaaaaggaugugacaagccaguuuucucagaagugccuuacauaucaucuacaauucagguuuucugauuuucauuguuuuaaauuuauuuugaaagugcuucagaaugucuacucuaacuguguagaaggucauuaagaugcauaagcauugggucuaguuaaucuugcuauaugauuuuuuuauugcaaguuuuuauaacaaaauuuuaguaaauauaaaauaauuaucaaauauauuuauaagaagagaggaagagagagggggcauaaggagggcauggggccaucacaccucucauaacccagucucagcucacacuugucugugacuccugcuccucagcucugagacuuuuauuucauuaaugugacuuuaagaggugagagcucuaaaguggaacuucagucuuauuaaaacuuaugaauuaauaauuuuccuaacacacaguuugauuacccucauugucuuacagggauuuuuauuuauuuauuuauuuuuugcauuuugcuuauuugauuuguuuuaugauucuagggagcaaacucagggcuaugaugugagacucccucacuaauacauccuaguccugguuuguuugagucaagauucaggcaaggucuuuauagcauucccuuccccucccuccccuucccucucucucacuccuuuucuucacuucccuccucuguccccccaccccccauauuuuuguuuggaaaaaaucaggccauauauccaguuaaacaacccacuuucugacugucuuuucauggugcuguguaacccagucccuaucuuuauuuccugaaaacuuaaaguuagauguagaguauugaugaaauuaagguuugauaguuauuguuggcaagaacaauucuuggguaauacuggguacauuucccccugucagagcaggggggggagugguuguguuagcuguuaaugcuugauuauuuuuuuccaugauaaaauucuuuaccagucuguuacaugucuuuuacauuccucacagggucaagaugucuggauccuuuauucauuuagggguuucaaaagcauacuauaugcauagcuggagagacuucccuuuacuagccauuagcauaaaacauagcuugcauaggaaaugcaacauugugacauuuuuccuggggacauuguuucuauucacccccuacagauagggcagugacaaaccagagaugguuccauccaagaccuguucagugaaucaguugauugagucugcuuccaggaugaugggugacucaggcaguuacaucaccaacaaagccugccucugccugccugaugacucaaggaagcugcuaauguuauggcaguccuccacaccgcuggcaaacagcggcaccacagagagcaugccggggucccagcuauugguuuuuacucagaaaauccucacaggaaggcucuuggaguccuguaaauuccuucugaguuucucgagcuccuuagugcucugcucccuccaggagggagaauucugguuggggaaauagcugcaucucaugcagaauaaauaucuccaccagagucuauauucuuuguguguguguuccuguuuguuuguuuguuuguuuguuuguuuguuuguuugagacagaguuucucuguguagcccuggcuguccugggacucacucuguagaccaggcugcuucuaacucagaucugccugccucugccuuccuagugcugggagagucuauauucuuuaaaaaaaaaaaaaaaaaacuccaaagaaugaccagugaggggugggggugaguauauuuguacuauuuuuaaacucacaggagcuaauguaagccaucaauugugaauaauuaggagaagggaagacauaguuugauaauguauaggcuaagagagaugagaaagauaagaguuuuauuggaaauaacgaguuugaggucuggcauauaccuguucauaguuaugagaagggaaaggugccccaagcugaggcuuagaugaaacgcuagagaugagaaagauaagaguuuuauuggaaauaacgaguuugaggucuggcauauaccuguucauaguuaugagaagggaaaggugccccaagcugaggcuuagaugaaacgcuuucauugugucuguacuuuuucagugugauguggagaagcugagagaacaggugacaccacuuaggauaugaaggauauuuaguuuuuaauaagaagaaacagaacuuuguccccuuguacaccgaucuuccccauuuucaugugguccuuaccaaaaugaauuaauucuuguguguauguguucucuuuucauuagagucccaagaguagccugagagaaaggaguuaccuggaggaagccccagagagaagugaaggaguucaggacgcugugaguaugacaucugcgcauugagugucaucuuggcguugagagggaguccaguguggcacacaugcuggcaagugcuucauagcagagcucugucucuucuaccuuuuguuguauucaggaugugcuaggaggaucucacaugcugucugggagagagggugggggacaaaacaagaccuuuuuauuagaagaacauaggaaagacuugaauagguaguccauagcauuaauaguggauuauuacagcaaacuaugccauaacauuuccuauuaacuuguuucuuuacuuuuuguuguuuugagauaggguuuuucugugugguccuggcuguccaagaacguguuaagauccuccugccucugccuuuuaagugcugagauuauuggcaugcaucacaagcacuugcaugcuuucugguuuuauggguggacuauuuugaccuguucacauaaacagaaucacauaguauuuuuucuuuguaacuggcuuauaucaaguagcauaaugucuucaaguuuguccauguuguacuuaccaugcgccagaauuuucuucccuuuuaagacugauuaauacucuucucccucccccucuccuucuccaaugcguauauuaagcagaauauaacaugcacauauuuaguaguuuuaaauauguaagaaacguaaaccuccccuauguauauacaugcuuaugcaccacugugauauuuuaguccuuuugagcaucuauuuagaagugcaguggcuggauuuucauacucuugaauaagauuuucuuuuuaaaaaacaaaaaguucauuuucauugugugugugcaugauguggcguuggugccaucuuuccacucagguccccaggcuguggcaagugugcucaccgcugagcucucggugcccuggguuuuauacacucucaauagaaaguuuuagcauuaugacuuuauuugguauuuuaaauguuuguguguuuugccuguaucuaugccagugcacauguguucaguagccagaagagagggcaucagaucccuggauggcugcauaccaccguguggcugcuggggccugaaugcagguccucugccagagcagaaagggcuuauuaacugcagaaugucucucgagcccuuagauuuuauuuuuuaauaaauguauuugaacuuuuacuguaaaagaaucaacagaauuuugugauaucaucaacauuuuugaauagucagagacauccaguuacaaaauaaaaaugugacuguuguugagaauaaaugucuauuguuucaucuaguuuuuaaaauucuaaaaaauuugagguuaaagaaaauaaaaguaauuuaaaaggagagauagaacagggauggggcuguagggcaucgguagacccuuaccugccaugaccaaggcccugguuuuaguucuagcaucacaaaacagaaagagaacuuaagccaguuuuauguccucucguuacuaggugugaguauaugugaaugaacgagcgaaugaaugagugaaguauuuaaaaauaugacuccugcgaggaaaggugcagugagcaaaggugguuuauuagugucaggggaauccacacuccccuccucagcccuccccuuuccugcucugagaaauagccagugcucuucuguccguugacuuugagcauuugagaaccagcacuuugaaaauagagcacuucagugaugauaauaagcaguuccuuuugaacggcgaggcgggagugaaagcaggcaaaauguagaccagggacuguuagaucugauggcagaauccaccaggaucugcccccugaagauuucuaacauagaauaauugauggguuuaggaugauagauuccaagcccagugguuguguuaucuguugauuuuaaacuuaaaaaaaaagagagaauaaaauggaacuucaugaaugaagugagccaugcauuucuuuguuugaaacagucuccuuucucugccucccaguguaugauauaggcguuauccaccauacccaguucuguaguuggguuuccuucucuccuaucuaucuuuucucuguuguuagcaggagccgcagucgcuggucggcagucccuccacccggggcgccccucacaucauuggagcagaggaugaugauuuugguacugagcaugagcagguaaagccuugcugucagaaaacagacugucagcuuucuaagacgucugagucaacaaauaauguuuggaagcugagauaaaacuuguuaaggaugcaaagcugaaucuuaaagcccagcacacuggggugacugccuuuagcuuugaacaguagaagcuaacauugcagacuauagaugugggcucguuuuauggguacuugagaguuucauuuuauuggggugggauggauguuacuggauaugauacuuaaaaacaauaaaguuuacaaaugccagcuagucacucgugggaggaaugucaucagccuuucggucuuuuuaaccugugcucgugcuaaguucagugauuaguuuuaggaacuuuuuuuaauauuagaaagauuuuugaggcauggccucaucuagcccaggcugaccuaaaacucucaguguagcugaggcugaccuugaacuuccucccaagugcugggauuacugcuguguaccaccacucucaggguauagguuuuuaacaggaguauuugaagcccuuaggaggcaggaggagcaugaguuugaaguuaaccugcacuggcuacauugugaaguccuggcuugcuuuaguuucaaaaacaaaaauaacaaagaauacuuuugugauuuuuuuuagauaaaaauucacguuguuucuuagugaugugcccuuuguuuucuucuuucuacuuuguguaucccuuauuucugguucuugccugcauugugcugacuaggacucccagcgugaggcugagucugucuggaggagcccuggcuuuauucagcccucuuauucagaaaacauugaguuucucuugcuuuaguaugugacugacagcgguuuuuguagauguuccuaauuaggucaaaaguuauaagcuaaaaaauaguccuagcuuaaugggagcuuucuuucuuucuuuuuuuuccuucuuuaaaucucgacaggauguugaauuuuguagaaugguuuggggugauuggcuuuucuuaguuacucucuuaauaaggcagauugcauugauuacuauuaguauugaauuggucuugcauuacugagaugacccacaaccagucaugacaggccagcccuuuaaauuuuauuuaacauuuaucuaguauauauguggaugugcaaguguguacucgcaugugcacacaugacacacuacacauguguaggucagggaacacuucagggguugguucuccccuuacaccuuaucuugaggcagagccucucuuccucuacccaccacugggcugcuuggacaguuuugguuaauucuucauguccugcuucccauccagcuguaggagugcuggccuucuuacagaugagugccaccacagcuggagauuuuaaauuauucauuuacuuuuuuuuuuuauguacacaaguguuugggccgauuauguguuuguguacauugcgcugcagaggagggcuccagaaucucuggaacuggaguuaacagaggagccaaacccagguccuuuguaagagcagcaagugcucuuaacugcugggucaucucuagcucucauaucugaauuuuuaaaaauaaaaaauaaaaaaauaaggaaguugguaagccuguaaacucagcacuugggaggcagagacaggaggaccauaagcuuguuagguugguucaggcuaaucaaggguauauaacaagaccaaaaaauaaacaaaacaagacacgaaauagcaacaaacaaacaaacaaaugaaauaagcacccccccgugugucccccccccccccccgccaaaagagagauagacagaaacaggaaggggccagcgaugaaacagacccuucaaaaucacucuccaguauccuugcccuccaccaaggccaccuccucaaguuuucaccacuucucagcuaagcccucagccauaagccugugggggacauuccagacggaacccauuacagaaggucaaugggaaauucugcuggcuguguucaguuggccucacaaguacaguuuaacucaguuuucaagaguuccugauguguaaucauuuuuuucugcuagaucaauggacagugcagcuguuuccagagcauugaauugcugaagucucgcccugcucacuuggcuguuuucuuacaccauguagucucacaguuugacccugcaacauugguaauauaucuuauaacuuaccugauugagcagccacauacugauucauaugcuggagagcuuuuuaucugaaaaacaaguauagacaggcuuauuuucuaaauguauaaggauaggcauaucaaauguuauuuacuaaauuauuaccuuuuguguuuuuucacugucuuuuccauuucuuucuccaugacagcucuguuaucucuauucagaccuguauaagcagacaaacuccaaggagacucggcgugucuuccuggaguuucaucaguucuucuuggaccggucugcaguaaguugccgaguuaauucuggggucagucagugcauccauugccucguggcccuugauuuccuguccccuaaccaugccauggaagcauagcaugcuuaguucuugauuauacuugacuuaaaaaauuuuucuaaauuaauuuuggguauaugaauuuuuacaauacauuuuugggaguauauauguauauuuggaaauuuauauguacaugauuagauuggggaaugaaaaacauaauauagaugauagacauauauaugaggauccaaaggauaauucuuggauaacugaauucugaguggccccucuggacauuagaaauacauuaaugacuaauaaauaaacuaauuugacuaaaaaguugcacacugaagucagcgaauugcugcgcuuuguuuuaccaauggaagugcuagggaaguggcccaccugguagugugcuugccacacaggcaugaagacccacguuugauccacacgacuccugggaaggcagagacaggaggaucuuggggguuugcuguccaggaagucuagccagucauugagccugagguuuggugagggaucccaucacuaacaguaagguaggcagugauagaagaagauacugcauuguccucuggccuccacucauaagcacaauguaccauacuuguuuaagucuuuuauuuuuaagcugaauuuuaucaugaguauuuuuuugcuaaguaaggguaaauaauagccuauaauauguccuuggaugaucuuguugcuugguccuuuucucaucaccuguuuuuguuaguuuaucuucaaaaaaauuguuuccuuagucuaugcauacacacaucuucuuauacacaugcaggccagaggccagcaucaggugucuuucucacauuauuauuauuauuauuauuauuuuuacuauaauuaguuuuuuuauugguguguuucauguauacuugugcuaagaugcagagggcaagcaguggaagucaguucuuccacugugugggucccagggauugaauucagguuuuaggcuggaauaacaaacuccuucccugcuuagccaucucccuagccauccauguuauuauguugaaaccaggucuuucacugacucucagcucagucacugacuuagaucagcugaccagugugcuccagggauccuccugcaucugccuccccgccacacccacugugcccugcuuuuauguggauguugagggcccaaguucagguccucaguccucaugcuuauuuagcaagcauuugucuguaggaacucugcagucaucccaccccuccccauauucuuuaucccuuuaguuuuacacaggguuucacgucagccaugaauucagcaugucauugaaaaugaccuuaaacuuacugucuugccuguuuccuaauugcagagauuaaaggcaucugcgaccggccauaucuaguuuuaugaggugcuuuaugaggugcugggaugacgcccauaguuucauaagugcuaggcaaacacuucgucugccacauugccagcccuugucuguucacacuuguucucuuagauggcugcuuuaaacucuagucuccaucacuucucuccaagauuccucaacagaagacuuuguuuuuuauuuuacugauuuuuuuauuuucauguauguuuguugucugugaggguaauguaccacuugugugucagggacuaugggugacagaagacagggucaggcccuaagugaacucugcgagaucacaugcucuucaccacugagcugucucugcaucccagcucugacccugcugcuuuccuggaaagaguguaaaguguggauggaucaccuacuucccucgaacugugcaucuaccugccugccugccugucggcugcucaggagcugugccagcagcaaaguguuaggagaauccauacuaacguauugauucuucuuucaugugaccagucaaaauuauauuacucauguccauauguaaaugaauuaguuuuuauuugauuucuuguggugcuagaaucacaccccugucucagugcacucagcaaggcugugcuguugagcuacacugcuaacccacauguacuuuuuugcaugugugcuaaaagaacauuucuguuuucuguuucucacgucuuucccuuuuccauaucauugaaacagagucuuuuagcccaggcaggccuuuggcuuaagauucucccaucucugguucccaaguguugggauuacagacauguaugaacaugucuugccauuucacucuucuuaggggccagagauggcuugcucagcgguaagugcuuguugugcaaguauaaguacuugaauuagauguuugcacccacauaaggagccaggcguggcugugcacacuuguacucccagcgcaggagggaagacagggagacaaggauuccagggacucugcagccagccaggcuaauagaucagucaguaucagguucaaugagaaacccugucucaaaagaauaggguaggggcuggugagauggcucagcggguaagagcacccgacugcucuuccgaaggucaggaguucaaaucccagcaaccacaugguggcucacaaccauccguaacgagaucugacucccucuucuggagugucugaagacagcuacaguguacuuacauauaauaaauaaauaaaucuuuaaaaaaaaaaaaaaaaaaaagaauaggguagagagugauaguagaagccaacauuggccuucacagaugcaugcauguacaaguguaaauacuuacacacaugugcacacaucacauacacacaccaaaauaaauuauguaauggucucauaauauuuuaacacugacuuauuuucaaauuuacaacuuuagaucuuuauaagaauuauaaauuuaggaaauauaugacuuuaauagguguacaguauaaaauuuguauaagaaccaagauauuuccucugaauacaaaauaauaagauuuucuguuuaguuauuggguaaagaacauuauagucugauaauaauucuucaugcuuauggggagaaauccugauagaaagaaguguaucuuaaaauaguugcuucaguucuacugcaggaacuacugauuauuacugauuguuguugagaguuuaagacucaaaaacucaacauaacauccaguacuuuuucaucggcaguguacugcugagggauuuaacaguuagcuaagaacauuacugauaaucacguggucuguaggaugagccgcucagauucagacaugaacaucauacuuaugugagucaaguuuuccuauauaauagacgcauagcuuagguuuacuuguaucauuucagguaaugcauaacugauuauauugaccagcguuuauaguaagcugaugucagauaguuacguggagugguaccgaagcauuuauuuugcugcccgauaaaauggcuaguucuuuguucacagcagaacuuuggggaaagaguuuauuuccaugucuaagcaauagacagggcugugucacuuggacgggcaagaacagcuggauuagcaaacaccuuuaggauaaaccuacacaccuuccucagucugccccggaagccugcggggcagcucugacucugcuuguguuguuucagcaccugaagguuccaguuccugaggaaaucuccguggaucuagguaaguuugaagcacccgagucccugaagauuagugucuccaucaaacuguggcucgccucagauccgcuguuuuauguuaguuuagucaggcuacuuuaaccaugugacucacagcugaaagagagucuacuacacugagaggaugaaaggaugagagcuggcuucugacaggaagugcaguaacugcacugaguaaguucucugguguaguaaguucaguguggaugugcaaugucacugugcugccagugucaggcugcauagaccaucucuuuagaucacuuaauuccucuucuuugugcagaaaagagaagaccugagcuuauuccugaggaucugcaucgccucuacauucagacaaugcaggagagaguccacccugaaguucagaggcacuuggaggauuuccgguaagcugggguuagagaaaacuuggugugcucauugugaguuauuuggcuuauauuuuuaaauaggaaaaagcuacauauguaaaccauaugaccuuagcccugucguuaaacauagugggcaucugaagucagaggguggaugagaguccauagucuccauucaggcccuuucagcauggagguggcucagugcagcaucuugacccucaacuuguuaggucaaaguaggaaacaggacauccugccuguccauagucaguuguagguagggcugucuagacaccuagagggagauaguuugcucucugcugagauauuuuuuccuaacucuuuuagacagaaacgcagcauggggcugaccuuggcugagagugagcugacuaaacuugaugcagagagagacaaggaccggggaacucuggagaaggagcgagcaugugcggaacagaucguuaccaaaauugaagaaguguuguaagucagaacggcaugcagaaaugcugcuuuugcuuggagcccucuuuaagcagaucugguggagcagucagguugcaauguguagaauuauucguccugacacuggaaauggaauuuuuuuccuuuugaaaguucuugccuucuccguucugaguguugguuaaugaguaacuccaagacuuguagucagugauaagcgcuggugaccacuuucacugcaugacuuaaggccuugggcaguacuugcugcuguggaacacacucaucuaaugacgcagcugugaaaugguggggguccuuuguggaguagaguugcuugaguauuuuauccuugauguacacgggacccuaaucauuuaguucuuuucuguuguuucaggugucuaagcuuaaauagcaaaucucugauuaaauguauauguuucuuugaucuuuuugauggcaccuuggauugaacccagggccuugaacuguguugugugacuuacagauagaucacuuccaaauguaucacugacuuauagauagaccaucugcaauuguauguauuucaccuuaaaauauuccuauuuuuaggaugacugcucaggcuguagaagaagaaaggagguaauauaauguucccuaccccaacuagagcuagguucucucucugcucuaaaaugucuguuucuuuaaacuucauauguagacuguaggcucccucugguggccuguuuuuuauuugguuuguaacucuagugucauguggauagaauugguuuguguacuuuuuuuuuuuuuuuuaaaguuucugccuugauuaauuuccaucauugggccucuagaaaucacuugaucucuuuauucugaccauccuucucacaucagaauucuuacaguauucaaucguuucuccuccaguuccacaaugcaguauguaauucucauguauaugaaguauuugggaguaaaagugaaagaaccucgaaacuuggagcacaagcggggucggaucggcuuccuuccaaagaucaaggugcggcuggggcaauagcacaggggcuaccuugccauucugcacauuugcggacagugauuccuucccagcguuuacuaaggcagcacaucagcacugagcaucgugauaggucuaacuuggucucucuugccaagaaacuaucuagugagaaauccacacauagaaaagcuuauuauuagguaagguaacguuuauaugccugccgccugcaaaccaguaccuuagacugucacuucagggcaccugucucaguaauuauuagguuuuauuuaguguuucuuagaguguaaaggugugucccuaguuuuuagcacggugcuuucacauacuaugaaaauguugaaugggugaaugaugcuguaaaacagcaaauguuugucagcaagcugcugguaaaauuggcuuuuuacuuucuaagagcauuauuuguguugaaagcugagcuugguagugcaggccugcaucaacagcacuugggaguuacaagcaggaagauccagaggucauggucacccuugucuauauagugggcuuaagggcagccaggacuacaucagauguugucucacaccaaaaaugcaaaagcagaaaauaaggcaugcugagcuggagguucacacgcagcucggcuccaugggcgccgugguucuuuucugaguaucgugccauuuccuuucagcuggccauuagagucacauugcuguauuugaaaacaacaacaagaccuacuauuccaugucucuuaucuuacuguaauuguaccuugaauuuagcaaagcaugaagaaagauagagagggcgaagaaaaagggaagcgaagaggauuccccagcauuuugggacccccaagaagaccaagccgccacgacaacagugcaaguacguugaagcucgaggugcuguucuugcugccuuuccucagaagccuguuuggucgggaauguguugcuggaggcagcugcucugcagcugcuguugcugaugcugcacucugccuuguuuccccuagugcuguucugaacaaagcucaccuacggugcuguauuaacugaugugaacaucuucaucagugacgugugccaucccaugccugccacggcuucuuaucuuugauuuuuaucuuauucaauuuaaaaaaaaaaaaaaaaaaagcuuugggccagggagcuagcucaguugguaaagcucuuaaaagagacauucaaucugcuguagagcccauguugaggaagaaugccgaauguaguagcuggaaucugggaagccagagacagguggaucccuggccugcuagccugaccuacguacugaguuccaggugagaagaggcuggacuuaaaaaagaauguggacuuugacugaggaauggaaauaguacucagaguugucucauucagaccugcacaccacacgcacacauacacacaugcaugcacaccccuggucaucgaucacuccaccaugacuugucuagucccuuuguacuuacuguuacuuacuuucugcguauuucugugguuuccauguguccacugugcuuuuucugacagccugucaaccccaucugcagagcgaggucagaccaccagacaguguggcagcagagacagaugugguacuaggaagguagccagccugugcugggcuucucaccugagguucuggcauaauggggugacaguuugguuggagagcagugaugcugcgucuccaggacauggggaguccugcaagugccaggcagaggcaaucugcgaagaaggagaagauggacuuagauucgggcuguccagagccaugugaggaugcauaagguagcagaggaugacccgaaagaaucugaugugagcaagaguaaggaggagggcagucuuugguacagcggagauauugugaauauauagggaaagguggagagggauaacacucacagauagaggcugcaucuuuaauuuuucaggagauaaaacugucucccagcauucccucugccuccacggccacugcucuugccagcuucuccuucuauguucuuucuucugcuccaucccucuuaacuuuccuuaucugcucucuccuuccuuaccccaaccccauuuauuucccuccuguacagccgcucugcaacacaugcuucugaccauugcuuucuguucaguuggcagggccauggagauacagaagucacgccacccgaagcacuuauccacucccucgucugugaguccugagccucaggacccugccaaguugcgccagaguggaguagccaaugaaggaacagacacuggauaccugcccgccaguuccauguccucugccaccucagggacugcucuuucccaagagggagggagagagaaugauacaggugagucauucauuagaguaaacaguggaaaaauggaagauuuuaauuacaaaugaaucccaguuuaguuugauuuaaauauuguaguauucuacaguucacaauagaaauauguugaaugauaguuuuuuauuuuccuaaaaaucaaaacuccaaaccacugccugaacucuugagguguuaacuauacacagaugccggccauuugaagcuuauaagaugcacgaggaaagucacaaaacuaaaaaucuacauuggagccccuggguaaggugauagagccagagucaccuucaagagccagaagcagagggaucaaagguucaaggccauccaggcacacacagggagacuguucauaaauaagaagagaagacccaacaccaguaguuggaaaauuuuuuucauuccgggaaagaaagauaagggggauugaggaaacuggcuaguuguuauuggcaaauaaaucuucuguuuucuaaaggaagcagaguugagacuuuaaaaacacacacacacacacacacacacacacacacacacacacacacuugaugcagacuuacgggacggauagagaagaaggcugcucagaaaggaaggcgcacugagcacagggugccuugagcugugucgccucgcugaucagauggauccucuaccacgugagauccaggaccaaacgcaggccaucaggguggcagcaaacaccuuucuuucaucauggcaggccccagauaaacuuuaaagaaaaucuguaaauuugagacccugaagauuuuuuucuuuuacauugaugauaauucaguaacaagaagaggucaaauauuugaaucauagcuauuuccacacaguaggaaagggaaaaaaaugaaagaaagccaggucagcuauacaguuuuucauccuuaaauaugaacaucauuccucauuccuggaaacauuugcuucuuaaaguuaaggcaugaggcaacacacagcuccauacaguuagacaaugacauagaaaagccaccccuagaggaacagcuuaauuuugauaaugcauaagaacuuuaaaauugccucuaaagugauauacuugggaacauuaaagaaacaguguagaguaggaccuuauaagaauauuucagagauaaacuuuaaaaguuaaauauaguagaguaauuauuguuauuaauugcugugugaaaaucacuccagguuuaguggcauaacacagagaguauucucauguuuuuguagcuguuugucuaagugguucuaacaugaggccucucgggacaguagggaacacccuccuccauacuagauaacucagaugaggccucagcccagagccccggggcucuuucaggaguugcuccaguguuccaggaugcuauagcugacuccuuagagugaucuaaaggagggagugaggacagaguucugcugucaccucagccagugagaggcaagccaccaagucauccauacuucaggggacacagauuccugaaggagaauuaaaaguuuaugaacauguuuuuaaaccacugcaguugccgguauuuaacaggcuguuuguguguagaaucccugaaaguaguguuuuccagugcauguaagaauuaaaaacaagaacaacaacacugcaacagagccccagaaauauuggggacucaugagcgagauccugucucgucuucagagucagcagagacgguggggaaggggcagagaaaguagugaggguucccagaggcagcaauaacauccacguugacuuagaaacggugaggagaaccaacuacuguuaccuaauugaugaggaaauccuggcaacuugagagcaagaaaaugagaauuguuuaucuauugcuccuuggaacacugaauaguggaguagaaaagaacacgacuuucgggucucugcaagaaaauggcuuuuacuuuaaauugugcauguugaauugucugucaaaaaggaagaaugaauaaagacguuuucagacauguaauaauguaaaguuugaaacuccucaccccuugaaccguguuugagguuauacuucugcacacugaggagaaagugaaaguaagucccggggugcaggacaccgcacagaagagcagcacacgcagugacggugccacaggccacacagccguggcuccagacuggagcauagcgagucaggagcaagaagagagcugggggucgggaaggugguuuacaucaaguuccuaaggacagaguuagggacuugagagugggacccaucucuagccugguguugcuggggagauaccggguccuuagagcucaccagccagccaguccagccgagagacccugucucaaaaacagaagguggggagcuaucaaggaagacauccuauguuguucugcagucucuccacacaaguaacauggaaacacucacucauaccuacaugacacacacaaaaguggaggaguuuuaagcaauugguaguaugaggaaccagaaaaaaauugagauaugauaaaauuauauuacuuuaccaauaaaggaaaagauuuaggaguacaaagaaaaacaguuguuuaagaaaauaagucguuuuugaaacaugaagcagacuaaaugcuguggcacaugugucuacucccagaaacugggacaugggucacaaguugcaggccacuuuggguuacauauugacacccuaugucaauaacaaaaugaaggcugguaagcugacucagcagggaaggggcuugccaccaauccugaccaccugaacugguguccuggacccccacguggcugacugcaaaacaggugcugcaaagugucguccaacuuguccuugcuuaucuugcacauacuugcacacgugugugcgcauaaacacacacacgcacacacacaaauguaaaaaauguuuuuauuuaaaaaaaaaaaacaagugggcuguucaugaagcagcugauugagugcaacuuuaguguaauaaacaccguguuuuaaauggacacggaguugcauaaaugggggcaguaagaaagaaaauauucaaacaagcauacuucuuaacccggcagcaacaguaugcauaugagcugaagguuguauuugacaauauguauauggccauaguaaugaaaacauauuggauuggguuucaggcauuuagagucauccugcuagguaagauaucaaguagauauuucacugagaccacagaucagaaagguaagaagaguaggagaaggaaauauggauggacaugaaaucccuagccugacauacaagagaguucagguucuccuugauggagucaaacagauccacauugggauuucuguauugccucauaaaccuaccaguaaugccauagcucucaggcauuguggggccagagcgugagcagaaucccuagagaaaggauauagauuguaaacuaaaaguguuauuuggaauugguccacucuaacugcugccauuagaaaugagaaaggagggggcaggaggaggcugcugcucauuccgagacaugaugcuuguccugccuuuuuaaaaaauuaauuuucauaguuucauuuauggacacuaugcauauugacccucugacuaaaaaccuuucugccuccugucuccgaucaccaugucugucuucguguuuagucauuuuuugugacucacugauaaucagggccaucugugugaccuuggguuuagagcuaucuuugcaacccaggggccucagcagagaauagacaacuaaagacaccucuccccaaaucuaugcacaggcagcaguucagaggcagagggcauguauggaauucagggaacuuguagcuucauucaggggccagacucaggcugucaggcuuguaugcaagcaccuaaccagccgcaccacccugauuuucuugucaggcauggugguauaugcuuuuuuuuuuuuuuuuuugguuuuuggagacagggugucucuguguagcccuggcuguccuggaacucacuuuguagaccaggcuggccucgaacucagaaauccgccugccucugccucccgagugcugggauuaaaggcaugugccaccacgcccggcugugguguaugcuuuuaaucccaucucucaggauguagaagcuggcaaaucucugggaauuuaaggucagccacaggcuacauaguuaucuggaaaagagaagagaagaggggaggggaggggaggggaggggaggggaggggaggggaggggagagaagagaagagaagaguugaguuuuccccauuguucuuuagugcauuggagaguuuuauauacuaaauuuuuuauccuaacuagccuauugaaauagaauguggcuaugauuuaggaaaaaguuuugggaauuaaucagguuuuuugguuauugcuauugcuguuuuauuuuaaacaguuagugacuccgacuuuuaucauuuuaggaacaaaacaagugggagaagcaucggcgccuggagacugcuuggacagcacaccucgaguccccacuacuguuuucgacuucccuccuccucuauuagaucaagugcaggaggaggagugugaaguagagagguaauucauagagcuuugugcauugcuuacguucuuugaccuaucacuuuuaauauauagcagcacuuucuuuuauaauguuuuauagaagucugguugguaguaaauaauaaauccuacugacauuuuuucauuauguuaaauggcuuuuguaucuuggguauaucuaucuuucuuuuuuguuuuuuauuuguuguugguuuuguuuuuuugagacaggguuucuuuguguagcccuggcuaugcuggaacuugcucuguagaccaggcugggcucaaacugccaagcucaaaauccaccugccucugccuccugagugcugggauuaaaggcaugcgcugccacuguccgucugggucugucuuucuuggucuccauuuuacucucuugugauuccuuauucucuacuguuuuaggguggcagaacaugggaccccaaaacccuuucggaaguaagugaaucuuaaguagcuuucauuuaaauagugcuucuccccuauaaaguccuaauuguaaaggaaagaaacccuauucguagucugaguauuaagguaagcccagaguacucgagggccacaaacaaguguacauccaggaggaagccauuuccuaggagaggagucuugggcucagugcugaaucagaugcagaagucuaccugguuuacaauaagcacauccucaugagguuggggugauagcacagcuguuaaaaaugugaagaccucaguucagauggugaaugcccaggugagaagccagacaugacaagaccgucaaaaggaauaaagcgaagggcagucaagaaagacccccgaagccaaccuagccuccauaugcacgugcacauguauacuuacaugcgugcauccauacacacaugaacauacacagaagauucgugagucugucauccaccugaagcccucaacaggauuucccauuuguuuguuuuauuagguuugacagcaucgccuuuggagaaagucagagugaggaugagcaguuugaaaaugaccuggagacagauccacccaacuggcagcagcuuguuagcagagaaguguuacugggacugaaaccuucugagaucaaaagacaggaagugauuaaugguaaguuuaaucaauuguuguuggcuguauagauggagauuuaccagaugaagcaaaucuuucagccuugggauuugcuuuugaagaauagaaaauuacuggccucuugugaaaacaugaauuuuuuaccucggagcccacccccucccaucuagagauuguucccagaacacuccuaaacuuuucaccccaaaacuccucacccuaaaguucgaacccucccaacuaaaaacuguuccaagaacauuuuugagauaaaggccuccuagaacaaccucaaaaugaaccagguacuccuuaguuacguagguuccuugauaggacaugacuccuuaguuacguagauuccuuuggcagaacucccuagugauguaaacuuguacuuucccugcccaguucucccccuuugaguuuuacuauauaagccuguaaaaaauuuuugcugaccgucgagacuccucuacccugugcuaagguguaugaguuucgaccccagagcucugugugcuuccauguugcugcuuuauuucgaccccagagcucuggucugugugcuuucauguugcugccuuauuaaaucuugccuucuacauuuuauguauggucucagugucuucuuggguacgcggcugucccgggacuugagugucugagugagggucuccccucgagggucuuucacuuucuuuucuauuggccuuuuguuuuaaacaaagacagaauuaaacuagauagguuauuuucaagccuuuccauggaaacgguacaaguaaugguacaauuuguguuuagguuucaggcgacugaagauccauaacauuauauauggaauucaaaaaaagucagugggacgcuuuaagguuauguuguagacauagauuaucaagaaugagcuaaauuuaaggagacuagcugagcaacaggcagugugaaaugagagcacagguaggacuuaggucacccauguacaggucacagaccauuaucgaggggggucaaagcaggagcucaguacagucagucccaucacaccuacugcggagcggagagagugaggcuucuaugcccuuccucugugcgcaucaagccuucuccugcucuauauggccccagaccgcugccuagggaauagugcugcccaugaugugcuggguccuacagucagucuguuaacaggacagccccuccccaguaugcccacacaccaaccuguuacaggcguuuacucaacugagacucuuuccccaggugauucuaaguuguggcaaguugacaucacaguuccccuaacguguacguaacaaguaugugacauagaugcuguauccucugcuaucacuauggcuugauuucaauaaauaucuucuuuuugaugacaaugagauuuaguaaaguuacagaaugacuccagaaaugagguuuuaugggccaauauagaaaauuuaaucuacuguuacuucagaagagugcuuaaggcuaucuguuauuagauuuuacuguauucugguguuauaaguucauauuguaaaugaguuugggaguaucuguuaauuaacuuccuaauauacuucugaaugauacuuuucauuauucugcugcauaggaaauuucaugaaucaguuugguucuuagagacauaccauccuuucuaaacacuaaauuuauuacauaauacauuugcuaccuaauggucccauggaaugagucuaaauaaagcaacauucuguaccuccuuuucccuccucugccuagaauuguucuacacugagagagcucauguccggacacugaagguucuugaccaaguauucuaucagcgaguguccagagaagggauucuaucaccuucagaacuacgcaagauuuuuucaaacuuggaagauauccuucaacuucaugguaagcaaaguuggcuugugaccguugugucuacauuucuaguagagagaagacuguguaaaagcaccuuuacgacacauuacagauaggagaguaccuaaccaaguuuauugaggaucuagcaaagaaagaugauuggaucuuugacuaaauauuuuuccuauaauuuuauaccagucuuacuuuuuguauacaaguggccuuuuauauacauaugggcuuuucugaucuaaaguuaguacuuaaagugaaaaacaugaauaaugaaaauuacccuugauaauauccuaucaguuacuauauguauguguguaguuuaaaauguauauugcauauaauaaucugcauguaaauauauuuuauaaauaguaaaauuaaauuaugguuagauaauuuccagcaaguuccgcuguuugugcuuagggcacguuuucugugcccggccccagcugacucaccuggacucagagggaguguaagauguccuuguugccguaccccacugucuacagaauuagaccuuaauucucagucuuucuuggucaaaggaauuagugguuugucaaacaaagccauucuuuuuuguggcaguuucagguuucauuggcaugcagcgguucuuuacauccagagucuuucugagcugggcuacacagugagaccuugagggugaauccauauucaguguagccacacuauaggcagugugcuaguuccuaacaacagaguuuaaaaugguaggaucuguguccgggaagagcuuuggggaucuagcuguguaugugcuguguguagauuacauuaauggagauugggagcagcugugcuacucugaaaacuuaagaaguaguuaacugauuuguacuaccaguaguucgauuuaaaauaagucuggacuuaaccuuuuuuuuuucuuuuuccucccuuaguuggguugaaugagcaaaugaaagcuguccgaaaaaggaaugaaacuucuguuauugaucauauuggggaagaucugcucaucuggguaaggaaacugagaaugucuuuuaauuauuuuuauagacauuugaucagauucugggguaaguaauaaauguguccagaugaaacacauccauggugcagagcuaaugugcaaagguggaaaggguuccgaguauucuuuuauuguguaguuuguuuuaaucaguaugcaaucagacucagugcuccaucucauugagaugcagguacacugguuccuucucuuaaaggagaaagaguacugcauccugucgguuuaggugacauagaaugccuaccaucuucuguuguucagaucuuaaacguguacuguauaauauuagguaauuauacugcauaagugucaguagugaaaacgacuuaaacuuauuuccagucuaaggaaagaauccagaggcuguaguaacugcagcuucugccugucuuucagucucacugucugucuguacagauuuauuuuguuguguuuauguuauuguuuugccuguguguaugugugugaaccacauguuguggcucaugcccacagaagugagaagaaggcauccaauccaguuuggauucccuggaacuguagcuaucggcuguugggaacugagccuaaggcaucuacaagagccacaagugcucuuacucagccggcuuuccagccccugauugucaacuuauauugaauaaaacuuuauaguucuagagacgguggcguguaagacacauagcuucugcugucacacaguguauggugggaaaaacugugggaguuugauuguuuuguuuuagacagagucucugcaguuagacucccccagaucuggcugccucugcucccaagugcugaauugagagguguggggcagaaaagagagaagagagaauguguagagaauuuuucccagucuugucccuaggugacugcagaacugcuaggaucccagcaucucauaaacccagcuguuccucauguuccuagugccugagggaugaccugcccuugacuuugccagucucauccuucagcauuuauuuuuucagugcuagugauugaauucagggccuugugggucugacacaaguguucaaccacugaaucauguucuuagccuaagcauccugucuguaagagaauaaaaguacaaacuuugaccaaccagcuagaauacuguguuauauaauguacuugaugauaauaguucaucuauagauaugcuacaaaagaauauuuuacagaaugucuucuuauaugauagacauuuagaaauguggaauauuguacggaaaacccucuuaacuaaguacagagcacuuguuugcaagugugaaacugucaggaaagcuagcuucgaaguuguaugugugacacccacacucaggacacaggcaggauggcugggagugugcggucagccuggauaaucuagugcagucguucuuagccuguaggucaugcaggucauccuuuggggaauggacugacccuuuugcagagguugccuaagaccaucagaaaacacagauauguacauuacaauucauaacaguagcaagauuacaguuauguaguaguaaugaagauaauuuuaugguugggggucaccacaacaggaggaacuguauuaaaggguugaagcauuaggaagguugagaaccacucuaaaacaaaaauaaacaaaauagagauuauaguauacaacaaaaaagauucuuuugacugguaagacugccuuauaagcaaagcagucguuaagcauuucacugagaaccuucaaguuaggguaugaguaaaccuacagauuaauuauuacaaacaaauuuacagggguaagauacuucuaagaggcauaauauauauaugcauauauaauauauauuugcaaaagagauuuacaaguucauggcucuaugccuaggcuuccuuuagcccuggcacaggugacacagaggggaauuuuccuucugcuuccacuuggcuugugauuguaguacauuuccuaaugaguaggaaggaaagccccuaacacguggauuucccuguagaacaguaggcgaguucuuauaaaggagucagagucuaugagaaugaaauaagaaucagucuccaggcauuuuguguugcauacuccccagaugucaaccuuucuaauuuggaagcaguguagacugaaagguaacaccuccuaggugacuggcauauggccugugcugucagggugaguccuuaauguaguacauugcuccugccucuacacacaaagucccgucucuugcauuugaaaaugcucccugggaugucgaaaggauuguggcugccuucaucuuacuuggccucacagaugcucaguguuucuuucucauuucucugcguucuuggcacaguuuaguggaccaggagaggagaagcugaaacaugcugcugccacauucugcaguaaccaaccuuucgcccuggaaaugaucaagucucgccagaaaaaggauucucgauuccauacuuuugugcaaguaaguuaagcaaguuauaugaucccaugauccccaacaaguuuuguauuaauuacagaauaaacuugaggaauucugacuuacaguguucaucuguguuaacauuaauauccccccucauuuauguuuuuuauucuaugaauauggauguuuuuccugaauauauguuuguguaccaaguaugugcaugguccugagaggccauuggauucccuggggcugcaguuacagauagaugucagcuguugccacaugggugcugggaauugaaccuggcuccucuggaagagcagccaaugcucauaaccacugagcugucucuucaaccccacccaauaugucagcgucuuaaaaaggcuuuauauugcaucuuacauuacuggaaggaauaaagaugcuuuuggaaugaugaguaauaaaagauacacaugaaaauugaagcauuugacguagauaucuguuuccauagcaguuuuaauuaggaaaacgucauuuucagcauguucugcagucucagcaagcacucuucacugagcuauagaccuagcccuuuuuguagccuuuugugguaaggucuuauuaaauugcccaggcuuguugcucugucugcaccucuuacuagccaugaguuuauacaggccugugcuacuaggccugaguuguauucacuuaugaaaagcauauuguuuaaguuugaggguuuuuuuuuuuuuuuuuuuuuuuuuuuuuuuaucagacuugagaggauuguaaaagugcugggguagggaugggaguagauaagagucuggaacuguggcccuaggccgacuccagccaccugcuguuuuauaaauaaaguuauuuggacaccaugcaucugugcccuguugcugccuugcuaagcagcagucacaguuuuguauggccgcaguguaacaggacccucucucucccuuggauuuuaucguauguacucuagaguugauauccucaccugaagcuugguuaagccaauggcugauugaucaauugaucgaucuuuuaaucaauuucucuccucuccucuccucuucucuucucuucucuucucuucucuucucuucucuucucuucucuucucuucucuucucuucucuucucuucuuucucuuucuuucuuucuuuuguaaaugcaaaaugagguccugcuuucuggcucguuguuggccaggaacuagucccagcuccucgggauaccugucucauccuguggccuuugagcaguguacagaguggauuuuugcuucuuauccaagccaguaggaauucuuuucucugguccagauuguuuuuaaaguuagggguugagagauggcucagggguuaagagcacuugcagcucuggaaaagacuagaauuggggucccagccacuucugauugaaucaggccaugccuccucuuuugauuaaaucaaaaucaagugauaguaaacuaauuauagaauagauucuacccacacuccaggggauggaaucacauauacccgagaauggaaaucuuuuauuuuuauuacauaaggacaccuuaaagguuuguauuuuuauuacauaacgccauguccauucaucuaucacugcucuuuguuaaaacagcagacucaguuguuuaagaaacugucccagagagucggaaguguguauuguuacauucuuuuaaggcuuguagaccucugaugcauauaaccuagcacguccaaacuagagauccaugguguuugcuuagagugguggauaauagguuaguaaauguacuuguaacucuuuuucuguguagccuuggcuguccuggaacagaaguaggauugcaugguuuuucucccuuuuuagaagagccuuugucuaauaaucaggccucugaugcaguggcauuucuaguaaauacaugauacacguuuuguaauuauucguccucauacacuuuguuaguugacuuccuccacuuugauuuuaggacgcugagaguaacccccugugccgucgucuucagcugaaggacaucauucccacccaaaugcagagacucacuaaguacccgcuucuuuuggauaacauugccaaguacacagguacagcauuuuggcugaaagaaaaguugggaacuggagaaauggcuuagugguuaagugcucuugcuaggaccagaguugggauuucagcagccacacucgguggcucacaaccacuauaacucccaacuccaugagaucuaacauccuuuuugggcucugugagcacccacaugcauagauucuuauacagauaaugcauacaugcacuuucuuuaaaagaaaaaacccaacaauauguccugcuaaauaaguaaucuuucauagcauucugaugcauagaauugauuucugcugguuguauggcagauauuuccugagaagacacaguggcauuaucagccuguuuggauugugcccucuaauaguucagacccagaguuugaccuauuguggugcaaaggucacauuaaggucccugccugguuuuuauuucagaauuguuuuuuaaagacaaaguaucacagagcccgguucaucaugaacuucauauguagcugaggguggucuugaaccccugcucuuaccuccuaggucagugguucuuaaccugugggucaagaccccuuuggcccaccucuaccucuaaaaguauuuacauuaggaaucaucacaguaacaaaauuggaguuaugaaguagcaaugaaaauaacucuaugacuggggucaucacagugugaggaacuguauuaaagggucgugguuuuagggagguugagaacugcuguccuagguggugggauugugggcgugcgcccccaccccugcaucucgcugccuguuguugucagcaagcuucugcuggaggcagcacacggaggccaucuguguguaugcuuuuucugagagccuuugcacucggcagcagaacugaguauauggccuacaaagugucaauugucaccugacccuguaaaaaaauucacccauauuuguuuuggcaucucucauuguuuuuaaaaggcuuuguacuaggucagagagauguuuugugucuauggaaguacuuguaggaagcugaauaaaugcauuaucauuccaacuuucucaucuugagacaagaaaugauucugaguuuuaugccacaaacuccugauucuuacacaugacacuaggaaugcguauugggaaucccagacuaugguaccuggcauaaauguggcucuacauccuacucuuaauguaucuguccaguggggccgcuguacuguuugagauuaguuuccacucgagucuggcggcucucuucacugcaguaaugacagaguguccgugguuuuggugagcuucaucuucuagcacugcuaguguuguacuuguuccuucuuuaaauguggucucaagugcaaacuuauucuggaauucuucagaguuguuauacaaaaaagacugcauaagaggcccaguggucauaguuaucuaaguuauacacugcagggguaagagaggguccuguuuguacagcuuccagagaccuuccuuguuagugccuaacauugggguuuuaauacaaggcauuacucuugcaucuagggcucuguauugugcuaucuucuuuccuuuuucauccuuuuuaauacugagauugauuuacagguugcauguuagguaagagcucuuaucaauuagcuauauuuccagucccuuaaaacaguguuucgggcuagacagugcuggcacacaccuuuaaucccagcacuugggaggcagaggcaggcauaugugaguuugaaaccagccuggucuauagagugaguuccaggagagucaaggauacacagagaaacccuaucuugaaaaucaaaacaaauauuuuaagacaaauauuagcauguagcuaaggcuaacugcgagcuugugauccuccugccucagcuuuguaaguagcaugcaacuccauagauggcuuuuuuuuuuuaaauguuuuuaaugagaauguauguuuuaaguuacgauaaucagaaggcugaccuguguaaaacuaccuggauagagacugugccauaggauuuuuuguuuguuuguuuuuuguuuuuuguuuuuuguuuuuuuuuccgagacaggguuucucuguguagcccuggcuguccuggaauucacuuuguagaccaggcuggccucaaacucagaaaucugccugccucugccucccaagugcugggauuaaaggcgugugccacuaccgccuggcugugccauagguuuuaacaugguauaaaaauguuaaagguauucguauauaucuucuuauacucauuugaauaaaaugaaguuguguguguacauuuucuuuuugcuaauuuucuguuucuucccuauauuagaauggccuccagaaagggaaaaggugaagaaggcugcagaccauugucgucagaucuuaaauuauguaaaucaggcugucagggaggcagaaaacaagcagguaaaaaggaaaaauaagacacaggauucacuggggaccacuaaauggguacaucuggagucugaaauaacagagaggaucaucguacaacugauaagcaggacauuuguuugagucaaaaugaugaggccccaggaggaaauuuggugcugucugugaaauuaaauggccugugccugacucggcccugcgaccuggcgguucugauuguagugauuuacuggagagaagugaagagaaguuauucauggucauucuaggcuggaaacagcucaugaauucagcagagagcagguaaagcaacgguguacucagaacuuagcaggcugccagagaugggcggaauggaucuaauuagcauugugacgacagaagaaaccagacgcacaagagcgaauacacgucauuguaguugugugaacuuguaagauacuaaaccgauuugugauaggaaaauaaauaagaaagacaauugccgcugaggacauacauaguguagagaucuagccagacagaaauacaaggaaccuuucugagaccauacuaauacuccaugccuugguaggagauugaguuguacaaguguaucguuugucagaauucaugaaaaaauacacuuaaagugcaugcaucuuacuguagguaaaguuuaaaaaaaagaacaaaggggucuggcaagauggcuuagcagaugaaggccccuguugccaagcuaacaaccuggguucagucucuagcacccacgugguggaaggagagaacugccuuucccaucagcuuucccugaccuccaccugaggcccuccacauaaacaugcauaugcacgcacacuuacacauacgcaaaacucucaaaagaaaccacucuuuuuuuuuuuaagauuuauuuauuuauuuacauguacaugaauaugccauugcugucuucagacacaccagaagaggguacuggaucccauuacagaugguugggagccaccaugugguuguuaggaauugaacucagggccucuggaagagcagucaguguucuuaaccgcugagccaucucuccagcccaagaaaccacucuuaaauauugaacuuaaugauaugcacucucuaacgguauacaugcuacaguauucagugggguguguauuuauccaagauuauuuagaaaugccucagagcauaaggcaaaaccaauuguaggagguggagagacggacagucugugauaggcacagugacaagagccuuuuuguauuuaugaugaggggaugcucaaaccguuugaagcagucauuuuuagaaauuuaucauacagacauaucuauauagauguauagcauacaugauuagacauuuauccuacaacauguuuuaauacaaugcacaugacuaaaagccuauuuuauuacuguaucauuguuauugucaaacauuguaaguaaccucaaugcccagaguuugaagugugaaugcuaugugguuguuuacgaaaacauaucucucuaggugauauuauaaaguaauauccgagguauacggauaacccuucuacacagaggaagaggagcgcaucuuagcuugcuucucucuugcucugaucagacacuuaccaaaaucaucuugguaaggaaaagguuugucuggcucacaucuccauauugcaguccauccuggggaagcccaggcaggagccuggagccagggacggaagcagagaucauggaggcagcucacuggcuugcuucccauggcuuguucagccugccuuguuaugcagcuaaggagcaccugcucaaaguuggcacugccugcauaucaucccucccauaucaaucauuaauuaaaacaaugcccgcagacuugccuacagucugauggagacauauucugaauugagauucccucuucaggggugucaaauugacaaaaaacaagaggccagcagucagcauacucuaagaacggauaagaggacuauguacuggaaugcuaaugggaugccaauauuaugcuccuacaucuuguuuuuaaaaggcugaauauauacacccaaugcacacagagacaaacagacucauacacguguguauucuguuugcauaggauuuucucaaaagucacucaagaugugaacaucaggauugcuccuuuagagaaaacagaaggguaucgggugggaagaagaugcuuuuuauuauguauaugaugguaccuuccgaacuuuguacuguguacauggucuauggggucaggaacuagguauaagcuuacuuaguggccaccagguuuaauaaaagaccagaggggaacuaggaaagucucuccaaugaugaggguagggugagcugagaaggagggcucaucuggcacagcuggcacugcaguuuguaaaaugcggauuuaagacaugaugugauucagaagcaacgaggccauugaugcccacgucuaaccuuggcuccauccuguuuaauuuucagcgcuuagaagacuaucagcgucgccuugacaccuccaaucucaaguuguccgaguacccaaauguugacgagcucagggugagagaugguuuaaucauaauuaaaaacguaaaggacugugcuaaaggccuggcaggcagcuaacaccccagugggaacagccauccuugaaagaggccugccugguagauugucugcauuugugaccucauucugcuuguugaaugucugcucugugucaagggugcauucauauuuguuacaggaguuacuuuaugagaagcugugacuauguggcaagaauuguuggaggacuugggaacaugcguuauuagaauauuuuaauuugcucugugcuuuuacuguuuacaacaaggacuuuucagagugcugaguaaacauaauuuuucuaugacacuuuugaaaagcaugagcuaacuauucacuaacugcacuucugaugccuagacucuaauauuauauuuuacuauauauacuauauuuuuaggauauuauguuucuuuuuuaaaauaucagcuuacuggugguuguuuugguuacuuaaguaucuaugugcaguaaccuuguauguuauacacaguaguuguaucaaaaagcacacuaaugugugcauucccuuaccuuccaaagaacgugagucccucacgaugcuagugcugagauauggcucuuuuacuaacaguuaaguugcuggcagugauaguacuuagcauucucauaacaaauguuaugacuguuaaaacuuuguuugggaggcuggagaaaugguucagcagguaagcaugcuaggaguuagaauucuagccucagaaagccuggucagaugugcaccuccagcacucaucgucuguauccgguuuacugcagguaaggagugaggaucuguaguggcucuuguagcgcuguucauaagccaguccucaucagaggcagguuugcagagagcacucaugaaugguuuuccguaagaugcuucuccuuuagaagguuuugugcaggcuguuuuaaugugaacaguuccauuuucaagacggcggcaguacugugggugcuugugcaugaguccuuuuauauuaagacuguucugaaaagauacaguuaugguggcuggggcuccacugaugaaggauucuugggaguaauucacguauaauucuuuuuacuuuggcagaauuuggauuuaacaaaaagaaagaugauucaugaagggccguuggucuggaaggugaauagagauaaaagcaucggugagucuaguguuccugucgggugagaggguggagagaagagaacaggaaagucugcuguguguuuguuguuguuagguauaaagcacguuacguguucauuuaggaacagcauguucauuucggcagcuucaaccguauuuccuuuaucuaucuacuggcgaaucuuugaguuuucuauaguaucuuccaggcucuugcagggagggagcauuacuuuuuaauucuuguagcucucagaugaugcccccaugacauacuaaaaugaacuauuuaaagugaaaauuaaagaaguuugcaaaucuguuuuuuaaaauuagcuagguuuuccagaaauaauuuccuuugccagauuacuuuaaauuucuguacuuagcaguuucucugcauguuuaucucuagaucuuuauacacugcugcuggaagacauccuugugcugcuacagaagcaggaugacaggcuggugcuaaggugccacagcaagauucuggcauccacagccgacagcaaacacaccuucagcccugucauuaagcugagcacggugcugguucggcagguggcgacaggugagcgugucugcugcaggaugggagcguauggauucagggugaagcugugcaggagcuuccgcugugggaguagcacacguaacaaggauuuguucuguguguguguguguguguguggggggggggggaaugugaaugaaaugugccuauugucucgacacuggauugaaacuucauaccuccaaauuauuugaggcagcaagguugucccacugguuuucugcauuugaaaauuuaaauacauuuacuuugguguuuauuuuauguucaaauuggugauaaauaccaagaaaguugugagugcuuugaggguagcuccaacgacauggcugucauuaaaauaauguguuuguguguuggaaaaaagugaaaauugaagagguaggugaauuuauuuucuuuuguuuuaauuuaaucuuauuuuauguacgggugauuugccugcaucuguguaccaugugcgagucuguugcucuuagaggccagaagaaggcguuggauccccuagaaauagaguuaacagagcugccauguggguauuagaacccaggacucuuaacuauugaaccauuucuccagcccugaauuuguuuuuugguuuuuuaaauaucagucuaaauugguaagcaacaguuuaacuguauuaugguaagcuccuuuauauuacuuaauuucaugacagcaaaauuugcaaacucuuuccugcaguauuucccaaacauuuguaacaacuuagaaauacagcaguuuaaaacaaaugugaaaggaguagcauuggguucaguaguauaugugugugcccgugcgugccugugugugccuuugugugcaugcacgugcgugugugugugugugugugugugugugugugugugugcacauguguucauauaagcauuuucauuucagaauuguaggcucauuagaacuccaaagcacauuauacuugggcaggacagagccuuuauagaacagaacuuuuauuuucuuuuuucuuggauauuuucuuuauuuacauuucaaauguuauccccuuucccaguuuccccucuuccagaagcccccuaucccauccucccucccccuguuuauuugaggguguuccuccccaggacagaacuuuuaugaagucagcuauguucauuguuugagaaucucaucuguguauagaauggacaguuuugguuagauucacuuucuguucccaucccugcuuuucucccuuagcacccccccacccacuucucugucccagcuuaaugcgcucuuuauuucaacccccagaguccaaggaauuugaacuuugacuuauuuuuguuuguuaauuaaauuccauguugacuuuuauaaacauuauuuaaguuauaauguagcacaauuuaaauuuacauacugaauaaaguuuuucaaagugaacaauguaauuuuuaucuaaauuaagaugcagaauguuaaugccugcaucuggguguauuucaugacuagaguaaaauuuguuuucuucuuuucuagauaacaaagcuuuauucgucaucuccaugucagauaauggagcccaaauuuaugaauugguagcacagacgguuucugaaaagacaguguauguaucagauucgauugccuuuuucugauugauacuguacuauccaaaguauaaaugauccacauacuuguuuucuuaagauuaauuucaauguaugugcaugugugugugugugugugugugugcgcgcgcgcgggugccugugcacaugugugcagguaccugcaggagccagaagaagaagguaucagauccucuggagcugauguuacagguaguugugagcucacuggguggguacugggaacugaacggcuguccucuggaagagcagcggacucucuuacugcugagccauccguucagcccacagauuuucuuuuauaagauucugaaagacgcuguagaaaucaaguacuuccucuuguauucuuuugggaacauuccucuaagaacuuguuucuuuugagauugaaguuuucuuuuucuuucuuucuuucuuucuuuuuuuuuuuuuuuuaauucuacugaaaguaaauuuuguaaagagaacaauguucagaaguuccaaguuaaucuuuuaaaggaguaaugugcucauguuagaauuuucuuuaaaguauauuuuagaaucuccacaagagugugccaaaauaaagguguucucuggcagcgcagggugcuuggguuugguuuuucucuucuucauugugaguguauuuacggguguuucugcuuuccucuguguucugaaucucuuucacacccccugaagcuggcaagaccucaucugucgaauggcugcgucagugaaggagcagucuacaaagccgauuccccucccacagccgccaccuugcgagugagugucguguucuugucgggaagauaugagcaguucuucacuugaaugccgugaaguuugggcaucuucuggagcucaaggauuguuucuuuucuuuuuccuuuuuucauagaggagacaaugaugaagaagaaccagccaaguuaaaaguggagcaccaugaucuuucagucgcuggucugcaaaguccagguaagccgcauagacaagugugucggauguaagauguuaccuauuacaacgaaccaugcgugucagcagaugcuaccucugagccuuccgugugccagcgcagcacugcucugugcuguguuuuccccagugcaugaucucuguagcuuaugugacuuaucucugcccccaacauaaguguucuauguugaaaaggaaacgucuguuuagguguaaccuaccuuuucugcuccacugaacagacagaguuuugggauuagaaucucccuuaauuucgucaaagccucagucucauucacugaauaccccuggcaaaucagcggcagaacaucucuuugugaccgcaacacaguuugcaaaggaacagcaugcaaauggggcacucaaggaaggugauggcggguauccagucacaaucccagguccacacuugccugugucagaggagcggugggcauuggacgcacugagaaauuguaaguuuuuuucauaacuuguggagauacuaagucccagagucguaugauguguuggaaagccuuuaagggaaaaagcaaugccuuguggaaaauacacaaaagucuaaccaaugauuuuuuuuccaagaaauuuauggucuaguugggaagauaauaggaccccacugccacuuuuaaaagcaaacauucuaggaauaauaaggcucugugugugugugugugugugugugugugugagagagagagagagagagagagagagagagagagagagagacagacagacagacagacagacagacagagacagacagacagacagagacagacagauccgaguuggcgugguuagagaaaagaagcagcagauagaaggaaaagaagauuugcuuguuauuugagaauuuauuaagaucaaaauaaauguguagaauagaaccauucagacaaaaauaucaguaggagcaggagagcaugcaggagccacagcaucuccaggaacagugagcagagcaggggccugugcacacuguaagcugggacagauuuagaaaucaagaagaugggcugagaggucucacuguugugaauuuuaaguaccagguuauaucuuccauauuugauggacagaaacauagaauuuuaggagcuguuuuauauuacacauggucugcauuuuauauggcacuuuaauaugugagugugcucucucucucucucucucacacacacauacauacauacacacacacacacacacagacacacacacacacacagagagagagagagagagagagagagagagagagagagagagagagagagagccuuguuugcugcccccucccuagcuccuccagccuuguugggaaccacuauuacagaucggaggauagcacaucucucagguacagugagguggagaaaguccaagaauaguugcucuggcuacagagaaccaugugagauuuuaaagcuagcuacgacggacaaaagucuauuaaucugguugagagcugcaugaggauuuggguggaugcuuggaguagcgcccuuacgcaggcagcuauuacaguuguuaggcucaaggcugaaaugguuagacuagaagaagcacuaaacaaggagucacuccauucuuagagcaggugacuucuguggguguuagggcaaaggaaaggggaugcacgucuggugacacuuggcagugcuuuccuaggaaauaagagccacacauaccacggugccucccugccuccaucacagcuuuucuuguacaguguggacuaggaauuacaccucaaaaugucacuauccagacagggaguggcaagccaucccaggggagugguagugggacauggaguuuuagggcuggaauuaaggugcuugagaaagggggagggguuuuagaccugagcucuuuauuggaaaagcagagggucagccugugguggaaucaggaaguugcaguuauuuaaaaucuucuuuauugugcauucuccugaggugacagacuuagugaugucugauagcuugauggcuugguccuagagcugacaucaccugcagaaguuugucauaagacuagccccaggguuaguuuuaacauccuaaaggagcaaugcugcuaguaagguaaucuaaacaaacaaaucuaaugaauacuuacuuuggaacuuccauauacuacucccaaaucauugccuucaccauuuaggacaauuguuaggaaaaaugccuauaaauauagagucugcucuugagaagaagagcauuugcuggccuagcugaaacagaugagaugcuugcugucaaguguauuuaggacuucuaauucaaagugccucccuauucaaagugcauaacucuugucaguguauuuuaauguuuaguguagaagacauauuuuuauugcaugcuucaagacagaaaugauuguguaggauuaauauuuugguuauauauuauuauguccuuaguuuuagaggggauugaaaacucagcugucagauuuugccuggcagugagacugugguaaucaguuuaacccucuguucucuucuucuugcccuaaaucuccagugggcuuguugaagcaguugcugguacagcaguuaggucucaccgagaagaguacucaggaagacuggcaguccuucucacgauacgggccagcuucugaagagguacaggcagacaguggcauccgggacuuggaaaauguuaaggcuugucaugccagggaaggacagaugucuuuuaaaacuggaacuggugauauugcaacuugugacaguccacggacuucaacugagucuugugcugcacaggauucagugauacuggcaucccaagacagccaggcaaguaacguuuuaguaauggaccacaugauccugaccccagagaugccuccugcagagccagaagggggucuggaugagaguggagagcacuuuuuugaugcccgugaagcacauagugaugauaauccaucagaaggugauggagcaguuaaaaaggaagagaaggauguuaauuuacgcaucucaggcaaguggcuuucacauuucaacuuugauugugauuauuauaaacugucuuauaugcuggaauggauguuguuucaguaucuaaggugugugugugugugcgcgcacgcuuauuucuuuauacaacaaauagucuguucuuugccaucuuugccagaaauuggcaaaggggcugggagauuggacagugaaaaaugacagaaacuucauuguuccuaagaagcuuaagugcccaaagggagagaguaaagguaaauccaaagcaagugauaaacaucagguggucagaagcauuagaaacaaacaaggccagcuacagcccgggcagagaguacugagagcagacguggugaugggaaaggccacguggauacaguguucagcagcaagcacuggcagagucugcuucuguagucagggggagugcggggugggagaaagcagcaggagcccaggaaaggguguguggaggugagugauacuccgcuugucauguaaggacuuuguagcuaagguguuaaacucaugaaaguuugcuaagguugacuuuaauccaaaguaaauucugguagaguuaaaacugaacuugggaguuggggguuccuccaccaggguagguuuucaaguuguccuuaugaccucauucugguggcagugcuaaucucaucacacuguccuguuaccaauaggaaacuguuugauccuugauggcuaugaugcaguucaggagagcuccacagaugaggagguugccuccucguucccccugcagccugugacgggcauccccgcuguggacuccagccaccagcagcaacauuccccucagaaugugcaucccgaggggccgguuucaccauucaccccagaauuccugguccagcggcacuggcgagcuauggaggauaccuguuuugagauccagagucccucauguacagauucacaaagccaaauccuggaguacauucauaaaauagaggcugaccuggaacacuuaaagguaugucccauuucagccuccguagcacuugguccuaagaacacagcuggcagagugcaaguuuggaaugauggaauccugauguccaaagaugguccagguucugugucugccauuuuuauugucuuuaaccauuaaucaugaguaggccuggaucagagcugguguugacaugguuugucuuuugacacauuauaagaacaagaaaacuguaggucuguagcuaauuaccuguuuuuugggcuucuaaguuuuaagacccuaaauacugggucaguugguuuccaucaugcuggaugaugcgggcgguaggugggcuuucguggcugucaaucacagccaggaauagcugugagcugcuguauccuggcaguuacaugugccucauaaauaguguugguaguuucucggaggccaugucaguuacaaauugacuccaguggcuucuguuacaaaaacccaugagcccaaauggagguagugaaagacguuacugugcugguuuuuuaugaaagagacucuauuuuauuuuaaaauugagaauaaauuauuucauacaauaucuucugaucaugguuccccuucucccaauuucucccagauccuucucaccuugccaccuagucagcuccguggccuuucucucuuuacuaacgugcaggcaaauuaaaaaagacaaaccaaccagagugaaaucaaacaauaacaacaaaaaagaaaaagcaugagaaacacacgcgcacacacacacacacacacaagggacaguaagguaagagcaucggcccuggugacacagcugcuggagcucacacuugcccaugacaucauuuaggugggacacguagugucgacggaaguccauuagcucagggcucaucucccuuaacuuuuuuuucugcuccauguaauagguuuucuucuuuaaucucauguaugucacuauguggccagcaaggcaggcuaucuaggaggccucuguguucaugugucaugugaccuucccugggugacaucugccaugggcagguuaccuuuacuuccuuccccuugcauagagagguagguuacucauucagaagaaauuggcguccuccuagcuaacagcaucuuuaguggucacuguuaauguuaaaauugggggccaugugcuuucaccccuauugucaacuaaauguuauuuuuuuugugugugugccaucccaugaagaagguggaggaaaguuacgcucuucuuugccaaaggcuggcuggcucagcccuccccgacaagcucucagguaugugaaguggugggcuuauucugacuagcaguacacuggauaaauaauuuauuauuuuccaacaugaaaacccgugauuuuguuccuguccuuaaaagauagcuuguuucugagcauccuguaucaaguuugcugacucugcucuuccugcucacaggagagcugugcuuguuagucccugugccagcucucgucucucucuucaccuuuccaagcugaaggcagaguggagggaagccuggugcacucuaaaucaauggaccccugcgcugccgccacuccccuucccugggaggagccccgcuguccucugcucuccugacaccaaggccagcauggccccuggcuguggcuaagccuguguucagugugccaguuuguacucguuugcuuguguacuuugaguugacauaucugguuuagaagugaacaagccugugccugcagguugcauacauguucuucacaauguuaauuugcucuuacuugaguuuccacauaucuucuuccuucucagauaaaaguuagagccccguguccuggaggugacugcagcuuguuggauuuugagugucggcccuguaucaaccacauccuggcuccaguguggacacagagagagugcgacagagggaucugccuggaaccaccuggccucagccaggccccaggggccccgcggggacuaguucuuccuucuggcagcugcacacaucugucagugagggaaugccaggucucucacgccucuccucacuaucagaaaugcauuuugauucagaguaaaaaccaaauguauagagcuuuggguguaggauauaaaauuguacguagguaagaaaaagagaaaaucagauguauuuauuugacuucauuccguauuugaaagcacacuuuaauuuuuacuuugccuuguuuuguuuuuaauugaguagugagaguuuuagcccuuuguauuuagcacacccaaggaucaauuguuccugaagccgaggucaggcuggggauggagagguuaguagacaggcagugcagaagagcaaagaggacuaccuggcccucgcuaaucuguaacccagcccuccuguccagaaggcugccuuucugaggaucaucucagaggugcugcaugacuccuguguguggaugccaugagcugugugugcccgggugcucggagcaggaggaccuccucccagcccaaggcgagcaucuccuacuggguuccauucccaggaaacaggaauccucaguacacuaaauggcaggcacuugaaaauggguggauuucccuugucguugucuuuucuauugauaguugggauuugggagagaagaaagcaaauuuuuauuuucuugauuauaaauuuguuauucuugguauuguuacauuuguauaauuauacauugacuggcacuuguaugaaauauucccugcagagugagcaggaaauaggaacaaaggaauggaaugcuuagugguggugggggugcuauggggggugggugggagaguugcagacuugaggagguuuucgaaacugaaucacuacugaguugaaccauggcugucacuagccacggguacugcugauuauaaggccaguaagaaaauuaguaccuggauguuugacucuuaagguuuugcacugauggugccaaagggcucugagucacacgcagagccaagggagggcagaggaaggcaugaaggagaguugcucgcaucgcaucccuucagagagcuuucucugaccucacugccauagcccugucugucuggugccaggacuggccuugggaacggggaccagcggugagcaguugcagccgccaaggugcugacgugcugcaguguggacagcgccuguggagggccagcuggucagacuguggccugacaacucuuaauucugaugguguucaguggcuugcuuugugcauuugauaaauauguuuuuagaguguucuguaaaaaaaaaaaaucauuugucuaaucuaaauucuguuaagaaggagcucacauguugcuuacaucuugcaggagggggccucugaacucugggggcagucaggauguaauuuuauucuccccuuaaugccccucacacaaaggaagcucacugucgccaagaauagucccccagcugcuuuuaugaacaccucuacaacuuaacaagcucaucugucuggguccagauucucguuucuguccucuaagcucuuacgucgauuggcuaggaccccuguaccucaucuauaaauuggaaucauauuuugagucauagucaacccuaacucauaauggagcuuugagauuuuggaguagaaucuaauauauaagugaaguuugggauuuggaccucccuguaucucuuaggagaagcaaguagagaccgaaugguuccguugucuuccaggcagccucuuacacuacaccaucuggguagcucaucagacagcaguguuccgaccucagacacuacagaucccuccgugguucuccagcacaguucagccggaacucuguucuccugcuuguuuacuucccucuuucugagucccagccucucagagucacagcagggcuuacuggacagguacucuggcguugcuccaguacuuccaaauaaaugcauaucauuacaccuucagaugaaaccucagaaugaagugcauucugaaagacaacagcaacaaaccacuuuguaaguuuuuuuuuuacucuaccagccuuacuucuugccuguuccccucccucgggccuccugugccuuccacuccauucuggccauuagaauccauuugacuuugacauuacaucucccuuccgugguggcgacagcaguguuccuccuguucuggaaugagauggucauugucauaguccucuuaaaggugggugacaagaaggugcaguguacuucugcuccaaagaacacuaggcaagcggaaagccaugugugccaugggugcaaccugugacccugcucuccugugagcuuaguggcucuccugucacuaacuggcagguuauguguggagugucaccuuuucagagagaaaaacuaaccaagccaaaccagcaaacccuccaaguacuguaauguaaaggccggcuuuggccuuccccaccuguauaguuucauggcagcccccuggacuguugaguucugcugcuuucacaaccuaaacuguaacuauuuauuguaucacacgcagguuguucaugaguauuuuuuccuuuguuuccccaaacaacuucuuuuuuuuuuuuuaagucuuggaagcuuaugguuuauuguggauugcucucaggagaguaagagacaagaaaagcaacauauauguggggggagggguuggaguggugguggagcaaagccagcuggagacaggcuccagccuagacccuugaagaccagagagcagcaaugcaccauacucuugauuucauggggagaaagggggauggacccccaggccaggagguguaacuccuagcugcaccuguuuccauaugaccaagaguaaucauccgggaaugagagagucuauaaagaacacucauugcugcugcaggugagccagacauggccaggugacaccagccaugucucugauuucagucaacucuuuucauuuguuuccugaauagcaaacacuuccuugaaacucuucucaaacuuggacuccagucuaagucccauuucgccaaacuuaggguccuugaacgugauuuugugauuccggaagaugagccucaugucuugcacaaagucuucuacuuggcaguaagccuggucacucagcuuuuucuugauuauguucaaccacauaggcucuugcacacccacagucaucucucuaaaauaauaauaauauggcaucuuggaaaaaaaggagcucucagaacagcaauagacucucaagagaacauacucgcacuucaacuguuccuggggagccaucucccucugcaguaucucagauucuggaagacucgguugacuuccuaaggacugcauccuacagaagaugcaacuccaugguguuaucucagcuuccacuguugggauaugacaguccucauggaaggcucuggaacaaguaucacagcagaagaguauuccuccaucccggcacaccucacauucaucugaguucugaauacuagggucagcuggggaacgaugcaaguucuguguucucugcucuuuucuuuugcgauguauccguggaggauuggguagaaauuuucucuggaucaggaguuugaggggccaauuauggcagcgcaggcucaguuuccaguucuuugacuuuccauagccucccaucauuucaaauuccgagggugugaaccaguuuccauucugacacuguauggacuucacagauaucccuuguuugaauuuauccuuguguaacacucccuucaaguuaccacacgucacgggaagcaacucagcacuaaaaucggcauuuucuuuucugcgucuucuuagaccccugaucuuagcagugcguccuggguucuuuuucauuuucuuucucuugaaagcugccuggacaacagcuauucugccacguuuucucuguacacucauuggcuuucuccauuuugguuuugaccaguuguggccuuucuuuuuucuucucugcuucuuggguuuucuugcaggaauguuccuccuggugcccacacauucuccuuggcugcuucccauccuugcuuccaggucuucuggcacauauguuggggaacacaugacacaggaacacuucuuuucacguguggguugcugugcuccugggccaaaauuguggguguacauagguuuguuaucuaauuuuguaauacuggggaccaagcucagggucucauuugugcaaggcaagcagucuaccagugccccaaacaacuucuaaugaccucuagaaagaacaagcccuuuuuuagaaaguauuuuguuucauugucuuuuggggagugaagaagagaaaaguccuuguugccagaauuuuagaagcuaaaagacuuuaugcugccucuacugcaggggcucguuuucccgucgcuccugggcacuggcgcuggccugcugccugcagcugguacccugcccaagcugucuucucugcagccgccugcuugagcuugcucugugccugcuucccuccacgcuccgaaaaccaugaucuacaaaaacagacuucugcaaggucucgcucgccugcccacccgcccccuaacguuguguugguuuugguuuuuguuuuuguuuuugacaguucacccccauuuagugugagcuguaaaacuguacuuuauuuaaaggcgugcucuuguucccgucuggcugccuuccccaugggugcugaggguuuggguaauacacugaucaggaaaagguggucuucucagaaaccagucccucccucccagccauugccaggugccacccgcuaagcagacauacuacagcaggggaccguagcgugcacacuguuggugguuuuuaaugagccucucuuuccccacuaggcugucucacuuuacuuguucaccauacaaucauuuacucuuuaacaaaaauugcuuuuaagagaaaucuggaacuaucuuuaaaaaaaaaaccuuauuaauaaucauguauuuuuacugaucacauuuugaaaugccuaaaagacuuuuauugcucuaauuauccagaugcaccuuuguaaaaagcucuuuuaugaauuagcugauaaggcuguauguuucuggaacaaaauauugggucaucuaaaacuuucuguuuucuggggucugggaaaauagaaaauaagaauucaaauauuaaauaagcuuaaaagaacugag

SEQ ID NO: 12435 - RNA, 6272 nt, Mus musculus
ggcccgucugccccagcccagacaccgaagcuacucuccuuccaguccacaaacgaccaagccuuguaagugcaagucaugggagcagaagggcugugggcucaauuagauccccuagucucuucuaguuugcuggguggaauugggucccuagagaccauucucuguguuagacaaaaagucuggguuaaaaugccuaggaugauuugacuggggcaaaagaauaaauggggugagagggaggcucaaauuucagucacugucccacccauagguguaugggcuauguguuaggcccaaagaggugacaaaugaggccaagggaacaacuccaucuuuggaucuccaagaaggugaggggcuaaguucuggaaagcagugacccacugaugguccccagggcuaaugcaacucgggggagccaggagguagcccccucaggcaguggaggacuaaagaucuuauuuuuuguagcgcuagggaucaaaccccagggcgcuauguguggcaggcaugugcuccaucuaccacagaaguuuaaugcuucagacuagccugggauagggccugcuuuuucuuuccuuuucucucucucucucucucucucucucucucucucucucucucucucucucuuucuuuccuuuucucucuuucacucucucuuucuaauuuucuuuuucuuuuuuucuuucuuuucuuuagacaggguuucucuguguagcccuggcuguucuggaacucacucuuuagaccaggcuggccucgaacucagaaaucuaccugccucugccucccaagugcugggauuaaaggcgugugccaccacugcccagcuaagguuugcuuuuucauggcagcuugguccaguuugaaaguaggaggucaguccacuguaggcagauaggugacagguggcagauaggugacagauaggugacagguggaggagcuuuggaacugggacuggacagcccugggaccccuguuccucccaaagggucuuggugguuccccuuggggcucucuaaaggaugucagugggcuguugccacaucuauauaagaggacuagucuucuggaauuuaggugugaucucucagggaugcagaaaugcucacccuuacugucauuuuaugggcugagguaccacaggcagauauacccugguucugcuuguuguccagggucucugcuacauggaggccccuuuccacagccuaaccucucuaccugcugacaggagggcuggauggccacaggcauccaagcugcgcaucaugcagguguuuugcguuggagcuuuugucuagaaauacccuggugggcugccaaaccaccacccauaucccucucuccucucugcugccucuaagaugacagcuugauuuuucuuauagugauuuuuuuuuuugguuuuguuuuuuuguuuguuuuaaguuagcauacaaaguaauacauuucaucauggcauuuggacauacauauauauuuuauuugcucuccuggccucuucucaaagagacuucucuggacuuucuuguauuuuugguugugagccuagccuuuaacggcugagccaucucuccagcccuucuuuggacuuucuacuucauacuucccaccagucugggaagaagggcacauggaaucuugagagcaugaccugacccagaccugacagaugucaaggcugcaguguaugcucuuguugcuacggcuuguucuuaguccugcaguucagaacuuucuggagacugagaagugcaugugaggacacucuccucccaucuuuuccucuaguggcuagugauguuugguuuuuuguuuugagacaggguuucucuguauagcccuagcuauccuggaacucacuuuguagaucaggcuggccuccaacucagaaaucugccugccucugccucccgagugcugggacuaaaggcgugcgccaccacuguccagucaggaguagaaggaaacuguaaggugcuugagacaggcugaguagaggcuaggaggaaggggcuccgcagucaccggcuccaugacucugugacuuuugugguuccuugucgcagcgguuccuggugguggugguggucggggguuggggggagggggcaggccacacaguggggugugggagggaauagcuguugacaacuucccaacagaaaccaggcuuuugaguccuccaggguagcuugagaggguacucagaaagccguguccauguccccuuuccuucaccucagggaaguaaguugccuauaggguugucauuucaaugaggucuucugguuauucuguuuuucucucaauguugguguugggcucagggaaugcuuuggagaagguggugggaacuggagaagggaagaucaguuuacuguguaaacucacugguuaaaguacccccucccuuccacccugcaauacacacacacacacacacacacacacacacacacacacacaccccaucucgaagagcucuauuaagcuccaggugcacuguaguucacagacugcaucuuccagguuugcucccacuucacaagcagagaacucauaacugaagggggugacagcacaggggaagggaaagcaagauguuuagagucugacagcuggcccgggaccagagccaugugguaauguuugcuccacucccuaccaccuccacggcugugauguggagaagguccccgcuuucaugggaaggaggugggggagccugucaucugcuccaugcucacacaauuuuucucucaaccaaugaccucucagaagcagggguugguuugcaaaauucuucagauaccucaacagauggcaucccacucaggcuaucccugcugacuaggucuggcuccagcccugacuguaucuacccagggaccuaccugccugcuuugcuccuauagccuuccuccgugucuggguccccagagagcugccggacauaggccuuugaggcaacagcuggcauacaggccaggcuucccaugcucuggcuagcagauucucugcccuggaggacuuugacugcaugguuucucucacugcugcaacagucagagcuggcccacacgggcacaacagcgcacuuccaucugggucucccugagaaugccgcuguuuucugagaacccuuggacucugguggcuuuaucaggucuuuuugucagcugcgcuuugggggaugaacuuugcucuucuggcuucugggucagaggguaaagauuugguggcaaccgguagcuagagaaagauagcuacuggcugaauuuggaggacauggcuucuggaaaaccucucuagugcuuuucuggcuagucuuggcaaaguaaaaaugcucugauagccagcccgggugaugcagggcuuccuguucgaggccuuucuguacaaaauuagugagacauugccucaaaacuaugaaacaagccagacucuguugaagcacgccuuuaaucccagcacucaggaggcugaagcaggcaagaucucuguuaguuggaggccagucuacaggaaaguucuacaacagcagaggccagacagugcaacccuuucugggggugugggggaggaaaacccaacaaaaacacaaacuauaaaacaaagagaaggccgaggacaaagcuuagcaaugcauacuucccuuucuaugugaagcccugggcuccaccaguacugcagaaagaagcaagcaaugagggacaggagguuggcucuaggccagggguugucaaaauaguccacaggccaaaggcagccugaugucuguuuuuauaaacaaaauuuuauuggcacacauugguuauguaucagcuaggcuauuuucauacaauagaggccauauggucuguaaagucuaaaauauuuacucugcuguuuuacauaaaaaguugacagacucuugcucuagacugacaaauaucuaagaccuuguuuucugagguucaaguucagaggggucucugcagcaaguggguaaagcuggucuaggucaugcuaugaugucuagggucccucagaguggaaggccugcuuagcacaaaugaaguaaaguaacuugcuggcucuuuguucuuuucuccacacucuauacuuuagcucugccucaacauggccaacaaggguccauccuacggcaugagccgagaagugcaguccaaaauugagaagaaguaugacgaggagcuggaggagcgacuaguggaguggauuguagugcaguguggcccugauguaggccgcccagaucgugggcgccugggcuuccagguguggcugaagaaugguguggugaguaacccuugcgaagggaaucuagggauguguaugccacccuacaaacugugagacagacucccugagcugaguguucaguuguguucuguaccuggcagauucugagcaaauuggugaacagccuguauccugagggaucgaagccagugaaggugccugagaacccacccuccauggucuuuaagcagauggaacagguggcucaauucuugaaggcagcugaagauuauggagucaucaagacugacauguuccagacuguugaccucuaugaagguauaaggaaaaaagggcuggagccagugggcgaguggagagcaagauuaucagucaaggagaaggaauaucaaaagccacaaccagcucuguugauguguucauagcaggaaugggauaugccaagagaacacauagcaaggggaccagcuuggugguacagcauuucccuucuggguacaagggccuguuuuggauccuagaauaucaaauauauaccacaccauacucacuaggguuuagaauauggucucuugaacccucuugauuuggugccacuugcucuugguuggaccauuuuugaagcugggcagguauugccuauaugguccugaaauuagcucccuggccacucuucucauagguaaggauauggcagcagugcagaggacucuaauggcuuugggcaguuuggcugugaccaaaaacgauggaaacuaccguggagaucccaacugguuuaugaaguauguguccacugggucucucugugggguugggguggcuugggcuggucaguugugguaaagaucagguguagcagagccagggacgucccagguaaggguguuggacuaggggaaaugagguccuacuucugcauuccuaccuuuugccagcgugugcuccaccaggcucccuaacuccuggagccaaacucaggggaaaaaaagagaagacaaacaggaaaggaagggagucgaacagggaagcagcagggaucaggaaacaguuggagaacacuaaguucuagcaagccuuacccugguuccuuuucuucuaggaaagcccaggagcauaagagggacuucacagacagccaacugcaggaggggaagcacgucauuggccuucaaaugggcagcaacagaggagccucgcaggcuggcaugacaggcuaugggcgaccccggcagaucaucaguuagaaagggaaggccagcccugagcugcagcauccugcuuagccugccucacaaaugccuauguagguucuuagcccugacagcucugaggugucacugggcaaagaugacugcacaugggcagcucccaccuauccuuagccucagcccagcaucuuaccccagagccaccacugcccuggccccuguucccagcuguacccccaccucuacuguuccucucauccuggaguaagcagggagaagugggcugggguagccuggcuguaggccagcccacuguccuugauaucgaauguccuuugaaggagacccagcccagccucuacaucuuuuccuggaauauguuuuuggguugaaauucaaaaaggaaaaaagaaaaauauauaaauauauauauauauacauguaucuccaucuuuucuccggccuggcuggcaguuugguuugucacuccuguuagcauuccaggaacccugaggguggaagcauguugggcucacacguuccuggccgauggcuucuggaugacuccucuggccccacaggcucagagcuucagaggaagcaggcuauggagaagaagagugaccugcaucugcauagcucugguuuggcagaaggagagaauacugggagugguggacuuguuuggguuuuuauacuucugcuuuuuauuuuggaaagcugugcagaaaaaaauucaacaaaauguugcuuugaaaaguaaaaaucaaaucuuaagca

SEQ ID NO: 12436 - RNA, 323035 nt, Mus musculus
cagucugaggcaggugcccgacauggcgagugcugugcugccgagcggaucccagugugcggcggcagcggcuguggcggcggcggcggcgccuccagggcuccggcuccggcuccugcuguugcuccuuucggccgcggcacugauccccacagguagguugugggcacccgcggauuggucccgaaaacccccccgggcacccccaggagccguagcuauggaaggggggacguuuccaugacaaccuucccccacuuccuaaauccaaagcggcgggagcguggcaaggaaagucggggcugcgauggaaggggccgaggggucggcgccccuucucuccuauccgccggcugcggaugggcgcccucagggauggcugcacccacaccucuucuuccuggcguagcgcggggugcugaguggagugggcucggggccgggggcuagcgcguggggggaaggggagcccucggaggcgccccgaaccuuccggacccuccgaaacucgcucucgucccuggaacuugcagguccuccugugucccugggcuaagcuuucgcccccuccguuccagcucgcccccccgaucgauucuccauuccccgaagcuuucuccuucgcggguccccaggacauccccaccgucguguccucuucccggcuugcccgcgcucugcagccaggucccccgcccgagagcucugcacgccucucguguuucccuccagccgaacgcugccccucggcccccuccgcuaggcugcgggucggcuuggcuggaauccaggcagggaaaguucccggcucgggggcggccgcucgucgccgccgcugcaggagggcucuuggagcccgcagguuguccgcgccaccgaggccucugccgcgaguggggauccgggauuucccggcugcgcguccuucgggcaagcggcccgcaggugguggcgggggcguucgcggccucugcggcccggcgugcgcccugcgggccucggggcgcuccccgcguggccggccgucuugagaaucugcccggguggcggcggcucggcgagcgccgcgccuucccugaagacgccgagcgcuuggcaggagccccgcguguggcugccccggugcggggcgcguuggcgcggucgcgaaagaagagggcaguguuugcauuugcuaacaaaagggagccggagcucuuccccaccggagaggccggccgcgcugcgaccgccuucccgccaccucgccgcucuugcccgccgcacgguguccccgugcugcuguaccgccugccgcugccuccuggcgaccggcgggaccgagcugcaccgggcgguggcgagagggcuucugcgcgaggggaugcgcuagggcucugugccugcaaaaccccucgcagcuccgagcugcaggaccugggagcaacaagugguggaggaugcugcgagcucaucccccaccugcggagcccccagcccgggaggaugcagcgcugggccagccagccugcgguuccgggggcgccuuucugcuuggguugugucuuuuguuuacacgcuagaggacacauaguuauguaaacaccgcaggagacgugcuguuggggggugggugggggugcuugggagugcuagcuucggauuuuaggggaugccagguugguugauuugacacccccacccccauuauaaaauaggcuugcggaggaacucggcuugaagaaccaauugagguucuaagggugggauccuggcagcaccuuccauuccagcuugagaauuuugucuuccaugcuacguucugucuccggauguuuauauguuuuucuucugugaauucuuaauuuaugaguuacaagauaauuagguuuaaccgaagccggugugguuacaacuuaauuucuggugaugccacugacuggaaggguucgauagaguguucccgaaagagaucccucgugcugcauuguaaaaagcgccagugucaguuaaacgugagcgugaguaaaggcuggguaacuggcgcauuacagaggcaacaauagacuuguauuggcugcagaaccaagggugggggagggaagcgcuggcccgggauauugcuuuucgacuaaaaaugggagccaugcaaugccacuaaaccagcagaguaggauuagauucugccucccuugucaagccugcucauugaaggcucuggguaguaacaacacuacuauauuuguacuaucucuggaugagaaguugccuucccgacgagggaugugugcugacuuaggaacggucuggaacucaaccgugcaugucaaagcuacaagaaaauucuguugccaguuaccauggaagcagcuucuugcucuuguguacaucccuguuuguucgccgcuuaucagauuguguucaaauuagaaaguaauugggcuugauuuguagcgagggaaugagaugacuuucuuuaaugucgugagugugguguguguguauguauguuuauauguguguguauauguauguaugcacgcauggauguauguauguauacaguuugagagagagucuuagcaaagcccuagauuccaaaccacagggaucaauuucagguggacuccuuaggacuucuuucccucagauguuaaguuaaagcuuucucagggaaagcuuucucugcuucucauuccuugccuuuaaagaaaccuguuggugcuaccuucuaacuucauuacguuuguuucauucgaauccuugcugagcgagccaagucccgcuauuguguauuggguuccugguucuguuugccuuuguaacugaauucuuucucccuguuccccaucccucacccccaucucagagaaaaucuacucccaucucuccugugguguuuggaugaaacagaccuguaugaagugcauccaaaauaggauugccugcacguuguuaaucacuccugucagguuuagagugcaggcaugcugcuguuugggauccugaagggaccuguaguaguccaacccgcucuuacucuuuuuaggauuagagaagauggcugaugggugggggguuugugaagguggcaguuaguccuggcuugcuguagucgacuggggcuugcauaccggggacagggacuuugcaaaagugacgcccugcuauuguugccauuccugcauaaaauugaauagucacaguagggacuugcacuugccugugauagcuucgauaaaauaucccucauuaaugccacuuuauauuuacagugugucacuggagacgcacaaggcuucauuuagugacuugugugacgagacaagcuugcauuauuugccccggacauuuuggaggaacaagagacccauugagcaaucuuuugaaaugaacaaauacgaaaaaggggggaauaaaagagcaggcaguucucuggaacaaagagcuuuauucauauggauguuguacaugcuuuauccaguuuuccccaguggcuuuccuggugaagggguaucgggcagggaagaugauaacuuacagggcacuggggcuuccucucuuacuuccugacuuccuauucuuaccggaguuggucccuuacucacuaccugcaucucugucucuccacucccuccaaagccccaacggcucucucucagguuucaaaggagauuuuugaaaucuuugccgccauuguuggcucucaucugaagacacugcgugguagcuaccuguugagacugaucaacauuggacagugcacugggugaagggagagagaucucauuuuucuaggauaugugucaagauaaugaaugucagaacaauagguaaagauaucuugcaauuaugucagccuaacuguuuauuuuuaaggguguuuuaaaaaugaaaaucuagauuuaaaaaaaaaucaucauuaauggugcucuaggauuuuauuuuuaaacuuuaucccauaccugguacauuucagcuuuauacauaagagauuaauauuauuauugcaauucuucagccucuauuauugcuaagugauuuuuuuuucuuuaaaauuuauaguacuacuaugacaaucaguucuaugagacuuauugggccuguuuuuugugacauuuuaaagcuagccauauagaguuugcauugcauuuaaaauuuuuugagugugugugugugugugcgugcgugugugcgagcgugaacauuuaacaaaagggucauuuuuaugugaggguauuucuuagaaggggccaaacuaauugauacuguaguuugaauagaaauuggccacauaggaagaaaauuuaaaagaaagaaauccaaaggauuaaaaugcugcauaucuucuuuggaagacugcuacugaccauuaugcugggcauuuuuuaacacaaaauccagcacagaaaggagaaaucacacagcgacaucuguugcagaacugaaaauuugccgcuucgagauggaagcaauuagccccauguaagcaccuccuaguaucagagugugugugcguacugacacaaauaugaaccuguguacauucacauuccaacauacauguuauacagaagcuuacauauuuaaaguaaugcacuagaaaaugcaacauuagagugccgacaugcuuuaaaaaaugauagagauuuucaugaauauagaacuuuugacaaaagauaaccacgcucuuuuuaggcaauuccauugucuucaggugaagcuacugaagcccagcugaacggaggcugaguuagcuguagaucuugguuggagacaggucccuugauauccagccaguggaccuucuguucuuccuccuggcagggaugcccagagauauggaucaugggacaauacuuggcucaaacuauuuuguauucugaaggcagcgagauuaauuguuugcucuagguaauaagcccauggaucagaaggagugaccucugggaagaaaggaccagcucuugguaccuuugccuuugguguugacaaaugauucugcaaccucuggacuuuaucuggcagccacugcgcggaugucauccaaagggccuucauaugggagacugcaggucuguguugcuguagucagucacagaggcgaaagcuaaguuucaggaagcucaugcuuuguuuuuuaagauuucauuugucuuuucuuaagucuagaacaagagccuucuucgguuuucuuugcagguucuccuuugucauuugcagagaaaaagcuaaagggaaaaucuucuuuuucuuaaagggaaacauuuuuuuuuuuccaggauggcuuuuacauuggccuuauuuucucuccuuuccccugauuguggggaauuucaaguauucacaaaagcagaaagaacguccuauuaacucuacgugcagaccauccagugccaacacuuacccacccugccuucaucguuugccccucugugcuuccuauuucuccuggauuauuuuaacuaaaucuugggcauccuauaauuuuuccacaguuccuucagaaugaauuuccucacuuauaauuacaguaucauuaucugaauuauacagauucucagcuggauaugcagaaucuugccugcuccucuugccuuucugaggagcggaaugaaggguuggcucaguggguaaugaccaagcaggaacuagagaggcaaagugcaugccugcuugugccgaggagaccucuccugcgguuuaguuuauuuugagcaagguuuuguuuggaucggauaagaugaguuuauuguuguguagauaugguuguauaaauaugcaguaauuguggcuagucuucacuguggucugcacccuuggugaaauaguccauuuccaguccuucccauaaugauuacccuuuacccacagacuuuuguagggaaagcuuauuuuaguuugauggcuaugaggcaccccauauagaugugugugugugugugugcgcgcgcgcaugugcgugcccuccagugcuccaugguauaaaugauauugcauuuugugcauauauuccuuaacagaaaaaaugucuuuuuuccauuucuaacuggcuaaguguugauuugagucuguaacugaagugaugaaagucccuucuguggcaugagacacccaugcuguucacugugaguacucugggauuauucuuguggguuggggcugagggggaguaggggagagggagagaaaagguucuaacuuuacucucaauguuugcucccauucauuuaaaaaugauauuuaauauuucagcuggaaaugcuugauagccauauaguucauuucugaauuuuuuuuucuccaugaaaauaagcugguuugguuucccaacguuugugacaugugagguugcccauucuuccuccuucccuccccacaccccuuucuuauugauucauuuucauuaccaaaaaaagauuuacuuuauguauaugaauuuuugcuuacaugugugcuacgugcagcaagccugugcuuggugccuaccgaaguccgaagcgggcaucacuggaccuuagaacugguguuagugauggcugggcguugcuguguggaugcugggaacugaacccaggcugugugcaagagcaacaagugcucugaaccucugagccagcucuucagcuccuuucuuuugauuuuaacaaagcuccaucuugaagguuucauuucaugcagauacaaaucugaagcuuuuucuucguguucaagaagaacacgauucuucuuguuucugaacaagaaaugaugaacgacgagaugauauuaaggggucugugugucccuggcuaggggaaacccuggcuccugauuugaccauuggucaagaaauacaugaaggaguuuuucucuccagggcuuggggugucacacacacacacacacacacacacacacacacacacacauauacauauauaaucccuuugucugucuggaagccaucaaugaaggaaggaacccacuggaauguuuguaaucauaagugauaccuccuuguuggaauuuucagacgccgcaguuucuuuuucagauauuuaaauugcaggcucuaggcagcagcugcuguugggguuaaugcacacuuuuucuuucucucuuugaaggucuuccagugcucguccuccaaagccuugggucaguuguccauggaccaagggauagacaaaagggagauguagguauuuguguggccaaaaugaugcgcagcauugaagguuaugcauaagggaaacucgguguuaaagguugauaagagcagaugccaaaagagccuguguaugacucccggggaccuugaacaaagagguuaccucaaggaagagcugugguuggggauuuaaaaaaaaaucucuuuguagcugcugcacuggagucuaguucuugaacccaacauuuugcuguggguauuuccgaguguuaaguaagcuugcagugaaagugcuaugguacauacuuaaacacuccuugggguuugagguuccagugagcacugugggcuucugucagugcggagaguaagugccuugaucuuggcagaguucuuugggaagguagacuguuuaauucccucucagcucucuagcaccaccaaguuagaauuaaguuuugccaucccuggagagguggagaugcaucuuccggaaaacaaagggcucaccagcucucucugucccguugucugugccauguucuuacagggcugggauggcuuuuccgaaauggaccuuucuuuguugugugcugguuacagcuucccucgaagucuucuucauuauugggcacaguagcacuaucacccuagccccuguucauuguuauuauuguuugagacagugcuggcuaagagcuggcuguguagucagagaugauuuuuacccgcugagcacaagguuacagguguccgucagccguaccuugcuuauguggcucuggagacugagcugugcucagcaccaaaccuagggcuucaggcauuucaggcagguaccuuccuaaccaagcuccuuucccaacauugaaauuaaauacaccacaauuuacuuuuccuccgugacgcuuuagaaacuuagugcccagcaugugcuguguuuuuucaguagaaggugccuagccacuccccucccucuccucagagcuagcuugagucugucuguccgcugcaguuggaauuccucucaggacagcaucauggagcuucccuuucagaagccuacucucaaauucuuguuuucuugcuucaaauucagucucugagcugcuugucuuucggcgguuccuuccuccguugcucucucguuuccucucuaauugccuucauuucuuauuacuuuucagcccaacccugaugggacuggaagacugaugacucugcaaugaacccgaggaagagagugguucugcccaucagcuuccgcuggucgccauggcauagaacgggccugcuuuuccuuuaacugucugucuuggcucauaggugaaggauggcugucucuccucagcuccuuggagaguagauaccuuucccuuuugacuuucauuuuacccagccugcacuucucuaaagaaggcuucccugagggccuuucuuucucuguuuuacagguguguggggggccguguuucuuuaugccaauuagagauugugacauaaguugucaguaucgcggucauaaauucucauggaauguuugagcuucagaacguugagaacacauuguggccuuuugguggaaccuguuugaaugcugugcuuuauucuagccuaaagacaaacgguguaagugacuuaaauuacagucugucaaaguaacacuuugagcccccaagugaaguuuucaaaggaggaccgucucucaagggugagaaagcaaaaucaaaggacuguuguguagaucuccuggcuugguaugagaucagccgcugugaaggugauccgggaaaugccaccuugcagauggcaucuugaugcuuacaucuggugcacguagcuaccaggaaaaacccaccuaagaggcggcagaagagugcucccuggccucugucaguuaguguucaaacuuagucaguuugggaguagggcuguugaacucaacacagucgugccagcuuuuuuuuuuuuuuuuuuuuuuuuuuugguagauaauaauagaggacaaguuaucauuggcucaauaaacaaaaccauggaguucuuguuucucggucucacuguugaacuugcugucugagggguccuuuuggaggaucugguauugccaucugccgcccuccgugccuuugguuuuccuugucugguacaguucuugcugguacagaaaggcuagcacugcagugauacaguggugcgaccuuucauugucuuccggcgcuugaggagucuugagggucagacgguguuuguguauuuggcucuuugccgccucugccuguguuaagucaagccgcccaguccuugcacaucaucagcuccauucuucugaauaaaacaggagcaucgccucauuucucuugcagaaacccuuauuuaaacaaugaaaacuuuaacgauagggagaaaaaaaaccccaaguuaauuuagaacuaaauuacugcucaaaugguuuuaucucuuaaaagguucaaguagagauuagcuuaaauggcacccacuuucacucuugcuuaugccuaucuugugagcgagcauccuugucaagagcccccuggccccugucuccagcuuuguuagcgaucaugagaguguuagcugcuggugugcuguuugcuccuggagccgaucucuccauccaugggccagguuggcaaguggaagccuugcuuccacuuccacagagggagcaugaagaagagcaaagcagcagaccacgcacagagggauguguacgccggaaggauccaugucuguccaucucuuuauuaaaauaucuaccuaguggcguugggugaugucuccuaaugcauacucaccuguaaaucccuuacaugugaggccguauugaaaaaguauguugaaaggauuaauucaagauguucucagucugcuuugagaagugaaggaaacaagugaguggaaucgcguaacaucagagaaacagcgugaucauaaucuaauugucgggccuuuaaacacagacguuauuauuuuaaucaaccucuuauauuguauuugcuauauugaauaaagacaugguauugcuagcccauaaggcagcugguagagaagaacaaacauuugauuuaugaagugauuauucauuugaguaucuguuauaugccagagacuguugggcauauuucucucuuucaagaagguaguuagaugugcuuuuugauauauuuuuuuuuucucucaccagguuugguuuuguuuuguuuguuuguuuuuuuuuuuugaaaauuuaaaaaucucagguaacuugaaaucagaguacaaugacgaugcauauuuguuucuacuuuagagcucucaacuguuaacuuuugaccauuuguauuauugccauaucccuaaauaauauguaaacauauauucccaguuuuucucuuucugaaccucaggaaaaugaauaacagguaugauaugugacucuugaauauucgucauuucugagaauaagguuauuucauguucagucuccaaaaugauacuaugcaauugacauacaucuacuauuaucuaguaucuaggucauagucuuuguuccaucagcccauuaacguugcuuuauccugcccaguauagaucuugaagucaccaacacacacacacacuggauuuaguuuucacaucucugggaucuuucaguguaaaaccauuucccuacuguccacccuuuucuuuuuucuaucaucaugauccucauuauuuugugguucuagguauuaaccagagagcuuccugcaugguggacuagugcuuuauuacugggaugcuccucccauuccauugaaaggauuuuuuuuuuuucacaauagaggugucuuucauggcccugccauuuugagucuagauaugccguuuucuagcauguucugugguggcaccuuuccuccugguuuggcucagauuaagcgucuuuggugauaauacuagauagcugaacugauguugucaucuuguagcuccuuaucagguuuccccuugauccugggugaagauaccaaguuaaccacuuaguuuagcuagaucacacguuucuccauugcugcccuuuuguaauuaaugaagaaguaagucugagggauaaucuugagaaugcugguccuuuucucuuacugcacuuacggaguuaacggggcgacagcacagauugugucaaaugccuaccagagcuaccgaccuggccuucuccaguucugggauucgaauauuagguggaggcauugcuguguugacaagagcuuguuucucaccacuccuuuuuugauggauuuuaaaaaauagaaauucagugugauuugacaguagcucauucgcaucaaagguggcccauugagagcaucuuuaaacucugcugucucacuuccauguagccuugcuaguuaagauucuuuguuacauguauuuauuuuggguaugugaguccacaugugccuguguguccgugugcgugcaugcucuaguguguguguguuggucagaggacaguguggaggaaaugguucucucuugccggaggaucuuggggacugaacucagguuauaggcaccuuuacucacugagccaucuugucgcccguucuuccaaguacuuucucacuacaccaucagcucuaggcuaaccuuaaguggauucuaccccggaacugcaucuaguuauuucuccaaggaaucccguuuccuguuuguggaggaaugcucaguaaauagagaguuguacuaaucagauuuguguugucccugggcagagguaggacuuuuguaaccuccuccacccccccccccccacagugcauacaugccugcuaccuggccugucugucuaaggucuguucagcucagucauggcauguaacauggaugcuuucugcucuagccuggcauccaaguugucuuucuccaucucccauuccuuccuuacauccuccaucccaggggagaacccugggucucagcuccauccuuaucuuauaacuaauauggaaggauuuuuacauuacuucaccaagaccacuguggaccaugaucuuagcaaguaaaucgcaguucuccccucccucccucccucccuguucuuguuaucuuuaaaaagauccuacuuguccuggcaguggugagaggcagagguagguggaucucugaguucgaggccaccugcucuacaguuccaggacagccaggguuacauacucccuucauccauccccccaaaagccaaaacagcucucuugucugucugucugucucucucucugucugugugagggggaggguugauuuuguagauauauuuuuuggguacauaaaucagccaucuagcuaaaaaaaucccccacuuuuucugcuucuuuaaaaauaaaaccaucuuccaauuuuauuuuuauugugcuuccuauuuuuuuaaagggguacuauuacucuuuuaagauuguguuagagaucuccguauuuucuuuauucgacccacccuggcugcuucccauuuauuuaaaugaccuccugucauucagcuuuguucuaguaaccaagaaagcuuuuucuuggguggaauucuguauauauauuuuaauuuuccaauuuauuucaacaaggaccaccuuuccauacugauacaaugugugucugguauuuaucguuuucuggaauauacagucuuugacugcguuuuacuuagcuuuugacaaucauuugagaaaugcuucuccccucugauaaguuggauaauuacagcacaagcuccaacucuucuuucuuuuuauuauuauuauuuuuuaaggagggucuugaaauuccgcccagccuggccuugagcuggaggugguccucugcuucuguuuccuggaauuacaggaguauaccaccacauccaaaucuacuuaaaacaaacccaaaaccaaccaaaaaacauauuauagccuacucuaaagugugcaguguauaaccaagguaacccuuguauuuaagucucagaccauguuuuaaagaaacaaggacagaagccugccuguuggaaaucuccauugccgugucugcaccaucccaaaggauaugaagcgagaacagccagucuucguugcuaucugcugcaagcucacuuguucucacugucacucugaaaguacuuacuccuguugauuucuuuuacagguaggaacugagagcaggaggagagaagaagcacaaacagcagauagcagaccaggacacaaacuaaaucaaccuuccagcucuauaauuuuaaacauauaauuaugugguuuucaaaccguaaugucuacagccaagccucccgcuuaucccuuccucuacccuggaugucccugugaagaaucuugcucucauccacccuggaguuugacuggguguggccucagagugucacugucuccuucaccaucuucuucccucuaaugguuucuaagucccucccagcuucauuuugcagccgaagaaaguagauuuaaguugguauuacggugccuuaauugguccauuugcuuguagccuccuccccugcaacgcaucuuugauucuguuucuagguggauugcaucuuugauucuguuucuaggcugauugucacuuucuagcuuaacccuaccagaccugagccccugacuggccuccugagcaaaaugugaagcagcauugauccauucccuagcacugaguacacagcacucagacauccacguccuucccgcacucggucugguaggguuaagauccuuaaauguguucucaauacuuuuaagacagggcuugcucauucccggaggccugcagugucuuuugucaccucccgucugucuucugcucucaccuccucccagcccgcccuccgcacauggaccacagaaguaagggcauuccuauugcuccaggaccgcucuugcuuggugugcauuaucagucucugcugacuccugugaccugagacuucagcucagcacuggcuguugaaggaaccuucccugacggcucggcuugguuagguuguaguuuguaguucuccuuuguacuucuuguacuucgcuuggggauuacuuuacuuuccuaacuuggcuugcucccgccccccccccccccccaucaucagacauccuucuuggaagccagccuccuguacguacuugcugcguguuugguuuuucuccggcuucuuuccuuuuccugccucaggguuagcaaauuuaaaugacaaccagaauggcccaagucugcuguuuucuuuuucaggucuuaccuaauuuccuaggcagauuauaguauuguccuugccaccucucucuacugaagccucucugguuuuuccaugcugguugguguuuuacuuucucaugugucagcguguguccacguguagugggugggcgugucugugucuugagucgcaggaugauuucuuauuugcauugauaacaacacuggacacacaggcuugugcguaacacacagucagugaggaugaauuggauauuaggugccuguuacaacuuuucuaaauccuuuaagaaugcacaugaacaggggacacaaugacacuaguucagaguagaagaccaacuugaaagugaaccaguccgaagugugcuuuuauucgccaguuuccuguuacacaauugaauuuccaauagguguguguccuauccuuuuuccuucgugaauucuccuaguugggauagaagauguguaccaggcuuccucugugaguuuaccguaaaggcugucagaucacagcuucuagggcuguaagucucgaaaguuugauuuuucucuccucguggaugaagaacugaagaaugccuggccauucugaagcucaaaggagcagcuucugguguuuguuuguacuuggugggcaaucacuggagagauuuagacucccagcccagauaagagacucuauucccauuuauuuagucacuccacaguccugggauagcuggacuuugagucauugcuagguuguaacggcaaaaccaagaaacuuaucucagaggucaucuccuccuacuccugucggcuuucagaagaaucuugucuuaaaacugagauauagccucgaaagagguggcgaacauagggaaauuuaaaccucaggguaacaauuuucccuguacgguaauaaagauguauguggagucaguggcugcagaaucaaaaaauagaucacaguaaucggaucacacaugagaaauggcuuguugcugugcuuaaaaacaugggcaaggcagcacguucgucuggagcccuuuccacugugugacugcaucguugguaggaauuaagaccgagacaaagugaagcuuauaaaguuaauugccuacaacuggucucgguuuaagcagagagauuuccuuucagucgccguggaagacgggagucugcacaggaagagagcagagggcuuuccguguuaccuugugauucagggguuguuuggaguuuggucuuugccuugaauguagagguggaaccacacuaacuggaguuuauugcuguaauauuuuuaaaaguauauuuguaacgcugauguacugugaccuugugcggguguuggagaggaggggguggccagcccucuuccucacugucagaagugaugcgcuugcuggcuccccgucccggcaggcuggggaaggggaggauuuguuuuuuaugacuucuuucuccagcacugucuucauaguuacagccauccauccagguuccucuccccugccugaggcuugcauccagccuagucuggaucuggugcuuuaaguacguugagugauggggaucguagcauuuuuacggaugcuucuccuguagcucuguggguuacacggcuuguguugccuaggcauugugaguggauuacacaaugagcuguggcuuggagcggagugacacuuucccuuuaguucucucucuaccacgugccaggcucuccuccguagauguuuuuuucaguauugcccuuuugagaaaucuuuuaaguugaaggcauuaaaccuucuuuuucuuaccauaauucuucaaagacauauccuuaucaauaugaccuacugucaaguuaauaacgauuugauggcaauauccaagagaaaugacaccuuuguaauacaaauuuggccaguguauuaaugcaugguauauggcugguauuauccaagaagaaaagccgaguucaucaguuugaguuucuccuggaauuagguggugaaugcuucaaguauccuauuuuaaaacaauugcaucuagauucugccugcaggauugcuuauuucauuauucuggucauuugcaugaaaacaaguugaugauuccuuaaauaaccugucgguucgguuuucuuuucacccaggauuguuauuccucaagugcccucauccagucaugcaggagcaggaacucaaucaaaaaacuuugaaauuuagaguaagguaguaacagacuuuuucuucauuuauuuuuuggccaaaaaaugaucucccauuuucauauuaauuuaccuaugauuuacaccucuguccucccuucagcagcugggagcauacagagauauauuuuaauagaacauuucccaaaguuuuaggcaucuaaaaaaugaggucaucaucuucaagauuuuggccugaacaucucaugaaggaagggagcgugaaaggagacguaggaagggguccuaguauguaauauccucauaauggaauaacgaucaaagcgaaauuccuuuuucaacauuugucuggagcaaaguaauuugauuuccgaaggagaagcccucuguuucuguaugugucagguacuuccuggagaaagugugcuuugcuuuuuacuuguuugucuuguuuuauuuuaguuuaaaguuucuuaccaguggcuuaaacaaaaggaugcuuuuacauucaaaacagcaggccagagagcggagcugugugcuggcaaucaugcugucuaggcuguccccuauagguagugaugaggagugugugucugucuggcauuuucuuucuuccuauuugcuuugggcucccacgagauguugcuguggcugcagcagagagcuggaggaguugagcuuuuccuucacuuggcauaugggacuucccaucaggaggaaacuaguugggaguaggguugucucaaaggcuuugcauugaaaugaaguucugaaagugcaagagacacuuagaaagagagacgcuuaaggaagacuaugugacuaaaggcuuauggguagaaaagugaaaauggcuagugagaaaugggauuagcaaaagauaagguaggguguggaaaaccuuggagucugaguuuagauuaaacuucggcagccauuuggagcuaaugaaagcuuuuugaauagugaaguaaaaacaaguuucauuuaggauguggaucugagagugauuagaaacccagagauuugauuagaaacugagcacuagguugggggauaauaguuuaauccuaaugaaggcuugaaguggggcagugcucagagaggcagagcugacuggauucggggccugagugggaaguagggauagagaaaacauaaagagcagaagugaagguggacugugggucugcaucugcgugacugggaaaauggcuguuccgauuaagacagaaaaaugugagauguugagguuaguaaguuuggcuugaagacauuagcuaagcuguuacggacuccaggagaaauguuuagagagcaguuugaaaauaagguucuuauuggaguuggagagaauuugagaguagaguuggagauguggauuugaaaaacuaaacugcaaagaaauuuauuaacuauuccaaugugcauaaaauaauguuagauguuauagauagggcaggaguguucaagugagccugaaggaggaugguguguugaggacaagaagaaggaggagggggaggaggcuugguugacaacagaaaggaccuguugcggaagggaggacugaggggagguggguggggcucgcugagauggaagugucuuugcuaaagugccgggaguuaugcagguuagugccauggaagagaaggcgucaccggagagaaauguguugucuggaauguaaaggaccacuggagaaggcuguauaaaggaauaaaaugagaccugagugccuuagcauacaguucagguauggcaaagccagaaaaaaaccaacaaccgaccaaagcaaacagaaagccugccccgccuaucugugccaccgaagugccguaagguuccuuagguuguggcguugagugaagaccgaauugugacgcucacaacugcauguuguguggugaaugauagcuuuggcaggaauagcauggagggcggguggcuggaaacuuuguagaaacgugcugcuuuaacaaccucaaccagagaacagaacauaucgcacuguagcuuggaagugccuuucaccguggcaggggguuuugucauuagccacagcucccauucuuuagguagauuagugucugcaacucuaguuuucggcuccugcagaagugggaaagauggcucccaucucagugcguuuuguugcggugacaguacccaaagcuggguaauuuguaaagaaaagagauuuauuuugacucaugguucugaaaggccaaaaacacggugcuggcaacuguccagcuucuggugcacacuucauugcuggcaaggcccacagucacacuagaaggagguaaacacaugagguaagaaugcuuuaaaauagcuaauucuccugagaugugauccauucaugagagaaccaaucuggcuggugaggaaagacaucagugucuguggaagauucugacucccaagaccauuaugucgaccagccauuuuaaauauaaacuuugguggugagaaucauuuccaagccauagcagguccuuaguacaugcauugaauuggcacuuuggagcaguuuaaucuacaguugaguagggagauguagcaacaugccaacuuguagacugaacuuccuaauucgucuucguacauuauacagcagcagggcuggagacauagccuagcaguucagagcacuuaguguucuuccagaggacccaaguucgguucccagcacccacuucaaagaagcucaaaacagccuggagcucugguuccagaucagucacugcuggccuccgagggcaccuugcccccacauacacacaguuaaauaguacaacuaaaccugacucccuuuagggugugucuggucgacaaguggcuucauucagcagcagaacuccagaaccugcaggcuaaucuugccuuuuuuggcuaugccucuccagugcuguucuauggagcauucuaugaugguggacacaucccccugucugugcaguguagugagccacugcuagugccccauaacuguaaaguacugaaaacgggcuuauuugcauuuaauuuuaauauagaccugaauaaccacaucaugucaccauacuugacaaaacuuccccuccccucaaauaaaaagcaacaacaauacaaaaaacaaaacaaaacaaaacagacgggaaggguuugguaaaggcuguguuguaccgaggucacuccaaauuuagugggucucauugaaggguggguucagccacugugggcauaugaaacugaauuuucucguucuguugcuuuuuagaucaaaaagccucuggaauaucuucauuguccuuucuucauuugaaaaauuauccuuuuuagccuuaagagggguguaggucauccgguuccuggauuaacagcgucagcugugucauuaggaagcuuggcuuggaaggucacuguuacgugacugugugaccaugugucaguucacaguguggguuucccccuuuccuguccuuuuuuuuuuuuuuuuuauggugcugaaagugagugaaauguggaagaaacauuauucauuuuaaauaguuuugacugccagguuaaugcgacucuuaagcggagcuucaugaggucuggccguaguaacugcuuuuaacuugauuuaaaguucuuaaacauucugaauugccucaccuaaucuuuuuauacugaacguacaauuuucaggcucuuuuuuauuuucaaauccauaacugacagcugcucaacaccucauucaaauaguuuuaagaguuuuagagaaaaguugggaccgucuggauuuacugacaucaguuggauugagauaucauggauuuaaagaugauagagagggagagagagagagaaaaguaggaaauaauuauugcguguucacugcuugcccaaugacagggauuuggaaucuaauaacugagagacccaagaagagcagaaggacauuugagcaaacuuucaaaucuuaaccucaaaagggaaaauuccauggaagaacauaauuugccugaaguacugcuuguuuuauuacguucaaaccuugaauauuaagggagguauggauuccaaaucucgggagcgcccucucauuuccccccuggcauguagcucacagacucccaguuaauucuuugggggauucugugggauccagugcauagcguguauuucccagaugaaauuaagcauuggagaggaugacaucagagcagggucuucuaccuuuguucccgcucaccaagggacuugcagcucaacccagugaacuuggaggagcucuggagugugcuguuugucuaagauuuaaaacaaacaugacacuuaauuuuguccuuuucuaauuugcuuuaagugcuaugugugugugcugugugugugcucugugugugugugugauuuacuguguacuguauauaauguugaggacuagcugugcaaagauuaauuguauggaaucuauuccaugcagaggcucacacuuuggacucuuguguacuaauagcccugugugcucagaagcacaaggcugaagagcacaguggagguauacauagggcagggcuaucuaccugaggauggagauuuagccagggaagacuuucagaaagacucagauaggguaguauagcuuggaguuuucuagguuagagguguuauguggaaaaccuuggaaacauaaaaggcccggggaugcuggaagcuguguggacuuuguuguuuuuaaaugauuagauuaagagucuggggagcagugacuagggagcaacagaaugaggcugcugagggagccacacaagggcacauagucgucagaauggcaaacucaacaggcacggguuuguuuuaaucaccaacuacaaacucgauaggcgugguuuugcuuugggguguuuauuccaugcgauaccuguaugggagcuagagguauagacuagauagcgagauuagugaccagaaauagguuaacaguugcaagaggccagggaagaucaggugaaauucugagagccuuggccaaggcacuggcugugcagguuagaaggaaguuggugugugugugggaaaguuggcuuggcuggugaagucagucuaggaaaaugaagcagaaucaaggacugauggaggaugaaggggagcuucgugcguuuuucaaaccagggagaccccaucacauuggagguaccacagcaggagaugggaaguaagaagaagggaguugguuaaucagacucacaagcgcccagaugagacucggaaaggacaucugcuuaagggaccugagccucauuuauugauugguugauugaaaugaggguaauggggaagacccagaauuguggauggagguaagauuguccagugcuaaugauucaggggaaagaggaccugucagguaauguagggguuugucucaccggagaugugacaggguguagaguucagcugcgguacccuuggagggaacucagaagauugcaugggcaccuagcugagguugaaacuuuaugcuguagugucuccagucuucuugguuacuggcuguccaugccuguguagcaaaccagucccuuguugccagguuagaucguugacaguaggcugcuacugaaccuucucuucuaaccaggcgugguggcacacgccuuuuaaccccaacacuugggaggcagaggcaggcaaauuucugaguucaaggccagccuggucuacagagugaguuccaggacagcaagggauacacagagaaacccugucuccaaaaaaaagaagaagaagaagaagaagaaagaaaaaagaaaaacagaaugcuugcugaaccuucucuucuuuagaagagagaaguuaguugcauuagcucuuuucuuccuuuuuaacuuaacaguuguuccgugcuugaguauuugccugcauguaugugugucccauuugguugccuugcgucuguggagggcagaugagggcaucagauuccauagagcuaagucacaaacaguugugaggcaccauguagguucugggaacugaaccuggauaccucugcaaaagcaacacgugcucuuaaccacugacucaucccuccagccccacauuaguuucuuucuuuugauuuucauaguuaaguuugucaugguugggaaggccuggugauggcuagcaggaacaacccuaggcuacgacgacaggggugugaggaugcuuguucauaucugugccacucaagaaggagagagcgagcuggaagugggugcugguuauaaaaccguaagcuccuccccuagugagucacuuccuaggcuccacuuucuacaguccgugagccugggggugcgcuuuccacggucuccucaugacagcuggccaggguaacaggacagguagagcagagagacgggagagaucaccagggcaaccuucucugcuuguggaugagcagcuuucucagaaaaaugaggcauuuaucaaguaaauucaaaccagggcaaagauccaacugugccuuguagcugaguucucucugucccucuccugcugucucaucgauaggaauuacgacaucuuguuacuauaaauccucuuuaacuuguauuuuggacucaaugaugucuacaacauuuucuuccuuucauuuccaguuuucuuuucaauuuaauuuuuugggggggccagguucaagcaggaauaacuauaguauucuaaaaauaaauaaaccuauauuuuucccaagaggaaaugacauuugauuugaugagaguauuauugagacuuaaaauaaaccagauuacauacuaaaguguuugagguuucucuuguuauaaacugcuuaauuucaaagucauguggauuuauuuauaauuuauuacuucugacuuucauuuauucuguaucuuucaagagcaucuaguauguagcaggggucaugaugauguaagcauagaguauucccucaucugucccguugucuguugagaaaugcuacacagagauauacuccuacuaccugggaucaaguuugauaugggcaaccugugaacuuucugggcucugccuuccaugcccuuagccuagacaagaaccaagaaacaaauaauagcuugucugcuggauaaauagagauuuuucuuucaggagcgauuuaguggagcaggggacccucaauuaauuaucauuguuuauaauacauuuucuccuuuguuucuaagagugagaauaaugcagcaauaugauugauaaauaaaacauaaaaggucaguuaugguugcccugguaacucuauuucucagcaaguauuuuguuugccaugaaauguguccggagugauuuacuggaucucaaacucugaaugucaugacuuuuuguauuuaaauuuuauaugcacucauucgcggagggaaugacaguuuuguagguuauuuuugaguagaguucuaaagcuguauguguagugugagugugugugugcucuuuuuuauuuuuuuuuggaacacaaucagcaaucugugacuaaggugaaucuguuugagauuagagagaagauccaggucuacaguagcccugaagagcucagccaugagacauggaacuacauuuuggucugugaugaacugcauaucugauggugguccuguaagauuacaguggagaccagagguuccuguugccuagcaacacugcuaagcacauacaauuauguacaggucaucacauuugaauaaacaaauguuucagguuuacaugcuuaauguaauacaccuuuuauuguuauuuuaggcuauacuauuuauuugaaacauucggaacaauuucucuuugacuugauuuagucuccuaguuuucuucaucacagcccuaggaugaauaagguuguauuuuuuacacacacacacacacacacacacacacacacacacacacacacacacacacucucacaccucauaaacuauaauauaauucagaugucuaauagaccccaccauauagguuguuguacauuuuggcuaugaaguagaaggauaauauuagcuaauguauuaguuaccauuucuguugcugugauaaaacaccaagauaauuuaccaaagaaagaguuuauuugggguuacagaugagggagauaaagucuguccuuaaagagaaaugugguagugagcaggauggcagcaggagcaggaaacugagaccucccauuuucaaacugaagcuaguaccaggcuuuuaguaucaaagcacaccaugcagugacguacuuccuccagugagguuacacugccucagccucccuaaauagcaucaccacccgggggacauuucucauucaaaucaucacaccugaauaucacauuucuugaaaacauauuucucuuguacaugucuguauuugaauauuuuucugaugacaugaaauuucuucaaacaggauuuuuuucuuuuaaauguaguauucaggcaaaggacacuuucuaauaaguacucagaaauacauuaacugauaccuuuugacuuaauuucuaugcaauuacuuuugaguagcauacguuaucaaaaaaguguuaacacugaaaaucaaaauaauuaagcaauuagugcaauugccaucuucuugaagauuuauaguaguaugaauuaaacagaaaugaaugauuaaaaaaguuuaguacauucuuugaucccugcaacagccuacuguaauagcuuuacaagugcacagauauaaaccuagaaacuguguuguucuuaauaauaaaaauuggaaauaaucuaaugcccaucaggagaaggcugguuaaagaaauuauguucugccaacauaauggaauauuuuguagccauuuaaaaaaugauguuuuccuaugcccauugacagaucucugggcugugucaguaagugaaagcuggggagauggcugaauggucaaaguguuugcugcuccauugugagggccugaguucagaucuccauggaaauccuggaugagcggggcaguccgccugugauuccagcuuuggaagguggugacagggaucccuagagcaagccaacuuacaagagcagcuaucuuggugagagcuugggguuuaauugagguacucugccucaaacaaugagaaaucagggaggauccugacaucauccuuggguuuucacauguauccauauauauagauguccauguguucccauacauaaagccaugcauacauacaugcacauaccauguacacacauuagaaaauggaaagaaagaacauguuacagaggauaugguagauauagauggccuguguuauuguaauuaaucuagaaugucuauuuaauuggaauauuuggaauauucuuuuaacaucaggagaaugaacagucucuuagcauugguuaucucuggaggacuucuguucucagaaguucuauuugcauauaguugaauuucuguaaugaauauggguuagagaggguuaaugaauauggcaauuagagagaaagaaaagauacaaagagccugcugcuuaaguaggcuacaauccagcugacuaggugcugcccggaggcccguagcacccuuucuauaacugcuucugucugcaugccuggaugguugaagauguguuuucuuuaccucucuugaaccauuguacugaaccauuuaaaaucacacguguuuauaugucuuggguguguauauauggguguguguggaggccagaggacaacuugggaguuuaguccuuucuguuuaacaugugggucuugguggcacacgucuuuaccugcucucucuuuggcuccauuauacugauuuuaaauucccuggugagcugcuguuuguuucuuuccuugacauuugcuuucuaagcauauccuuuucuuuagguuuuuuucuuuacugacuaaccugcuuuauugccauugcuuagcugcuacccaguauucucugguagguugcuuuugguuuaaagcuuuauugucugacuacuaguuuuauuuuaaaacguuauaaccucuauacaggaacgauccaggaagggaacuugugacucaggguuccaucuggauuugauguuucuggauccugacucuugggcugaaugucuaggcuuucuuuuuuuuuggcugugugucuagacaggagcugaaagcagagcaggcuggaggagaagcagcaggcuggaggagaagcagcaagcuuaggagcaggaccucucuguuguagccaguuucucuuugcagagcagucauuggcacaggcaggaucagagaagaggugugcauggauggugauuauugccaucuucagcgucugagcuugguuuguuggcacaagggauggaacagaagcagugauucuagacccuuacugugagcuuuccucuccacuguugugacaaucuggauuaggacagagcugcagccugauguagacccuggguugcaguguugacacccuggguauauuuuauggaucugcagaugcaauacacauuuagacaauggcuuuacauuuacaaauuuucaccccuccuauucugucuacuaaacugaguagguuauucuuuuucuuagaauuagcuguuggaaucuuguucuugggagguaggugauaaaugcucuuaaaggaagucucaguaggggcccacuauacccuauauaagauucaaaacagugguuuuuauguuuucuugacaucacaauacaaugcuaggcauaauaaauuuauaugacguauuuaucuuuuaugugcucauugcaccgugaguuuuuuccuucaguguguucucauauuuccaucuccuuuccugucacccaaaccaguccaucuucuuuuauuggccaucaucucuucuguccugccuuuccuguccugugccagccacccuacucuguucugcuguauccauuucuauuccaguuuauuagaaaguacucauugggaacuauucacauuauuucaggaugcagcauuuaaaaaucauggcuuugaaggaugacagauguuaaaauuaaaacuaccaaaaagucuuugauucuguauucgagagcuuuccuguuuccugcagaggugagcaugccuuuagcuugaguucuagcucaugccccguggcuuguuccuaggcuugguaggcuucagggacuuacagagcaccucauugugagacauguggcaugcuugaaagccaucuuucuuuccggacaguuuuuaaguaggaagucuuuagcaggcucucucgcaacugugucaaauagucugccagaguagggacaggagcagguuaaauuuguagucuccccaguauagcuuagcacuacugaagguucaacuccggguuacuuucuucagcuaucccugcaggcuccugucucccuucugcaaccauccacugauguaccuguagagaacguaugcccauugugauauagcccuuaagguaugguaaaccuguaagaaaaaaacaaaaugcaaguaagucacaaauuagccaaguucauuuacaaacacgauggaaauuaucuugaauauuuagccuuggccauuuuuuuuaaaguuuugauaaauuaguguugguuuguucuuaauaugucuauaauugaauuucaacuuucguuuuuggauucauauaaccacacauaaguuauauuuuuaagacucuugagaguacagcuaguaaaaaugucuugaauuuacuguggaagccugcucugcaaccaggacauaauuaguucuugauaaaaguauugauuugauuugaaugugaauugcguauuaaagaccgaggccacaguaaugccucauuaauucacauuauuauucuuuuaguuuaaugaauuggaauagcaaaguuaaaggaacagcacagaagacagacaacaugaaaaacauguacuugcaggagaccugugcacguguugcuaauggcuggcgucucuuguauuaaggcaugcuuagaacaucgugguagguacacuucugguuguuauggagcugaaccugcuggaacuuguucacucacauuaauagucugugcccucaaguuuguguuaaagaucacacagagacaaaaaaaaaaucgccaauaccgaguuucugucugccauucuucuaccugcagugugcagaaccacccacaacaggaggagggggaaagaggaagcuuuuguuuguuugucuugaggauggaaauauuuccagccaugguggauucuuagcacucaaaugccgaaugcuagcugacaucuuugggaguaaugguuugggucggcauugcuaacacacgggcuccugccuccaaaaaguucaaucagauaagccugucuugcuccuaggaagcauaauagcugcugucugaagugaaaaucuggagaauuccagagaaauugcuggcaacagacacuugaaggggagcucggaguuaccaaguucagcagacuucuggugcuuuuauuugcgagugaugcaauauacuagguagacccuugagaaauuucucuaucccuucagcggagggcacucuccuggucgugggcuguuguagccaguuacuuucuggucagucuguccuggaguguguucuuaccuuggagccaaagcucugcaggcugcauguguguuagcgugggggacaggggcacacuggauaacuuaacucuagcgaaugcuuacuggaggcagguuacuggcuucacccacugaguccgcacugcuguuccaggagaauaaacuuggucgggaaguuuuuguccaguugcuauuuugaagaauuuguuuguagaucuuccugagcaaaguuuaacuuuuugggggguggggugggggugguggaguuuugugaguuuugguaguagauuuaugagcuaucucaugguaacaugacugcaccacaguucuucauuaccagaucucuucccgccguccuuggaggcaggccucccucacagccuuucccuauuguagccaucacucugguucugcauucuuaccauuccuaauuuuucugaaaugucgcagaaauagacugaugcuggauguagauguugucuuuugaaucuggcuuuauucacuuaaaaucuuacgucuaaaauuucucaugguuauuuuuaugcacgaguagaauucuguaguagauguaccauggugucgaccgagggagacugauguaguuuucagcuuuuggcauuucagauaacguagcuguaaauauugaugugcaaguuuauauggguguaaguucuccccucccccacccaaauaccuaggagcaggcugcugagucauauguaaguauaguaagugcguauuuaauuuuaaagaaaccacuagauuguucuucagaggggcugugccauuuuauauucauuuuggaauugaacccuggucuccuuauaucuucauaagcauuaaauauugucgggcguggcuguuuaaucuuguccauucuaauagauguauugagaugucuuuauggguuuaagcuguguuuucuucuggcuugcugaugagcaucaaauguaccuauuugcuaucugagugucguggugaagugccuauucaaagguuuggcccauuuuuuuuuaaaaaaaaagaaaagguuauuuucuuacugucaaguacugaaaauggugggcauaaacccuuggucagguacauaauuuguguuugcucaguccguggcuugucuuuucauucuccuacuagugauaucuuuuggugagaacagcuuuuagcuuuaugaagcccaguuuuucacuuugugguuuauggauugcaccuuccaugagguaacuucgaauaucuugccuagcccaaccaugaagaauuuguccuauuuuuuucuuggaauuuccaagugugucuagccuuuuugacaaaguaacucacuguugucaucaauaaaauucaugcuugaaaacuguguuguucagugacauacacaaagaaacuucaaaaccaaaccaaaccaaacccucaguguuucaaauaagcuuaugauuuuguguugggugccguucauagccauccugagacacuggucaccuuuggacugcuuugggcauguuaccucauuuuguuuuugacucuguuaaccauugaguuaauuuuuauauauuugucaggaagagauugaggcuuauauuuugguauacagauggccaguugcuucaaaaauaucgguugaaaggacuguccccuuuggcuuucaacugacuccgcaccuuugugaaagaucaauaucugugugguucuauuuuuggacuguuucuuuuuaaucaaugugucuaucuuuuugucaauugaaguaguuacuuuucaagccucagauuacugaugagggagccuagucuuagccaaauuaagcaucuugucuaagguaauucagcaacagaugauugagcagggccacgcuaggggagggcuguccaguucccaaagcugugcuggucagggaaguggcuuuggcaccugaaauaauuuuaguuauuuuguuucuguuuaaaaugguugccuuuaaggaaugucugauaucugugcuuucggcaccauagaugugaugagccgaucucagugagucaucugauaagucuguuggaaguucuuuucugcuugcaaggccauuaguuaguagaucuaauuacuguccagcauuuuuaacacggcauaauaugcuuuuuaaaaauauaggcuccauacaccauuuuucucccucccucccucucucccucccucccucccucccucccucccucccucccucccucccucccucucucucucucucuuucuuucuuuuuucuuuuuucuuuaacgagagugguagaaauauauguuccuguguagcaaggaaaagauguuuaggauuugugaauuugagaacacagaugggccaagagugacuuccauccagauggcuuaugcgaggaacuugguaagaggugagagagcgaugcuagcgugacagugaauaauaaauuaguguuucaauauuggcaaacuggaggauuuugaagaaugccauauuuaguuagcuuuugaugauuauaaccuaagcucauguauuuaaucucuuaaaaacuaggccugugugccugccuuccuacuccuuccuauaccuuuacauauacccacacacaugucaugugugagagacagcuccagugaguucagguuagacaguauugcugcuuuuuaaaugaaacguaacguaaaaauccagucuuaccgugcaacccaggcuguccaugagaguguauuguccugucuucaccucccaaauccuggaauaacaggcuuagacuaccacgccuggcccuauguuagucauuuauuuaauaucuucuuucuuuaaggugcuggggacugaacccaggaacuucaaaucauuuuuaggaagcugcacccucaucucuauguaauucucaugcauacuuucuaaaacuuaaaagcauuuugucuuuuucaacguguguggguguuuucccugcauacuucugugcuccacaugugugcaguuccugcagagacccaaagagggugguggauucuuggagcuggaauuacagcugguugugagucaacuuaugggugcugggaaucgaaccagggucuucuagaagggcagccagugugucuaacuauguaacugucccccuccacccucauauguauauuuuuuugagaccgggacuggcuuguguaguuuuagcuggccuggaacucccauguagcucaggcucguacagaaugcuccaucucugccucgucagugcuaggauucaauggcucccucaguaaguacuuuaguugaaggaacacauuuauugauguuguucaacucucuucaagagacaaauuccagucccauaucccugcccccccugugcuguuuccugaggcuuuauuagaugcaacucuuggaauuacuuuuugcugcuaggaacuuagacacaaaauugagcuguuuccucuucuuuuuaauaacaaagcaaacauuuccaacuucccucuuuauuucuauggugggcucuuaaucaccucacaguuuuuggccccccauccccacccccuuuuggugaccaaauccguaggugacuuggcaacaugugauuguuaguuuauguggcuccacuuccagugcuuucuuccucucccuucaguuuguguccaccccuaguucaaugcuucccuugacuguugcaggcuagacugcgucugucuuguuucaugggcauugugcuuuccuccugcucugcccagaaccugucucuugcccgcuaguaguugaaaaauagggcaucggcugcaucccuucuuugaaucccucaaugcacugcaaagagcaagcucccuauugccuuugaugucugaaacaaccugcauggggucugggcuagcagcaucagcauccccugggaacuuguuagaaaucccccaccccagaccugcugaagcaugagcuuuagggauggauccagcaaccuguguuuaaaagaguucuucagacuguuuuuagcaugccaacacccccgugaaaaccaccucuuucugucagauguguagaccagcuuaucuuuuaccaucucuagguuugguuuggguuuucauucucaacagccauccauuucucagccauuucuaauucuuuguuuaaaauaggcuccaaauucacucccuggaggaagaccuucaauuuauuuuuccuaagcaacaggcauuugcuuuagacuguucuuauuucuuguagauguuauuaaggguggagguugauggcaggguguucuguauuuucagcugguagagugauagaaugugucuuucaacccaguacuggggauguauuucauacaaauuuuugucaguuuuaguagcaaauuggaggaaaaauauuaaaugucaagcaguaaguuuauacuuaauugagguaugucaugagcccagccauucaguaguagagaugccuauguucaacaacuuugguuguucugggggugaccccagguuuccuaaucucucucuugaggcaucagaggacaucuugcuuaagaggccuacaauacucucucgaugguaaggaugggaguagagugggcaggcauuuugacuucugguccuucauuucuuacagucguuaauucauacuguugggccuugugcuaucauuugaaaaauuaggaaccuauggucuguuuccugcaguucuuacugugcacggauuaaaugagauuucaggggagguccuuauacaaccccuguccuauauucaguguucuauaaauguccccuuuaaguacuaacaccacuaaaacagcacauuuaaagcaaaaucuccauggaccgaguccugucugcucauagaaugccuuuauugaauguauugcuuguagauaagaaauuucauggcucuguucuguacagacauccucuuuuuucagaacuucaaguuuuagugcuuuauaauuguuaaugaaugcuaagaaauauuacuugacuuuuugacaaaucugugcauuucuuaaaauuuauccauucaacuuuaguuuuaauggaugauagcuuacuuucuaauaguauuugaaagguuuuuauggguuuuuuuuuuccuuaguagaauaaauuaggcuagcuaaauggucuccuugauacaaugcccuaccaagacuguuguuucauugucaguggcugguuuaaucaguauuauuugaagguaauuucagacuauucuggcauuugguuccuuauuuaguuuguguucuuucccuaacacaucuaauuaauggaacuguccaguggucuaacauggagaaggagagaugacauggugaaaacucuaaccauugugauagcagcugacgcuugucuggcuugcuacagucugcagaguucuuucacuugcaucacacugaagugcagagaucaugaggagcuggcacugcuauuuuuguuguuguuuuuuauuuggaaaauugaugauuauauuauugacucuucacaaaaccaaggcgguaaaauaaggcacccugaaguugaggauaguacagugauaaaaagagcugcaauucuuggcugaugauggagcucaguugguacaaugcuugcauagccuggccgaagcccuggguuggcuccugacuaccacgcacacugggaguguuugacagaggcaggaggaucagaggaccaaggucaucuucacuacauuguaaaucugagacaagucuggauccauuagaccauguccaaaacaaaagagaauuuguaauucuuccugggcuaauacacagagaaagggguacaaauucacaugauucaaaagugcugccucccacaguccaucaugugggacaagagauaauccgcuuagguucagaguuuggcuuggcuuccuuucuugugacagaccucagauaaucauuucaucuuccugagcagagcucuaucuccucguuggggaauggggaagcugagagcaucagcccaguggauaaguaaggcagcgccugcacuacacugaguacucuguaagcacuagcugucacugucgugggggaguggaugaagugccuccuauaaaauguuagugauuguacuuagacguaauuauaauuacagaagugcaaaccagagugucuagaagaguucacucugacacagcuguuuacuucuuaggcggggcucuaaugcuacgguaaagugucuaugucuuucuuaguuugaguguccgcauugucuuagggacaugugaggacucuacuuuaaaugaaaaaaaaaaaaaaagacccaaaacaaacaaacaaacccccugcagccuggguaugauuucuauuucuaaaaacucaaaaccaacaucaggacuacagcagcguuccaugugccagaaagauucauccacacagaggcaggcauucugguggggucaaagguacaguagccauuaggagaagggaguuuuguuaauuuccuucuuuagaaauuauaguuuuccugauaggauuuucacgagugagacaaacguucuguuggugaaguucagugguuuucuuguggguuuggcaaaucaccuguaccaggaacccuuuccugauugcauggagaugagacucugguuggcuucaagccuuuuccuugccaacaguccugccucaucucacacaauggagaacugagaacacaagauugacccugugcuguuuauagucuuuauuuauaauuuucucugcagcuugauuuuuuuuucagugagaaaagcauuuuuuuuaaauguggaaaaccuacuaaaauguugguaaauacuagaaaugggauuaaauuuuccagcauuuugaauuaacauuaagauauggauguggcucuucgauagauaccauguauagaauguucuuguaguccuuggggcucuaccucacaaaauaugggguugcauuaugaaauuugcauagcaucccauguuuucuuugcucauguuucccccaggcauuuuucucucuguccucugauucucuuuccuccuuugcauuuuuuuccuucgauuucaaguguguuacaggcaggaggaaaaagucccuuucucuauuaaagccacaggcuguguaugacacuguaaugaaauuagauacucagaggaaucuauucacuuuuaauuucugauggcuauaaucaacaugaaaagcuuuucuuaauaauuaauguuggggacuaugaacuuuagacauauuuaugacuucuuuccagaggauacuugggugugacuagacuuagaaucuugaguucuuuaggccccuuugauuucuucccaguacaccuauaaacucuucaagugaaaaggugugagacuuuuucauuucuguuucaaaaaagaaaaaaaaaucuaaaugugacuugucucaguucaaaugguauggaucuucucuuuucuaugcccaguaugugugcacgcaauugcuugcuugccuggauaugcaggugaggauaugaauguggaggccuugauugucauccucagaaauggccuccuuugagauagggcaccuaucuuugaguguguuuauuucucugugccuuuguuauuaucagcacaugucaaaauggaaaugccuuagaaagcuagcucccucuuagguggccccacacgaguuuaggaaacacuguagaacucuuuguggucaccuuaaacaaacaaacaaacaaacaaaacaaaauacuccaauaccaaaaaacugggucugguguuugcuccagcucgugaggaucauugggucauggcuuuucuaagcaaagaacaaccuuacgcucagaagccuuuccaccuucaaucaguugggcuugugccugcuagccguuuccacucugugauugauagcucuguguuagguacccagucugaagcguucuguacugugugaaaguucagaguagugaguaguuauuagugacugaaaccuaauuuagauucccagaucgaaaucguucuugaagaacgcuggcccuccacugcagaugucuugugccgaugacgagugugcucaucagagaacaagcucucacccugccuuucauaauauaaaagcguuuuuaauccuuccaaacaggugcugucgcaguuuauuuauaacugaugcauuaaaaugaaaaauauugaaagggcccuaaguggaaggcggcuuuugaaauauugccauauuuaaaugauaggauuuugucaggcugauuuguggaaaggaccagucagugcuggcugguaagucuuguacuccaggcuccucguaaguucaggugcuguucucugcagugcgacaguccuguguaggcugcuggcccuugcaguccaaaugauuccacucuccuauauucauaaucauuuggucagcucccuuggucuuugccauuucugaccuuugugaagcacgccaucugguaggcuuucuuggccuuccacauucccugcagcauaaagaugugaacucuucuuugagauaaucggcagguggucagcccguuucuucucaguccgacuuucaucucacacauggggcagguaaauauguuccuucacacuggccuaggccugcugaucugaaaaugucacagguuuuacauucccuccucauuguguuuuccugggaaagccggccagagacuaacguguaguuggguuguauggauggguguuaauaucgucccgugccagcugcucucacuaauuuguuuuuacagggcagcuuauaguaaaugaauggcaugcugaauauuuuacugagauuucagauuauccgaagaauauuuuccgguuuacuaauugguagauaaugcugaguacauugguguugacaugagcaaauggauuuaaaaugauuugaagugagccucauuaaaagaugcuguaaucacaggcagcaggaaaugucaagccucucucaccgucacucgcuauaguggaccaggagcuguugcaggcuuuggggagggggaugucagcuuugcuguucuaguguugggaugucaaagguuugggcaagagauugagguuuuguucauuucuuaguaucuuuaccagaaaguaaacagcauacauuucuaauuaccugaguggaugaacgaacauuucucugagaauuagagugaauucuacugugggagucucaccauccacuaaagacuggauacauggaaaucauauuuuuuugcccgcucuguacuggaagcuaauaaauuauguaguacccauuccagcagaagccugcucuagaauuaaagcuaaugugcuccuugaaacaccaaagaaaacauaggcaaaugcaucacagguuccccggcugacgcuuagaccacugcguuaguuaccuuuugcuuuuaauuccuuugaaaugguaugcaagcuauuugaucaaaauugacccccugacacaaucuuagggugaauuaugcagcaguaacuauagcagugaggagggaagccucugguacaagacuucucaggcuuccaaugccacucuugcccaggccaaguguguggcucuuauacagcucagccagucugagcucaagguuuguuuguuuguuuguuuguuuguuuucuuucaguuucuucagucuuggagauaacaagccaggaccuuacaggggcuaggcaaguucuuugccagugagcuguaucaccagaccuuuuucuuuuucuuuuccuuuuuucucuuucuuucuuuucuuucuuucuuucuuucuuucuuucuuucuuucuuucuuucuuucuuucuuucuuucuuucuuucuuucuuucuuucuuucuuucuuuucuuucuuucuuucuuucuuucuuucuuucuuucuuucuuucuuucuuucuuuuuuucuuucuuuuuuucuuuuuuuuuuguacaaaguauauagaaucagagauaacacugccuuucucgugagguuguaagaguauuuauacacaggaugauuuucaaggacaaagccgcuggcgagggcuucaucagagcugguucuugaccuaagugaguuuaucuccuucuuucaggaacuaaagaaacacagugggucuuaauugcuaacucauuaaccaaauaccuuauucuucauacuccagcuuugugaagacuugucaucucggccagaauauaguuaucuagaacaugaagggcucugugaagcagugugaagaacuugggacaugacgagacuacccugaauuccugcugucggagucuggugguacuuacugcaguauucuugccuuucucucugacagcuaucaacucaguuucucuuccagccccgaugugcugugcuaagaagcuagcccuuccaggcccugaucaagggcucguaaugauuucacaggaagaauaccaugauccaggaguuuauauaaugcuaaugaaauccacuaccuggcaagcaacauguucauuucaggcugcucauuagcaucgcauucaccuagaugcccuguaagcauuuguacaguuuguguaucuuuuaaauaguaccagcaugggucagcuugacauaccaacaaucuagcuggaugugcaguagauucaaaugccucacggaagucacuagagcaugcacugccugaguagagauaauagaaauggauucuauugaaauggagggagaagguucuggacuacccaaauaacaauuaaguaaccacaguucucgauucagagcuucuggcucuauugccagaacagaaaguggccuccacaucucuugcaagacagcugugaguuaauuuuuuuuucuuuaauuuucccuuaaugccuugauguauauuguagggaggagagaaaacaaaacauaacuaaaaaucuucccacucaaaugacccucuuagcuuuucuuuguacccuguauaccgugcuggaaauguaaugcucuucaguggcccugggugggauccagccucuguugacaaauguaaaaaauggcccagcagacugcagauguggucugugggugaguguggacuucccucaucaauggggaaauggggcuuaagucaggcuuagaaaaugagaaaaauccuuaaggggcgugacuaaugucuccagugugcacuacgcuacauaaacccauuaugugcuuuaauuuaauguucuccauaaagauucaggaccugucaguggaaggaaagaaacaagcaauccaucuucagcgaauugugaauagaguuuuagauuuuaaaaaacacacauucaccuccacauacuuugccuucauucaguuuucuccacagcucgcccccuuccccucccuguccuaucuuguagccccacuacuuuggcugcugcagaauuguuuuguucaguggaaguggacuaauguguuaauaucuaauauugcugacugagucaagguaaaggauaaaggaacagaugcagagcgcccgaccccucccuggcagcggacuugagcagaccauaggagguuugcucuccucugucccccaagccuuuucuuuucaggcgucuggaguagauuugagaugaccagauggaugugguauuuuagugauuuuacgucuuucgcaugcuaggaguguuagcacacuuacccguacuucacuaaagcaagccagaauuugucgugauuuuaauugaugagagaggaaauggaaacugcaccgggucaguguagaauuuuccauuaugaaaacauaaccuuucacagggcacccauuggcagugaaaugucagauauucacauuccccugcucccccucucagaggaaagaaacguggaucugcauuagaccuccuauaauucaguucuagaauguacuuacauaauaaucccauucucuuuaacuuguuuuguuggcugauguauauagaugauagguacuucugacaucauuuuuucccuuucuguuucuuuuuucuuuuuccuuuuuuuucuuuuggcuucaaauuguuuuaaaaauaggagaaggcuagugguggguuaggaaauaggagaaaauauaaauuucauuuuagcaauuguagacagguaagaauuagucuuaccuguucuuuuuucuuggggagacacauuaguaaaaugaggcagagacagaauuguuuaaaggauuaaugagauguguaugaugcucuaaugaaguuugaugagcuagagcugagagauccgaagggucuggguggacaucaggguguuuguguaucucuggggauugccccaauguuugccauuuccugggaggggccguguauuuauugguucugaaagagacucccaguaaagccacucccacuggcugccucuaagcaccuccccuuccugcaucauugcuguacucuuucccugucuguccgguucaucuccuuaucuugaaucccucuucccuucucuuuauccgcuuuaucuucuccuccacugccucuuguaggcgagacacgguuuggaguggaugaucuaggugcuagccauuuugacugccuauacaaaccaaacucugauuggcucagccggggcagaaccuguaagucuugugacgcuaacccucuccuuguugauaacauaaugaugguuuacuaacuucccuugcuuucuucccuccuucuccucuacaucagaaauaaauuacuuguggaauauuuaauagguucgcagggcucugcucugguguuaucuguuuuaauuccgucgagaugagaugcagcgcuugucagcagaggcggcugaugaugucgguacaccuugcugagcacaggucacgguggccugcaaaccuaaauugggugguucagcagaggcagccuccugcugcugagugggacgacuggaugcagagccucagagcucccauguagcugcuggguguuaugcaguuguucugccgggguucaugcucccucccuggcuaccuagugcaguguccugggcugcucuugggucauucugugguccaacagaagcagucagcuuucugagagccgucuugcaaaaugauauuucugaaggucaccaagcauugguagccugcaguuaagcauuaucugccuugcccgcccugugguauuuggcaccauuaacuucuguuuccuuuuacaaauuccuccauuuguucugcggcacugccuguuuuugggcagcuuuauuugguggcacuugggcuggcuuuuuuccccuucuccuaccagcuguuuuucuacauuuuguccuuggccauuuucuucucuuuagccuggauguucugucuacuagaucuuauucacuuccccggggcugucuugcauucugucaaccuggacccugucccccuuuaaaaauuucuaaaaugcauugucaacugccuucugucccuaguuccacugccuccacaaaauccuguuguuuaaaacagaauuuagggcugggugauagcugucuauaaagugcuugccuugcaagcaagagcucccuacuaccucuccccaggcauuggucaagauuauaacccaagugcuggagagguggagacagggagaucucgaggacuuacuaacuggcuacuuuggugaguuauaagcaguugugagaucuugucucuaaaaaaccaagguggacggcuccugaagaacagguugaccucugccccccugcccccgccccgcccaacagacaaauaaagagcacagcuccacuuuacuguucuaccccaguuuccacacaaauacacaugcacaccaaaaggcugaaaugacaacuaagauauugccuccauagccaccgcccacagcaguccccugaagcagaugucccaugguucguccucuuuuuuuggggggggggguccugauccugggagccuccagaccugaaucucucagagucuucuuucuauguuaugugcacguggcacaaggucuuccccuugaugacagaguuuucuccaucaggacuucccauuaccauccuuaggucagcuggcgauguguuccucuagagcauggcucauccacauaguaaagacggauuugucuuucucagucucuguuaucaccacugucuggggccaucaggauuccucggcugccuucucuccagugcagaugcgaucucccaaugcagucaaccgcuuuccacuucucacucuuaggaaguuuuucagcauccaucuuuucucaugucuaugcugugcggcuuauaauccuauuggaagaucaaguccuucuugaccgccuuuacuuuauauuggaacuuugauccauacucuuuuugguggggaagggaggcaggaucucauguagcuggggcucacuuugaacucguuuguugcaaaggaugaccuugaaccuuugaucuccugccuucaccuuccaaguacuuugguuacugccuucauggucugucauacuggggacuguaccaaaggcuaaggguguggcagccaggcacgcuuccaauugcacuacauccucaccccucgauguuuuauuccaucugagguuuguaacuuucauuuuguggagcauuucuuccauugcaucgcucagccgggcuacaaauacuaacggaguagaagcuuucuuugcacacacuuuucuguaugccacccagcacaguaccauguaaauguuaggagcccaauaaauauuuauugaauggauuaaugaacaccuacacugaaaugcuacuuagguuagcaggcuaacuugaaggaacuuaaagaucucuucccacuaaugaucuuuugucuaauuguuuugcuaccuuucugcuuagccaugcaaauuagcauagguucaugagcccaaggccugaaguaaucuguaacagaaagaaaccagguuguagguguacaugguuuuaguccaagaaaaauuggaaacauagugccugcgaccaguuaucaauguaagcugggcguguccccuccccucuuaaaaagaaaucuuuuuucccccuagcccucggcaguacugaguuuuucuuacucccuacauaggccggaagaagcauggcaacaacagcacaaggguggauaggaagaggaacuggagacaggcagaaaauaugguguuggaccguguuuauuaccuaacauacaaugucguuguuauuauuauuauuaugacuguuauuaucacuuccacuuucaccauuuaucaucuagaaaacacaggugacguuguauuuuuauaaaggucccuagggaauuauguacaccccauagugaaagguuacuacauggcaucuuagccuacggggcuuggucaccugugggagacgauuuuugucaaaccagcaaagccguguguaguugcgauguauuguuccgggcuauuuguaaauacuguauugugugacacacuuccagcacaggggaaaagccuggccucugggacugaucugaagagcuguuuacagcuguggcaagccaauaccauggccgaagggaaaaggucugcuuugagaguggaccccaacugaagggggacugugugccucccuuaacccccuccguggagccuggcugagcacagcagaggcugcugggagggaacccgggaagcuucagagagccugaacaugggaagggaggcugcucuggauacagucuucucucuaaacccaccugcuaacuggagggaaaagaugccaggcuuucaggucugcucgcaggcgcauccaaaauuuaaauccuuucugugggaaaucaguagaggguuuaauagaagguuaaacaaauuacacauaaacacauagaaguagucuggcccaaguguggaaaggccagagagcuggaguguuauggugaaguccuaggagguaauuuauuuuuaaaauuuauugaacccacugaagcauaagugugaggauaagagaaaccauaugcgcaugugguccagaaugaaauucuucagaugccugagaugguuacaacuagugacuaagcccuucugagucuaguuuagcccuuuccagugcugccaaaggggacugaguggugacagcuggucagggcuacccuuccgccacacugcaaggaggaaacaggaccuuuagcucucaugccugcuuggagcaugaucucccucucuuaucuagucuggcuccuuccccucugagaugggagugggguuaggggagggugggucugaacaaauuuuauucacuauggaguuucuucccagaaaaaggguaaccaugcuguuguauagcucacauuuaggaaguacaaaacuaagccaggugugguggcaugugaggacugaagaugcugaagcaggaggaugggcacauguucaagaguauguagagacaaccaagcuuguaagggcuauaaagcuaggcccugauuuuggggcagggagaguauaaaaauauaucagagggauagauuucuuuuuuuuuggugggggaugugucuuaaaaguuauuugugaaauuuggaccuuauugauuaaguggguccaugagaguaaucugcagugacaucucaucagagggagaaucugaaggaaucaaaccggagacaaaccaugggcuugaaugcagaagugcacuguguagcaguagcgcuccuuuccauucauuguugcaguuauaauuauggaacccaacguauuuaauuggcacgguguacuccucgcuacugaauggguugcauuguuuguguuuuuuaaaaaacaaaacccuugugcacaugaauuccugcucguguugcucuuuggcucucgagagguuucuuuguuuacgugaugacugauuaacugagccguggagccucgaagcuugucauaugcaaaaccgaagaggaaacucugcuguaacugagaaaggcuuuagguaauuuaagaaaaauuuguucgaucuuugggaaaauauauguucuaacuuagaaagucauagauggaaauaucaguugaguccaguaugugggcuggccucuuccugauugcagagcaccugauguguggcguuggagagguuauuggcaugcauguuugagucugaaccuccgaaggggaaucucugaagaagcuucugccuccugaacccccagaaaugagagcaguccugagugugguggaaaauaaggggcucauuuauauaggacuuucuaguuagcaccagagacucguagcuuuugagaugagaugcacaggcuaucucacaaggauagcaaccaucacagcuaacuucaagaaugccugcugccucccaagcccuguacuaaguacgcaucuucccgucauuguuucagguuuucucaacucucucugcguuccucuuauccucagccuguggcucaguggugcaguuuucuuguuuguugacuucucagcuaacagagccggaagaugaucccaguggccuuucaccugcuucugcugucugcuguagaaugugguagaaagacaaggcucauuaucucaaagccuuccucgucuuuccuggguaauuccucacuacauguagcaucuacaugcauuggaaaagcagucauagcucugucauuggagauugucuccagaggcaaagauccccagaacauaggcuguguuuauuggugccacagguaggccugcucuuggaugcagaaggccucuaguucaauuucuugcuggaauggauucuucacaaauaaggaugcuccuucauuugcuguuuacucucacugauuucuucuguauucuguccuguccacaacagacugugcaauuuuuuauauauucuugccagaaugcacuuauucauuagcuguuuuuuauuaguguuccgguugagaugccauuuuuccauucaaaacuccaauuuucaguggcuuuuaauuuuacaaaacaauuaccuacugggcugaaacuccguaggcugcugcuucuccaggggaggaggucuggugggggguacgggggggggggagacaguuccaguuucccuggcagcuuuagcauuuauauucaugcaagugcucuuuaaauaaaguugcaauugcuuaauuauuuaagcaaacgggaacugaaugguuuagggaauuuuucuagcaggaccaaaggcucuggacucccuucguauuccucacucagacagugugauuuugugcuggccaacuaaaagcgagugucucacuugugcuuugguauauuuagaaaucugagacuauuuaauuuggaguccucuuuuuuccuccauucauucauucauucauucauucauuucuucuucuuuuucccuucuggaauguucucuguagcccagacuggccucaaacucagagaugccugauuuugaauacugagugcugggauuaaaggcauccacaaccaggcuuggucaauuuggaguucuuaaucagguuacauccauggauuuuauaucuacuaccaaauccagggccuugaacaugcuagacaagggcucuaccacuaaauccauggauuuuagaagucauguuugaauuuuuaguuuauaucuaaaugcuuauguugacuaucaugauuaauauuuaaauauuugucagcuccuugaacacuuacugugugagagggacacacacuguuuaagacugaaaguccugacccuugguacugaccuugccuucuagguggcugcguagggauuucccugccugucauuguucucuuggguagcccaccuuauuagggagaugugugcagaauccauccacagagcuuagugucccuaaggagcuguggugaccgugcagccuggaguucucaaccgagugagaccggggcccuguucuuaaagggccaaugauccgcuaagggcaaagcauuuccagaagagggaacagcccagagaggggucugugaaaccaugcaagucccauggcuguuuuggaaaccuuugacucuccagggucuaaucuaaacaggaauacgagugcagcugcuaaguggagggguccuuuggagguuuguagcauacauggcagccgcuauuucauuugaucuuugcaaaccccuguguggccaauagggaucaccaccucgauuucauaagggguuugagggauucaccuggaaucacauagcugcugcaagagcugguacugaaguccaggcuuugcgcuuccuguccggugcucugcuccgggaucauucagagccauuggccuuaucuacauauacaagugcuaagccuuuaaugguaauuuaaugagacuuuauaauguucuuuuuacuuaaacauuuuuacuuaaacucaucugaugagauaaaauuauauaaaaugaaauugagguuauacguuagcuucucuauguaugucacugguggcuguaauuaaaaaaaaauuuaaaguguagcuauuuuuuuuuuccugaguguggagacucuaaaugucacuuccuuguugcauuguguggucuuucuucucucuuuucuuucuuuuggcuucacugucuuuuuuuucucuuucucucuuucuccuucuuucuuuuuuuuugggggggggguuugagagacagaguuucucuguguagcccuggcuguccuggaacucacucuguagaccaggcuggccucgaacucagaaaucugccugccucugccucccgagugcugggauuaaaggcgugcgccaccacugcccggcucacugucuuucuugucuuagggaauggagaaaucacacccacuugaguaucuugauucucuuaaguaugcaguugaaagccucaucucaggccuuacuucauuaaugacaaagauacauauuggggacagauguucucuuucagggucuguauuuauuuuacuguauuugauuuaaacacauugccuuggcaaaauuaucaaagauuauagcuuuuugcugucauuuauguauugaugagugugucucuauccgugcuuagaggaaaccuugcagaaguccuucuaccuucaggguuucaguggaucuaacucaggcaaucacacaugguggcaagcagcuucuacauccugagccguugaccugacaggucacacauguguguauguguguucacguguaugugcacaugugccuuccauggugugaauauuugaaggucagaggugacacugggugccuuccucaaccacucuccaucuuaguuuuaauacagagucuuaaauacuggguucaugccuuuuuggccacacugguuggcccgugagacccuguauccuggaaucucuguaucugcagcaguggguuuacacauggugauggcaugcguggcuuuuaugugaacucagguccuugugcacacaaaucaagcaucaucuccccagccuaccuccugccccauuuuaaaguuacugcuugaacaagaagccaccaccuccauucucuagugcuuccggacgcacgccauugugcuguuccuaagguauucaacaggaagggcagaggcccaguuccacuucucagggaguacucacugaacccaggaguuguuggauccugccaguuaccaacauuuccaaauaaguaugcagggcaugccugggcuuucgacuugauuucugaauacuaaguuguugggcaaggagagaaaugcuaauguccccgagaucugugagaugcuucuccauguuaggugcuccacagacccacagguuuauuuuauuuuauuuuguuuuauuuuauuuuauuuuguuuuuguuuuuguuuuuuuguuuuuuuguuuuuuuuugcucccaaggaagaguacuuggaagguccauccaccaucuuuguuuucugcaggaacagucuuuuaaaguuucuuuuagaugcacagaugugauucuugagcccucuggccucauguguggcuuuucuggaauauucagagaguuuccugaggugcuugguucuugggcauaugcccauaguugagcguaucagugaagauuccagggccccuuucacacuuggauucuaaguacauuauuauuuaaagcugcagauggggauuuucuacuagggacuguguuuaucuguuuguucuguuuauguuuuugucuuugaagucuuucuaagagauacuccugcuccucaaugcuauuuauuuauuuauuuuuccuuuuauucuuuuuccaaagaacauugaagaauuguaaagaauuguauguuuaacuuuucagucagaguuaccuguaauguuuggagcuuucuguuugagaccuuuugaguucucacuuuaauuuugcaauugauugcaaaaagggggaaagaaaucucaggcuggaugcugagguccaagaagcacuuguuaauaagaaucugaagaagagaguccaguaacuugaccauuguuccucagagguuuucccuugccuuacuggugaagguauguccauggacugcaagggcaguaugggacuuccucucuaacucgucaagaaaggggacuucuccucauccuccucuuccucuuccuccucuucuucaaaauuuauucauuuauuuuauguauaugaguacaccauugcucucuucagacacaccagaagagggcaucagaucccauuacagaugguugugagccaccguguaguuguugggaauugaacucaggaccucuggaagaacaguuggcgcucuuaaccgcugagccaacucuccagccugaaagggagauucuuaugcucugaccugggaggaaagcuggcagagacacaaaugcuugcuguguccagugccagaaggagaagguagggaccagguugucacuaaaagauggacaggcagacaacagacagacugguacucaauucaagaaccaguucuuagacaagucuuugagcaugaaauguaaaggaguggucuuugacucuugugcauaacuacagaggcacuugugaggaugccaccauuggcuuccccugagagaacaggacccugauuguggacaggggaagagcuggcucaagccugauaaccgaguucagucucugggacagaccacaggguguaagagaacugagagaugaacguuggccugacuuccacauacaugcugugguauccauacgccccuucuccccccacguaaauaaagggauaauugauguuaagucccaucuccugugggaaucugccauuuuccauggagauuucgggggauuucggagguaagcgguaugaucuuuuuauaaggcuacagugaagcugucccuugaccccauggagaaacuaguuccugaaggguugaauguauuuaaguagcacacggcugaacuggagacacugccagagaaaugucugccuggcaaauugugguucugccccaagaggagcccucuaccaccuugauuuaccuggcaggagaggaucuucugcugacuccacugcaguuuuccuuaaauuccucugcuuuguguugugucucugggagccauucaucuuugucacccgcucuacuucugcuauuuuuagcccggugccaaagaccuuacagcuuccucaagcuaaggcuaaagaauuaagaucuguuguaaacaaagccucacccagccccccuuccucuuucuuccuucagguguucuuuggaaucaaguuuacucucuuagaaccuggaguacucucuaggagagagggagggucuuagucaguuuugacuccagagacuuuccuccuucguaagaacauccuagaagaaaggaacacuugguuguuuuuuguuuauuuguuuggauuuuuuguuuuuguuuuggaaccuauuuucacauguuaaagcauaaaacaguaaaaaaaauuuuuuuuuggcuugugagucauaucugugaguucauuuaggcauguucuaguguuuguuuagcucagucaguuacuguagcauuuaacuucggauuucauugccauaggcucucguguggguuaaguaccuuaugacuggugucacuguuggccaccucugggaaaacacuguuccaggcacauacucucugaguccuuauccuuuuaugaugccuguguuuauaaaaccagacuaaccagacaagccacagcguaacuuaacuguucaguuuugcagggcuaagccuuacuagcaggcuaucaggcaaaguaguggaugcccaugguuguuuuuaccccuugaagagaauaggggugcucacucagccauuucuuccaccccucaagucccuugugaggcagaggcagaggcaggaagaucucugugaucucugaguugggagccaagccuggucuauauagugaguucugggccagccaaaggucacauugugagacuuuaucucugcaguuuaaaaaaaaaaaaggcuuggagacugaaaugggguagauauuuuccgugauggcagaauucacaaguguaaacuuuguaccuauuuuuuuuuaaagaugaagaaaacguauuguaaauuaucauuuuuuuuauuccacucuuccaaguugaguuuugccucauuuuauuuuuaucucuccaucgauguuugcagggcugccuguuucccccaaguguuaauguaaacacauuuucuuuugagacagaucagcucacuucccucuggaaauccuugccuaugaugugguaacccucaauauaacucuccggcccgaaugacauuucauaacuguguacaaaucaaacagacuguugauauuaaaugacaacauuuaaugccuaugucaacaauucacuuaagucucauuucauuaaaauacucuugaucugggagcagccgcucgucugaguagauaaagcccuugacuuucaccucucguuuccaggugaaaguguagcuagcuggugagcuguuagcuguuagucagguggauuuuauagguucuggccugggggauuggaacagaaaucuaauucuuaugaucaggggaaaccccagguugccuggucaagaaccagcgauucccuuacccccacuuuauuuccugugucauuugauucccacauccaaauuuuaauuuuaagcaaggaacuaacauaguuaagaaaguuaaugucguuugcuugaauuauauguccuuucuuuuuuguuuuuuuguuuguuuuuuaaacagcagccacaguuaguuucaagucuuuuacucuuaauugacuaaucaauaaaucaauuuggggacagggauuuuguagcucugacuggccucucgaccuucuuaucugagguugaccuugaacuuaugacccuccugucucuaccucccauguaaugaugggaucgcaggcaugaguagcacaccuguaguguuggauuggcuuccuggcuuucuucagguuuucuucuuggaaguuugagagcauuuuaguugguggaugccuccugcagacucuugacucucuggggagagcugguucucccgcaaaaaaaaaaaaaaauauauauauauauauauauacacacauauauauauauauauauauauauauauauauauauauauauauauauauugauuaguuaguugguugauaguguuugugugugugucuggguguacacauguguaccacaugccugcaggaaccuuuggagguuaaaaggguauuggguccuuuggcacgagguuauaagugguugaguccuccuguggcugccaggagcugaaccuggaucuccugcaagagcagugaguacucuuaacugcugagccaucucuccagccugggggauucucucuuccccguuuccugacuacaauccuaauuuaugugacagucuuuuauacacauugaguccucugacucccuguaguuuaggaaagaagggcagccuugcuaggaaccuucuccuaggcugaaaugaucaaggguggaguuuccugcauuuccacgucaggaguucuccugucuuagaugaaggcaguaaguagucucugccuguaaguggccagcuuggauauuugaauaaaaagaguauuaucuaucacaaacacaguugcugcugcuccuuugaaggucucauccugcuucaggcccugguccuggccacccaguaaaucuuucugccuuguaccuccuguauugugaucccucaucaaguucaggguaauagagagggaggauuaaucuguuguccaagagauuggcaucuccgaaaggccacagcgagaaaacacuggcauuuugcuagauauuuauauacuuugauaaacagggcaaaacucugaaauaaaugacauccuuugccucaguuaagcagugucauucgaaauaagugaccguguguguggcuucuuucagggccuaauaacauagggaaggcagguaauuaauacaaccaagaugacagugggcuguaauugucagcacacuauggaagucagguaccucuuuuccuucucagucuggagaauugcuccaguaugggaguggagaagacaaaggguacgauagcaguaguuucauuucuagacgauucugaaagcuauuuaaaagucagugcagggugugcuucacagaagcaauuucauggcuccuuuagguuuuuuuguguaaacccagauaaccaaaauguuagcccugauugauuauugaaaaggaaggaguuacaucaaagguguguugaagccuggguguaggauaaaggcucuggggcuggggucaggagcccacacuagucuguguucuuucauagagucucaguugugauugggaauguaaggggcaucagaaagaugcucguuauuugaggacuguuucugaacucgaacugugcuagccuuggaucccauucacacucacuggcucugaugccguuuuccaguccacgugaucaguuuggagcuucagcauaauuuuauuucugcuucacaguucuuaaaauccuguuuggaaaugucauuaggaggauaagggauguaaugaaaacuacaucuccucauguaccaaaucaaagugcauaguuauggagcgggcuaucuauacugcacaacaguuaacaaaaugaauuggccgcuuccugcauuugaaguugcauaguggaaaauucaaugaaacauucaauaacuggaaagaucacaucagaaccgaaggcucauuuagcuggaguccccccaccauauuauaagggugaauguucgguuuagaaccaggcagaaaagcugugaaugaaguuaaggauugugggaggccuggagguggaaagauaaguuagaggcacugugccuggaaacccaaguugggaugccagcagaaggaaacugacagaaagacgggccucuggggaccaguauuuuauaagaauggcgcuccugucaguaccuuccauuggaggcugaaaguuauuuuucgaaacugucaucugucaggcucuucccuagggcaaaagaccucagguuagugguugaacuugcuuggacaaauccagugagucugcccaauccucacguuguguagaaagacacagaauguggugaaaggggacuuuuuuccuccauaguugguaauaguggggauuuauucuguaaguaaacgaauugaauaugugaaugaaaauauaaaugacaaagcuugcuguuuuucuggaggaguuucacuugccgugaagagauuugucaugaacuugcaugaacaaugaaaaauaaaauccagcaaaacuuauacuuucaggcacaugugguugugcgcauguacgugauugcgguugccuauaacauaaugaggcuguuaaacucacuagaaugggcaaaaccguaaaguuaagcugcuuuaaaauauugcugucacacacuggcuuagcagaauccauguuuucuuauaaaacacggagaacacugugagauggcauuguaaggaaaugcaccuugcuacccuaagcaguaggcacaccuuuucagaaugcaaaugugcaggacccagcggggcagcguacacauuccugaguuuucuuccucugaguuuuaaguagguuggugguauagaaaggggcugcgucugauuaugacucuuucagggggaaaacuguuucaccagacugaccuuaaguccaaaauggagaguaauucaaagccccaagggggcuuaagaaaugaagguagcuuauugguuuuggcagccaaaggguuggcuggaaagaccauugagccccuuaguugacagacaaugcugacaagcugagccgaaagccugugugccauagcaagcgcagucauuauuuucauuggcagaguguauugcucacaguuuuggguagucuguccauuuugucaguaauuuaaucuaggucggaaaaggcaugugguaugaacugcuauugucacacauccccgcaggcauaccuggcagguuccauuccagcuuuuaaugaggagccuugcuuuaugcugggguccugcuggugccuugcaauaucuuuucugggguguuuuaaaauggaaguuaggucuuaaaucgaacaaggugucugcaggaaaguuaauaagaccccccuccaccccuaccuuguuuucugcuccuuguaaauuugauaauuagggaagauuuugagacagacuaaaguauagacgacacaggaucaugucuaagggaguggcucuuuuuccggggguagaauacccugauuuacaaucaggauguugaagauggaaacuuuacacauucaaaaugagcuguauauuugcuguaguuugauuccaugguuggcgcgucauaagguaagacaugacacugcgcaucauggcguuuuauacuccugccccaggaauuaagcuggcacgcuuacaguaggggcauguugauucugugcucuugggacgaaucccauucuuguccuuucuucucuugagucuuccuuacgccucacuuucuugcaccagcuguucuugucugggauuucugugauuucaucuuagaauugcaaaaugaaaaugguugcuugaauguaauccuuuuguauauguuaacaguuuuuaggauacucuuggaaauauucuuggaaagaaaaugcaggcauuuucauguuuuggcguucuuuuauuuucaugcauuuuuagaucaacugaggaaugugcaggaauuuuuuagucugcaugcugaauuagugaacaauuaauugggaggcacucccccugccccagucagauuuuuggcagcaacuguuagggugccuuuuucuuuauucauucuccguuuauagaggguuuuuuuguguaggaauuguuuguucuuguggucaacauaaggaugagaaagggguugcuuuuaagaguaaagaagacaggaacucagucacuuacaauuauucuaacgaugugcuguucauugagcauuaaccauauuccaggugauaaccuaggaauuauuaaucuaugucucuuccaaagggagaaaucagacugaaacagaacagggacacugaacauggaaaacauaagagcuuguuaacugcaacaagguauuauuggacuaaugagauuggccaguauaaaaaagagacuagcacucuaaagaauagcaaacacaagaggccaccgcugcccaggugcugaacuagauaaagcacagagagaagccauggccgacugcaguccagaccacugugggagcggcugcagcugcgcucccagagaagccgcugugcugaugaaccugcugcaaggcagccuguccgggauuuaggggaacuuuccuaaaguuaggauuguggagacuugguagaauauuuucuguagcgaguaaaagggaaguuugccuggugacccaggcuguggggacccugucccugcaguugcuggauccuaggagagucauagucugcagugccucucuggcacccucuauugaaaagccuuaaccuggugcuagaggauaaaggaaaaacagcuaaaaggacccagagccauugucacagaaugggcaaaguaaagguggauuggcaaugagaggcagcagugugacagcuggcacaggagugacuacugcuuauuuuuggaucucaaagagaccagaaauagugaaaagggaauauuuccccuauuuccacuuuacuggugaaaaauauuuaaccugagguagauaagugauuuguuuaaugccaauauaaaugacuagguucuuuuacacccccccccccuuuuucucuuucucucucucucccucuccagagaagggaaagguuuguuuuugcuccugguuugaguguacagucuaccaugaugaagugaugagggagacaugguggcaaggguagcuagcuggucacacuguguccacagucaggaaacacaggagaaacugucuuccucagcuuccuuucuucuuuauucagucaguagcuccacccuacaggauggugcugcccacucaggucucugcucgguuaacccuuuccgaaaaggcccucagauuuucagaaauuuguuucgggugguucuaaauucugugacacuggcaggaaagaugaacagggcuauguaacuaacgaauggagauucacuucuccaauucagauuugucaguuucuaaggcucugaauuuucuccagaacgucuugcauuagagauaacagcaaacccuagaaacuggccaaacauuuguuuaggucccuucugccugguccuacagccgaggggaucucuggagagacugagugcuguguuuuuaccacaggcuaucagaguuggaggcauucacgaaugugcagugcucauuuuaguugggucccuaccgccuccuuuuacccaaaucuugguugcccuuguaucagucaagguuuagguuccauaccugauguccucuuggcagcucucaggggccuccagcuggauucauuggguuguagggacaggagaugguggaucuuggauuauguacggaugaaccuucucucucaggcugccccuuuagugugcaccccacucucagcugcccccuuguugacacuggguguucaggauugcucuaucagaacuuuuuugguccuguguuuaguuugccuuucuuuuacugugauaaauaccacggucaaaaccaauuuaggagaggaaagaguuuauuucauccuagagucccagguuuccucaucacuggggaaagucagggcagggacuaaaguagaaacaaugaaagcugaggcucacagacucauguguucucuuacuugcucuguggcucaggcucagcuuguuuuucuacaacccagggcuaucuguguaagggauggugcugcccuuagugggcuagguccucccauaucagucaagacagucuuccacagacgugaccaaaggcuaaucagauugaagcaauucucaaaagagguuucccuuuccaagaggacucuagguugugucaccuugaggauaaaacuaaccaucaaaucccguuagccacauauguuuaccucauguugaguaacagacuuauucuucauauuuguguagcaugucucacuuucaugcugauugacacuaugcuuuucagaacuacuuuaucauuugaccuugggugaguuacuuaaccucuuucauccauucuuuaaucuauaaaggggauggccuuucuaaagcucugcucaucuuaaaaacacucaguagcuauucccaguuuaacaucguuggcagcaguuccacacaagggcacucacuugccggauccugucccuggcaaguagcugaugaaucacaaauaaauggagggcagcaugaugcccucaugagaaugugacuucugagucagacagaggaggguuugaagcucaguguuguaacuuaguaguuaaagggccuugggcgagagaauuguuuucccuugucccggccguuuacuuggugauugguagucuccuguauucugauaagcaggaagggaaaugacucaagcauagcuggcauguagccagugcucuguaagugguagggagugucccugcccaucaaggucuagcuucuuugauggcagauuccuucuuucuaaucgugcuugaauugccuguaguguuugauacccaacccauacucagugcuguugccagcuuaaacugagaugcccccguccacuagaggaggcuucccaaaccuaguuucuucacaaaguaaauacuuggcacaugaguaaucacccuggaguuugucuuaugguuugauugugcauauucuucugucuugaaguggcgcauccauuguuauagcuuuauuagauuucuuguaguuuucugacugcgugguucuuugcugucuuuuaaaaucaugaagacaugguauaauaguaguuguaacaggauuaaggauuugguaucuaguugccauuauuccaggugauauacaccaaccauuucuuuaacauucacagugcucuuaguaucuccauuuuguaggugagaaacuaaaacucuagcaggucauugcagcuggcccuagggcaugagccaugguuggggagcaacggcagaucucaaaggccacugcucuccgcugcgcucuguuacugcuugcuucaacucuaguuuuagaauacuuuauccgaggucagugauggaagucaaucaaaguucaaauuaucccaagucuaaaauuauagggaagacauaugcuucaaggcggauugacccauauccuucccccacccccacgagacaggguuucucugugucgcccuggcuguccuggaacucacucuguagaccaggcuggcuucaaacucagaaauccaucugccucugccucccaagugcugggauuaaaggcaugugccaccacugccgggugacccauaucuuuuuaagcuuucuaauacaucugggggugggguggggaggacaguuucuccugcucauagaacuaaagaaauaaagaggaguaagaaccaaacagcacauuuguaauguaagauucgaacagguucugacauaugagugcucuuuuguagucauucguccucaggccccuucccugccuugcucucagccucuucugacaccuucucacacgcugucccuucagauucagcagcaacaugaaucuuagcaucacgcacccccucuuccucacaugggagcuaaggcacggcucucccuuuagugucuguccuuacucuaauuauugacuuuaccuuggccgacuuucgaacaugagugagcgagcacugauuuucuacuaauaauacauaguccuagugacuugauuuuaagguauuuguaagcgagacagugggcccaaugaugaauuuucagauugcauuuaaugaaucccagagguugucaucuggcauccaccucuacugcaugggaacagacagagucacaaacuguggaaccggaaugaaguguguguucagaugccaagagcuuauuucauuucuccuuuuauuucaguaacaacauuauuuucacuguuaggaaaaagauuggcuugguagacuuuaggaaccacuuuagucagugcggauaaaugaaaaaacacaagugaucagcuuucauugugacaaauggaaacugucauuuaauuuuuauccccaauuauacagcuccgggaccaauuuuucagguggaauguuggagccauuaaaaagaaauaaguaaacuauacuauauuccaucauuuuucuggcagcuaaccaaugaucuguagccuuauuacauauacgcuuuuauagagauauuucucuuaaguuugugaaggguuuuauuaacucuuugcugauuccuucugcaaagcauuuuuucccuacuugaauuucauuuguuuuccucuuuuugucaccaagcguuggcugggauuuacccuuguucuggaccaagugauccagcguucaacucagcuucgcuuuuuaaauacucuucgguuauugcaaguaggccuaaugguuagugucuuuuuaauuccaaccaaagauacagugauggugcuaaugcugaguauaguaaggguuuauguggauuucagaguuaaauuucuuaaaaugcuuuguauaugcaaagcccagcugcuaucucuccugccuuacugugugauacuggacagugggcaccuccagaaaagaguguuacuguaguauugugugcguuguccuagagagugaacaaaaugcuuucauuucugauuugccaacuauccucaguaagcugguauuguaggcaugaccgucuccuucucuugucuuuacuucugguggugacaguugaacguagagccuugggcaugcugggugagugcacugaguuacacccugagacuauuaacgugcauguuucaaucucuuucauuuaccauugcacccacaaacuuagcgaagggcuuggcauaugaaacaugcagcaauaucuaauggcuugucuauuaauuucuauaauaucuaauggcuugucuauuaauuucuauuucuaaagggaauuaaguuaguaauaauaauaaauaauaaugacaguauugaaauucagggucuucugagagcaaaauacaauuccuuuagcuguguguauguguaguauuauauagaaaauuuguauguuagugguuuguauuguagaggccaaagaaauucaaaucaaaggcuguuauuaauauuaagaauuucagagagagcaucauuauuacuacuggaaccacugccuucugauuuccaagccuucccauacuaccccgcuuuggggcucuguaggcauauugcucauucuaccaguucuucaucacugaaagcaucagucuugucuuuuggaugcacaauuucuauauaacgugauaguggggaccaugauggggcggggcccauuagugguggacgucuacuugugggaaguuguugcuugguguuugcaucuuuuccuuuucaccuaauuagauauucuugggaguccuuggcucaaagacaggggauguuugccucuuccuggcuuuagcaucagaaugguuaaacccgguuuucauuaaagagguaccaguguguguguauuaugaccaauaaggcacuguuuuccuccgaugugugccuuggcaucugcucagaggaggaaugauacccuguuguaucuacuuaggaaacugucaucugguacuaucacuauucgaauaugcaaguaagcgucuaaaccugcugaugagaggauuccuguuggcugggaaccuuguuaaguaagagauguuaaaucauguaucgaguccucaggggugauggacuaaacagcugcacuuauccuuauuaaugccugcagacuccugcuucaggagcagcaaauggccuuugcuaagagucacuacacuguggagaguuacucugaggcaaguucugcauggggaauaugcauauauuaguuuggccuuguagauguggguggaggguaaagaaaaacccuagcaaauugcaaauguuuucccuagucuuauucucuaauaguuauaaaaggaguaaacucuaugaaacugaugcuguuggcaaucugucauaacuaauugcacauggaagguaucucuuuuuaaggcuacauuaggucuugcaaugggaggaagaguguuccuaguuggcuaauguaccugcacugauagagaguuguuggcucuccuuucuuggacucauggguuauaaaugagaauguuuucugugucccuguuuuuucaguuguggcugauauguuaggauuggaauuggugaacgagcauuucagggguagaagggaccauagauaauaauauagaccuuagguucaguguagaacacccugacuccuugguagcugugauaauagaauguuuuguuuuguuuuuuguuuuccuaucauccuuguauuugcuacucuuuguaaugucauuuccccagagucuaauccucuagucaccaaccaugagugacauucccggcuaugucaucguauuuuuaguucuuuuguuuaucaaauacucuuuucucugucuuuguaaauucugagccuucaaucuuccuugguauccaacuuacugaacacugauuauacaguauguacacauaucccuccaggugggccucugaccucuccacuuugguaguagcccacucucuucuguccuuugacucagucugcuucccaccauugcuugcacauacaucuugugcaccacaauccuuugugcaugcuggccgugaaggcaaucucugaucuuaaugcguuguggaguuuugggugccucagacagugcucaguccuuaagagcuauacaagaccagaugccuaauguucuaacugucuuauggcuggcuaccgguauauuuucuguauauauguagcuuuuagguugucugcccauacacucuucauugaacucaagauaaucgaaacgaaacacucugggcugucagggaugucugauuuaggguuuggggaacugugaaauaaugagagagguacugaacgugccacagaacaacuugucauugauuuuggaguccauauuucucucuggaaacauucgccugaggcauccaggugauuggugugaguguaagucagcaccuugcucauuucuauaaauuuugauuguguucacaaauuuaauagcauaaauaguuuccccccacucagagcuuuugcaccugaucuuuaugucauggcagaagcuuacuuaccauucccaagugauagauuaaucguaaucuccuccuuuugcaguucugugcaggagucaaauuagcguuauuaaguaucuugguagaaauaaaacagcauuacagguuuuuaacaugugucugucuuacaauacuguauuaguuagcuuuuuguuacuauaaugaagugccugaggcaauuaacuuccaaagagaaaaggacugcuuugucuuaugguuguggagguuucaguccagucuugggcgucugaacugcuuuggggcuuuaucugcauguuuugccugagggcaugggagagaaaacacaugaggugggaaggucaccgaugaccuaagcaccccucagagguuccacuacuucccaagagucccauuguggguggugugugacucuuguguaccuuucccugaugggacacugacuacagauccaagaaauguucccacuuaaguggagccuagugaacaaugaauuuccugggguuacuuacaggaacaugggugauucaaagguggcugccucaccgaaaugcccacugcagccugagggaaagcugugucccuggagauggcugggaaauuugcgggcuuugaaggcauugccacuggucugagucgucuucccccaguuuuuauaaucucugggguuccuguuuuuuaaaaacuucauaaauaucuuuuacuucuuccuuguuuugaacuucccucuuuccuccaggagggggugauucaguuuagaggaaaucacuauacaacacuggggaccaaaccuuaacacucgggcauuugggggucauuuuguccaaacuaccauacuauucaauauuucugcagguuuucuccauuuuguauuugaauggucaaaccugcaaggcuauugagaccgaagucaucauuuucauugaaaguauucaauucuuccuguaaguuauagcucaccuuaccccuucuccgugauugcaguagcacucagccacaucugugcacaugauuucugagcccacagggugcucugagaggccaggcuucaccucacuggauguagccauuuguuuuacuguuucuguuuauguccccccaccccccaaggagacaggaauaaaauagacaccauauuuaugcugcuaagaacagagcuuacuaaaaucuugaaccaaauuuggcuuagauuacuguauuugaagaaugaagagcauccuaaggauccaguuugcucagcagcugugaaggagaacauggaaaagcaggauuauuugcaucauuauucugaugauggccuuuggguccuguugaagcuaaugccucguccauggauucacugguguguucuccagccuucccucugaauucuuuacauaacgaauacucagauacuuaccuguauacaagagcagcauuuauuuauuuugagaguuuacuggugauagugucucuuuuuguacuugauuguguguguguguguguguguguguguguguguacacacuuguauauaggaguaucucuccaggaauauucgugcugaggccagaggaagacucucuucuagcucucuccaccuuacucccuuaagacaggaucugucccugaaucuacaacucacugaaucuagaggguuuacuuuuuggacuaggcugucagucagcaagcccuagugguccucuggucucuacucaucuccagccauuccuggcuguuuuacauggaugcuggugacacaaacucagucccuucaugauugcccaguaagcacucuuacccauugagccaucuccucacccuuggugugcuuuuucacagucaggguuucagcaaguguuuauugagcaucugucauaggccaagcacaguguuggcuauugggaguaugguugagaugauggauagaagucuugccuaagggcuuagagucuauggggagcacaggcaaugaaacuauuacagagucucauguguaggaagcauaagggaugaaaggcuugcuguucagcaucugguacagcgauuauguaucuaaaaacuaaagaaguaugccaaagaaauaagguuguggcuuuaaaaaaaaacaaaaccuaaauaugaauagaaauauuaaagauaucauuugggcauucaaguauaugcauaucugagaccuugcaguaauuuaagaguacagagagcuagaauguuuggaaucaggucugucauggagaaccugacauguuugcugugcuucauggucccugccacuuguagaacugaauuuaugacacuauuaauauagggaauggguuuaaauaauuguuagcauauaguaaaggcauaccaagauuuauuaagacugauuuucuuuacacauucugagccucaugccaguguuuugauggggaaaaauaaagcagagggaaggagugauuguucauggucucacugcagagauuacugaaaggccuucugugcgacuggaguguuauggauuccuucucucaagccaccacuuggcugugcuuugucacucgaggugaucugacagcuuccuauagauaacucugaaaugagcuuccacuccugacuuugcauaauaauuguauaguuuuaauauugcugaggucagcacguggacaucucugcaaaaacauuaguuaaauaauugguccuuuuaaguugcagucugucaacagacugcauccgcugaggccaugaauagaaauaggcaaugcaucaguguguuagucuaugcaaaucagaguuucacaggccgacaaggaccgcaaggaggaguggaagucagagaugucugcagugaucaagcaguuccuacaagagugggcuuccugauggacaugccccucuucagccacgacccuggugaagauugguucaggaucuuuguacagcucuguaccucucccucaaccaagccugucuucuccuguuguaaccaguaccugguuaguugucaaguauauauaaucauucacuaaaagccuuugucuacugauagacgcgagggcuuguagauuacauguauggaguguccaugugguucaggcaguugugcagugucgugauugugagcggcaggucgaagacccucugaugacucauggcaacccccucccucccagagccgagucucugcugguaaugcuucaccuuuaagaccgcuugacaggcguuaaccacacaugcaacaaaucaauguggucuagagcacagaugcacuugaucuauaauguuugucuucuuuugacugaugcgggcaaaagaaaccaucagauagcugcuugguuaauacagcuucguucugggggaaaaaaaggagaagggauacaguuggauguaaaugacccagcccuggagugacuggagacuuaccugccggggguggggaggguggucagugcuuagcugaaccaugcuaccaaaagaacucgcuccccugggguaaaugacauuauguaaacguucccugaugcuuuauuaguaucguugaaaaauacagucuacuaaaaauucuaaccgaucauuuuaaugaaagccgugucauuugugaguggcacuugccuauaaauuuuuccagagcaaugaaaauaaauuagaaacaaggccuaugguuguuccuucuuuccuuccuuuucuuucaccccuccccaacccugugaacaguugugacugauuuguuccguugcuucuuucuacugccuguagaacaucuguuggaaaauaaugcuugcccugucaguuuccagacucagcagcaaaagcaacgugugugcacaagguacgugucagcguuauccugcugcugcugccacgggcuucugggauacagaaggcagaaucaauccgaucauggggauagucguuaaaaaaaacaaaggucugggcaccccuuucaggaccgggaagcuuauuccaaaaugcucggagcagaacaccagccgagaugagauuuugaacgaaaggcacaaauucaggaugauuauugccuguuauuuaguggacgaugcuuuguucugagacuggguuguacucuuuugcuggaagcucacaacagaucaauaguaauuuuguuaugggccagaugucaaaacagaaaugugcucucaaaucccacugacuugcuaugacaacugguaugcuaaagucagcucuccggcaucucacgagggucuccaaagcuccgcaggccugucugcgucuaucacuaguggggauucuguuuuguguuucccuuuuuuaucacauucuucuuuugauugagaagagaggcaccucggacaaaccucccccuuucuccaccuuggccauggaguuaggugaaaucuacacuguagcuucuaguuacagauguuauuuugauggugaugcauaaaucaagucuauaguagaaaaauagcucuaaagaaaggcaaaccaccaaguaacuuuuuaaaaagugucauuguaauucagcuuuggcgguucaguuuggacccgugugggguuucggaguuaagucuauccugagggaaggcaagugugaggggcguuugcuuaccuguugacuuacugucuuccuagagcucuuuuccugggaaacggcaguugccuaccgagacaagcaguucccaggaagcugaugucucccuguauugauuugucuguguagaaggaucuagaauaaauuugauggaaacaaccaguaaucuggggcaguugcaacuugaaacuguacuuugagauggagagaauuuggucuugggcccauguuugucugggccuagccuucuuuuggcacuuccgccuaaaagcaagaaaagaaaaaaaugagagcagcuccaauccuucagcccuggaaaggaccgaccuacugugcgcagacugguacaguguuaugccauugcccuuucaacgguugggugggccugcugcuucuccccauuaccccucgugugaaguggacacacugucuaccugggaagaaccauuccugucaagggugccuguucucauaggaccugcuacucugccagguuuugucuuagucuuugcaguucucuacuugguuugaggccggaggcugagauguuauugggccauguggcuuuugaagcuacucagcugacucccauagacaucccacucacaggaagaauugcuuggaugcugcucuucucaugacuacugcagugcuauucagagcaucuaagauaauaggugcagagcaaaggggacagggcucaaaucugaccgggacccucgugaagccacucuugcauuuauccaugacuacugaaaggccaguugauacucuacuguagcaugauaggcuccauguuagaagcaagagguagagccacgauuaauaagccagaucgagcucucuuagaagcuuuguugugcauacaagcauugcuucuagaucccagcagugagcugcaagggaagaugaauuugcaagcacuguccucaguucuuuaauugagucuccugauaacuaagcacauaaaauugccgcaucaucagucagagaagcuaagcccuccgaggauuaagucuaagacuugggcucaugggauggaacuaaccaauuauaugccucgccaucauuacuaccucaguuguauuucaguucagagagugaacgagcaugacaaaagaacuaagaagaugcuaggugggucucccuccccaaacaaaagcaagaaccccaaauccaguaggggauguauaggaaagacagaauuacuguuugagaacagaccagcaaagacaaugaagaaggcaaaggguguguccaggguuuuaggaaugcauuugggaccccugccucucuaacaauguuaaucuaaauuaaacaugaucaugugagaaaaccacacacacacaugugcacacacacacagacacacacagacacaauaggaaugaguuagugagaacucaugggagaauauggggaaauggguaggcagugaaggucugaccacugggcugguuacagagccuggugccucucaugggauuggcagcucuccuagauccggauagugaucgcuuuguagcuaagggaagggugaggugaagugauaggacuacauuggggacuaaggagcaggaugccucuguuagagguucaguugaaccuugcagucaacucugucugaucaagacagaugcuuuucaagcuaaaaugcaguaaugaagacugaaaguucaaagaaaaugcggucuuuaaaacuaaggcaaaucaugggccuggagaaccccgugugaagguccuuccuuccaagcuugugaacucccauuugauggcgacguguccuguccuagaaagccagaggagaugcuucuugacucauugccaguccuuuacuuaaacuuaaaagaucuuugcauuaaaauugcguauuugaagugcuggcaagcuaauaaauucagggggcuaucuuaagcauugucagucuacaauguaauccuguuaaaauaauugaguauuuucugaguggagaauucccucuccuccuguccacggcucacaagagaacaacauaaaagggauccuaggauguccucugaacaucauugaagccaccgacgugcuggcacaagguaauucucuucaguaaaggauuuccuuggcucuaucucuuuaaaaggcaaaacccgacauaauggcugguuuauccuaauaaugggacguggggauuauauugggagggguacuucaucgguccuaggaaugcauggucuguuaauuugugcucauuucagagugugacugaggcucccgcguaacuugaaacguuugcguuuucuuccuucuguucauuucuugggcuccuuuucauccagcggcuuggguuaccuugaauuaaauugguuuauagcauggcguuuucgggaaaacucugcaaaagaaaugguugcauaacucagaaagguuugcccuuggagugauuuagucaugcuggaugauaacuggggagccuuauugacucugagcucccucuggaaccacauuccgaaagcugugcacuuccgugguaccugcgaggcacucacuugagcagagccacggagcagaggguugcaguuacuggcauuuuuccuaaugcauuuuguaugugucuauaccacagggagacaugugugguuauuguugaaauauuaucuacaugccuuugccggagaagaagaaaagccauuguucagcagucaacagaaagaugucuuguaguguauggggucuguaugucuguccccccuaaaacacccacauagauuuauggcuacacuacuuggauaacucuauuugacuaaccuugaguuccacaaugugcgguuggcaauggcguucaggagugucauuuaaaugccagcuugcuuucuguucaccugguuuugacugggaagcaaggcuuugauccacugcauacgugcgcugugugaauccaagcucagaaaucaaagucucagaaaugugcagggcuuaauuugcuuuuccuucuaaacagguaggcuccugucuaaauaaaacuuuguguggacagaugcucauuuuugucauguauguaagugggacguguugcguuuguguaaagggagcagguuuaagcggcuggaugugaauacccgcuggcuaucagagccaccuauccaucucagcaaauccccucucaucuaacaacauugcaggaaguuaagguaauugauucucuugagcaacacaaauaguggaauucuuaaucaugcuaagguccaggcagagaaacugcuuuuaugcuuuaagaaauuugguuuauuagucuggugugcucauuaaacaauuauugaugggcaguucaaccugugccaggcucugggcuagaugcugaggugccaggaggaaaaaagguagaagcuaugaccuucucauccacugaagaagacagaacccaaauggguaauaauuaugcaugcauucauuaauucaagacauuuugguaagcauguaccaggguaggggaacuuuugauaggaaggagagggggagagauaagcagagacagacuuagcccucaugguuuccacagccaaggcuaaauagccuucauaguauuuaggacuaacuguaaagugauccauuugucaugaaggagaaaccauguaaagcaaucacaccaggagaacuggaccugccugcgaagucaagggaggguaucuuccaggaagucgagaagagacugucucgugaccuccagaguuagccagguuaggcuggacuggaagaucuuucuagagggagccaugugacuuaaaaaaaauuucugggucauacauaggcugcagucaguaacuugagagagagaagggacaagaagcacuggcugcuuuagggacauuuugagggcaggagaaggagcaucaaggaaggagguuaaauuucauuguguagggauugauugagauuucuauaaggaaggcagaucccagugagacauccuagaacagugguucucaacuuuccuagugcugugacccuguaauauagcuccucaucuugugaccccccaagcuaggaccucauaaguuuauuuuuauugcuguaaguuugcuguucuuaugacucauaauguaaauaucugauauggaggcuaucugauguucaaccuguuggggucacaguccccagguugagaaccacuguucuagaguacuguuaaugcugacauuaaguaugaugaaauaauccucaucuugcuucuucaagacuaaauucaucuauuguuauuauagcugucaauuuauuuucuaauuuucugagaccccuuuuuuucugccaucugagaaauuguaguucuuauccauccugcucccuuuaauauaaugaagacaguagacguucucaguuaugacuccauaaaggaaugucacagaacaggcucaaguagaggacagcgucagggugaaggacuuccagcugcacgcaucuuccagccacgugcgugcgcagagagcaccugaagacggcaucaggaauggagcuugcugccucuugcccucccugcccauuugaauucagaaaauuuaagugauuacuuuucauaucaaaagugagcggaaauacuaaggagccuuucauuuauaaacucaauucaguguaauuuauuuuauauggaggagagccuuaaauuagcugucagcugggcuccacagguggaugggaacuccugagugaaaugaccaaauguccaguccuaaggcauucauuuucaucuccgcuuccuguugaaaacugggagacgugaaauggcgagauaauagcucuaaacuuccaaguaauugcuuuuguuagcuccauucauguuuacuccuauuaauuacuggaauuugauaaccccuuuguuuucuacuuagcaugacucugaauggagaggacagagccauaaaucaggugggugguuuucacuaaaggcaggccuccuuugcuuugauguugacagcuuaaggcuaauucuccaagcuugauagguuuauaauucaaaaaggugugauuuaauguugguggaauuuauuuucaaaagucuuuaaaggagaaaggcguucuaaguagaaaaugaaguuuugagcuaaaccuuaagcagacaaagacugucaggguuucuagacaccuggcauuggagggcucuguaggacacuugucuucaaccuuucgcuggaagaaaacacuagacaaaaaaggacaaagcagacagaaagugagggagcuguggcacccaaggaaugcuccuaggauaaaggaugucugcuuauuuuuuuuuucuucuguuucuuugucauugccugcagacaguaagagcauuacauuuguggcauaccuuagacgcuuuugauauuuaaccuggacuauacugucguugggcuugggaaaaaaccuggaaucuaucccuaccccuaaucugggugguucauaaguuucuacaaacgccugaguccucaucucauuuacacugcuaauguuaaggauagacugaguuuucaugcagugagcaugcccacagcugcacuagacacuuggaaagauggggagagcaagucucguuuaggcccuuccucauagcucacagacacacuacauuguuuaggcccugccucauaccuugcagacacacuauccucccaccugaaaucacuugaucuucaugcguuuuguuuuggucucuucaugacacuugguuguguucagcagacaaauuucuugcaugaugucugagaaaaaauuguucuaaaauauaauacacuuuucugccuuucaaagacauagcauuuugaauugagucuuacuuaaauaaaugacuuugggguccuuuagaauacuaaaucguuuucuuuagaaacugaagugggguugguuguuugcuucauucugcacucaaagaaugcugugcguuucucgaauucuccacggcauuuuaaaaauaguuauucuuccuuugcuuucagcuuuuuauucugcuugaaauucugguuugauucuuggacagggugggaauaaagguagcuagaauuaucaguccuuacaaguaugcacaguggcacaugaucgcagucacuguccucccaugguuuuaugagagacuuuggacugaggcaucugggugacuuagacacugucgagagcugggcuuacuggauacuuggugacguagacaaggagguuuagaaacggucuggucugagguguguuccugugagauccuuugcgguaggaaccugugguguaagucagugcagcauuuugcgaguuugucccuugcagauuucauguguacgugcaugcacaugcaaggcacuagcuccucccacagcuauacaccagggauugaagucuuuaaaauaaucugucucuaaucugucaguuguauauuaagaauuauaacaacgugaggaguugugaaaguaagaauugagagcucacagacaauugcaaggcuucuagaccagauacuagauuacaugaacacacaacauauugauuuggugaagaaaggcuauauauaguacagagucgggcuaugacagaugggguucacuagcaacacaucuaugacuucuaggcgucauuccaaacucugagacaaauucaccagaugcacggccucuugccauuuuuaaugaauucacuuuuauauaaaugagaagcauuuauauauauuucuccuauggccaaauaccccgaaggcuuuauaaaaacuuuuacuuuauuauuauuauuauuauuauucacuuaauggauguagugccauauaguaguagguaauuacauugguaauaacaguuuuuuuccccuaguggaacucagagaugucuagauauuuaaucuuuauauaagaucacacacacauccaauaaauaucuguaguuuuaucuuagaauuauguucaagaugaacccuuucagaggugguagaaaaacucaucucuuagcuccuggggagaauuuuggaagcucagaucuguguccuuuaauuuuugauauuauuucuuuggauugaaacucagcucauuauaaauauacuucauucuuaauuucuaauuaggaaacuacuacaugaauauaauuuuuuucuaaaaaaugcuuuagauuggggguggagcccagugguacagugcuugccaagcaugcgugagguucaguguucagugcugcaaacaaagaacaaacauacauggauacauacacguacaugcauacaugcauacauacagaccuuccuuucagaaaaucauggaguccccauugaugacucucgguccaucccaguugacaucuuuuccuuccauuuccuuccccuucucugccuacucauucugcugucugucuguugucaucuaugcaucucuucaucaugucagucacuguucucuccugagguggguagaaacacagcaucuguggaaaccuugagguuccuacgugaauguucuauucgugguggcauacuguccucaucaccccaugagguucugcuuuugacguucagugucccagaagcuccgccauguugcacucagaccuccauuuaaaggcuggauucuauccuauagcuauagcacacacuccuguuuauuuagcccucccuauauguuccacauaauggauuuuggguacuuucucuauuuugcuuauuuuuuuuuucucuaaacaguguuuggaugggguuucuugcccaugcguccacacuugcauguaugaggauuucuuuaggauguauaacaagaaaugguauuacugggccagaguaugcaugcuucagguuuaauugauagaaucugugcccagggccgaucauuuuaaacuuucuuuuagaaacuuuucccccuaaucuauuuauucacauuacacccacaucacagcccccuccucccacugucccacucauguggucccuccccauacaccuuucucuuuaccucucugagaagggaagguccccccagaauaccagccuacuaggccuggccccucaagucacuguaggacuagguaauccucucccagggaggccagacaagacagcucaguuaggggaacagauccacaggcaggcaacagagucaggauaaaccccugccccaguuguugaagacccacaugaagaccaaacuacaaaucugcuaaguaugugcaagggggccuagguacagcccauuucuacuuuugcuuggugguucagucucugggagccccauggguucagguuaguuaaccugacuaaccuguuguucuuguuguggguuccuuaaucuaucuccccacacccccaacuccaauacaagaggagcucuguuuaauguuuagcuguggucgcuaucuguuuccaucagcuucuggguggagccucucagaggacaguuaugcugcuaggcuucugucuacaagcuuaacagaguaucauuaauaguguuagggauugguucuugcucuugaggugggucugaaguuggucuagucauugguuagucauucccucggguugaaagguuuguugguguauugguguccuuaguccuccacuuggagcccugccuggcugcaggagguggccacuuuaggcuccauauuuccccacugcuacucauagacucauagacucccugaauccucccccaucccaggucucuggcacaucgagagaugcacucccccccccccccgcccgauuuccccuccuucuccuggcccgcucucccuacacugacuuccuccccaucauuggaagcuuuuuuuuaagugaacaaaguugagccaaguggucucagauggagcagaaguaaagaugcucuccuuucauccuccuguguuccuguaguauuccugucugccauggaggguuguuuuuaaaaaacauauaaauauuuuuauuacauguuuguuuauuuucucccucucucauacuccacucucuccugucccccauguacugcaugcauccugccuaugggguccacccaucuugcugugccauggagggacaaugacacaguguuuaugaugcucuggcucuuaccccgucaucccgucucaucucagucugucccugugagcaguagacaugcaguccugauaguucaacuaaaaguauccagauuuugagaagaaaaguaaguuaaauuuauccaggccguggaagaacugagagagggcacaggaaggaggguggagaaaggagaacgcauccugguugaaacccaacugguguagcagagaccacucgcuucugucucagcuaacuacguacggcuagagcaaguauaucuaagaaaagaccuggaagcauagccuuuaaccugcuucugcuggagcuacagucugggccccacccacuucaagccagccauagagucgacuagucgacuguuugcuauacucuuggugcauugaaacuugaguagaaggacagacaggugagucagagggucagaaucugauccugcgucucaguacuauuuuuuuuucuuccuggaguuaguuucuucaguuuuauaucauuggugagagagacuauuuuauuuagcuacauugcaagucaggagacagaacacuuuucuagcauccacuaaucauguaggguggaauauuugaaaacuucacagaaaauucauguuugggagcugcuuggugcugcuugcuaagauugauuuugguuugaaaaugucagugucugugcuggucccgcaggucccccccccccccccccccgccuccuuguugccagagucccucaguagcucagguuggggcugcaucugucccugcagagcuuuccuuucugcccgcagaaagcugguuuguuuggcugacagaugggguucccgcauuggccaggaugugccuaguuaaaggguuucuguucgaagccugcaggggaagcccagcuccauauagaccccugcuuaccacauucccuucauggucccguaaagcagugaggaagguuuuaauugacauugucuacuguuaagaggacauaguaugggcaucuuugcagagauuuacuuugucuuucuuugaaaugucaagcuaguaagucauuggauaaugcagugggcccacuuuugggcaggagagauaucuacuauuguaguuuaucuuuuucaaucugggcacauuaaaaucuuaaaagcaacaaucccagaaacuuaugucacaaucuaaaccaaagcuaaagcugcuugagugauagguaugguuaaaauaacaguauuuaaugcccaaagcacaucgaauuugggugaagaggcugcauucugcauaaugccuggagaugucuccuauggugugguuaccuagcaacaaguggaaacuguaugaaaaugaggcgcuuaucuguuuuugaagugggugcaaugaaacuuauuacgccagccugcuuugcuuggcauguuauuaaaaucacagcuaauguggaaagaacuggagccuguucccauucgauacagaggcacuguuaaauacagcuacuguaaaaugucaaugcuuugaucagggaaaugaaacccacagccuccuuaaacacucagcauugagauguuagaaacugauuuguauuauggaagauuuauuaauaaugaaggagcugacaggaucuguaguggugacuuuagaagcugcuuguuauucagauuaaaaaaaaaugcagggagccauuuauaguuuuguccauaaggguagcuuaguagauagaguuccggaucucacggccagauuguauuuaacugucugcugaacguaucgauggauucuaaccacagccuucuuaaguuuguugaauuugcugaacuccgauguauugccuggauccauagaaauucuauuuuuauuuugccuccuagaaacaagcuucuaaucuuuaauucuagcaacugccacacacuuugagggacacagaaagcucuuccuggcccucagcguugcucuugucugugcuuuagaaaagugaguucuacccuaggccugcccugccuuuucuuugucugaaguucaugcaacuucacauugaaguccuacuucacacuuuauaaaaacagaaagucacaccuagaacucuaccaaaauauccucucugguggcuggauauucuaacgugcgcuagcaccagcucucccacagaggaaaaaaaguucccgugcuuucucugcucaucaaacaccugugaugacacgcagaaaucuggcacacaggacccaacuccguuagucguauccugacauuacuuuggggguuuggaauguguuucuguguagcagauggagcuauuaguuagccgagcuaucuugaagaauugcuuucccagguaaucagcucugcucauuuaggaugucgucucccuaccucgauaugucagcucaagaagcaggaaugauuaaucgcugcgaguggacagggagcuggaauaacucuguaaggggaaccagcccuggugucccccaguacauuugggacuucagagggcuaugaggcagcaaacaagauggaaaugaugaccagggagcuuccugaagcuuaccugucacuguauagaguugcuguggcaaccugacgauuugcaauucagaggcagaguagagcgagacaaaaccuuaagucauggcugucauuacaguggaaggggugccaccaacaccuggcagucucuauuacuucaaguugucucuuuucacgcucggaggaauaaaaugcauaaaagauuaauaugcacaguaaaccuuucgguaaaauauguauguguucugcauuucagaugaguggaaacuuuuaagaguucuacuguacucaggucaacauuaguuaauaaugugcaaaauuuuggucauaguguuaagagagugagaacuggaaacccagaauaaacauaccaagaugucuccucaaguuaaaaaauuuaaagaaugaauugcuguguguuuuuguugucccuuauggaagugcucauaguuuguuaguguguuucuuuugugauccacaaggagaguucugaggcuggucagaucuauaagaaaggugggguuuuguuguuguuguuguuguuguuuuauuuacuuauuuauuuucccuugcuaaguagugacuaguuuaagcuuguccaugugcaagucuuaucuauggagaugacuguuaaaaugauggugaaggauucucuuuuuagggggaagucaacaaaacaacugucauuugugugagcucuuuaauuucacgauuuaauggaaaccagggaucuaacagcaaacucaugucacagccuccauccuuuggucuucuucggaaagcuggaggcuagugcuugcauauggcagggcccacgugagcaggguccacgugaguuuuagcuucuuguugcuacugaagguuagggcuaucuuugcuauuugcuguauuaaaaugcacauuuuuuuuuaaaauaagcaagccuagcuuuuaacauuuucaagacuugguaugaucaguaacuaguuuccuucucuuuucucuucucuucucuucuuucuuucuuuuuuuuucuuuuucuccuuuacacaguguuuugcaaguguguuuuaaaagcacuuccaaccaacuuuggaguuuucuuuugaagaucuguuucugagugucaggaauaaacacaguggcuaaaaacauggcaguccguuucucgacaagucuggaauuaaaucuagagggcugcuguuacaaagauuaaauauuuaauauuaagaauuggcuucuaauuuuucucucaucauuuuggaggucagaacgagcugaggauucacuuguaaaauguugcccuuguacaaggacccuuuaaaccaguaucccgaaaucuggguuaugguuaagagcaugagaaaacaaauagaugugcugcucugccucggcugccugacagcauagcugccgugggcuugcacagcuccgggcugcugcaacuggccuccuccccaccauggugguauaauuggagucagccuucuugaagauggagccuuuuauuuuuguggcuuucuggggaguuguaaugccuaccugcuuuuccuuuuaaucagaugucugagagcugcagcuucgggucaaacgagcauauucacaccuguuuuuuuuacaggguuuucagaaacuggagaauuagguuuaaacggaaaccuauccugaauagucccauuucuguaaauggccugccggaguacagcucucuccagcacuagcugggcuuagagaagguacugacaccuauaauuuguaacacaguuaaaauuguuuaucugaccugcacacaccuguagucaaggggaaaacagcugauuuuuaaguugagcuguggaauuuugcuuguaugcccagaugucccuuacuucauuugguagaaacuaauagcaguagcaagaucucaaaguuaauuggcagcugcuaguggagaguccugugaauggucuggaggaacccccucaggguacgaggcugcacgaagaugugugacagagcacuaauucagaguucacauaaucaccguacagaaauauuuaagauggggcucuaucaggucucaucuguggagacaugauccuuuugugucuggcaggccucaugcaacaaauuuucuuucuuucaagugauccccgaagccgucaaguucauuugagcaaagcaaacuugagggagacauguacagugucugcgauggcaagcugcugaugacauauuuuuagaauuugaauuuuuuuuuucucuucccccacccuuggagaaacugaacuuuuauucaagcucccugcuguuaacauuggaaagaaaaguuuccugugccaauguuugcccaaacggaggaaaauguuugcauuucguaugcaguguucauagacuugaugaguggagcaguuuggcaccgcuggugaacgcgccugcucgggguucugcagggcaggcagagaugguguuguggaguucugcugcgacucuuuaaggugugccugcacaccucugucuacucgagucgggcuuguacucagaacugacuugcagggacuuugaaggucauuucuuaggacagagguuggcuaaacauuggugaccaaaaagacaucacguucuccauuuccucaggauaagggaguucaaacccuggaccaaucuccuuuuucuuggcaagguuguguguauaaaggaccuugaguguuucucugauuuuggcugcaguaguaccaacuuagccaagaugcauuguggccuuuuauuccuucacucuggaaguuugugccaucaaaucaguccaugacauguuguagacuaucuuauuaaaaaaaaaaaaucauccugggccuagggagguagaucaguugguaaagugcuugccuaccacgcaugaagccuagggcuugucucccagcauuacugugccucaugcccagagucccagcccuugucaaguggaagcagggugaucccaaguuucaggucaucuguagugacauauugaauugagggcuagccaguaauacaugaaaccuuaucucaaaauaaaaagaaaaacagacgugugcaacuaagguguauguguguguguguguugguggcggcgauguagccagaugugguuguauacaccuagaauccuaacauuuggaaauggaagcaagaacuccaugagugagaggccacccucagcuacacagggaguaucugucucaaaaacaagcaaacuagcacuacucaauugcacuuucacuggacaaaaucauaauauuucuauaugcaagauagaggucaaggaauaaaucauguccuguccaaguacgugugccauugagagagguuaugacagcaguggcgaauucucugauaaguguauaacaaaugaccuagacaagaaucugagugauaauaauuuguuccaagagccaguguaaggugauguaggaagauacacuuuucuuuggccucuauccugcagcaucauugaaucagguaagugauucugcuuuggcuucguucauccuggguaagccaagaagaacauggcacgggucauuaagauuuacagcucaaauguaaauaauucaggacccacaaacaauaauuaaaaaccaacuguggcauggugugguaucagguccucugggucccuuugagcaggaacucuuccauuuuggcuggagaccuguccaucuggguacagaugguuguaagagcuuuuuaaugcccuuuuuuaaugccagugaacgugucuuuggauaccaucagaaccaauggaugagggggauacaaacggcaggguaguggcagcugagggaguaaauguccugaauuuguuagacaucuguagaaacaugcaauuuguugggcaggaaauuguaaacaaaacagacugcaucaacugucaacacaccugugacacccugggaugccagcuccgggaguguaauggcaacuuucagaguccauaccuggaacagccuguugaaacacggcacaagugccagugcccuuggaugcuuccuuuguucguggggccagagcuuggcuggcagcaucaagcagucgggcgugaggaaguucagccaucagguggaagccaggucuaaguuuucugcuguggcuugacucugugucaugaucuccugugcggcccugucuuugugacaguaauguguugcugaggggcucaaggagccagagagcucgagaaacauaccauaguuguaguguaggaccuggccaugcuccuuuaaaguucuccgggcaauucucaagcacacaucuguugagaaauauccuccugaguauuucaaggugaccuugaagaggccaugggaagacauuaacuggauucagcauucaaaagagcagugcaucuuguagauaaauaucguucaggacaugggcaccguggagauucaagugcuaaggacaaaacuguguuuccuugaugacucucuguagaggagccagcugagugacguuggguuuggauguaagccacuucuugagucuagcaucuguuccuagcccuggaucuucccaguaaagguccauucugucaccaugcucgcccaguuuaacuaaucagauuacugcgucucggaggcucauuuucagguucauggucaaagauuucuuaacucucuagaggauuccauuaauuuccuacuuuaaaagaccagaugggguauuggcuuuaugaaccugaacacauagcuuucauuaacagggagauuuuugcaaacuggaaaucucuggugaucacaauuuauaauaauuaucauaugaaguaagaauuuaaaagggauauugucuguuuauggcucguauucuuuaaggcaagaggggcaaggcagugggauccccaggagacauuucuuggaugcucuccugggguugcagaaggcugggaaagaugucuguugcccagaguucucugaguuuuccagagugugagagauuaagcaugaugaugaggaagccgggcaacaggggacauggaacccagggcccggaaauaauuuaggaaccugagugcuagggcugacucggaggaagagagucucucaagauaagaucuucccgaggcaugucugagguaggaugugccgccagcagcaaaguuagaugcugcuucgacuuuuuguuaauacauucauauuuucacccauuauuuaucuugucucuuaccuucagaaaaaaaaaucuucauugggcauucagugauaggccccaguucacugugcccucuccuucucuccuccuguaauauuuguauucuaaauuaugauugaguggguuccugaauauuuuaucuuuaguagauuaugauguuguauaguuuauguaaauauuugucuggaggugccuuaaguacuggcuccuguaaaggcucacaucugaauuguuuuauugcagccacucugucuaaauuaagcccuaaucucuucaauccuauugucaaggccucacucuuggcuuggguuuaauggagguaaaauuugguuaguuccuucaugugguauauuuaauuugauuuuucagguagugauaaacauugggguuugggcuauugguucauuggcauuaauauguaaaagccuugaucucaaggauggaacaguuuaaugcacucugcagcagaaaugcuuucagauguauaauaccguguguguguguguguuugugugugugugugugugucugugugaugauucugauucugcuguggcacucagcugaagcaaacacccaaaugacucaugcugucuagaggguaguaguugauuuuggaguccuggaagguagcaguuugauuuguagcuuucaguucucagguucuguaggaguuuucuaaauauagcagucuggaacagacauagaccacaugaugcagcagacacucgacuguccauucuuguuuaggcuaauaguccuacccacuugggcaugucguuccucuuauaccucagggcuacgauguuggaggaauuuuguuuucuucuaauggaaaagaaaagcauacaagcucagccacuacagugcaaaugacuggcguaucccaggacuggcaagacgaguguuccccuaagaucuuacuuuaaugcugcaguaaaaccuucccagcgcuuggaagguaggagagcagggggaaaaccuuucuucacaucaaauucaguggguuuuuaagucauuagugcaguuucuugcccacuucuggaccagauauugaaagagucagauccauaucaugguauacgguaagaauaccuacagcaucuuuuuuaauacagguguucucugcuuuaagacuugauauauugacaucugagccaugccugucaggggauacuccaguugcuuuagcacaguaaugaaugacuuugcaaagauucaccacaaauuuccuauauagagagagcucccuuagucaugaaaugcaugauucaauuaaaauguuuugauuugcauuuaacuuugcaggaauugacugucaaggugauauaacaguuuaaugagcugcuggggggagauugugcagucuccagccagccgcuuaucaagugaguugagaucuguuuucucccgaugguuaaagaaagauagguacugggccauauucuucuugggcacuuccuuuucuccaguguuucuguaaacacacugacgucugcagcuuggaugaguuuuacaugucucuuuacgcauaauaaacggccaccgcagcgcuucucaauccaccacaaaugcuuuugaguauauuguucuaggaacuccaccccuaucucaucucugcucucuuauuaaaucgcauuucucauggcugacaugauugggucuaaaugguaacuauuuuaguucucaaaaauauuaaaaaauugcccagaucauuuucugauuuuauuacuucuccacuuugauacucaggguggagcccagggccuugagcauuggaaauaugugcuguaccacaaagcuacccuucagccugauagcauuucuucuauuagcuuuucuuacuuauuuuuugucugagcuuuugagcugugaguccugaaucugcccccagcccuggcucccccagcccacgugucuguaauccuugcaguuaagcagcaggaaauuggucuguggcucuccacugucuuggagcagaggcuacugcagcuucuuaggacuagaguuauguacugaaucugaaaauaagacauuuagugcuagugcggaacggaacauagugcugggguccuggagcacaggaugaauuuaaauaguguggugugcuuuaucugugguuguugcuccuaacugucuuugcugcuuaaauacugauaaggaacagcuacaagaauacuagaugugauuugugcuccuccagccgacugcuccccggcagauuuaugcaauccauguuuaccgugggagcaguucgcuucauaucagcuuuacugauucugaugggcagaaauagaaguaucauuguuucauauuuccucacucuggagauuucauacaagaaagcagaggacaauuggccaaagaugcacagcuuugaaugugauacccgcuuuucacagaaaugugucuuugauuaucucuucauaaauacaugacccagagcuaaaauuuucugucagggucuucaguggaguuguguauuaguggcgugacuuggcauuaucgucugagguacugugccauggcacuccuuauaauacucagagacaugcagcuggcauggcagauaacaguggacugaagggcuccacaaucugccaguggcuggcucuccagucuucguguugggggcuccauuuuauaaguagaaauggggccggggugaggcaaacagggaugcccggcuacauccuucaaccuuaagaucgcgcuggcuuuuucuuacgugcaguuuuuuuuuuuaccccccacaaaaacuauccuguuuaucucacuuggaucagaaucagaguuugagcauuguuuaauuguuuuucuuuuccuuuuuuuaaaaaagcaaaucucuuaugaccuguuugccuccuacacuuauuucuuuugcauauuccucugcucauaacuuuugaaagcucauaagcggacucucuaaugccacacacuaaggguugagaaagagugcaggggacaugagcauaagcaacaauuggcugucugcagacuaaaauugcucuuccgggugucaccuuguaagcucuccugggaguuaucuccuaauagcacugugagguggagggaacagcccacuucucaggugugaaaaaacggucugaaagagguuaagagauguuucccgagucagugcagccacugugugauucagcugggauuugaaaccauuuuucagacucaaaauguuuccuucguuuucacuguguuagaagagguguaauaugucccucaugcaauucugaaguugaaguucccuuuaauauguagaucuuguaagagaauccucuuuaucagaagauaauugauguguaaagaaaggucacauaagugaacccacuuaaagcagguaucagaaacuucguaguaaauagagauagcgagaagcgaauuaaacuuuacugugcugagugaaacccgaaauuaaaaauguuauuuuaucuuauguuuagcaacacugaaauuuuauuuccaccucuguguuaguucuuacaccuagucaagaggugacuguucucaggacagcuuuccugacccaguugagugguggaaagccagcccagccccugacuuaguccccuuuccugcugcugugauaaggugaccugacaaaagcgauucaagggacaaggaggcugcuuuggaucaggauugcaggugucaccagcacauggggugggaagggagcagcuugcauuuacaguggagaaagagcgcagcaagcgcgugcaggccagagcuuuccaguuuaacaguucaggucccugcccggggaauauccgcauucccaaugcaugugucugcccacaucagugaacacagucaagacaugcuuccacaggccauggcuuacccagagccccgugucucugcugauuucagauucugucacguagacaaugggcacuaacugucagagucucccuuugcacaguccagcuuaggggucucccauccuuucugcaugguuuuauuuauuuauuuauuuauuuauuuauuuauucaucuauuuauuuacuuauuuuggcucaguuuugcaggguacucauuggcuuuuuuauucuauuuguuauucaggaaguuuuuuuuuuuaaucauauucauugauuucaucaaauucuacauuuuuaccuuaaugcugcagucugguuuauuggacuguuauacaauauagaaucuucuaggaaccuacaaagacuauacauaaaaacagauuauguuauuuuacuaauugaguggagauuaaauuuauaaguguuugauauauuuuguuauggcuuuuauuuaguaauuaaugacgggaucaaauauuaaaauaacuaauagaaccauuguguaauuaaauauuguuagguuguccuuucacguggaagcauuggaaguuuauguguucuagugcccagguacucauuuuauggaaguagaagucuaucugguaaagcauaauggaagucacaaaaaauaagccacgauuguaaaagaggacuuuguuuuaaugucgcauuugcauuauuuagcagauuaacaauugcaugguuguguauguguaguaaguauggaggugacguuugcauaaaggaucacgucuccugagugugagugauaucaccagaaggaugguagguauuaguuuuauccuuauagauaauaagccauauugcuaagguccuguguuaucucuuccauuuacuagcuauuugaacacuuugaaguuacaucaucucucaaugccacaauuacccuguuuguguaagggagaugugauaucugugauagauugauuuugagaauugaguuaggauauacauguagagugucuagaaacacagccugacacuuagaaagcucugagugaaugguaggagaguguguggcuucugaagaagaaaaccuguugaaaacugcugaaggcugggaccagcacaucacagccuucugccgcuagcauaaauaaauaaauagcaaaaaugaauuaaaguaaguaaaagagaaaaccagaaagagcuacuucucuaagaaguuuauuguugaacagaauguaaacaauuauuacaaugcauuggcacacauaguuucagaccuuauaaaaagacaaguaguauuuuucugcuuauguaaaauauuucuucccuuucaugugcuucuuuugaaucuuccuccauaaguauacuacguucucucucucucucucucucucucucucucucucucucucucucucucucucucucucucacucuuucccucucucucucucucccucccucucucucucucucucaaugcagaagccuuccagcucuccuugaguggcugagauggucguuuuaaaccugcuuccucauguguaagcacagggcuguccagugaggauuuauccugcugcugccuacuugcuuagaguuguaggagugacggugacggaugaacaguaauugaggugugaauagaauuuuggaaaagauaaaugauacuguuugcuauggaacgugcggcauucucccauuguggggcauggcugguuauuaacucucuuaaugggcaagggcucugaugguugcaggcuaacugugguuuugagugaacucagaaucuguuggugguaagugauguuguuuaaauagagaccuuauuggaucgacccucggguggcguuugcaacugcagugcgguaguuaacccccugugagucacaggaagaagcgcgggcuuguugcucaaauuuuucucuuccuacauucuguaguucagaacagaaccugcuagaaggcuguguuguucuuccuccuauggaaaugugauuguaaaucacuguaagaaagcaaccucaguguaauaacaauuaaaaagauucaagcucgcuuauaaaagcagguucaguauguguuuuuuaaauugcuagucugcuucauaaacuuguuuacaggcuuccucauuucaacuuccuuuagccucagaaucccgccccccucaaaaacaaaacaaaacaaacaaacaaaaacccugauuggauuaaacuagaguauuuucaggcuaugcucaaaccuuguggccuguuguugaaaguuuuaugguuuuccuuaaaccuuauaaaaauacuuaauaaaaaaaaucagauaaauaaaggggccucaguuucuuccuuuaguuacuggguaggagcccuuguuguauuuuaauugacuuuggguuuuaucaaauucuggcccuguuugcagaaaugugccuucagguauucccacuugcuugugaaggucugugauaccauaagcaucaaugacuucuuacagcaaugaguucuguccccaggauuuuuccaaaauagaauucuuucuugggaaaaaaaaaagaauaacacccuuucuugauuucuuaagggggaaauuaagucagacuguugggagucaccaaugagugagacuucucuauugugauaaugugacaugacagauccuguaauggccaucccagguauuagcauauucuacuguuuauuaagcugaaaaacauaaaccuuuccuaucauuccauaacuaaauauagcagugaaauuuuaucucaagucaggaacauuguccaaaucagauuugauguguguaggacacugaacagucauugagugguacagauuguguuaaaugggccugaaauaauguucaggaaagagaaucacuuucuauucuucuugacacaaacaguuugucaccaacaggcaucccucuccccaucuuguuaguguagucguuacacuuuccauuacaaguuuuauucaaaucgccuaguuuuccuugauuggguuuacgugaauacauugcaauuacagacaagguguuauuaauauaugcaauuaaacauguaauuaauauguguaauuacacagugagaggcgugccagagcugggcucuaugcuaauuuauugccuagguauugcacacacagugucaggguuuuaugugcgcgacacuuacucccacuguaaguccgcaguggucuauaucaucagagugcgagccuuuucaugcgaguucagaaaaucauuuuuauggucaugcaagcaacuggauuaugguuguccuuugcgguagcuauaugaaauaucccaccuagagaauuuacagaaguuggauguaaaaaugcauggcuuaauuguuuguguauuuaauguuuuaauuuccuuguuauguuugucuguucaguggcuuuuccucuucuaacccuuaagccuuuagguaacuuuuaaaaaacaagugaaagaaaauuuucuacauuuuuuuaaaugaugcuaucuguagccacuggauuuuuaccuaucucaucuuuuaucaccuauagcuuuguaaguaggcuugaucuacucugcuucccagaaauucuaugacuuccuugcucuguucccaggucuaccucuugccuguguuucuuuuucuuagaagagaguccugaauugaaacuauggcaaucaaagaaagacagccaggaucuauaccauugaacagugcugggggugggggugggggcuaggagcuaccugagagaguugauaucugagaaguaagaggggcaaucaagguugacauugugguugaauauaggugcugucuaaugagcuuuguguaugaugggagaaccucacacgguaauaggagccauacuuaugcauggcacuauuaaugcacaaacaauuccugguuguagucgccuccagugugcucagaacaugugcagcgugccguuuucaguggcugguuaugguguugaggcugguggguccaagggcuggcucaggcgcuauauaauuuugauauaaaggauuaaguugauauacuucccuccagagcacaagcacugaaguugacugcuaucuggauaggcguguuuccaagggggaccugggaacagauguguugucucuucugaguacucugggauccguccaugcuuugcuuacagacccccgucugucugcugcacucugcccucuaaaagcuuccugaauugcuuuguaaacaaggcagcuacuacagcugcaacuguuggaguuggacuuuugccagcuugaaauuuaucccugccccagugcuauauaucugggagcuggaaaaaaggggggagauuaaaaaaaaaaaaaaaaaaaagcucacggaugcauucccugaaaaacaagauugugcugaagguaaggccgugcaggucucuggaagcuguaggcacuuucuggacuauuuggacuuuucauucugugccuccggaucagguuucaacacuuuucauguguuuucgugugcccacuuacucaauugggccauugcuucauuaaaaacccaucauuccaguguccuuuuuaucuuugggcuucccuuggcucaagaguacuagagucagcccuuaagugaaugaauggagauuguuuuuucagaauuucucccuucagcaugccaguguuuaacaauugaagaaagaaagaaaggaaaaagacauaaaguagggaaugggauuucuuaagaaaucuuguuuucggauuguccuuccuggcaguugcuucagugccuguguguuguguggauuucacguccccuuuguauguuauagagagguguugagugccuucucugaaugucaaaauaccaguguuuuugcaaaaauugaaguuggauuuugcuuuauuauauucuuggcuuguugaugagguuggcgcuucgccgcugucuuccuaucucacuauuggagucuccugcauaggugcguuccuguauggcucccacuggcugaggauucaaagcucauuguucaucucuauguguacuuuaagcuguucagccugcugcauugaccucuuuggacuguugauguacgacauugugcaauuaggguuggcguuaccgauuuugugugcuuuuaguuuguuucucauugccggauuagagcuaaaaucauuucguuuuaguagccgcagaaagcacaaaauguugaauuuccugccaauauucuuuuuuuggaaccacaucaaauguaacuuuucuguuggaauaaguguuuucuggccaacaucauuuccuucccucaguuuccauuggccuccuuuaucacaggguuucaaccguucaggagcccguccacaggagaaggaugacuuaaguaucguccuggaguagaguugguuaugaauaagcgcuugcaguagggaggugugggugcuguggcuugugguacuccauaguaaaaggaggauuaagucacauucccugggagcaucauuggaugcccccucccuauguccugagacuuuagaucgcccaccaacacaguugugaacuuccccacagcuuuuggccgccccacaugagugcuggccugcacagcagcauagagaaccaggcccucauugauuuaugccuuuugguuucagucccagaucuuggaucgugcagggauuucaacugauggguucagccaacuagcuguaggcuaaagaagugagcuauugugucagaaggaaaaauuguuguuugaagaauuagaaugacacuuuuuggggguagucagaguugccaaucuaauaugggaguguuuuguuuguuuguuuuaaaggaagacaucuuuuauuuccauucucauguaaaaguaagaaacagcuggcuuccgucugugcuguugccagugucaacauugcuaccucuuuuaagguuucacuuaaaaaaaauggguccuguuuuuaaauuuguuugaguuuggaacuuguuguucaguuuuggagcccacagggaaggagaacacuucuuuagaaauucgaugauuaaggggcuuauucaucauucacauuggcuuaccacacuacucuucagugcuccaagacuaaaaugcugugauggaguucaguuugaaagagcucgcucacaugauuacgugggggagccuugaaaccuuccugauguggaaagccagauugguggagacuuguugggcuaugucacgagguuucacaaaaucaaccuaaccuuuccauguugaugauaugcugccaugcuaccccauggccccuuccacagucagugugucugcccuucagcuugaaagguggucugaaugaaaaugucucgcauaggcccauagagugacauuauuugaaaggauuaggacauguggccuuguuggaggaaaugagucacuaggggugaguuuugagguuucagaagcucaagccaggcgcaguggcucacucuggaucugcugccugccgcuccagagauggaagucucagccacccuuccagcaccauaucugccucucugccaccaugcuucccaccauggugacagugaacuaauuuuuaaaacucugaacuguaagcuaggcccagugaaauguuuuucuuuguaagaguugcuguacucauggugucucuuugcagcaauaaaaacccuaacuaagagcuagagaacuaauuuuuucagccuuauggaauuaaugcaugagcagaaguacucugagaucacuggugccauuggagcaacuguugaucacuaacacuuuguugggagaagggcagggaauagggucuuuguggucuggacugaggaguguggacccugugcuaugucuauggcuacuguugaccuuucagaugggaggucauagcacuuguucacugugaaagccagcagucagcuacggcuguuuuuaauucugucuaauagaggagaaugcucgcuuuacauauauacccaagauauucaauuuugauuauauuauuauuuuuaucacagcuccucaacuaugggggaugcuucauauuagauaccaccaaacacacagcccucacagugaugucuauacuuaaauucgucucaggaacugugacuuuauuugguuauauuuaggcuuuguuaaauuuauugccaauuaucuggguuuuguuacuguguuuuguuuuuaaaagcaaacaucuuuaaaauuuaacauuaccagcguacucaggucuguagcucacucaaagaggauuugaguaaauuucuucucaaauagaaauucuuauugacgugacugaauauaugaauaaggaagugucugaauauucuuaaagaaagaggaagugcuauuuuuagaguauggggucuaaagauacacuuacuuuauguuuauauauaaaugugauuuaagggggaaaucuugauaggaaaacugaaugaaaaaaaagaaagaaagaaagaaagaaagaaagaaagaaagaaagaaagaaagaaagaaagaaagaaagaagcccuaccagguuaaaccacagcggcugaggagaccuucagagaccuucagagaaggccgucucugaugcgguugucacugaacccuuuccuauguguagagaggccuaucuaucuacagcaguagaaggcaccaucgcacuuagcuuugccauauuguaauguguuucugucuucccuggccuugcuccucauccucuuuccuaggguuaagcuguguguuauguuauugggcauugaacuugggccucaaauauuugagcaaagcucacggagaucacugggggucuauuccuagcccuguaaucuucaauguagcguucaucaacccugccucuauuuuagucaucuucuuaaaaaauuaauuuuaguugugugugucuguguguaggucugugcacaugaauguggaugccugcagaggucagcaggcuuuggaaccccuguaguggaguuacagguaguuaugaacugccugaaguugguucugggagcugaacuuggaucuucuguaagaacagcaagcacucuaaaccucugagccgucuuuuccagucccuaguuauuuucuuuuaagcauuugcaugucuauacaggugguaucauucugcauauuuuaaauaaguauuaaacaauguuauauaugcgucugggcuaggagcauagcgaaauauggagugcacacacuccugugcacuaaugcacuacccuacugcuguauuuuuaaauuuguucuucacucucauuugugugacuuacucaucuugguucauuauuuuuaauuuucauugcuguaugggaaaggaaauacagaaaaaaauaauuugggcuguccaguuccagauucugaguccaucuccaaugcaaggauaacauggaaggugagguucggagucuccucuccuuugaagcauggaggaauuucugcugagcaaucccuagguguguguggauugcuuugggcuccuuuggcuuucuuggauaccaugguuaggcguggcaugcuccuggcugguuuccuagguacugugugcuuccuccuucccccauuacugcuguuuccuggguguucauaugauagaagaggaaacuuuaucccuguguuuugguauguauuucucugaauugugaaacccaguuucaaugcacauuuuugggccauuuggguuucucuccugacgguugccuuaucagaucugcuuuuuccgccacucuguguuuccuccuggugugcaggcguucuccauggucugcacacgaaucuuuccuuacucauaugcgucucacguuugcggcuuguuucuuuacccuguuuauacuaucuucuguugaacaaaagucuuuaauuugaaugcaggcaaucuugcucuuuucuuucaugguuuguauuuuugugccuccuuauaaaaauucucccuuccuccaaggucauagaaauguccucucugugccuuuuuuccucagaacauuucagaguuuuugccuuuugcuuugaguuaacuuguuaggcauucuuaugucauauaggaagaaucucccucuugcucccuccuccuccuuccucuuucuuaugguuucuguugucucagugcuacacuaagaaaagcuucccucuauccccgccuuccucccuuucucccuuuucugccuuaaacauuuuugaaaauauggcagagagaugagguggcucuggccuggaaucccagccuaccugauauauccugaguuccagaauagccagggcuauguaaugagacccggucucagaaagaaacagaguugaagaaaagagagaaagaaaagaaaagaaaaacuaauuuaacucuaaaaaccugauuuuagacuuaagugagagaagguuguaacaucauaccaaaccugccuguagauugaucaucuagguuggccagauguuagauugauuguucagguuggccagauguuacuaucauuuauaacuacagccagagugugaacagcagagauuaacagugguacagcacuguuaccuacucucuaggcuguauucaaagcucaccaggucucccugauugccuucugcuccucugggcuagaaggacacauugcaccugauuccugucacuucccacucaccagucugugacccauucucaguuuguucucuacuagucagauguuuugaagacuguccacauuuuuuuuuuuucugaugucauguaguuagauuuuaacuaaacauggucugugucccucuuggugcauuauaugaagaauuuggucuuuaguacccauugguccuaugcuuaaugaugagccuuucagucuuuugguguggugauuugaauaugcuugacccagggaguggcacuuaggcgguggcacuuaggcgauguggccuuguuugauuaggugugucacuuugggugugggcuuuaaaacccucuuccuagcugccuggaagccagucuucuagcagccuucaaaagaagagguugaacucucagcucugccugcaccaugccugcgugaguacugccaugcucagccuugaugauaauagacugaaccucugaaccuguaagccagucccaguuaaauguuguccuuuguaagaguugccuuggucauggugucuguucacagcaguaaaacccuaacuaagacaauuggcuucaguaguauauuaaucaggguuaucucaagaaauagaauugauuguguguauaugugugcacauguguucgugugugucuguuaaaaggggauuuauuacugugguuuacaggcugugguccaggcaguccaacaguggucaucuccugauggaagccauaguuguugagucugugaaccugaaugacucagcacugaucugcugcuagaguccucucaggauuccuugcgagggcuuggcuguaaggcuacacuggaauguugaaguaggagagaugagcuagacugagggcaggcugcaaaggcagcaacuucauuuccccguguccuuucagguggacgaugugacccagauguagggugggcuuucccauuucaaaugauguaagaaagaaauuccuuacaagaaugcccagcuuguuggguuucaguugauuccagaugaagucaauuugacaaaccaauacuggcucucacaaguguguaccacgucucuuuccccucugcuguguuagcaucuauucucgaccgugguauuugccaaauagcuugccauuuuccccuucuuuuauacuuauuagcuggaggucuaucaguguuauugagaugugcauacuuauuuuuauguugauuuuauacaucugucuuuacaucucugcuacgaucuaccuuuagggcuuugcauucucaugccuacuugggagcacugggcagaggcauccucaccccaggcucacaaauggacugugcucucaaaugucauuuuacaaauuugcuuuaugaaaaaaugugaguggaugcucuuuugagucuguguugaccaugcuuuagacuuuuuauuuuuucuacauauuccuucucgaugaccauuauuucccuguaggagugcuuuuccuauuagauuuuuaaggagcacuuuguauguuagguauguuaucccuuuuauaagaugggaacauuuauuuuuguaacuacaacauuuuucuuuagcugauggcauauuuugugaguuuucauguagaugaaguuauuaaucuuuccuuuuggugcuagaccagugcuuucucauuuucaguuuguaguagaaucacccauuugcuuucaagaguuuuauagauaguggggagguguuauggguuuuauuuguaaaggacuauguaaaauuaagagaaaaguagagauuuugugucgcgacgcaagaacagccucccccuuugucagcguccccuacagggcugaauguuugauaaaaaggguaagcccacacugacaccuaauuaucacccaguuuuuauuguuuaccuuuagguucggacuuggcccuuguaugguuugcacagguuuacagugauacauuucauuauuauaacaccacagaguguuuccacugcccuggaagcccucaguugaugaagcuccuucauccuuccuguuauccguccaucccagaugaagcuccuucauccuucauguuaucuguccaucccaggacaacacagaucucuucauuaucugcucaggguuacauuuuacacaaugagaagacacugccauuuuggauuuucuucacucauuuacagauguuccaguguuuuuccuucauggcuugagagcuccuuugcuuucagaguaaagcugugguaaacaucuguguguggguuucugugugggugcaguucccagcuccuuuggguauaccugagugugacuacugggugaaaguauguucaguuuuauaagaagccgucacaguuguggcuuuuugaccuccucgcugacaauggcugcguucuugcugcuucacauccucagcaauguauggugcuuucugucagugucuuggauguggaccguuuuuaaaguugggcauugucaauuuauuguugcaguuggcauuugcuuagugacauaugaugcagagcgucucugcaaauguguguguguguguguguguguguuuguaucuccguauccaucucaugcuguguuccauggcagucugaauaguuuugguacauaaugugagcugugagagcaacuuuacuuuggagcuuuuccaaucauuuguucaggucuuucccuuacugaucggagauaaugcccauccuguaccaaguguccaugucgguuuugcguagccugugagccuuccuguugugccacagugcaucauuuaacucaugcaacugagcuacacuguuaugcuuguaguaacuccauacugugguuuaauuaaaaaaaaaaaguguuuuguuuuguuuuuuaaaaaaagaauuacuggagagcuggcucagugguuaagagcacucaccgcucuugcagaggaccuggguucuguucccagcuuauaagcacccacaacacuaguuccaggugcuccagugcugacuucugaccuccuagggcacuaggcacauaugugacacacuuauuuaugugaagaugaacacucauccaccuaaaauaaaaacaaauaaaaaaauacuuguuauccuguguaucucuuauaugugugcaccagaacuugggagugggagucaagagacucucccaccauccuggguuccggacuuugucagguuucauguuuguuuagcaagugcuuuuacccucuaaggcaccuaucucacugaccuguuaaggcuugccacaguuccacuguagucagucagucagccagccagccaaucucucucucucucucucucucucucucuuucucucuuucucucucucuguuccacuguagucagccagccagccagccaaucucucucucucucucaguuccacuguagucagccagccagccaaucucucucucucucucaauuccacuguagucaaccagccagccagccaaucucucucucucucucucucucucucucucucucucucucucucucucucucucucucucucucacacacacacacacacacacacacacacacacacacacacacacacaacacacucacacucacucaacuuuucuugcuuagguuuuccuaauaauucuuuuugaaugcuaaaacuaauagauuuaguuagugaccaaauccuuggcuuccucccuccaauuucuagggccuuuuaaaaucccauuuaguacugaucccuuuuuguauuuauguuauaucugcuuaaaaauguguacauuuuuuuuucuuugcaagguacaagauuuuacauacacaccauaggcucuuuaggaauuuaaaggugugucugcguuugugugugugugugugucugugucucuguguguguguguguguuugugcaugcaugugcagguaucugcaugcaugugcauguguguacacgugagugcauacccguuuaugcagaggcccacaguggauguccuggguuucuccucaguuguucuccauguuuauuuuugagacagaguuucucauugagccugaagauccugcauucugauauucuggcugccccacgugccucagggauccuccuuucuccugccucuccaaggcuggguuacacuccugcucugccaugcugagcucuuucuguagguucugggguuugaacuuugcuccuccugauuaugcaguagguacuuugcuggugguguagccaucucccaggcccaggaauuuaagguuuaugugggguucugaaguaaauuugaauuguauuguacauucagagacgcgccucuccugucaggcagguguucaucauaaggucaauggguagacuguggaggacagugaaccauagaacuuacauggagagaggugucuguguaauuuucuggacagaggauucaucaauuuuuaaaaaauguucuuucaucucagaaagauaaaggcuguuccagguuaaagcgagaaaaagaauggaauuuaaacaccuagcaaccaagaaugcaaaauugcgagauaggaaaacccagcuuuuccuuggccacugggaucaggguguacugauuaggaaaugaaggugucuuuuaauguuuccaggagcucuaaagccuuccaggagucacugucuacauuuaccauaaugguguuuucucuccucuuucuuuuagguaagugacagucuaaagcuugguuacugcucuaucaagaauggaugcaugcuuaagacuccaucccuguuucugcugccaugguaguaaguucuagccuccugugggcugugcugcugugggcaaggggcuaacuugcagaaagaaacagguaauuuccugcaagccauuugcuucuuuccaugacuuguuuuugcauggcuuuguuuucucuuuuguuuuaagugggcucuuugaagccucucugcugaguuucugcauaaaaguagagucagggcaguuggguccuaagggagguguagaagguuugggagcugggugauuuggagcucugcuccccaguguuaauuucaugguagggcaacuguagcuuuuuucuuucuguuuuuccuguuuuugaguagguacagugauauaagcauuaucccaggaagauuaacucagggaccauuaugcuugucaagguguuccaggucacaggucuaguuccuucuuccuuuucagcuccgacuuuucaucaagaugccaauaacagugagucuaccaugugggcaaaggaagccugacuguguaccugauagcucaagugucuuugagacuuagaaaucuuggagaccaggcgccgaaggauuuguaaaggaaucuaaacuggguuuaaggaggcagcaaacaucucuuugagcuuacuagccacaguagaaaagcccacuugagguaggccuaggugugguuucuuagguggccuccgaagaaacucuggacaucuuugaacugcauguugggaaaagaauucccuuguuucuucaaggaugagauucgcucaaauaaguaaagaauguuaaagccaagacuguuuuaucuccugcaggucuuuaaauacuugucagguuguugaguucagaauuaucuagcaaucuggcuuuguaaacagaugggcacuuuucaccaggaagcagaagcgcacucagucugauuuugaaagugaaaguuaguugugcccaguuggaagacaugugagucuguaaaagguuggggaauuacaugccccaguguuuuagcuugugggguuuaacccaauggcaaggucccgaggagaggcuggggccaaaggaaaccacaguucauugcacauuuagagauuaaaauaucuccaaauuaguuccagugauucauuucaaauuauuuuaaaagcccuuuauauuuuaaucagagucuauucagggccaguuaauuuggauaggacauucuaaaauuacuucccccagugauguuuugugccauugcuguagaaugcagaaagcccaugagagaggggaccugggacauaaguaccauggagcuguugaucuuuguggaauguuuucugguuuaacaguggcagugauuuuguacaugcugccugacuuagcuaggauaaugaagaauguucuuuguagagagaguggcugcuuucacaggcagcccagagcccaccacauauucagggaagccugggcgauguggccuggcucuuauguaucugaaucuaaucucuaacagccuggguaccucagggucuuuauccaccacuuuguccaucuucccugcaguuaguaaugaagucccuacauaguaaaugcauagugcuuuuccuccacuacucaugcaaacaacagaguacagugacuucuuguuacguuagaggagaaaagacccuggacuaaguggauccuuucaugauucaaauugaacuuucauauucuucagucccccuucaaagauggugaaacucggugucuguaaagaaaagucugaaugaggcuccagauggaucuggugcugaguucaagcccugguuuuccugauggcuggcuuuugucuuccgccccacuugcuugggaagaggccuguguguuggcauucugugcguucacgucuagacccuccauuguggaaaauggcuucuccuuagaagcuauuccaagcuagagggaccaggagugggcacuaauuaauauguuguuggaagauagcagcauccauuuugggauguuguauuaccuaccaguuaccagcuuuuugcaggaacugacuugggaaaggauggcaggaugggcuuucucguugugcaacugaggaacaacugguagucaaggacuuuuuggcaguuggcuagaaucucauuuuaaggcaauaacacacucagaguuguauucaaacacugagauaaaugcagcaaccuaaauucauggguuuuguuuuuuuccaucauguagcuaauuauugaacauaacgaggcuuauucauaauuucuuuucucuugcuugauagccguaauccuguauuugugcuacugucauucccaugguaacagacgaaugucugaagcccaagauuauuaaauacagagcaguacauuaaaauaaugugaagguucugacuuacagagagacuuucacacuggggcaaacuucaaaaagagaauacuuacacaaaaagcaauuuacuuggccaguaaugguugguauucacaucgcuauuauggaagagauuuguuugaauuauagccucucucuucccagaccaucaucuccucaggcuuugcagccaagucuuaaucugguguuuaugaugucagccaguugccaggggaguuuuucugccacaaauguauugugacuucacugcaugauagaggcagaagagacuggaggguggaagcgaacugccaaggugaucuuggguggaucuguucugcaggguaaugcuuucuuucccuugcauccucuuuagaaaauguguagccaagugcugcuuccaaagcuuggcccuucauaaaugcuguugaaaugacccaaagugacaaaagccaacacugaggaagacgugaccccagccggaccauaauacuucaaaagugcucauaauuuguuuaguucuaugcuccaguaacgaagcacaugcauuuccgaggcauauaaauugguaaaccauaccacccccccccucugcuuuuccugugaagggaucugaguuuuaauugaauccuauuacaaauccaaggccugugcuuaaccacacccucaccggucggucacccaugaaugugaaagccuggccaaaccuagaggugucuuugaagccaaauuuugugauguucaucagcgcauuuccauuauggucucaggggcuccuucaucaucugguaucugggacauccucccauuuggauggcauaaaaauaaucuuacucuuccaaaagauaaaaagaucucuguagauuuaagcuaagugcacagguggugcugugcacacuaggaacacguugacugccauacucucauauaaaugggaugcauacaccagaagugguuuucaaaaccauguaaguguaagaagaacuugagcaagaaaaugcugucuggugaggaagauaugcaggcuguguuuaaauaguaccuguaauuagaaaacuaacugcaccaagccuuuauauuaauaaaguugaaguugcagagucuaggacgguaucuuccagcucccucuuuuuccaucgcugaacgcaauacaagguuuuaaugaccuuugccuuauuugcuuuucaagauuuaaggucuggcaugggacauguuuuccucaguguuggcuuuggccacuuugguucauucacacauuuacgaagggccagucuuuggagaaguaucacucagcuaaacauuuucuagagaagauacucgguaaaggaaacacugcucugcaguguggugguaguguagccuaagcaaauugacauucuucaaacaucucuuucuaguugcugccaauuugucaccuuggagccugcauaagcuuguuuuggguuugucauaagacgcccuuucucuucuguucucuuucccaaaucagcguccuucuuaaagaggugcaugccagcacauggugcuauuauacuguacacugaagacagcacacuguaccuuuauaaugaucgucuccgcguuuuguugaggaagcuucagagugcguggagcggguguggaaaugacuuucuguacagagagcagagacguugcauucggcugcugauuaucuacuucgcuccugcucccugucagucucugagcucacucacauuuaugcgaagauaccaacaugaggaaaaucugggugugagggagggagauucaaaaaaaugguacugaguccugauuuuuuuuuuccggaaauuguuaucgaauaguuugcgggugcuuugucugggcuuugggauuuaaaaauaaucuccaggugauucuaguguacagauuagcuuguccaguugcagguuucuguguugcuauggcugccaauugaacucagggcaagggaacccaucacaggugcccuggacuuugugcuuuggcucugacccuugcuacuucagggagacuucccagaagccccguuuccuuucuugugcucacaccauggaaacagucaucagaugauucugacacuuuguuuccuugcucccggacgauuaaaagaaaugaucauuaauucugacuuccccuacguuugucuuuuuaaaaagagccuuuaaauuuuuagaagacuuuuuuauuaaggcugugaaacagaacagaaaucaauagacgugcaacaacaacagaccccacaggcugggaagggaaagcaagcgugggaucucgugcuggucccugggcuaacacuggagacugaacguucacuuucugacacuggcuuccacaccacugaagagcucuguagugugcucagccugcaugcaaauuguuuuccuuaagcucuuuaucaaugauaugaugacauuaaaagaagaguuuaaucauguuuuguuuuucaauguguaacgcuagaggagacaagaaaaaaguagauuucuucaucucauaaaaccaaguccauugcaauaaaguucugacuaaaacuuagccuagcgguuuuucauuuaucuugguuauugcuuuucacgugucucgugguucuuguaagcacaauuuucccucuggagcuagauacaaagcagagguuauaaagagaaggguugggaucgcgagugucuugcuucugauguuuagccuuaagaaauauauuugagcuuaauagaaaaguaauaaauagguuugcuugaauuuucuuauguugguuucauacucucuuuugccaaaucuauggcuagcccugaaagcuugaauuagacagagaucugagguaauuccaaguagcagcagugucagaugacagcagcagaccuucuuacuucuguucccugccuugcacccucaaagaacaugugcaaauguuaaguccagaucgguaugggagagcccuacugguccucucuagugcuugcucagagcccucugcaguucugcugccugaagaagagccucgcugagcuugcuggggucuucuuuucucuccacaguguuguuuuccugccucccugcuccucuccucuccucccccucccuccccggcaguucaggcuuuuccucauggaaaauuucucucugugauuggugacucuugcuagcugauuuguugauaaguucauuaauuaacgcugauuucugguucauauucaaggcagagaugguguuaaugccauaagugcuuuggaucuucgguuuucuuugugugguuaugccuuugcagguguggguguggagaggacgggaacagaaucugguguccuucccuaggaaugcuaccauaguuuugagacaggguauuuauuggccuggcaagcuaggcugacuggcccagugaggccccuaggaucuguucuucucugucucccuagcucugggauuacaaaacugggugcacaccaccuugccccccuccucucucucucauguugguucugaggauugaacuuaggaucuugugcucgcuacaggcaguuucugcaccaagccaguuccccagugcacgcucugcuuuucaguuuuguuccugcuucauggauguguuggucaggaacuaaaacuaauaagauucccugucugcacauuuccugucagauuuuauauugaauuugaaaaggaaauuuuaauaauuugauucugguugaaaagaaucccaggaagcuguuccgagcugugucuuacuuucuguuaguuuuaauuuaaagagaaugaagcuuuguguuucuuagaacaugucuauuuuuucuuucagauacugcuaacauuugcacuuccccaagauuuuauuuucuagaccucuucuugcuaauaauggcaacauugagaguauauuuuauccuaaguauucuauaucuuugguuuuucucauuauaaaaauaaacuuguuacuuuaauuuuaaaauuguauaaaaguagagcuuagaguacaaaauuuaccuguaauccuauuuacuuggggauauacaaauaaauauauauauauauauauauauauaauuuguguguguguguguguguuugugugugugggcauauauguauuuugagacaaucucacauagccacagcuuuccuuuaauucuuuauguaggcaagaauuuuucuccucuuuaaaaaaaggaaaaaacaaacaacaacaacaaaaacaaaagcaaaccaaaaaauggauaacccugguuguauuggaauuugauaugaagacugguuggccuugaacucccagaugcccgccuuccucugccucccagucccagugcuugaacugaaaggcaugccugcacauuuggagaauuugaguucuugaccgcccucugccucccccuuccaggcuuucacugcccuguucuauggacagggauagcuccgcucucuguauaucuacagagagcacguuucacuuuugauuaguuaacauuguguugcuuggaaccauccaucucugcaguaaugcuccaggccugugucccaaugugcauauaauuaauuuccugguguauacuaauugauuguacuacuucuuuauuuuuaaagccauagaucuauccccugaauuuuguuucuguaaacaaugcuaugguggacaucuuugucuuugaucuuugucuaugauucaaguauuuuguuagaguaaguuuccacuauguagccuccucauuucuucccuugccuguuucacuguacaagucgauaaugccaguggcugacguuucgucuccgguauaacugugcgguugguauaugguaccguguuccaaggucauucacguuucagaauggagccgaguugcuuugccauucaucacucaagucugaaagaccauuguaacuacuuugcugauaaagaaugugaaggcacagaggaaccgcaguaaacuacacagccccagaguuguguugccuucaaaagaagcacugguucauagagaugcucuuuauuucauucauccccauugaugaauccucuaaguuguaugucuaauugugcucacuuuuguuucauagcauagugcagacagguuguaagauuuuuagacacuaaugcacagugguuuccuuuacaaguuuggagacaauuguugauucauaaaaccugacaggaacuuuggguaauugucaauuguaugacucuucuaugcauuccuuuugcuuugcuaucggcagucauuaaagggauucaauuugaaaacugaaugagaaauuaguauauucuuacgaaugugccucacauaaauuuuaaaugaagcauuugacuuuuguguccaaaucaaguuggcaaaagaauuuuaauuauuucauuggcugaguuuaugaguuucaguugaaguuggagauuacucaaaccagaguacauuaagaaauaaauauaauuaagugcuugcagagguaugugucuucaacaggaacugaauuguaaucauuauuuaaucuagaaacuucuuuuguuuugucacaugagucgccugguccuuuccucagugacaguggguggcucugugucaguuuuccuuucuguuaaccaaacauuuccaucuggccacugcuaccuacuuuaauaaaugauuccugccgucauucucucucucucucccucccucccucccucccuccuccaguuucuuauuucuuucucuuuuuguccucuugccuccuucucucaauggaugucacagugaauacuugguggggacaggugcucugggcuucugugugugugacagggcugcaccgguccaccugaggagcaccagggcucccagcuggggcugauugaagaguuuuagucugaaugcauacuuuccagccucugagcaggagcaggcagaacaggaagucaucagggaugccaccauucauucuuggaagcaucuugcuguucuuucccccuuccugugaggcagagacagacaggugaggaucauauuguccucagcccagauuucaggagccccaggacugggguggcugacaagugauagugccuucuggccaggacagggauguggcacucaugaacucuuaacagcguggucagaaccgcagaggccucaccagcugacaugccaacaugggcugagaaaaauuucauaaggucccaccuguaggugaaguuaugaacacucuuugugguugcugaagugggagagaaccaguuugguuauuuguuuguuugcuugguugguuuuguuuuaggaaagcaccccaguccuaagugguuagcgccaaacacaugcaaaacaugagaaugcuaguuggacucugaaggugugagugucugugugugugugucuguguguguguguguguguguguuggaggacaugagagguguuggagcagcgagagaaagggucaauguaaaugcaguguauuuucuggaaacccuucagcaacucagaacauaaaggacaaaagugaggaggaagccuaugaagguggagucugcaucuugaaugaccgugacgucagguuccuagugugaccucucuagcugccuuguuuccuguggacugcaguagcucagagcagacagcuggccagccacagugcagcuguuuauugagcaaagaggauugucuuccuauuuacuuugacucgcuauuuuuggaaggaaguugauguuuuuuaaaaauuguaacauuauaugguuagaauagagaaagaaggggaaagugcucacaaacuauguccugagggggcuguccauucuuuucauuuacuaaguuguguuucuaagugugaucggauucuguaaacauaucuaaacacugcuuguuguuuuguugaaucuacacaguacaaucaaguuaaugggucagucaguuuaaaacaagaguacuuucagacguguugugcucaucaacagcacugugucagacaucguugggucucuuuucuguauacaccugugggauggucacaggaacaagguugagauuagcaaugcaguggaugguauuccaaagucucuagaccacaugggaggggagcuuaagcacaaaaacaaaacuuguguuugaagcagccgcuuuugaccuaggggaacuuguagcaguagggagagccccugaaccauauaagaauaaguugcacuccucaagccccuuugccuacaaauacuucaaaguguauuuccaaagagcgccauuuccuccucuauaguaccguuauuagcuuugggcacuuuaacauaaaacugaugaguuuuuuuuuuuucuucuaaucuucuauccauacaucagcguggccacuacacugaaugauguccuguagagccuaagaucuagccuggaauaacaacgcugaaggugacugcuugccuuggcaguuuccuuuacgggagaacaguuguuugaguugguucaucguuuaugacuuugccauaagaaauagucuaccccucacaccuuugugcuggaaguccuccuuuggguuuauuugauguuccagucugaagagaccaagucuggauucccagucacacugauccuuacaugggggguaucuuucugaaaguauugugccaagagguacggguauccuugugcguugugauggugauuugagcuuuguguaucuugccgggcaccgucugaucucucacuguguauugaauacacauucuugcagcugcugaggaagugcauguaagcauguuguuccauuaaaucuuccuccuuagacucauugacagucuugcuugaauuuuucuuuccugcagucauuuuccaaccauagcacccaccagcauuuacuggucaaaagugacuagcauugacagacaggggacaugcacgugcacacacacacacacacacacacacacaccgcaccuuuuuacuuugagacagugucuaacuauguacucuccaaaauggugggauuccaagcaugugccaccauauguaccacuacuacuaauaauuaauaguaauauaguuuuaauaauuuauauuucauguugcuaaaguuacuuggguagucagauuccucuagacugaaggagcaggagccccuucagcuugguuuuuguuccuuuuuugacaccggcuuuugccuuuuuuggaaguuuaacuuuuuuuuuuuugucaagaaauguucuaggcucacaucuugugcccugucuacucugguuuugcaaugaaacauuaucugaggaauuuugguucccuuuaaaggaaaauugcauuagaaaccgucguuaagguacuagguguguuacuuaaggucacaccuaagagucaguaaaaaguaauauauucacacacacacacacacacacacacacacacacacacacacacacgagcacauuuaggagucaaaaaucacacuagugcuucuuccuagucuaaucuaucucuacagggguucuuuguagguguuuaagguuuauuguuauuauuuuuaauuauugugucuguguggauauaugcaugugaaugcaggugcugucaaaauucagaagaggguguuggaucuccuggagcuggaguuacaggcauugggagcugccagaugugguugcugggaccugaacuuggauccucugcaauagcaggaucugcacuuuacugcugagccaccucuccagcccucuaugaggucuuccucagugaaauccccagcuccuuauacauuuauucaguccuguaucacaggcacuaguaggcucggagcagcuuugcccagagcacagcagaaaggcagcauuuuaaagcuugggguauaucugccacacucccuccuugccugagaauauagagcacacugcugaaaccuaacuugaguuccuucgcuucucccuugugguuagugauucauuuaaagcacauuuguguucauuuaccuccucuugcuuucaauuuuagguuguuauucuuucccaauucugauuuauuaguuuuggguuuuuugacuauggagaugagucacaugcuuugcaaggcccguauuuauaugaugaaaaugcauagggccauuuuacaugaaaaaauccugaacacauaucacugcugagauugaucaucuguuaaagggcauggcucagucucagagcuaagaucauagccuuccucucuucuacuagaucuuucucucucacuccuuucuuuccucccacucccuucuuccccccucuucucucuuuuuuucuucucucaguguacuucuuagaaccugaaaggcagcacuugauuauugcagcuagccuuagauuuuugucucuggcuuucauuauuuccuaucccuaucauuuaacaucucugaaugguagacauaguaggcaugugcucuuuccaggaaucaagcucuugauugcaucuuuuaaaauacuaagacauagaacaguuucaccuagaaggccacgauauacucuccuuucacaugacuugacuuugaaucaugauggguucucucucuuuguuacauuuggaguuggugaccauugcccaugugauaugguugugucugcuucuuguucaaaguuacaggcagggcuuauggaaugauggccucacagaaguuagucuggaaugccugagugaucugccaaacggcucaccugcaggggcuacaggaaagaccuagauuugcagaauccgaggcaguaacaauugccuuuugcauccuagcaggugauuuccuuagaggcaaugcauguagucccaauaacugagugugcccaguuuuaucuuuucuuaugaacagucucaguacagaaacagaagcugggcuuuauauacugaaaaguauaucaaacuuauaaagaggggucugcuagucaguuuugcuagugauuguauuguuugucugugaugccucuuagaauccaaauaaaucaagcaugcauauuaaaggaggccaucuuggaguagcuaauuagauggucaggacuauauagauguaaaaucaaugcuuuaucuauguguauuugggaauuuucuggacaguuguauaauuuuuggugcaguuacccacuagcuguaugugugcccagagugucuauuuuugcuuuauguuuuuacguuuuccugcucauaagcaacuacaaauuacucagguuuauaucaaaucaacuuugucugcauuccaaggcaaacauucaauguagaacacaguucugaaaguguauaagagaauaauugagaugaccuuuagcaggacuucccauaggagggucaugcuggugacauuggcuggccagcacacuucccuacugcccaggugggugauauuggcuggccagcacacuucccuacugcccaggugggugacauuggcuagccaguacacgccugggcugccccugucaucugugagagacauuaacagacagaucccugaacuaagcagccucacacacaaggaaagcucugagacaaaucuuccauguuugauucaggagcagcaaauccuuuucccacaaggcaguauuuccagccugucauguugugauucgcuuuuccccaccugaauguaaugugccauuaguuucuccccuguucuuuuguuuaaaaaaauuuuuuuguuguuguuguugaaauuccuuuucuuuccaagcacauuuaaagaaaugaguaucugccucucaguuaggugggagagagggaaaugaguaugaauguguguuuuccgugaggguucugagcgcaguaauaggaccuuuuaaagcuuuacaguagagggaggugagugauccaucaaaggcauagucuuggauuugggucuucuauuuagauuaggaauguuaagaaagauggaugguaaaugucuuuuagcugcguuguccccaaaacaugaaaugaaaucuaaagacucucaaagaagguuucaauuacacuagcaaaugacuugaacagggauuggggaaggggaggucaugggccaguggaaugccaguuguggauuuauauuguuccaaaugaaaacauuauuuccauuaaccccuuuccacuagugccuccaccggaguuauucucagauuguacguucguagguguucgucacacuugacggaaauaccucaucaccaagguggauuucacagccuuuccguggcuguaggcuuucucccuguccaacacacaguccccgcuugcauuagcugaucuucuagaggugcucuggaacguguguucuccaggcucgauuuuaaagcacaguagucagcuacccagugguagagagcauuucuaaguuguguaauuaacaccaucauaaauggguucugauugggcuuuucucccaugagcuaauggagggggccugauuaacugggaacuggaguucaaggcagggggaggagugauuucagguuuacgaauggcucugcacaaauuugcccuuaacugucaguguggguuccagugugguuuucugcccuuucauagcaaauagaggaaggaguugguaagcagaggaugaaaccuccuugucaggagccggcuggagugcgcacucagggcaggcacuuuaaaagaaugccauuaauuugaauaaaacaggagaagguagguacuuuguacauccauaaagcacugaaggggauaaauccaauuaucuguucaauauuuaauggccauaaaguuaaaaauuuuaaaggcaguaccuuggagacugcuuagucaauucuguccauauuauuuuugacauucaaaagucaagguagaauagccauaucgacggcugcgugcaucgcgcuggucuacuggcuuaguggcagugacccuggguuugugauucuccaugcagaucuguugcaggguuugugggccccugccccccaguccacuuagggaguguagggucuccugagcuuuuggcacgcuccuuuucuuucaggcuuuugcuguugucucuugguaugaauauagcuaaagacagugggcaaacaaguaaaauacuugaagucagggcgcaagcccacagccuagauacaacuacagccuuuaaagaagguaggaaauuuuguuuuuaaguauuucaaacauucccaucugagaaacgcuuggaagugccacuaaaccccaguucuuucuuuaucgauguuucauauauccugugcauuuucuaagcuaauggugggguaaauaguuaaugucuuaguuccuccuuauacaggugggcuuugcucuaagcguggucuagagguagcucugcaaagcaaagcuucuaaggaaaucaaugcaguagccaucguugggauguuucucaauaugacagagagaucuuaggauauggucuccuuucuccuugccaauuagcuaacguaggaacccaguuagccauuaauaggcucuugccuguagaagcauggcucacuauagugcaaggaacacauugcauucuccuuuuuaaaaauucugauuugugcuuuuucuuuugaaucaucgauucuucaaccccucucuccaccauuugcuugcugggcauuggguccuuuccauguggcuuugguuauuuuuuccccauagcuuuuugcuguuuacuuuuaaacucauacuauguauagaugaauguugacacgagacagguguacugcuaaaaugugcugagggaaucccacagcaggccacacugagggagauuaaagaagcaaguuaguauacugcauggauucugagacauaagaggccuguucugucuuaagaugugucaggcugugaagaagggcgugccucugugggcuccuuaagccaccuguguuuuucccagggaauacacauaaaaucuuucccuuucuuuucuauuuugcuacccauuucccuugaaagggaguguugcuuugcucugcucuauuuucaaaugcaaauucagcuuauuccugucacaugcgaggucucucaggaugauacucccugaaaucuaaagccauuuagcuguccuggaucuuagaguuuuaaguagauuguuccaugucuugcuccaagagucuugagugauuuggcuguuaaagcagcagaaaccuuuguuuucucagguuccuggaaagaaaaugaaggugagaaaauaaugauuuccgggauaauucaaagaaaagauuuaauguacaaaucccucacaugcuacugcacagggacuuccagaucagcuuaugucacacucagcacgacaauuguuaaacucauuuauuuuuaaagagcuuuuaucagugauacccugaaagcgucaagaggaguggggcucagcaccugccucuggacugugacacagaccuuugugagcuugaacugauucccuugucuuuuuauucuugacccacacagcucuuggguggccaacuuugugagggcaggaccccuuccuucugcucuucauacucccagagcacagugcuucucccgaguuuccuuccugucuuucuaaugccacuaucauuuacauaauauuucucuuuuagguugguugauugauugauugauugauugauugauuuuguuuuuuucuacucaaucacaucuuaauugguauaggccgugaaaucacagauuugucgggcuguauuuuuuauguguauugaaauuaaaaucccaauuauuaaaacuuaugaagcuuauuuaugugccgcuucagauccucucucauguaucacacuggagaaacaccauccuagcgugcuuuugcaguuucaaguuugaugcacauuggugcgguuaugggaagaacagagauaaaauucauuauggacucgauguaccaagcccugcuuucaguagcuuauaugucuuuuucuuuaauccuuauaacucuagugaggaaaaugccccugauuucacauaagaaaauguaguugugcuugcuuaucacugcccuggggaaccugaggcagggagacuuuugagguuagcuugggcuacaugagauguuccaggccaaccuggacuauaaccggagaaacucugugugaagacaacaccaagggaaagaaaaaacugaaacacuaaauaguugagugaccuucucaaggucaaacagacugcauagggacaaacagagcuaaagcaagagccagguccucagaguuccgucuguguugucuuugguaugugcugcugguuuccaguaauuagcgaauuaaccaugugcauuccugcagcagccugcucugccugucuuaguucuccgugaugggaggagcaccaccgccacugguauuuauagucugugcuuugccucuggaaucgcauuucucaccgugcugaguuguuuccaucucggaggguuuggaugagagaaagccucuuagcaccucugcgagcugcaaauucaguuuugauuuuuuuuuaaauuucaaaagaguuucgcacaaguauugugucugugucugugucuguguguguguguguguguguguguguguguguccaugcacaucuguauguagacuuuuguucccaugagugcuuggagagcagaggaagauguuggugucuugcucuaucgucuuugccuuguucucuugaggcaaugucucucugaugagggagguagucaucaacccucauuaacuccccauccuugucccuuaagcgcugguauuacagcuacaagaggccagagaggagguuuucuauaaagugacugcuaaguacuugaacucagguccccuugcuugcacagcauggagccacugaguguggcuuagaucaucuuaaaccuugaacauaguauuuucaaggaguguggaugucauucaggucgccaucuuacgccuaguggacucggagacccucauuaguccuuuauuuaauuaccucuaacuaaggagucucacuacacccuuuuauaucaguuacccaaacucucgucuuuuacucccccgcccccuucuccucuuccucuuccuucuuaagacagucuugugagcccaggcugggcuugaacucuaugcagccaagguugaucuugaacucgugguccuccugacucuaccuccagugcuuggacuguagguggcaugccaccaugcccaacugucauguucucaggggacucaauauuccgucaacuuaaguuuauacaaauauuguuugccuuaagauaaauuuagaaaacucuuuugcccuuaaaucauuugguucccauuucauauagucauuaggcuuguguuuucacucggccggauggcguacccggagacguuuaaugggcccacuuaugcugauggaugguguaauauuuugaggaucgcaaacaguagcacuuuuaagagaaucaucggaacuggcgcgugaggggugugacuugcuggagcugcacacugaagcaugggagcucaguuuugaguugacuucucuuuagcugcccgaggaucccgcuacacuucccuuucccuugauuauguuccuccugguuuccugucugacuucauugccaaauuuacucuacaucuuccaauucaugggaaauggggaacuaggcaagcugccugucuuucuuuuuuaguuuuaaggcugcuuggccuucaguuuugaauaggaaggagcgacagacccccucccaaaagucauugcuggaacccaacauugucacaggcgacuuuuuguagauagaucccucccagcccgccuacacaucaguuggauuuugauauauggccuauacugcaaggggaggaaguauaauuuuuaaauucuaaaaaauuuuuaaucacaaaaguaauuggugcuucaaguaaauauuauuaaggauacuguauuuuaugacauaccaaaaugacagauaguagagcugauaucuuguguguuuauguccaucaccucauaaaacccggagaaugaaaugagccaugaucucauuuuuagucucaaaaggugaaacugauuagagguggugagcaccuagcccccccaucccccagcgcugcucagaaguagauagugagugacuucacccacacagcucuucuuuccuacuccaggcagggaguucagcuauauuggagccaaaacucuagugcagcauuuugucaguuacagaauauuuggagcaucuuuauuuugcccguuauuuccucccucccccaaaugcgugagauguugcuaucacagaaaaaccgggcuauuuuggguccuguaaagcauagcagcacuguccccauguggggcuggcagcacugucccuauguggggcuggcuuucuguuugcucggcugcuuuccucaaccuaaccuuucuguaagaaggaauaauagguuaauugucacuauugugagcauuuuaauugaagauaaacacauuuucuuuuuagaugucuucaguauuacauaucuuugguuuuauuauccuaauuucagcagauugccaaagccagauaggcuguacagcccuaaccugauucagcauucauuacuucugcuaaaucaaauaagaucuggcuaaucgaaacauggcuuguggaguccuucuccaauugaauuagaauauugcauguugaguugcgcuuacauguguauaccagggacagaacuucgccgucaauuuggaaaugcugacucuguacccuccaguaaaagauauuuaucauuuauugcaaaaaaucuccucuuuguggggagucugugaauuaucaaguaauagcauugcuugaaggaagggagauggagcuagcucauugaaugugccauugaagguuaggaaauuaggugucaucucgcagauuggcauacuuuuucuauaaagggcaagauaguaaauauguuaggcuuugugggccauacggucucuuucacagcucuucaacucugcuguuguggugugaaagccgcuguagacaauauguaaacgaaugagcauggcugugugccaauaaaacuuuauuuauagacagugagauuugaauggcauaggauuuucauguguugugaucuauuauucuuaaaauuauuucucaacuguucagaaaugggaaacuauucuuagcucacagacuguccaaaagcacaugguuuggacugugagucuuauucugcuggucucuguuuuagagagucccccuuuuuacugugcccgaggguucugaacugcauguaugcucuuagacuuacaucuuugggguaauuugccuuuucuccuugcuuguucaguuccucauaauguaggaagcuuggacgcgaauaaauacuuuccaucucuuuauuaucuacccaucucugcuugaugugacaaaggagaguuaguaguucagaguccagcgagaguaauuucugcuaacaguugguaguugcuguuuaauucucaagaugugacaaggcaguggaguagacuuaccucauuuucccaugcugggagaugaucuguuagucccaaggauguugucagcuuuccagugugagccuuccugcagggucauuaauaauaauagauuccauaaauugacccuggguuugaaucaggacuuguuggcccugaacacucggugcacagacuugcugucaguguuugcacugaaagaaguagucuaaggucagcuucauuaucccaccuaaccaccuagcauguguguccgccaauguucagcuugugcugugagaggcuucuugugucagacauauaccagacauggcaccucaauuguuaaugacacgaugaaucauucauccuccagguuggcagugucuuucugcaaggauguucaccaagaacuggauuaauucaucagcucuagauucagagagauuuguuaguagugaaaguucagcuuguaauccaucagugggagcucuguccucugacauuauggaggcuugcuguuuucucauuuagguuugucacuggccacuuuuuugcaaaguggauauacuucauaagacaguuucucaauucauuugaaaacugugaggaugcugguuaauguuaucucaggaggagugaacucuuggguagauuaggagcguggguuuuucgacugacugugcugaugccugcuauccagcuucugugauucugaccagcuuauugcuagaaucauuuacucacuaaauagaggacuuaucaguuauguaaccuuagcugaguuccgaucagauggcacggaguuuucuugcaguuuuagacucuguuuucaucaucauggaaguggacguuuucguccuggguaauuuuguuugaaccuauuuuacuuguuuucugguuuugcacucggagaaccagaccaccucucugaaaauguucuuucuuuuucuuccucccugugagcagcuucuuugcaaaugacuuggaaauccuuccaagcacugcugaagcuucuucaaggagcaguguuuucggugguacacaaaguucuguaggucagcuugaaaccauaaugcuugcaaggaaaaaaagauugaaauugacuucaaaggacaacucugacacggucaauuaauaauuaaaacaguuuuuuaaugagcuaugcaauuaccugugugucccuggagaugaugguuuaugguauuauucuagugcccuuucuuuagucauggcgcaugacauuuguaauuuaaagccggcuagacauuaaagugacagaacuuucauuaaccuugucuaaaguuugcuggugacaaaugacuuauaaaacaugcuguugucaaaauauaccacauaccuuaaaagucucuugggcucugaaaaacuggauucucaggggaggacugggccaccugacugucuucaggaacucacuguuaggauccgcaguggccgcguggucucuuccuacuucaggaagugaugucuguccagccagagcugcugaguguuucguggcugucuggcucagguggccuucccguggguuuuauaccaugugaguugguuuuuaacuagugguugaugaccacugaauauuuuccuccaaauuugccuugguguguaaauuuucacuuuuagaaacauacuuaaaacaaaaacuugaaauuacagcauuuuuguuguuguuguuugacuuguuauuacuuguuuuucaaauucucaaccacccaguugugcuauggcuaaaugcuugcuugcuugcuuauuuauuuauuuauuuauuuauuuauuuauuuauuuagugucccucuucauuaaaauucucauuuuuuugagacccccccauauuuuauauucuuaauuuuuaagaauccuccaauuuugcuauuuucuguuuccuuuagaagaauauuuagaaauguuauuaaggaagauauuguacuagaaugcccuuuuguaguauugcuuuguaguacuucuaguuguauuacuauugguaauacuauuaucauuccaugugaaagacuuacaacuaagagacaaaagauggcauucuugccuucugucuucuaacuucugggugaacuuggauucaguuucaagauugacugguaccaaaaucuuguuucacaauucugagagauacacucuuuuaguucacuuuacuuuuuucaacauaacuugaauuauuuuuauuacauuuuuauuuacuuuauuaaaaauccaaguaauuucaucuucacgcuauauaucaauaccuacaagaacaaaugagugcaauacuuuaaaagucauaaaagaaaaacgaggcaggguaugauggcuuaugcuuuuauucucagcccucaggaugcagaggcagugcucuuacucucagccguaaggaugcagaggcaggaggagcucucuaaguucaaacuaaccaagguuaauuagugagcucuuggcccucuaccaaaacauaaugaaacuuacugucaaaauugagagagagagagagagagagagagagacagagagacagagacagagagacagcgagacagcgagacagcgacagggaaacagagagggggaagagggaaguggggggagagaaagagguuaaaagacuaguuaaaggaauuuguaacuaucgcaugauagauacucccuaaguauuuaugaauguuauuacaauuccccggccucuaacuuaauaucauggaucuuuuggggcucuuucccaguuaccucccauaagguuaaugauuauaauuuucauaacauuuuuuguucaaaguccauucauuucuaaugugaacauuaaacauuaugaaauguuaaagacuccugucuugaugaauaaauucucaucuuugcauugccaaguuguaguugagauuucugcauacccagggagggcuuugauugaagcauaacacuagaaagcaugugauauauaaacacacaccucacuaagaaaaacgucacaagguaaacacacaagugaccauuauucaaaucaagaaguagaacuuuaccagcaccccagaauucucccucauggcuucuuaaaauuacugcuuuucuucucuuuccaaagauaacccagacuugaacuuuaaugcuacaguuguguguuuuuguuuuugacauuuuaaauuuccuuauuguggaaaaugucaaacauacaaaaacagaaggacuuguauauugagcccucauguucccuucagucaacgucaacaauuauuaacuugugcccaguguuauuucaucuauaauaucaccuguucacccaccacaggucacuuuacaaaacucuagaccuuauaacaucucaucuauaaguauuucaguauauaccucugaaagggaggcucuguauagaaggugaccauaguucuauauucauacguaaauagacauaaucucuguucaugccaacaacauuuagccaacaucuaaaauuuuuauaguuauaucauaauuauugaucugaaaacauauuuucguuugguugaaccaaaagccaaaaaaaguccauaauuuaacuacuguuaaguaugucaagugucuuuuaacuuauaguuucuaacuccaccuuccuuuuccuguauuauguauuuguuuaggaaacuggaccuguccugcaguguugcaugcagucugauuguguccuccugaagcuguucugcauauuucuuuguuuugauuuccugcaagucagaugucuauuaaauucagauuuaauuuucacuuuaguuuuugggaaagggauacaugaaggauaagaauauuucacacagaacauaacacuacuuuuuuguuuguuuguuuuuguuuuucgagacaggguuucucaguauagcccuggcuguccuggaacucacucuguagaccaggcuagccuugagcucagaaaucugccugccucugccuccugagugcugggauuaaaggcguguaccaccacugcccggcaauuuguuguuuuaaucagggcuguaaacggugauaacugugccaucacuucagcauaaagggcacuggcccuggcugugugacuuaagguaugguuggauacaaaagguuauagaagugauucuacccauugagcuacugguuugcaggauuaguuggaucucuaaaccaucagaagugaucauggagucuguguuuugcucuguuuuaauagaauguauucuuucccuuagugggccacuuacaauugguaccagcauccaaagauaaauacucaaggucccuaaaucccuuauauuagaaugagugcauauaccuauguacacuuuaaacuauuaucauacacaauacaguauaaguguucuguaaauaauugccauauuuggcuuauggggcaaugacaagaaaaaugucuaugcauguucuauauacauauauuuuuuccguccaaauauuuuuaaccuguggguucuuacaaacugacagagaaacccccauaaucuaaaugcagaguuuaaauggucuuaugcuucaacucauugcaacuuuuauucguauugauguucaaauuauccuaauuuugacugugguuguuuccuuacauuaauaucuaagaccuuuuaacaugacugcagagacaauguuuacagcuuuugcugacaugccugucuuaugaauggcuuuugucuuacucuuguuuuagaccugaaaucggcucuuucuccuaggaucucauuuuuuuuuccaaugggaaguguguuuagaagccauagucuggucauagaggaugccuguugcuauuaggggguggggaguauuauuauacaucuuuuuacuauggagagcuaggaaguauuccacuuuuguguugaaguuuaaaugcauaggacuugccuugacucuuuaguucaaauucaaaaccacaugaguuucacuuaaagcccuacauugguauuuucauuuguucauauagaauucugaaacuaacacuaaccaauuuucacacaugcacaacugugcguauacacacacucacacaugaaugugcacaugagugugcacacacauaauuuauguaguuucuuggagaugaaguuuggaccuugaauuuuuaagaaguugcauggauaauucugaugccccacaauagauggaaaucacuugcaugccuaucuacccccccuucuuucuaucuuacuacuuuuuguuacugaaccuugaaccuucuauuucccuguaagaauugucccccuugauugacuguacccuuaaccauucaugucccaccugaauuguauuucuuguuuagcugcuagcugucuauauaccuaacagagaacacuguacgucauuucagccccauggaaaacagucugcaguuaccuuuggccacuugagugcuaaaauacaggugauccccacagcuaaagcucugccugaggccagagaauccuccuugcuuugagcagaaugccugguacugcaauagauuugcucaagggcaacucugcauuugauuaaauaucagagcaauuuauguccuuguacccuuguucccuuucuuuccuccuaugcagaaauguuaauugacaaucaaaggaauaacaagugcauaccugaauucacaagccuuuggggcccaucuuuaauagcucagcggugccaggccugguuggggucaugcuuucucuuauccccacucaucugagagugccuuguucucucuuccgcagcuggaguuggaauaucugaugccagcuuguccuuuauggcuuuuuccucagaacagacuacacaucuaccuuguuccaccaaccucuuuugacuuaguguuguucaugggguaaaggggagccugggaugagcauaucagacaaucaaguguuaguucaagaauauaguaacgcugcuucugauaauuauuuaccuucguuuacuuagcuuggcuguguggcucacagauugcccucauucuugagagugggguugggugaucgcuguuacuuugaauguacgguguaaaauaggacuagagagcaauuauguaacuuuggugauguaggucacacaucuuguaagcagugaagcaaguacucaugucugauucuuucuguuauauggcccuacucuuuggggaaaaaauagcguccaauauuacaguacaaguaaaauaauuuuagaaaaggucaaaaaccaauuaaagaagagaaugagaauucugcucagugccugguuggauuuauucuuagauuuuuggcacugaauuuagcuuugaguuuucuguugguuagccaagacauaaaaggaaaacuuuggcuuggguaaugcuuaucugauuaaggaaagcacaugaauucacauggaauacagacauuuucuuggcacggaauucugugaagaauacauuauaugguucuacuaaggaauguuuguaacaaugaauuauaccuucaaugguaauuuuauaggauauaaacuucaaaaggacauuuucagguucuuuuuaaucaguaguaugggaauucauuggcaguguuuuccaugugggagaggauugguacaagacagcaugcuugagggagucauuuguccuagauuguaguguggaugcaucaagcccauguuuuuacuuuuaaccuuugugcuuuuuguaguuaauguaacuuccucauaauaaguguuccauuuggucuugcuuuuuacguuuccaauauggcaaucucuguauuuuuaaggguauuuagaccauuuacauuuaauguaugauuaggacagucacaucaucuuuguuuuuucacuuuacucagguacugcucucuuuucaaccuuuccccgucuccuuugcugaguacaguucaggauacuagcuuaucucuucuaaagguucacuugcaguaauuuucuuaaaauauauuguacauaucuuuagccuacuaagucugucagcaaaugaauguguacuugucuguauauuguuuuccccagccuuuaugcuacuuuuguucuauauauuuauuuuuauauauguuagaaacuuuauaauuauuauuauuauuguuguuguugcauguucaaugaguuauuaaauaagcauauaaaagagguaacaguuauucuguguuugcuauuugaaucccauuuuugguuuauuuuaguccuuucuagagucugguauguguuuccucuuuacugaaggcauguuuuaauuuuucuaugguagguuucuugguuagguucuacgcuucauuugcuuugucuuuuaaaauugcuuuugauggcagccuguauuuggcccauguauuuauuauccaaaugggaagugaagucuuuauuaauuuuauauaaaaguuuaaguguugguaguucaugcugaauuguuuaauagccaaguucugaugacauuagcguucacuguuggugcuucuggccuucccuuucuguagaggaguccagaugaauacugauguaccucaaguuguugguccaacugccuugcugugcuggaaaugcuguaccccaauaugacaggcaggauagguuaaacagcugaagcuuacugcuuacaguccagacugaggaacauaagcucagaauggugggaagcucagcugcauucugggacccauuuccuuagcuggugggucgcugccaucuccauucuaucaucugaccucguuauugggcacacacacacauggguggggaaaugaagcuaccagcugucugauaccucuuauuagggcacaaaucccccauaaaugcucuacccccagggccuuaccuuaccuacuuucuucccaaaggucccauuccaaguaccaucacauugcuaaggucuucaguuuaagaauauggggguagacaacauacacaguagcugccuuaagcucuggcaauguguaucacucuaaaaacccaaacaauuccuccuuaggagauguagguugagaacuggaagaaacacuuuacuggaucgguagaccagaaccuuaccuguacuugucuccacagagaaucuuuauuccuaucauucuguuugacgugccaagaaguuacuuaguuccacuguauuaacaacagccaaauaucuguuugagucaggagcaucuggaaggaggaagggagggccaggaagauauguauguguucagcaucuccucacaucuaagucuuaagugacagguuuguugccuggaaaguggaagugggugaagcaagugcuguggccgcccuguggaauuacgccguggagcuugggcgugaccacgccucugcagucacuucaaauuagaaucagaaccuugaucagaugcacugcugccuuucuuacacaaugagguggacguucgucccuagaauguucaugaggaagugucccaugagugaugcagguugguuugugguuuuuguuuagagaguauacuuaaaauguauacuucuuugguuucaggguuguagggucacaggaugucccaagguuuuugcacauuucaugugagaucagaauuuuauauuuuaauuuacucuguugcuuguuacacagcuaagagguauuuuccccggugauaaaaugcgaugauaaaucaaauugugacaauguuuguuaaguuaaacaagguaucucugcuaggauucuugcagcaaauguaaaauaagaugauaaaauucugcauugucagcuuauaugauuguuuacuuccaaugacugaccacuugcauaaacucuuaggauaguuuucaaacaucagccucauggaugggccucauguucacacaaagauuucaccaggaggucuugggagagguugguucaguuuucaagaguuuucucuuacaguagcaguugucuaaaaagagauauaaaaaaugcauuuuuacuuuauauauauauauauauguguguguguaugugugauuugcugcauguauauaugugcaccacauacaugccuagugcuuggaggccaaagagugccaaaccccgaagaacugaacuacagagaguugggagcuccuguguggcugcugggagccaaaccccuucuuuaagagcauccagugugcuuuacccugagccagcuccccagcccagacagucacaguugggcagcgaguuaggguuuugaugucauuuugauuuucuuguguaccaaacugcuacuucccgagcccccugcuaccuucauuaaggaacaguuccccccaccaccaccaccaccccgccuuguuuggaaucuugaacaaaauuuuaucacguaauuuuuauuuuaaaaaaaaaaagaggauucucauuacucacaggcacugggguuuugcaaagacucaagaucucauucccucucaaucuguugcuaaaugggauugcugcugaccacuugggaccauuucaauguagcacuagcugagacuuuaguucucugggggcguuggccaccucauaagcgcucuguuggcuguaggugauugguggcugccauguuagacagcagaagacagcagauuuuuuuuuugacauugcagaacauuucuugugugugauaguaaauagaaauuauucagauuuauguacucuguaauguguuuggugugguagcuuucagucauguuaacccaaagaugaaaugggagacaaaacuauaaacaaaaacaugauccgaggaacauuccuguuggguacugaugcgcucuucuuuacaucgucuccucuauuauuaguggguuccucccugggauauuacucuucaaaaaagaagccauuguauauagaauugagauuuuacaaaggcucuaauauuauggguaaucuuucaauuacuucauuuugaacaucaaaauggccuccaugaaugauugcuuaugaugcuuaaagaaguuacucggaaaaaucugaaaaagagggagacaaaucuaacacaaauuuagucauuuugacauucucucaaaucuacauauguugggcauuaucauaaacaagccuuugaaaggauauauaaaacaacaacacagagucuaugcugugaagaauagagaucccaauuaugugucggcaggaugcgcaauaaaccggccugcuauuuaagugaauuggugcuuaugguaaaugugucauucaugaauuuuaaaaaaguguuauaccgcagacaaccuggaugagaaaaugauuugcucaggaaaguaucagaaggaaaaguggcugcagcgacaauaaaggcacuuuugugccuggagaguucugaguggaagaaacagaguguuucucuaaauuaaauaugcucuauaauggugcgugugaauuugaucaugccuuggaaguaaauggaagaaacacagcaccuaucccuucacucugucucugucuuaagagucaauauaaagaggucauaaggaaggccauacugugggcagaagugaguaaaagcuggcugcugacagccaagugguaggcggagagaacccaccccgguagcuuguccucugaccuccacaugugcccugcggcauggauguuagccaccccagcccacucaagaaaaaaaaaguaaguggacauuuugaaaauaaaaaggaaauauuuugaggggguuauuucauauggaauauuauagaguuuucuaauaaucagaauuaccuuaaauuuggauacauguacuguuugcuucugguaaugucuuaacccucacucccuggagaauuugcuuaaaguuuguagaguuagggcagauaauuuuuuuuuaauccauaggaaaugaaauauggagacagcuuugaguuacccauuaaaacgaagaucauauacaauauguacaauuguacgacuguaaaugcuagcugugucaaggacaauacaguggaagauggacccgaguaacagcagugguuagcagcagcugacugggcugugggacagguguggcuccccccauccuuuauucuuuucuguuccauuuuucuaaugaauaugcauuauuuuuauaauuagaauagaaggaaaagugaucacuuaaaaagaacauguucaagagaauccuugauaugauuuauaggucugcacuuacagguuaacuccaguaaauggaaaugaacuccucugcacagacgccggcuucugugggcacuggauaagggaacccauugucucucugcacaucuuguuucacccaucuuuagcaaugcuagaaugucacacccaagauaagccucaggaaugcuuccauacauuauuaaguaagaccuguccucuucagcaugcaugcguaaugugugguucauccuaggccugaaguauucugacuuccauccaucagcuguagagaucuuggacacuggcauuuagcaugguggaaaaccccuaaaagugcucagccuauuuuuaggccaauuauuuuuaauucccagugaaauaauggagacagauuguuuuagaagguaaucuaggucuguuuuuaucuuuuggcauugauuuauaauaaccuugaaauauaugaauauauguaauaauaguaaucaaagaaaaagagguuaucaguuagcagggaagagagaggacuuggagggaaggggacaggcauggggcuacaagcgaggagagggaaagaggaauugauaaaauuauuuuaauuaaaaugcaaaaauaacauuugguaccuuaaaaacugcuuauuuucaguuuuugaaaauuauuuauuucuccugguaaaugcuggacauuuggaagaaguaaugugcugagaaauuugaaugccagacugucacuggcauguucuuuauuucuuuucuccaaugcagcuucuuguagcacagcccgagcaaaucauggguuuauuucuucaccugaguugcugaaaagggaaaaccauagggaccuccuucauugacaggcuucuugagacacaggggugggguagggucugaacgccccagcgugggacgaucugcccccacugccaccuuacaaaguccuggacuagugaacugccuggagacggcacuguuugcugcucuggacaucugacacuaaaaagccauguauuuuguauuuuugcaugucugaaucuuagccagaggaauuaaaaauaaauauuuaaguagguucuugacuuuuucuaucaaggaggccccgacacaggcaauuugcucaguccuuucuguuggccuguguuugugccgcacugcgauacgauguuugcuucugaugacuccagcgugccugcauugugugaucagcacacagaaaaugccaguguugucuguggaagacuguaugauaacaugugaccccagugacagaaauaaauggaucccaggaacaaggagccauuaaucuggaugaaaauauucccacacacugggcagauuaauccuggcggcagccuucauucguaaaaccuacucugcucucccaaaugccagagagacaggcagacagaccaguguucacugugacuccugggggacacuuggguaacauuuucccauauuagggaaacugaacuccgagcugcucccguccugaaguauucuugccugaaaauugauuauuguuucaagcaagguuagcaucaucagcuugcuuuguuuguuuguuuguuugauuguuugcauuuuauugcuugauguuuuggaaagcuucacaaauuuagccacaguuggugaaccccaaagaaaagaaaaagcagauuuuccuuugcuguccugaguucucuuuagcugacauaugggauaauuaaaaauuguuguaauguugaagcaguuacuuacaccuguaaucccagcauuugggaggcuggcccaggaaaaucuuaaguuugaaacuugucugacccauguguuaaauugcagcuuugccugggcuagacagaaacuccuacaacaaaaauauuguaaaaguuuuagccaguuugauugaugucaguauuuucuuuacgaaacauguuaaagcaaauuauaaauaaauacuuucuccucuugguuucaacgucuaugccaauauuugucuauauagaacaaacuuuguuauuugcuaauguuuaauuuuagaacaaggcccaauaagaguauuuaaccaugguuuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgaauaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacucuaaccaugguuuuuguguaaaccauacucacaacaaaucuuuuauuaucuucaucuauuuauacauguaugaacauacauauauacacacagucauauauugugugugugcaaacgugugguauguauguguauaucugugugugugugugugugugugugugugugugugugugugugugugugugugugugugugcgcguguggugaugcugggaauagaauauaguaccugguaaguuaagcaagaaguuuaccaaugaauuaaagacacugaaauagucuaagagcagaauccuacuagaccuuuaccaacuuucugccagcccuuuucaguuagcucacuguauuugauucaauacuauuuuuauaauucaucuuuaugaaguccuaugaguauucugcuuaauuuugacagacacaaguaacauuuuaauaaaguuuuaccaacuuauuuagaguugacugugcaugagcuggugagagggaucagcagguagagcccuugcugcccaaagugaugaucuaaguucaguuccgagcguaugugcaugagcccccccccauacacacgcacacacacacacaugcacacacgcacacacaaauaaaauauaauaccuguuaaaaacuguauuccagcuuaacugaaagccuagaagaaauggguggauuucuaggcacaucugaccuacauauauuaaaccaagauuauaucaauaauuuacaaauugaccuguaacaaguaaggagauuaaugugguaauaaaaaaaauugaaaguucaucaauaagcucaaauggcauaaacaauuuugaggauaaacccaagaaacuugucagccugugauucagcuggugggcuucauaugccccuccacaugauaauccucuagacggagauucauuuagagcaccccaaacaucacuuagcagagaaugaaaagcauuguugagccaauauuguuaccuuucccuguaagcauauauaaauagcuacagcugaaaacugauaaaaauuuaauuuucacgauuguucucuguuuucuucuucuaaugaaaagccagagauaguugaguaaauucuaaugaaacuauuauuuacuuugguacaugcuagcauugaucuauuauacuacucuguuuauuauguaugugcuguggugauugauuauaaugcuguuuuaaaauuuccagagcagagagcacuuguucuccaaugugaggugaagucgggaagacagacagccacugagauuugcgccacuugaguccagugcugacugugacaggcaucuaagacuguggaguuaccuggauggguuuggcccuauuaaagacauuaaauaaacagaagcccauucuguauuuuuuggucagguucugauguguggagcccgugcuggucucagucaccaggcaguccucucuccguagccucucccaugcuggggcugcagccucugcuccccacuccccucccucacuuaguuuuuaaaacuuucugagcuuuaauugggucuuagguagccgaggaugaccuggaauccuugcuuauaaaugcugcgauuguuggaucuuguaguucucguuacaggauacuguaguguagcucaggcuagucucaaacuuucaguccuccuggcuccagcaucuaagugcuacaguuacagguauguacguuucacuugcuccguuuuucucuauucuaggaaaugugugggagcuuuaaaaaaaauggugccgacaauguuaauugggaggguuuuaggauugaguacugaugaaauguuaggaccacauuugaaaggauaaguuggcuuagaaaugaguuuacaaaguaaacaauuggagaacaggagguuuuugagacugaggugaacguguaagaauaaggggcacaucuuaaaguugacuaagcaggcagggucacagauguauuuaaaaugcugacaugccgacccagggucauuugguuuuggucucagugagagguguagauccccaagaacggcagccuuucccucuguggggugagcacagccuucagccuuccuaguugaacugaugcaaugaucaguggagcuugaauggaaggaaacaaauuucuguuuaucuuaaagccuccucuauugugcuuucgcaugcauucaucuuguucuuuucauuauucuuaacuuagucauccagauugcugcuuaagaaggaaaauuacccucaaacacacuuggcaaacaaacaaaucuaucauuguccagaguuucuggauccuucuuaguagauuucucgugagaaggagcuggguuccuucauguugacaagacauuacuuagagcaccccuaagcaaccuuggucccuaaguugagugacucaguagaauugauaggcuccugacauucagagaacagcagccaagugucacaaaaacaguaggagaugggaauaaugaccuccauuuaaggucaccggugcuugaaugcuugcgguauguuggcaccagcuaugccacguccugcugauccuggaaguggugccagccuacucuuacagggucaaaagaauuuugagcacagugacaagagguuaaagagucugagccccuugguuuguacaauugauccuuaauggaagauuuauguagacugggugaggcucugugauuuuucuguugguagggacuggaaaucaaugaauuagaugaacccaauauucugauacucacaacagcuguccucaugcuccuguuaccugucucauaguagguguuuguuugagaaaagacucacugugcacauuucuggcuagauacuuucuagaauuauuacucgaaguagacguguaugggcugcugcugcugcugcugcugcugcugcugcugcugcugcugcugcugcugcugcugcugcugcugcugcugcuacacugguuaguguggaucaccuuccuugagguuaaauaggugacauagucagugaccucacaacuuuaugguacuuacucuugaaaaaagguuuaaguagcaucuugccucuuuuccuucaccuucuauccuuccuugcuacauagagguuuaugccaucuguuuuugucaaaacuugccaaaauagaagaugccauauaauucagauucucucuauauuauaaagagaaaagucaacucuuuaauaaucuauuuauguuuugaauucuccaagcuucuuccuaaaaacagauuuaaguaaaugcccugccaacaaaagcacuauucauuaaaacuauuuuuguugacuaggucucaauacucuagaggcuuuggaaugacaccuaccugucauuucauugggagauaggacaggaaacaggaaauccugccaaguuuaaaagguaaaauaugaagguguagguuuucuuauaucaagguacauucuuuggagaaugagcauuccuaauggcuaaucuaauuaauucuuaguggcacaacacagggcaaaggggauugaaggugcgugguacuuggcuuccuuauguuuuguacgagguccuucuuaggcaguuaugucucaucaguaguccagaggcauaggcaucguuaaccuuagugaagaguuuauuagaagccauuguuagaacuuguuuuugaauaauaugacucuaguauuucaaugagaggcauuagcugcacucaggcuucauaggcagcagauaaggagagccugcaaggagaguguuugagugugugauuuaggggcaggaauuuuaugcacucaugucauuuggggugcgcauguguuccccuccaccauauacagugggaagacaugagaccaagccucccacccacaauuaaauuugcaucuuggaguugcuucuuuuccaaccagaugcagauguuguaaggaaccuuacagucauacauaauggcugguagagaucauucagggaccauguaaacaaaacucagaucaguccguauauucacacugcaaauguguauucgcagguacaaugugaguuaaccauuuugacugacugugugacugguaggucagcuguggucugggcacagcuucaagccuacuuaucucaggcaggagaguacccauccuuacauguccccaaaucugucaguagcuccaguuuaaaaguccuauuuuguuaaugaccucucucagacaagcacagcuacucuggcugagugagcgugguauggaggaugaaugcuucccuucguaggugcuggcguuucuauuuucuuacccuggccuuugaugccccuuaccccagccccauugcugaggcugcuacuguuguugcugcugcuuccucuuccucuuccucuuccucuuccucuuccucuuccuccuccuccuccucuucuuccucuuuuuuguuguuguuguucuuauuuguugcaggaagaaguggaacacucucaauuauaguuuaauuauacuuuaaagccaaagcuggauauagaaugacugcuaccuuuguacucaauaaauaauggcaguaauugccaugggaacuguaaauauaucagguuacaaucauuugcuguucaauuaaaauaccucaccccaaccccuuccccccucccccccaaaaaaaucucuuguugggucuuuugagcaggcugcgggaucccuguaagauucuagagcaggacaaccuuuuuuaaaaggcucaaggucacaguugucagucuucuuugaaagugugugugaauugccucgcugauucuuugauuuugccucgagacugcgacugaggucugucuagggguugugcugacagcuggcccaaaugaguacaguucccauucugugcgaucagcacgaucggagauugcagaggaugccugugcccuugaggaguuagucauggaauguaaggaacugucaacaggaaacguauccagcuuugaaagauuuucauguguugcaguugcuuaaccugcaugccuuuugggugucagcauuucaucccugcuccacccgggauguaugugugucgcuuucucccucacuggaaucacccaucggaugccguccauguacagagcucucacuccuguucauaauggcguuagcaguguuauauugaaguuuuggcaaaugcuucauuucauugaacacccaagaucuugagacucaucagcagcauaaucugcuuucgugcgauucugguucuggggcagccuuaaagucagcagaaaguccgaguugcuuucagauuguucauuuguacuguacuuacacuuagaugaguugacuccuuuuagacucuuuaauaacaacuguaauaucaaugucagcuuugaguaugugacuuaagcaaaugucagaguagcagguguauuauuuuauuuccagagaaaggcucacuuacacucucuucuaugugauuaacgcuucuggcccgcugacugcagaguuugacccagcagugccuggcagauaauaagcguacagugaauggauacaaccgucauugugacuguuauucaaggcucucaaaaauauauuugagcaaaggacacuuagaagcugaaaugucagguuauugugagguaaguaaagaacagugggcggagccugugggcugugaccugugggcugugacauucuguuauuuccaugaagcucaaacuuaaccuucauaggcaaugcuuggcaugagcuuuuuuugugacuucugucauauuuaaacucaauaaacuuagaccauucagcaaagauggggcuaacaucccuguaucuuacucauguucucagaagucgugguccuauggugaacacaaugagugcuguguuuccacugauuaggacuaaugcuuaggacucguggcuuguuaauggcugcuugaaacugcaggauauaguguaauuaagggagggauuuguuucuguggugaacguuguguuuuguuuuguuuugaacauucuuaccccucccugccucuuuuguagggcuagaccacauccaggacauugcacaggcuagaccacauccaguacauugcacaggcuagaccacaagaccucugccauugagcuacuuccuugaccuuuucuaaugaagcuuucagugcgauuccaucaugucgagucuuggucuugggcuaauugucuauaacucuuguucuauucuuauugaagucccuacuaugugccaacuguuauacuugguguuuaauguaauuggauuaguuagaaacguaagaaguuuaacaugaaaaugaaagaaguugauuuguuuuuaauuauguauauaugugugugcuuacgguguaggcgcauguguauacauggauacagguucuuucagaagccagacaaggcuguuagagccccuggagcuacagucacagggagguagggcuagcuacccuguaugaguuuuguguccucuggaagagcacuaccugcucuuaacuggugagccaucucuccagcccccccccccccccagaaguauuuuuauacaacuuuuauauccugacauugccuaguagucuaguaaagggaguagcgcucccugccaucugcagcgcaugucuaccagaagcucaugccucgaagccgucuacuuggucacucagcuggaaaucucugucuccauaggcgcagcagcuaggcccuacaacaucugcagaacaguuucucagacacuucugccaucuccugacaagccacacagaugugccucgcagcuuguaguauauuuaaggagugcuguacacauacauaugcauacacacauaugcauuuaucugaagggagggagggaggagaggggaaggauggaaagcacacucaugcgcauuaucccaaagagucugcuuugaugauugauugaagauugcucaucuugguuuguuugcuugauaugggcagcacaaagcaucuaucuuuaugucccgacaguaaacacagugcuuggugugaagcacucaguggggaucagaggccgugacugaugcggaaauggugcuuagcaugauguguuugugaagcugacucuuggaaccauggcuaacuuccuaucaauucaccccccugggaugcauagggauaaguuggacuggagagauggcgucugagggaaaggccuggacccgguauacggucagauggaucuggugauuguuucuguucuuuguguucaaaaauuauugauggucguuauuaaguagaguaaaaugaaccagauggaagaugcugugcuauauacagcuccuuucugucaaauucccucaaguggcgauuugacuuccagggaggccaggugugucuggugagaugggguguauguggggaagaggggcuccagguaaagccuggacugccuugaggugcuacugauuuuuagcaucuugauugugauucuguauggauauuagaaccugcuaucuuaguauuguacacacuuggaauguauacaccaguaaugcugcuaaagugaaaucuuguggggcuggaaagagauggcucaacaguguuugcuguuacuguacagggccagagucugggucccgauacccauaauugguggcucacaaccaucuguaacuccuacuccagugaaucugaccccuuuucuggccucugugggugcaaaauacauaaccauuugccccacauaaauauuuuuaagaacauaauuuugcauagcauugaguaguuaaaaucaacugguuacucuuuaucucaguaccagacuagauacuccaagaagaccggccccucuguucucaguggucagccagugagagguacuuaccgaggauucagcaguagguugaauggagagacagacauauaguugaacagguauagacagcugcugugcacuuaccacagaccacagauuaaacuaaaaauauguuaugaaucaucacauuucugagagacauuuuuauuacuuccauuugguagacaaggaaaacaaagcgcagugcaguaaaugccaugcccugaaccaccagccaaucaguggagggagccguggcaucgagcccgucggacugaaaguccaugguauuaaccucugcacucagacccauuggcauuucuuuauggucugcgugacagggacuuuuaugaagcugugacaggaaaaucuacaaggauauaagacucaguugccagcaccccucuuucaacccgaggaauuaaggaaagggggaacagaugugagcgagcugagcaucuuuagggaaaccccuguccuuuuauuuccauucccaggaguuuuagugcaaaguugccuugucuuguauggcuccccuuaugcacacuggaaccugaaugugaagcagguuagguuagagccuugcauagcauggcuuucugccaagaaaucuagcagaaccuucuggaagcccugaaggacauucuuucuccuccccauugucacuuuucauguuccugugccaggagggggaugaaaagaacacacauuucaguugucugugcaguuguaggguguuuggggucccccaaaugagugguuuauuuuaauaggccgauauuaaacuuucaaacagggauuaugaaauauuugcauuguaacaguguaacacaguuggaauguacuccagacuccuucugcuuucaacgcugucuuucaagaaugauggaagagaaagaauguuuacauuucugaaaauaauacuugagguuuucagcaggcaauuguguuuuuccuuagaagcuguaaaacauugcuuuaucucgucuguggauaguuauagaaccccagacuucaaaucacaaauacgaguuauaaauuuaacaguccuggcuccccauuauuuuuuauguaugauuauaugggugucacacuggguuucguacagacugcuguuuuuccuauaaguguuccuuuugaaaaauaacuuggaauauuucacaucuuucuuuuuaaaauuuguuuguaggggaaauagaauauuucauuuauuuuauuggauucaucacccauugauacugcucuauuuguuuauucaaaaaacuuaagucugcacugugugcugugugugauaggugcuggcggccuaggaggaauauuuguggaggguaccuaaccaaugcugggaauugggucucuccuguggcuuugcuugcgggacuauuagguagaccagaauugcuaaugcuugguaguucuguccaaaucucagguacuucgaucaggccgccuuguccugaucacaccccugugugugugauguguauguauguucucccauauacgggcucacaggaguguggauucacaugcauauggguauggaggcauggaggccagaggaggacagugguuguucuucaucacccuaugccugauugacugaggcaacgucuuugcuaacccagagcucaccaguuuggcuagucucacuagccagauucuucugggggauccucugucucugccaccccugccgucuuagauugcucauacccacucagcgaucugaacugggguucucauccuugcacaacagacucacagcacugcccucauuccuuauuuuacaaaaugugguaguaguuucuuaucuuuuguuuuuuugucuuugguuuuuuuuucgagacaggguuucucuguguagcccuggcuguucuagaacucauucuguagaccaggcuggccucgaacucagaaaucucccugccucugcgucccaagugcugggauuaaaggcaugugccaccacugccguguuugcuugcuugcuuccuuucuugcuuccuuucuuccuuccuuucuuucuuucuuucuuucuuucuuucuuucuuucuuucuuucuuucuuucuuucuuucuuucuuucuuucuuucuuucuuucuuucuuucuuucuuucucccuuucuuucuuucuuucuuucuuucuuucuuucuuucuuucuuucuuucuuucuuucuuucuuucuuucuuucucccuuucuuucucucuuucuuucuuucuuucuuucuuucuuucuuucuuucuuucuuucuuucuuucuuucuuucuuucuuucuuucucucucucucuuucucucuuccuuccuuccuuccuuccuuccuuccuuccuuccuuccuuccuuccuuccuuccuuccauucauucagaauuauuuauuuauuuuauguguaugaguacacuucuucagacacaccagaagagggcaucggaucccauuacagaugguugugagccuucaugugguugcugggaauuaaacucaggaccucugaaagagcagucagugcucuuaaccuccgagccaucuccccagcccaguaguuccuugucucgugugagucauauaaacaguguuucagguaagaaggagcuaaaugugugaaggaagaagacaguccagugaucggccucucagugugcgugcgugugugucuguguguaugucuguguguuauacagaggagggaagcauuaaaagugugacugaauuuaggacuggcuuagguuuuugauuuguagguaguuugccuguuccuagauuucucuugagaugacuuuuggauuaauuauuuucuuaucuuuguguucugacuugaaaauugggaagauucugaguuuggaaauuugauaauuuuuauuaaugucauucuaacaaauuaaacuucucuaagauacgaagguacguuuuguucaaguaacaggaaaauggucuuggacagaacuuuuaacaggcauaggcaggugcauugauguuuagggaaauucugcacagugcauucgcaaugaauaaaaugaacaccgaccaucuuauaauuaagauaauuuauugacgguccuuuucuacugauauagaggaauacucuggagccugaguugguuuuccuuaauuucaggaugguugauaacuucucguuauuauccuuccauaauuuuuggacagguuuugcuuuuuguuuuuguuuuuuguuuuuuggcacaggaacuuuuuuuucacagcauuugcucugcuguugaaggcucucaucuccuugggcuguaauuccccgacuaccugcgaagcccuucaagucaggggucuuuuccugaacuuccaucuccagugcuuuggucagcacuuccagaaacugccugauagugggaccacgucagccuccuaccuuucggagauccgucucccucacucugcuuuuguguacuugauugccaaguugugacgcuuagugccccagacuggcagagaccccuguguccacauggucccaaauagagaccacuaugucuacuggucgcuguuuagcagugugaccuugaaaaacucacauuucauuuguccuucggugucugaauuuuguuuuguuuugucuuauuuuauuuuauuuuuuuugguagugcuagggugugaaaucagugccccaugaaugcuaaacacauguucagccaugaagcuacaucaccaacccuagugucuuaguuagaaaugagaauguaaugcagaacuucaugagaacuaauuaaaagaauagcuagcgugaugauucagauauaguaggugcacaauaaauuguucuuuuccuauacucuuaaucaauggcuuucauauuuuuuaaaauccucuuuacuucauacuagauuauuauaauggcuacacuaucuuuccugacauuuuaaagucucucgugccucuaggauaacuuuagauauugcaaccagauuaaauauuuauauaaucuucacuguguguuaaauacuaggccuuuucugucccaugguuuaaaauaauccagcaagcaaagaaacucaccgugacuaugaaccuagaaaguaaaugcacacuuuaguugacagcuuugcuauaaccuguuuugugugccccacaggccgccacccaccucaauacuuuucacuccuuuuuccauaaagaaaaaucagaagagccagacauggugccucacaccuuucaucccaguauucaggaggcaggcaggucaaucuuugugaguuaaggccagccuggucuacagaaugaauuccaggacagccaagauuauacagagagaaacccugccugaaagaaggaggagaaagaaagagaaagagaaggugaaggaggaggaggaagagaaggaggaagaggaggaagaggaggaggaggaggagaacaacaagaagagagacccuugguuccuaagcagguucugauaaaggcuguacucugccagggguuccagcccuaauucaggaggugcuuucccuucucucuauucuaaaccugguguagagucuucuuuuugcucaauuucaguaaauauugaagcuuggaagagugaaggagcagcacaccuaauaccagccucucagcuucauggaagucccagagagagagaugggcaauuuauccugggucaggcuuugccuaguccuggugcucuggcuaaggcgugaugccuuccccaggauucucuuuuauccccacagcagcagcagcagaguugcaugcuccugaagaaagggagcaaauagugagggcuccuguccacaggugaggaagaaaaagaagagcauuagcacgccucccagguagggaagauggaggguguagucagucagaggcagucucuuuccuggaguagacaggauucuauuuccugggaauuuuuuuuagaagccaucuucuuuacuuacaacucagucugcugcggcuaaaugcaaggauguguauaaaggugcaagcacucauguagcugacacauuuauuggagggaagggcaacagguacccugcagaugcucuuugcuggagguucuugaaacaggcgagagccugcugaaaccugcuccauuguuuugcagaggugucugucccuuuggccaucaugguucacucauguccagccacaugucccucaucugccuuccuagguguucuugguauggccauuuaaaacucuucccauuguaacugaggguugauuccaccauaacccugguaggugaggcugcugagaagcaagggauuuaagaaagaacuaaagcauggguuuaccuuugacuccagaaugucucaccggaacuuucaggaccuggagucuguucuagaaagauggccuuaaaaguucuuucuuggcugggcaguggcgacacacaccuuuagucacaguacagagaaggcagguggaucucugaguucaaauggagccuacuuuacagagcaaguuccaggccagccagggcuaugcagagaaacccugucuggagguggggugugcgucauuuccuagaguggagcuagccaguaucuaggaaagccugagacaaaguugaauggcuuugaacaaaugagaugcaaguuccauuuuccauacccuagguagucauugguaauaguagcuggguaaucuucauuuaaauuucuccuuuuccauuuuaaaacugcauuaaccuacuuuuuaaaacuagaguuuaaaacauuguuauuauucuauguguaugcagagcacgugggacuuguggaggccagagaguaaucauguggagcuggcgcccuccuucuacugagaggccagcuauucaguucaggucaucagacuugcaggccaaguggucuauccacugagccauccuaccagucuaaacuaugaguccuucugccuccuagaaucgcuuccuacuucacccuuuauuuccuuccccagucauuuugaagaguucauaugcaauuugccuccauuucagcaaauggagcuguuauuucucuugaucacacugcuuaaauuucaguugagcugguguuuggucacugcuugcugacugugggguacugugcuuaguguuggagaacucucgcccaaguccucgcuccuaccccaugggaaaucuaagguuuguagacauagaaacugugaggagcucuuuacuuccaaaagacagacuguaacaauaaggccacaaagagugucccuagacuagucacugcugccuggcugugacacagcaagggacuugagugugugucuuauagaaguagcagcaugcucagguacaggccauguuugcuugauaucccugagaaacaugcucuuuucugaagggaaauguagaaggagcggaucuggaggagaugggaguggggcugggaggaguggaaggcaugggaacuguguuaggauuuaacaugugaacgaagaauaaauaaauaauaauaaaaguaugaguuaaaauacuucaugccgucaccauccagcauacuuucaccucagggacauguagaugggaugaguucuuaacucacaaagcaguccuggcauggcguuauuugaagggguguggcuuuauccacccacauaaguugagguaaacuauuaagcauuucuugaacuuugacuugucaacccuuagauagaaaauuuuucaaaggggugacauguggaacacaucuugcauccuauuugccaaacaaauggcauguguucuagaacuaauguuaauuuaaguaguaccacacggcuacuuaaguguaaaacuuugggggucugaagugugguggaaugucuugcauaaaggcauggguucaauuucacaccacagucaaucaaacaaacacaccccaagccuuccuuucccuguugcacuggccauacuccaaauacucagcuacauguggucuaccucagacauugcagauccaaagugcccacccucacagaaaggucuagcagacccugccauucucaacauauuaaaagcagacuuuggccucaugcugcuccagucucaucucagcugugacuuggggaugaugccaagcaucucuuucauaccuagguugccaugguuaugucugguaaacaauagcccacaguggucagugcugcaaaauucuauggauccgcucucaucaccacuacugucccuuccauuuucuuagaaacacacauuccuugaguagggaagagaaagaaaucuacuuuguucauucucauuuuuuuuccauuccuggagauuagauggauucugggaaaagaagacguuucugucuuuaucccguacccuguguaaucuggccaauugaauaaaaaugucauuguaguuguguuauggcuuguuuccgaaggcugguccauguaagugguucauccggaaaugcaugcuucugcauugagagcacugcauugagacaggguugcuucuuaggggagagcacugcguuuguaugagacggggguccccaagaacccuuugcugagacagucaggugagcuggccacucaauuccuuuuuuguagauuuacacgauuuuuggacauuuugguuguggcgacuugggagcguuuaaucuguuuuuauuaggucauuuucuagacucuuacgacaguggccuuuucagcaggacacacacacgauuuguuauuguaguuauggggaauugcugauguaaagcauucugugacuucagggaauauuaauaagccucuuaaaauacuuguucaauuagauccccugaccuccuguccagagguugagcugucauuaaccgagagaaaucuuuccccaguugaagugguaguggaggaaaccauugucuuucuccucauuuuucgcuagcuuguuuuccacacuuuuucuggaccagugggggaacauggugcccuauguuagaccgccaaaggcccaucucgacucuggacaguaacuagaguugcuuagguuuuguauuacuauugugccuacuuuuuauuaaaacaaacaaacaaaaaaaaccaaacaaccauuugcuguauccacagguuggaaagauaauuuguuucacuuguguggagaauugcuucuuucugccucaagcagcagggucaggggugcauaguuuguuugcauaaaguaggaaguguuuuccuaaacucgcagagagagggaucuggggacuguaauugcccacuggccugucaccaaggcugggcccuaagaucagcuugucuuggacugaaaggcuagguuuugaaaaugacaccacaucuguacugggggggggggggccaaguggccacggcagucucggguuuaugucggcuccucaugccaaucuguugugaaauucucuugcugucagauuuguaguuucucucuccgagaguaggucaucugauuuggagcaugaagguacugagccuccuaagucucugugacagaaagauaccgauggagaaggagcgaagccagagaccagagaccagaggagcuggcaggaaauugcaaacaugguggaauuuccagagcuuuccauuuugugaagucauggauaauuuaaaaaguacuggcuuuuacuuuuguuuguuucugugcugcagccacgucuaucugccaaccuuucuaaaaugucaugauguaauuauuuuaacaggcacuguaugcuccuuuauuugggggauauuaaccuuucuaaacaaaaggaauguuaauauacacuggagacacaacuaaugggauuucauuuuucuuguuaggcaagaagcuugauuuuuuuuuuuuuuaacuucuuguaaaagaauucggcgagugaaauaauugccuuaagcuaauccaugguagcgauuuuuaaacgugacuuuccagaucacuuuuauauggcuuagaaagaauaaugugauuuucuuguuuuuguuugcuuuagcuaaacacuauugaaaaaugauauaaauucaaugacuugaaaacaaaggaaaugcuaauuucuaaugugcugaguucuuuuaaggcaugaaauauaguguuuaauucauuguuuacuuuuauauagauuuaguuaauuuuuugaaaguaugggacacagaauaaauuagcuagcucacucuuuucugaaucacggugccuuucuguuugaugguugcaugcauuugaccugaaugugcuguuguauauaaagcccaacagccauagccucuugacaggguggccagaugcaugcagaauucucggggcuccucuguccccauggcugucuucugcccucuuucucuacccuucuccuccccccgccccaucucuuaugauacauagccacugaagcacuuuaucuggacuucaugacucuuggucaguaacacucauuugccaugguauauauauaaggcaacaaaauccucuaaaauuaaucaucaggcuugcagcuuugaccuuauuaccaugaguggccugcacguaguucuguagacaccugcaaacugaacacacacagaaucuguagucccaggcugauggcccuacccaaaacagugaagucaggaggagagggaggaggaggccgugccaucgaaccuccaucauccucuaugucaggcacuugaacugcguucccuuuaagcaagccagaugacacaagguuuugcgauuuuggauuagugugagaguaugaaauggcuccccuuuccuuccaggcaaaaauaccaacagaaucuuaaagugcuaauuucauuucauggcuuucgggcuugaaauaugggcucaaaccggaacugugcauuagucagcugaggcacacacgguucuuuugacaaugcuaguuauuauuucacgacaggcauuuacuuuauguugucugcugucuccaucccaaaacuagccauuguuuggggaaagaaucgguuggagugucaugauccuguccccagacaagucuugcuauuuuaugaguauagacacugugcaauaaagagagcuuuauugagaacagucuugcacaugaaauguaaucuggaugaauauuuaaaaaaugaauagguuuauauuuuaguuuugauuuuuaaaguauauauauauauauguauauguauauguauauauauauauauauauagacaucccaauuaccuugucuuaucuccauuaaauuuaaucuguucuuauugggauacaacuaaauuuuuguuacucacauggacuuaggaaggagugacauauacaguuaacaaauaaauacaaaaugaaauugaauauaaccgucuugaugugcaaaggaagaugaguggaagagagaguugauugcaugucuggaagcauaucuggcugauuuauguccuaauuuuaguacugaguuuccuuuguaauaguaaaaugucacauuagcaugucccuuuuaauaaucuaauaugcuaccagugacaauaaauacaugcaccaagucuagcucaagguaucucuaacuucacaggcccgugacccuuccccguguaguuaaaucacccagaugacccugcugucauauauuuuuaauuguaaagcacuugaaauuaaucauguuuuauuucuuuuuaaauaagcgccucaagugcagcggugcacaguuuugcucacggcacuuauccacucuuaaagaaaauuaaagaucggaaagggucugugucucagaggcagcaaagccauccacacagggaaaacacagcagaaggaaacgaugcaugcaugcuaggccuacacccagucucgugcccgugcacugaguaaaaauugaggucggugcaugaaacaaaguagaaacauuuuaaaguauuaccgcaagucaucaguggucauaacccaaggucuugaggaccucagugagggcggagguuucuuccacucugggaggcaacagagugccuuucauuuaaacuacgcacagcuaaucuuuaggagaauuggacucuggcuccgaacuaauuaugauuuacagaaauugauaauuugucuucggcaugugucugcaggaagaaauuacuauuaaauuugauuaacaaaugacagauuucagcccaguaauuuaccaucuuuauuagcaaacuuagaaaacuucucagugccauccugguaguucauccuggaauaccauggauaccuacacccucggcacggagcuaccuuccugugaacaaacacaucucugugugguuugucuucuccauccucaggcacgguccauguguucaagcugauuucccaugagagguggaacuuaauaauauguaauuaacuucccaaaaugaaggaucuggccuuccaaguacacucuccacgggcucccucggaauauugaggcguaugcaagaggaggcugugcuucugcagccaccucaguuucucacacuccacucugucaaacaaauguuuuuccuucucucugaaacagauugcagaccauccauuuguuuaaagcugagucuuaauauccaguugacacugcgcgugacuuaggagccucuuuugcaggcucauaauugagacgugaaacuguuguaacauggcagcaaagugggguauuaaaacguuucucaugcgaguaacaugauuauuucuaaguacacuaacauccauguuuuuauauaguugagaacauauuccauuggacuaagcagucuauuggaaucaucacugugguaaaaaaaaacaaaaugcccuuuuauguucuccuaucaggagaaccuucuuguaugugaaaaggggaaguugagaggcuggagagaaggcuccucagggguuaagaucauugcuacuccugcacccauauccacaguuugcaaugguuuguaaccccaguuccaagaaaucugacacccucuuuuggcuuguaugggcaccugcacauacaugguacacaucuguauucuggagcagugcacauguauguaaaauaauucauaaauaaauauuuuaaaagauaaauucaauagcugguuucuaauuuuauuucauaucuaucaauguuuugccugcauguguaucuguguaccaugugugugcaugguaaccuaggaagucagaagaaggugguggauccccuaggagcuaaagauaguuguaagucccucuguaaguggugggaauugaaccuguguccucaagaagagcagguagugcucuuaaaugcugggccaucuuuccagcccccaauuagccuuuuaaggaacuagaagcaacgcuuaauuuuauaaugaugugaaauaaauguucuguuaucuaauaguucaccagcaaagucugcaguagccuccuuucucaaggaugcagcuugugugugaugcuaauauucaaaugaaccugccacagugagugaugggaggugcuaauaacuccgaguggggagaugaaaacaacauauugcacacaccugcucuccgccucaugucagccucaucauaucacugaaugagugagcugaaugaggggagucagaggccagacagcagcaagacacauguccuuggaucuggaagccucacugucacugugguccacucuugaccuuugacccagggaugcaaaagaaggcagagcccuuacagcaguguuuccuguggggguauuggcaaugcugaguguucuaucaaccccugauuucaaucuuucuuaguacugcguugggcauggguguuuauguacuaauuuuguuuaauagucuccaucuuguuuugucucuuuguauuucuaguguucuuauuaaaguaggauggucaguaaucuaaucaggcagaagggaaugcuuuaagcagguaacugaccguuguugcugaaaauggucaggauucuagagagaaacaaguuagcaacaagcuagacaaaacccugggauggaccaugaggcaaacccuuauaaaggaugauagauuuuagagaacugcagauagcucgugcaguucacccaacagaaaccuucuccuagcaacuuauguucauuuaaaagcuaaggacacauugauguccagcccaggaaugcacugaaugaggcuccugaaaugucugucaucugugggcuccugaagcccuccagacuuguuugcuuauucucgcccugucauucuuugucauuuccuaaacaucguccuuugaguacaagccaaaccauguaaagguagcaaagugagucacuugaggaccagaaggauguguaaccaaaguggacauuugaaagaugacugcauccgcugucuucccuguucugaaagcaaacugaagaagaucuccgagaagaggaacuuugagagagaaugagauuuauacagaaggguccacaggguuugggauuacuguggaaccacagcgacccuuaggcauugcauaagcuaaaaagaauggacacucccaaaacccaaugaacaaaguaucuucagcuuaauguaguuccagggaaucacuuggaugcaucuaugauuuuucuuuucaauucagagucucagaagucaaguugaaccaccaacaaaaauggagugaagaaauguuugaacaccuuggggggcgggggagagcaagaaaguccuugauaggggaaagagcacugaagucuugcucugacaagugggaccccugccacuaggcucugucagcccagagugcuucugggaagaccacuaacagaacgagcagccuguaaacaugagcaaguuaaggacucgccagccccgugguuaggaguggaagucaagcuaaagauuaaagacagcuugacaaaauccuacaugcaauccagcugggcuuuacacauuaugagauguggucggacagaaugaggguguuuaaaaaaaugauugcuauuaugcagcuggagggcagcgggcugagcugggcgugugccaggggaacuugugcugcuuguguagauaaacuugcagggcuucggcuuucaaccccguccacugcuuucugucagccucucuuaaccuuguccugucccuugcugagcccugacauuuucagugcaggagaaaaucguguuaaauuuauguaugaggagggguacgccuguguguguugcuagacucggauuuuaaguguuugggcucuuuugauuaguucugcccuugguuuauuuuguagucacagaggaacuuauaaaccaguguugaguaagagucuuggugcagcuucccguguucuuggucagcacgggagcaggccuucgugggggcucugcggaagaaccucggcccucugagaaagccaggugagcucaugcuguuugccuaagccugcuggagcccacacucguguuuuuggucagugacuuaacagggauuuuguccaagacuuuguuugaugaaagaauuacaaaauggaugauguuaaguucugauggagacuugugagcacuggacuugggaaggaggauuuggaccagacuguacaacaucuggggcagcuaucagaggacaguauauucuccuuuucccuuuagacagguagugggaugucgcugaggaugacugagagguccagaagccaugugaaagagggauaccugugucagaguugucaggcagagggcuguugcaguggacuaggagugugagcaaugguuucuguuagccagucaguaguagucuugggagaaccauagguguugccucacaucccaacucccaaauacaugucucaggcucauugaagugguaugauaggaaggaucauaaagucgugucuguguuccuuucagacgggagguaaagaagaugcucuguaauccauuagugaugucugcgauggguggggaugguggcuccucucuauggagauguuaccccugauagacauaccucagcaacacuuaagagaaguuuuaaggauuaguggcugacuaaauaugguggggaaucgggaaguuuggagggauauuaugauggcuaguacugaaaucuugacugaccugacuuagcaaaaugacaauuaaaagcuaauuacucaguaaacauuguugauugaggcuagagccugagauuugggcuggaagcggccaacaugguucugaucguuguacucuuguaacgggggcugaagagcuagagaggacugcugguagauaagaagagauagccugaaaccacgugacccuccuagucuccaagccuggauguaugggcuucucacaucuugaaucagauugcagaaaggagacuacccagugaacuuggcaggugaauuuggaaccaguguguauuaggaggucucucugggcuugucaagauuccauugguaccuuuuauuuuauaucuauggguguuuuccugcaugcauguauauauacacuguguaugugccuggugcuaccagaggccaaaggagaauaucagauccuuuggaacuggacuuuuucagaugguuguuagcugcaauguggaugucaggaauugaacucggauccccuucaaccaccccaagugcuccuaaccacugaucuaacacuagcucuuguuauuaaauucucauuaagcacaaauaugguaauuaccaugauuuagugucugaaauaaauggaagauuaguagcaagaagcuaguucuuuguuagggagaagacggacuugaaggaguuaagaguucacucugagucucacagguaauaaaugucaggauugggucuuagacuuaggucuggugguugucuucuugugugcuuucccuguuaucauaugcuaucugcuagaauauauaugauacagagcugaacuuuauauauagaaauaaaggauaaaugaugugcauaaucugacagaaucauuuggagaaguggagaugcugacaguacccagcuuuugcccuuuacauuuugccucugcguucauacauucauaaauauauuuaaaccugucucugaauauuuaggucauuucuagucauuugcucuuauaaauaggagagagaugguauaaauuagccagacugccuacguuuaaauccaagcuccaccacuucuuaccaaugagaucuuugguaaguuucuuaaccuuugugucccaguuucccuauuugcaaaaugggaugauaauggcuugccucauacagcuauuguggcagaugcaugcggaugcuauguaaaguacuuagcauaacaauuuggcacauggcaagcucauauagguaagagcauaauuugggggucagacuucuuuggguuuaaguuccagcuccaucuuuuucuaguuguaugaccuuggccauaaccuuagcucccccgggcuuugcuuguaagcccuuuuauggcuguuggaagguggaguuaaaugagauaaugcagaaaaguugcuuucaugguacuuaaacagaggacacaauacaagaucauuguuuucauuauuacugccauaaucguuauaauuaggacuaaugccauaaugaacaucguguacaucaauuuuugugugucuuugugacuguuaccucaggguaaauucuuaaagcauaauuccuguguuucuuuugacuuucaaaaaaauaucgaaacuaugcuauuuuguauguugaaaaugauacguuuuuacugaguacauaguugguagcccuuaccaacuuggauauagugagguucccuaaggaugcauauuuucuaguguaagaguuaagaguggaaacuaaccaugauaaagugugaugguaauuuucagugucagccugaguugguguggauucaaaauaagagacaucugggugugguuuugaggauuuuacaaagacaccugccagaggaaggaagauucugauagugguaacacaccaugcuaugaauugggaacccaagccgaauaaaaagggagaguaagaaggaggaagcugggugaagcgcaucguuccucucucucugccucugacuguggguagagugucagccacgccuucuucuguagugcuggacucagugcccucaagcugugcgaugaaauaagccacuccuccuucgguggcuucuguccuguauuucaucagagaaugagagaaucaaguaugcauaaagguauguagugugagugaugcuuucagaaagggacccaucaauuggagaaaaauaagugggguucagggaaaucagguuucccgagagugguggcaguaguggcuccugguggugugugugguucugguaaguggagcuggggaaggugucucagcacugugagccggcaccauggcuguuucuggaaggcugaagugcauggagcaggccuuggcucuggagaccuugagacuagcaggaugcuuaucuuguccucgaggcucaagcuguccacccagaaucuaucuuccuuccaucucuuucaggccacagucaauuuugggacuuccugguuucuaucagcagcguaaugcucuguuguguguuacuuagcaugaauccaggcuacuguacacauguagcucuugaguuuuuuuuuuuuuguuuuguuuuuuguuuuuguuuuguuuuuuguuuuuuguuuuuuugagacaggguuucucuguauagcucuggcuguucuggaacucacuuuguagaccaggcuggccucgaacucagaaauccgccugccucugccucccgagugcugguauuaaaggugugacuaccacgcccggcucuugaguuucuaagaauggaauuucuucccagguucucugauuacuuucaucuaauuucuuuaaaaacaaccccccaccccccccaaaaaaacccaguuaaucucuugucacagucugauggcagagcagugcccacauagcuauuuuaauguagucacaauucuuaagguaaguuaaaaccuuuucaguugugccuuauucuucagugacaguuaugacaaauagcuagcauaauucauuuuuucuuuguagaugguauaaccgggaaucauauauagugguuacgcauuuuuuuaaaaggaauuuaugaaguuucaacuuagaauaccggauuagacauuaaagcauuucuguugacaagacugaaguaaauugucuucugauccaguuuguauaauaacgugcaacccaauucacuaaguucauauuggaaacucagcauugcugugagacaaaaauuacauauaugagaguugacauucauucaccauggcuuagacuugaacuccagaaugcaaaggagcuguuguacuccuucuuugcaguuuuuaaaaaaaaaaguggggacaggaucuuuucaauuuuuucucccacaugccauuuuuaaaugaacaguuacgccaguuugcuguuagcaagcgcugugagucucucaggcuccuuguucccaucaggguuccuugugacaaauuuauaauuuugugucuuauaucugggucaacaguucgauuaauguuuuaucuccugagcaaaagcacagcccuucuuuguaaacuuuaucucacucaaccugaagauugcaaaacaaaggguguucugguucucugcgcccucgugcgcgcgugcacgcagagccgagccugcaguuccuccugugaagcagagccacagagcuuugccugugccuugacuucgaguccacugagcucuaauuugcugcagguggaagagucuccucuuuaaagcuuucaaaccguauuaauuaaagcgaguuagucgucauuacugaucauuuacuaacuuuuauuuauuuuugcuucauuauagcacaguaggaggccauuuaauuuaaucagaaaauuguauaccuaguucuggccacagaaaagcauguagugauaucugcugagugaagaaauugaucauguaucuuaccuaagagauaguuaaucuuuaauauuuaguaucuuuaguguuuauuuuauuuauuuaacucaauuuccuuaaagcuaaaacucgcuuauguguuggggcagagauugaaugcagggccuugugcauauccucaaauccucaacuacugacugaacuacccucaccaccuucagcacaaagucaauaugaaaaaguuauucaaaauaugcauaucacgcugucugagagcuggcaguugugggcauuaccuuuucuaauugaaguaguagcgcucucccucccccucccuuuugcccucccccuccccucugucucccucucucucucucucucucucucucccccucccccucccucucccccuccuucuuucuccccagccuugcuauguuaccaguccuugaguaagcguggagacucauuaguaauuuuuuugaaauaugcuacuuauaauagggcauauaucaauauuuucuuccauuugugcgggcagauuuauauguuuggugacuugaaucacagacuggggaaauuuuauuuuaaauagaucucauuauccagcaugcauugcaguauaacuuuuuucugcaacuccccuaaaaaaaaaaaaacauuucaagccuuaucauuaaaaauucucuuuaauauugccaaucccagcuauuuccuagaauguuccuaaaaacaucgugaaaggaauggacauaaaagguuuugaguccucauaggaacaauggccuggauacaaacagaaacuaaccagcucugugagccugcucggccuccugucucuguucucauuaagugagcauguuaguuauacaugugcaaauucgauuauuacuaauuuugucaggaacauuuuuucagucaucaaggaacaaagacuuuacuggaauggcuugagaggaaccagagauuccaccauccaguguuccagaagcaggcuguaauccuagcucuuagguggcuccauacuuuggaagccugacuuaacaaccgagaggugcuggccugggauggaagagcagacuuggugaagagacugauuuuaaaugugauccaggcacuucagcaucuuauuggaaacaagaauacaauuuggaguacgcagaaggaucaauacuuuaucuacuaccucuuuguaacuaaaauauuaugaaucucacuugggcuugcuggguagcggauugaagagggcucaugucugagcucugguaaguuagacuuuggaguugauagccuucccuuuauuguuuaugcuuugcuauuagauagcuguguguauggccauacaucauugacuaauggggcauaugcuaaaaugaagauuugaauucucugguaagguuggugaaaaggcagagggcuagaguggccucucuggagcgagcaugagaaaggcacuuugaaaacugguccgguuugcuugcauuuuaacauuacagcaucuuuagauacuuagaagcuggaacaaagcuccccuaaaguagaggggaucauauggcgucuugcgacccaugaagcaugcgcagucuucugcucucuuacacuccuuaccaggagcagugccuagauauguggagaggaagcagugcaugacacagucaccuguaccucaggggacuugagucauggcguguacuagacuaggacacugagcuccacucuaugagcaagcacagccagucgcuuuuccacagccuggauucuacauugguccagggagccaucacagguuuaagugaguauaguacuugaacacauguugggcucaaagaaacuagaaucuucuuuagagaaacaguacauuuagggacacuggugugauuuagauaacaguggcucuuucuguucccccugcccccccaaacuuggagacaugagcaugaaguuagguagagugugggagugccucagucacauuguaacucagcucuguggcuuccuauaugugugaguuaucuugggcccauuucuuguaccuuucugccauuuaauuuucccaucuauaaaauacaguugauaauggucccuacuuggucaccuuuuguguuuacucaaggaacuaauauauacaaaaugauuaugauagugucuagugagccauucuguuguacaugcuagcauugauggugcuggucucauugccccccccccccccccgaaaauuuguagaagugugagccuugccccaguucauucauucauucauucauucauucauucauucauucacuuccugaggaaagccugaacugcagacugguauuuuauaacccaagccauuacacuguacuccaggccaacuggaugccacagccuugugcuuagcuucccaaucucuuagaacagaacugaaaucccacuucagugcagagcugguaauuguuuuuuuuuccuggucaucucgggugauuuaugaccagaggcagcagugugacccucucauaacauuucuaucuaaguuccccgagaaguggauuuuuaauaaaccauuaucaaacuggcaucauuaucaccacucggugguguguuaauucaacaacauuugugggucucuaguuuauuuaaaggacagugguaggaacugugagaacuccaaagagggugaaaagugaagaaaggauacuuuugcuugggaugauacaggacaggaagaagaguggaggggcuuugggaaggaagguuagcgaagagcccagguaugugaaucucggauggagccucaguagaucuggaaaaggcacauuuuacucaaaaagaggaguguggcugcaugguagaagagaaacaagugacguguucaaaagagauacagcagucugggugugcuggaaaagaucugugcucagauagucagacagcacauugguaagcuaggcacuuagcagcuguagaggcaaauuuguauuuccaaggggcagcguccacagcaauuuugcaaagacaggcaccaagugcggauuauacagccucuaauucaugggaugcuaagaaacuagggaacaucuaagagauaccuucaggcacaaagcagaacugcuggccccaggagccacuugacagaggaaggaauuaggaaauuauaucuggagucagugagaguuaagcacucuugguuuuauagaauccaucugguuguauuagugaacaaaaugauguuccaacccucaaucucccccucuguaaaauggugcuagcguuacuaugagacaguucguucaaugugugaggaugaaagaaaugcagcggagggugugcgugaagcuuuuaaacacucaaacgucucuagaguauuuaaugaaugguuacuaggaauaacugugacagagcacgcgucaaggagagagaguaucuucaauucacuggugcugcuuccaugagaugcuguguaaaugcucacugaugcuguacuucucucagaaguuggaagagcacucccagacuuauuuuuagcuucacaacugaaaugacagagcugcucaguccgucggugagaucuacuaaucuuuguaaaggauuaaauuguaaauauauacaucaagccagaacagaaaucuaguauuucccaacuucuuguuuuguuucaugugcauguuucaugugugugugucugugucugugucuguguguguguguguguguguguguguguguguguguguguguguuugugggcacacauguguaucacauccauagugucucucucucucucucucucucucucucucucucucucucucucucucucucucucucucucucucucucucguguguguguguguguguguguuugguugguuguuugguugguuuuccgagacaggguuucucuguauagcccugccuguccuggaacucccucuguagaccaggcuggccuugaacucagaaaucugccugcaucugccucccaagugcugggauuaaaggcgugcaccacccggccuuuuuuuuuuuuuuuuuuuuuccuuuuuucuuuuggacauccauauucucacuuuuauuuuuuuauuuaauagaauguuuuguuaauuauuugagaacuuaauauaguauaucuuuauauccacccccacuccuuccaaauguacccuauccuuucgauccccccacuucgugccccccucuucuaauauacacaacaauuuuacaaaggguagaauccaagaguaggcauggagagucaaugaggaaacugaacagggacucccauuaaccagauguuuggaaacaaaggccugacuacuaaggcucacacuuguucuccccccacuguggcacuguuuuuguuucaaauaauggcauauuuuauuuuaauuuuuauacagagcaaugaaaagaauacagauugaccaaaaauccuuucacuuuucccuccagccauuuucccaccuaagguuccuugauaaguaauccugaguuugugaaacaggcccagucaagucacuaucuauguaacuccaaaguaucugaggcuaggugaggcacaccuguccaagugugauccaacccuggagcacccaugcuccuuucagagaauccaugaacucaaccugauccugagacuccuagugugucaguguccguacagaagcagcggugcaguuuacacgucacuaacccgagucaucucaguggcaccagacugucccaagauuccugugcuuuucacacacaguacaaaugaaugucccgaugaaccagaagagagugauuacuucuaucagcucuuggccuguguguuucuagaaguuuaugaagucgaggggcacaaaggcuucccuggucaucugggaaggagcgcugauguguuugcguuguaaauggaacuaacucggaaauccauggaacaucauucacuguuucucaauagugauaaccacccuggcuauuaaggcauggguguuaggcagauguuuuuggaaaauaaaaugagccugucguuucuagggaauaaugggcgauguguauugucagcaacaacauucaagcuuugaauggaaaauaagaauuauuaaaaagcuucacccaccacuucgcacuugauagauuuucuaagacguagagacaacucuccugagagagguggccauagugaugccaugaugcugaguuauggaacaugccagaagaacugugcagcccagugaauggcugauuucuaaaugacuauaguaugaugcuaaaauucacagguggguaaaaaauucauggacagaggugcaacaguggccagcugacugacuucccugugaccgcauggaaaguucccugucauggcuucagguacuacacccugacuauccauuauaaagccaacaauugcggauuucagucuagcaucaguacccaucaccaucaccaggaacuacuaagcccucuucccgguuccaaccacauagcugugugaggcuggugcuuuuuauauugcugaacacaaacagcucauggcaacaggcuaaaacggcaaacaugggaagccaggugucuucuaguaaaccaaacacuaagagacuugccaagacuuccuuucccuaaucucaucccuuggaaaauguagcuguuugugcuaaaaugucuuugauagcauguaauggauuuguuauaucuuaauuggauuaguaagaaucaauuucuuguuuugauuucuaaugugaugacagucuauaugcauagcccaaguaaacaaauuucuuugaggcccucaauuaacuuuaaauuuaaaaaugacucugacccccaagaugugcaagccacaccucuaauguaguccuguuagauuuaugauuguucuggccugccagugcgugagagugccaucugcugacagaauagggaaguacaggugcuuuuugaaaagcacagcuggaagucuuggaugauuucugaaacuucuuguuggaaauuuaucaagggaaaaagacaucaacucagauguccaaaggaaucugucuuagaauauuacguaccgaaauauuaaucuucagaaugcaaguaaaaacaguuaaugaaaugcuuauuuuaaaagguucacacuuacaggccaguguuccuuucuuauguccguuuaguaguacagaguuccuagucuguguugguacucugacucucugacacaccgagaagugugguguucugucaccugugauuggcauggucagucauugguauugcuccaaccuuuccugacagucagugcuuuuggauguggguuuuagggccagucucuagggaaagagccuccaauguauugcccuuagagcccaugccugugcaaguucugucacacuaucaccuggcuccccuccuucuuccuugagaacugacacacgcggugugggagcacagaccuguagaaggacauacagacaaacacggcuaagccaagcugugaggaauaggaugcagcugcacggagcaggcucaugaguaaugagcuccaaugcuguggaccagcuucugcaugucuguguuugcaucacugagcuacgugaagaggaaggaaccucacugcauuuccauucaguuagaaugaaggccuacuggccaguuugguuuuguuuuuuuuuuuuuuuuuuuuuuuuguuuuuuuuuuuuuuguuuuuugacucaauucagcugauuguuuucaaaauaaccuguucuuuucaaacaguugugcgucgggacagcugcacucagaugaaaugacugugagccuguaugcuaacuacuguacucauugucuguccaucuccacugugugcccagugacccugcugaugaauauuuuagacaucugcaugaauaaucagacugcccacaggagagcugauggcuuguuuguggggcuggaaugcuguugggaugauacugcaauucuguguacccaugcgaaaguaauacguaccgcagugagggggucuuacucuggauugucuuugagcauccauagaugcccuaaaauuuggcugucagaguuuacuuguaggcaaaggcaaaggcauguguucaugcuuuugauuaagcaccggagcuuuuaucagacuguccaaaaagacuguaacccccuaaaggcuaagaaccauuggcuaaugguugagagcuuugcaaacaccucuuggcuuucaaucauugggauccucccagggguuuugugaggcuuuuaacacgucaugacuuggagcuuauggaacucccaguaggccucgagagccauggacaguuuucagugaguauguaaguugguguggcuggauguuuuguuuuguuuuuuuuuuaggacagauggagcuggggugguguggagagcauguuagaggucuauagaaccagguaggaacucauggggaauugggugaauaaagaugccaggcccugaggguggagucagaauggaagagaaggaaugguuugcaauguaguuguaagccuugggguuuguucaucaguugggaauggggaaagagagaaaguagagaccaagcagguuuuacaagauggcuuucuggugugagugaccagacagcagaggagaagggagacagcaaauucuguuuccgugguguugguuuggaagagcugaugggggaauaggccagcaagcccuugggaugggaggugaggaucuggugagguggggcugacguggcuccgugugugcaggggaaauagagaaugcuggggaaagacauuaagacaucgggugggguuugguggcaguggugaucugaggggagaauaggcuuccaaguggcuagggaaugccacucccucuucuacuccucagcugaaaagggggguaucuaucuuucaugacucuccuuauuuccucucagcucauuuccucucacuucaccuuuauuucucaguugcgaugacuuaauuacucuuaaagaaauaaccagagucugccagcaagcugcugugaacggcagacaaaggguggcuucaauguccccuccuuuggucucuaaaacccucguucuaacuuugaaaacugacaacuaagcuugcacguuugcacuguugugacgcaauggcugagagaaguuuaagggggaaaaguuuauuuggcuuccaguucaaaggugucaauucacugugaguugaccauguuccuuugcauggagggucaggcugggagagauaacagaagaagucugccuugagagaagaguuggaguacuaaugcccucuuccguggcaugcccccaauauccuaacuuccucccccaaggcuccguuucugaagguuccaucuuccaacagagcuacauguuaaggacagacuuuuaaugcagaaaucagaagaccuuugcgggccagacuagcacaguacagaagcaccaggcccguugagcuucgaguucccacugcccaggccuccucccuagcaguaaccauggagccagaguugcuuccaaguggucucucccuguucuccaggagucacacagaacccugaggaggugucacaucccuuuaauggcauuucuaguacuuacaucccaguucucugacucccucaucucaaaugaccuucaucuuuauucgacuucagcugugcacacacaugccacaccugauagaucugcuccacucucggaguuucaaacucuauuagcuucucuuugaagcagccuuccaauguacaccgcccguguuacacuucccccaugcuucucuagaaacguccugucugcccccuuucauuccuuggucuccccuuguuuuccauugugggaagaugagagugaggaggcuggacagccccuucugugauacccagugucccucgguggcuaugcuuggcccguacaucucuuuugcacagccuucuuugagaauuuccaaacuagguccuuccuuugccaucuguuuuccuccugcaacuuugaagucacugagcauuguuagaaaacuucacaaaaacuggggcaauuggaucaauaaauguguugaauaagggaauuugucagcuucauccccguucaccugggagagaggagccugggaaaacuaaaggcccaugcuucgucuuuguuacaucucuaucccaguagcucugccugggugaguauuugugaaugucaucugguaggccucagaaauuuggggccaucucaauuuagcaugcuuuuauuagaaagccauccuuggggcccauuuuuaccucuuuagaguuacagucuugguaaaaaucuugacaaaaccuuucccuagacagccacucacccuuugcgguuggggccuaggcugugugaaugccuuucucucgaagcagugagugauauuuauuuauuuuauuuuugucaguuguuuccaugguucaugaauucuuuauuacaguaggagucaucaguuggauggagaaucauugaaauuguagguuuaggacauuaguuggaauaaccugaacaaugcacuuaccuuuugggcccuuaauuuaauuuaaaauuaaaugggucuuaugauggcaagcuucacagaucugccugagggcuuucugaaugggaacguguggcucuguguaggaggcuccuuuguucaguuggagaggcuagaaagucuuugccuaaaaacacguauuguuuggagagcacaaauaacugaacauaauguuagugagaaguuccacuggagauugaacugcugacuuccaagaauagagcagagugagaggaagcgcagugaacagugucuucucuguuuuccuuaaaauacccgugaaauuaucugaaagggcaacaaacccccagaaguaaccacagugagccccaggcguggagccccugcuggguucugggaggaauugucucauucuucucuguugaaaucagaucucaccuuccugacucagcaucccacccuccucccucccccauggacucccacucugccucuaaucauggaaaccuggucuccuuguccuaaccugcucuugcgccaucuccaccacugcugaugguuuccguugauuugggaaaugacugcugacccgcucgcucgcucauuggcugauguccucagcucgcccgcucgcucauuggcugauguccucagucucuuggugguaugauugguggaaaugacugcugacccgcucgcucgcucgcucauuggcugaugcccucagucucuugguaguaugcagcagaaagcaccugugauuccgcccaucccuugcccucaggcaggucuuggcuuggucugugacuuuauuuguucagaaggaauguggcugcuggccaggcuuugacucugcuuuaggaaugaggaugucugcaagggcuuccuuaucagucacccaugccggguaauugcccugacucccugaugguagggaaggaagagugggcucuggagguacauuccugccaauuggucuccccuguacgaagaacaguagcugucucccaaguaaucagggaucaucaaauugcauugcggggggaaguagucuucaaguguagcacacacugaagaccaaggucaacaaacugaacucaagccuguaaaaucaggaagcuaagucugguguugaggaagaagaauuaaaacagaauccuacagcuucagaaccagguugaggaaauguagcccaucuuuguuaacaggcucgccuuaagacauggcagaacagcccaggcuugugaacgcauaaaaugucuaaaacagguuguuucuaccaacugacgacugacaaggggcauccuaagacaccaaugacaguaacuaaaugacuguccuuguaaacaaaagaccacgaagaguaaacccagagaagagaugccggggacacagguaagagacuggggagacacagagccaacccagaagugaucaggacucuuagggaacacagaccaagacagaugaaccaacugggauucaguuuucagagguguggggccuggaccucagguguugagagaugaaacucugcuaggcaagguuucgaauuagaaauuaacacugaaaaauauuggaugauuucuuuaaacuggacccugguaggaacagucagggaaaguacauggacuggauugugggucacccauugugaucuuuuggggguuuuaauuguaaguagauagagugcuugaaaguuauugaaagucuguguaauugauguaaguaauaaacugaugaauauagagcucgguagagcucuccuacccagccacagggaagcagcgccuccaagcuccucccccuucacugccugcagacacacccacugccugcaguaccucauuagcauaucccgaaauguauggagcccuuucacagggcccuuauuaguguacuaaguauuaaguguacucacuuaggaaucaggagagugaauuugaagguaugacccauauguguccaaauaauaucuaaaaauugacccuuaaaauuacagcauuuccuuucaaacacuacugauaggaaucagaguuuagaacauaaaguguguuugugaucauaugaugucuauuuacuguggcacaugguagauauuaaaauagcgauggaauuaaugauaaccuaggaaacuuaacuaaaauuguaaaccagggggaaugucauuccauccaccaauaaggaguugcaccauuucuuccuaguugucugucagacugacagacagacagacagaguugugcuuauucugaaaucuggacagaacaucugcugugauguagcacacugaagagaugcugagauagagauaggcuauggcggagaacuuggugcugaugcagggaaggcauaaaguagaacggauuucaaugaguccuaauuuuuagacuuuuaagagguuaauuccaauuguuauucuugcugucuuccuaucagagagcuuuggccaaucugguaagaagcagaggucaauagaaaugauuaagcagcuggaaaaaucagcuuagggauagaggggagggguuaguacagcauuuauaaaaaagaaucugaaucucucaaagucuacggaaacaggaggauaauuuagcaugauuuggagagcuguggagccaauggcagaaaauugaguaccaaaaaaaaaaguacuuacugaguuuaagacagaucuuaauagacaaauuaaagaacugcagagcaguccagaggaaagugucaugauguuuuaauaaaacaugcuaucccaaagaaugauaacaagcagcguuuaugagcacacugugcccagcacccugcaagcauccuuuuguuugauauccucagugaucugugaaaugggacuaucacuuucugcuucauuuuucaaagacagcgggauggggcagucuuaugaggcugguaggccgugcacacuucauuuugaacuuaaguccugagcucaaucccagccauacacucgugcuuucugugccaggcaguugaugugcuuuccaggguaacccacuugguuucccacgugcuuaaagaaacacgacuugcucuaggaaguuacuccucacgcacguggaaagcaaacgugugccagggucccuguucccuguuggagggaguauccagcaggggucagaaugguggcagcaucauagcaugcaucagagagggggacagugggacucucgcuuucuaaaaguuuacucguuagcucaaauaaauuagucaccugaccuccguagggauaacacccccaaaaagcagagaaucugauuccauaguguauauaugaagauaacuauguguguguaguacgugcauaaaguacuguaaggguggcgugcaaauaagaacauguguauaaaaccugcgugugugcguaucguguguguguguguguaaaguacuuaaucuuaguacauacucagugagcaguagcugacauuguuguucugaucaagucuucaaggaaaugaagacaaauagccaagggcauuacaugguagugaguuuuuaaaaagacuuuaauuuuguguguguaugugugugugugcaauccucccagauugucuauuuaacaguaaaacuucuguccccuuugcacaauuggggaauucacaaaaggcuuuggucuuguagaugcaguaguuuguccgcugcaaacccggcuucugacaaacugaaggcuugcugugcucugauauguuagcaggcaaugcgugguuuuaauauucauggucucuaagugcuaccgacugacauucgguacuaaaugugcagauacgggugcugagcgaaacacaggcggaggacuugcuaauuuguauucuagauggaaaucuuaaauuaguuuccaagauuuuuaaauggauuuuuaaaugccgggcacauaggagauugaguucauauuaauauuuauaagguuugagaagauauuuagugaaauauuuguauaauuuaauuuuggucauaaucaagaagaaaaccauaacaagaaggacauugcacuuuaguuuggugacucuuuguagcucagaguuagaauuauuuuuuucuggaaaaacucaugcugaccccugcauguuuaaagagaacuuuuuuuuaaauuuauacccagaaguuagauguuauguguguauaaauuccuugaguuggauuguuuuaugguaauuuuauauaagcuaauuaggaaaucaguauugauaaugauuuuuuuuuaagccuucauugauaguccugcaaaacuccauauuguagcugcuuuuauauucuguaguacagggaagagcacccuggguucacaggaaaccugcuuccugugguuuugcuuagggcuaauugagcuuaauguaguuuugugugcagaagguauugacuugugcauaguauuuaauuuguguaaauauguguguauguaauguuuggccccuccgaguuuuauuuuaaauguaacccuugaaacugggauaauagaaauucguagcuuaggccugcuagcaauugcaggugccaacgguuuaaacugcuguagaaauacaauuaugagcagccaagagcaaaucuuguuuuaagguccauguguaaugaaugccuguuaguauuauagaauacaauuaaaaagagguuuaccucuccuaagcugugauugguucuuucugauggaaauguugaguccccugaguagaauguguauucagcucucggugauuuagacaccagugagccuggcauacugcaggcuuggauaaauucagggcaguuauagucaagcagagaugggaaaagacugaaagauuaaugagcgagcuuaaaacaaagcuucaaaaaugagagcagugcucugcucggucuuauauaauugugcagaauagaagucgguuuuggcggcuguuguuaaaaaaaauuuuaggaucuuggcagaaaauguuuauuuguuauaaaaaucggaccuagagaaugcaagugaaaaccuggguugaaauauccaguuccugcuuggcuguguaguccucagagacacacccugcccauagccucuuuuauucuugcuugaccaagccucuucaguucuccccacuacaccccccacggaacuucccacugcuucaugauggugagggccaaagucccagcucuggcuacucuccaggaagugcacaucugggugguguuccuggaggccucacuggcacucuugcguguugaccaaggccuaacagaucaggaccguucagaagcaugagagcccucugccacgguagcccaacuuacugcugauuaccuguggaucccaguuucuggcugguggcuuucaauaguagccucguggcauuucuuuacuaagacuuaaugcaagggauccuaauggcuuuaaaaugcgcuuuuaccuuugccaauccuuuuaauagccccuguaacuaaccuuccauuugcccaacacuguggagcucugcugcggagcuggucaucccguaaugcgaggcugggcacucagggaaagggcagcucguaauuaacgcagugcaggugagccauuucuuugauccagggcuugccagcgcagugaagaagagcagccuuggaagagagacugccaacucagaagaggguucuccagucuguguagacacagcagcagccuuucacucugccugucccuuucuucaaggaguuuggcgccaccuacaggaggcaggaagcgcgguaaccucagcuucucauggaagcacuggacuucuccccguggucauuccucauauuuaggguuuuuuucccccccuaucaaguugaucacuuguucagcauguaguauuuaucaagccucucuuuggccacgggaugaugcuaagcucuaugggaagaaagguuacgucuguacuaacuguuuuggcagaagauuccucaccgguaauugcuugguaaggucucuguuucugcugcccugagccuuuuccuuggacacuccagcaagagagagcaguuacagaugggcguuggaggggacagccuacaagggcugcagacuucacuuuugaguuuccuuuguuuuuuuuuuuuuuuuuuuuuuuuguggacagaguggcagccaauccauuauuuucuuguuuguuucuauuuguuuucuuuggaaagaaauguugaguuuaacaaagggguggggggaacuacagucaaggaaguucaagaugcaugauccaguucagagacuucagggggaaagacaggugaucgcuguugcuggugcauuaaaggugcugaagagauaaugaggaucaauuauuuucauucaucagccuuucauaacuguaucacugaauuaagcucuccauuguuccacgcuggagggauuuggcuugaaaggaguuaagaagguagguuucugccugcgagugaaugagcucagcucucccuuccccaccagcaccccuaacccagaccuguucuugaacucucugccugcacccugcuggguuuuuugugucaucuugcaccacaccccgacccccacuccaccacucugccucccagacccacuguggcucacaucagcuugagcacguguccucaucuguccacuacaaaagacacagucauguaaccugcccuucuuuguaguauuucuagcuuuucuuuccccccuccuccaacuucugggcaaaugacaucaucauucauucaggguucugggaaauaacuccugguuaucuuccacacguuccccaagaaacucaaguagguucugagccugucucuuuaccucuauagcuuuucguaaauguccuuguuuaaaacugaauuucuguuuugcuuuucugucauuucauccucucgaauuucccguaacuuuguauuuucuaagucauuugucuucuuuagaaauccuuacuaguuggcuucuaguagauuuguauaauggccuguuggcuagagagagcugucuagucaaaugaaaaauuucccaccaagccccauguuaaaauagacuguggaauuuggauauuuuucuggguuuagacacuuagguuucuauuuaaacaucaaaaggaauuuacagauaagaaaaacauguuaguuauuugauggggaaggccacacauuggagcugaaacgauuuuaaauacaguauuucauauguuuauaccaaacaacugacuaaugguuucuaaaaauaaauauuuagagcaucaccuaagccgaugcacaggcagaguacacagaaaguguauuugcugucauagucaccaggguaaugcaaaucaaaaccgccucacuacccaccaggauggcuaaaguuuaacaaaagauaauaauugcagacaaagguguggaaaaccuggcaacuuuauacauucgugguagagauguaacaugaugcaguaaauuuggaaccagcuuggugguuccucaaaguauuaaaaauagugaucaaaggauccagcaguuccaugccuagcaauguacccugggaucaaaaugugucuccauagaaacaugcuagacaauguucagcagaaguauucauaaucacaaaacccagaaacaacccaaaugcacacugcuuaacaaaucgauaaggaacacguggcgcauccacucaguggaauauuaugcagucuuuaacagcagcacacagcauagcauggaugagcuuaaaacaccaugccaagugggagaagugccauuuaucugaaauuuccaggaaaggcaaggcuauagccacagaaaauaaauuacuggcugccgaauugggcaaaagaugugagaaugagugcucguggaugugagaugguuuggggaugaagucaggguuuguaacuuagguacuagugacagguacugggcccugugaaccuccuagagauuucuagcaccuucuagagaccacugaacuguauaucccaaaugcaugaauuaucaucuccuaugugcaguaaagcuguagaugguaaagucauuugcaagugugcuugugucugaugcaucuucauaucacccccaaaugcuuacacaacacuugauaaguaacugaacaauggaggaaugaaugaaugaggucauaagaauucuuauaauauacgagcaguuucuuggcaagugcucugggggagacucgaagaaugauggccagacaucgagccucuguccuucuagucacucauuuugaugaggcagcugccuuguccauugaucugaugucagccggauggaaucaugcucugcucugacgucagugggauaggggcuuuccuuuuucucuguugaaugauguuggcggcacacacuugagcaacucuacacugugugaaugguucgugauaccagugcucuguugugaccuuuauuuuuaugagcugugagaauuaagaaccuaccaguuuuaguuuaauuaagcagcaaggcacagcagauggugcauuuguggguaaugauugccuuccucgaguucccuuaagcagcgcucuaacccugugguaagcugugccuagaguguugcaccacggugacaaaacugccagaaagaggguccccauggcaaugguaucaucagaaaaucauggaggaccuggacacuaccacaaacugaacuauaguguuaggaggaagaagcgcuaacugugugguuauagcauauuaccauccauccauuccaauauuugcaaauaaagucuaugaagguuuucauuacccugguguuguuuuguguaaucuggggcaggcauuaagaaugcauuggaauaugauuugcauguuuuaaagugcugggagaagauuggugagauagagaagcagugauuuuuuuaugucagguuguuuuauuauguuugcuuguagucacuacagagggccgagcgaguguccuaugguagacauuucucccagguacugugugcuuacuguuagaguguuuacuccagaggauguuaaaagcaucccuaagugaacagaauauggaaugaaucuagugcuucccccugauugugcagccuuccaggagggaaaucuaauuguugaggagaaguacuuuucauuguuaagggagacgcuaucugucuagcucaaacucuucccuuuacuaucuuugaaaaacugaauuacuugaaagcuggcauaaaacuuauaauugcacaauauuuuagauccuaagauaauaugccucgauuuuuucucauuaaugcaauauaugaaaucaucaaaaugaaauacauucccuuacuggcuguaauguuguuaaaagcaugaacuauguggaucuuguagaauauagccauaguuacuuucaauagaauaauccauuugucucaucucuguguuacagagacuagauuggaauccugguuaacucaugaacuucaaaacuaauauuuuaaucagaguguguaauuucucuuuggcuaaagcccacauuuuauguugggaggagaccuucugaaauuguauaaagagacucuuuucuguuuuucuucuguaaggguguuguagcccacaaggcacgugacucugucguccuugcagaggugguccuuggcaacucagcuuucauauuagcugagugaagcuuuuuucuucccucuucuguuccuaccaaccacaggauacgugagcacuuaggauaaagcggaagguguaaacaguaauuuugccuuuuuuuuuuuucauaauaaaagauaguuagccuuuuacuuacuguucaccagcauguaauaaagagagaugugcgcgugcauaccucucugcagaggaaaugcaaaacaauaacggaguucaaccuacaaauuauuaaaaacucgggcgagagaaguuagaauuauuuuuauaugggaacagacuuuauugcaaaaucauuggcauuucauuuccuuacagaacuggguuuccuucuaauuaaaauagacgagaggaacuagacuacuucccacuuacucaauauauggauggcuugccgcuccuguggcucuguucaacaugggcggacggaggugucggcaacuaacuuaaacuuaugccugauaauuuuagggugauaaggaguguuuauucuaaaacugguauuauguuaauccuccauagucaccuuucccauuuauauuuaucuacuucauauuaauuuugucguagaggagaauuguuauuuaaccaguaguaucaaucuaggcucuagccuuggucuguccuaagcagcugaacucuuguacaggaagaacaaaggauuucgaugaaucaacaguuugucuucagaucccaacaugcuagauacuuccugugugacccugucauuuaggaaucccucaugccucuaaagaacucuccgagagugguuugguuuuuuccuguguauguguguacauguucgugcauguauguacacaugugagugcucacagagacaacacccagaugucaagaaggugggaauuucuaucuuuacugggggcaggguaaagagugggguucuguuuccaaggaugcaaggaggaguagauaagugcuaggcaucuaccauucucugacacacugaccuuaggcaguugaaucucauuguaccucagcuuuucaugucucucaacauggucauacaaguaaguucuaaaucaggaugcuguuguuugugguuaucguuggaguuauugcaucaaaugcauuuaucccagugcuaggcauguaagaaguaaguaauaaauguuaauuauucucacgucuuuccaugucgcuuuccaguagcuuuagguuaacguuuuguagacccuuaaagcauacagcguucaucugcguuacagacccuuauuuauuuccugcuccuauaggggaggaaccucaguacagucuguacgugcuuaugacaucucugauccuggcgaucgcugaauacaacuguacucacaggauggcccguggcguccucugcccugugccccuguguguguucacuauuuaagcaaaagcugccuccaucucuugcuuccacgagucuucauuaucuaccagcuaauacccaaacuuccuacagcaguauucuugccuugcuaucaucuugccauaguauuaaacacuuuaucuuaacuaagccacguuucuagccccacagaucccacauuucuguguacuuuuaaccucaucuaaaacucccucuucuccaagagaggucuuauggcucuaguuuuauccuuaggguaaacuuuuaugaauuuucaacuugaagcaggaacaauggagggcagaugguuuuucugccuacaauauauaauguuugguugugauucucugaacacuucuuaugauuuuguuucugagaccuauagcguaggucaaccagcacucucucauagcuaaguacauguguaaauauaugaaggaaugaagggacaaaggacuguuaaguauaagaaacuggugaaggggacucagccuucugauggaucgguugguuuguucagcaguucucagagaauagguugagagccagaaauucauuauuuuuacugugcaagacaauagcauugguuuggguacuuuaaugugaaugucucgaaugcauuuugcuuucauauaaagaaaagaaaagguuggcuucauuuuaucaacuguguguguguguguguguguguguguguguguguguguguguguguguguguguguguguuguauaaugggcuguguaauauaauuuuagagcccucugaugcaauauuuugaaacuaaguuggucauacaauuaaaacauaucuuuggucauagauugcuuggccuuaugccaucuucauaggcaauguccuacuuacauagccuggauuggcugagaaaaauaauugcugcuaugaaauaauuuugcaauuaccacuguaauuaagggcaguuuguuaaugaaagugcuuggugaauaaugacugcagggcacuccaucuugcagcuucaugccagaugauugguucauguggcagaggcaguuagggaaucagcgacacagcugucaugguuacaggauggauguaaauauccuuugcaguugaugaugaagaacagucauuagccuccugccccuugggaaccggucagaagaacaaaaauaaacuuaacacaggauggugaaagccauucuucugucuccuuuucuucgguaugaacaauuaacauucuaauagaaagcgccaggagcacagagaugagcccucuccacuuuuuaagcauguuaaggugauagaugcuucuccugguagggcagugguuguucacaguuuauaaccacucuuauuagcuuauaggcuaguuuaaaccgcucuugagagacccaugggccccacugaaauuuuucuuguucauccccagguauuguguguuuauuucagccacuugaagagugcccacggagggauuuuugcaugccaucuucauggcugcaggggcaauugaagaucaauguucuguguuugggcuuaccuaccuguauaaacacuauacugacugaagaagugcuggcuggcugcugaucccacuuuacucuagacugugggggaaaaaaaucacugcugcagggugaggguuccucacacccucccucucccugaaagucagguguuuaagugcacuuuguauuuauauucauuccaccucugugguguuuugauguuguuuuucauuguaaauuugcuuaagcaaucuuuuguggaguaauuucauaacaugcacacacugugguuuuacacugaguuguucgugagcugcaacucauuaacuuuugcugacuaguaagucagcagagcaugcuguauuucuucaacuuugucuugucacgcaguccuuuuuacucucuauuaggaggcuggaagguugccuggcuggauaagaacccuugcuuagucaggaggaacugaguucaagucaguagaacauguaaaagucuguaaucauaggauugugggggaccaagggaggaucccugcagccugcuagacaccaaccuagcucagguucagcgagagaccuugucccaagggaauauauccaagaaugauauagcaggacacccuaacuccugcucugccuuccucgaugcucacacgggcacaagcaggugugugcaucccauguguaccacccaccuccagaaaguaaacuggaccuaacaaagaaaagaugcuagcagcucccugcagaggaauggaaacacagcuucucauuauguccugauggagaaagcucugcugcuucgguaggaggcaggaguaggguacccucauaaagaaccaucacugaagugcuagcacacguuaugggugggcuuguuacucucugcuucugccggccaugaguccuugugugguaggagaugcuuagugucucuggauccucaugacuuuagcaagaaccgaugcuaagcaacggauggggauugugccccagaguuuuauaaauccugugucccagaccugacucuuaaguagucacagaaggauuagaaagcaccugcugcucacaggagucuuccccccccccacacacacacccagucacucacucucucaaaaugaacucucuauuucauugaccauagaugagucacugugucaucugacacuguaggacacaaaucaacucacuuguccuuaaaagccacacaauguagcaaaccuuccauacuaagcguuaaaacuaguaucuuauucaugcucaugucugaugaauuaauauggguuuugagagaacauaauuuuccagggacuucugagagugccuggguuuaaggaaaaaaaaaaaucaacaacaacaacaacaaaaaaacugggucccuacaguggcuucauaguaaagcuacaaggguaauuguguuugugugugguguguguguguguuuuccgaaguaugggcuuuuguggugggucaaaacucccaauagaaaauaucguuguauuuuuaguugguguugcucaggcagaggacacaggaacuauauccccccuucaggggggaugggacaacugcaguauuuacauagucuguucucauuccuguuugguuugguggcauuuugauucacuuauuuauuuuuuaacuagugugagauuuguguuugauguuccauggcaucuguacaggcgccauaacacgacagaggugguaagugcucucagacaccgggcgggcgggcgggcgggcgggcgggcgauggagauucuuaagugaagcagacuucucacgcacuguccucaggauguguguggaccugagcuggcacauagcuucuacccagcaccgcccucgucuggcuucccucauuuucucagaacaaaucaaggacuuuugguaguucuccaggacauaaaugcaucgugucccauucgguccuauugugguccuaucugucacagcaacacuaauuauaaaaauugaacguaaauuugugcuguuuaauagguuuggguuuaauuuugccucagugggaagacauuugauuaaaagagucuuuuuuccccuccuccuuccuccuuuuuucuuuucguagaacaguuaguaaaggcguaggaaauugauuucagugucacaaaggacauuucugacaggaauguacuuugaaaugauucaaggcaucuguuucucucaaaugugcccaacacugcugagagcuguaccuaaauuaaacuguuuaacgugucagcucagaauccgaucacaauuuacaucccaguggcuuggcuggagucuccaccauuucaugaacucccuccccuaauuuacuaaacaaguucucgcucaaagugaccauuuguucuagaugccaauaugucacggucggaauugauuuagcuuuggaagcuauuugcuuggguauggucacuuugccuaugagauggaaucaucucucuggcauugcuucuggcguggcuugugagggacguccuggugggcauuuuggugcugucugucuuucacugcugcgaugucugucaggcuagcuggcuccgggaguuccuguugaaaguguuucugagcccaggaaugaugugcgcuguuuauggcugugucuggcacccagcauagacccugggaggcacuuaacguaaauucuucauaaaugagcagagaaggaacacuuccacacgcccaugcguguaacccugguguagacagcacugggagggcucauuugucugccuugcuguguuucuuagaaaucagcgcuguucacuccuauuaauuacaccgaggcauguccuuugaaguuggagggcuggggcaauuauuuugugugugagagaacuuuuuauauucauaguagaaauaauucccuggggauaagaagaaaaagugucuauguugagguauaauaggaaccugagcucauuaagguaauuauuuagugguucuuuccccuucuucuccccuccaguguccacccacgucauccucagacacaguuuaccaggcaauggagaugaagaacccagggaaaggcuccuucuauugcccugccuguguuuauaagucugccaccuacugaaacagggcgggaguuuguauggggcuacccuggaaggcucuuguccuagaggggccaugugguugaccccacugacgagcagcagagaagacugucuguggcacuguggucucucucuguagaucuggacuucacuagugaagauagaaagcauggcauuuguaguggcuuaaguuagugauuuaccucuuguacauaugcuagcuuagccuggaugucgcacauauccagcuaccucagauucacccagccauuaauagucaaagcuuaccagggggcgggggguggggguggggagaggcugugccaucuugugugcuagcuucuggaaccacccuggccaaaccauuucagcuuccuggaagggggaaaggaaagguagaagggaaacagccuucuucaccaccaugcucaggaaggaaucuggcccuccuguucacacagggaggagcuuagucacuugacuagccuuaagcaaggaaggccaggaaaggagaaaggaacuugacagaucaucccugcagcugggcuugcauggaagcagagauggaguugcuggagugucuugaaccuuaggcuuuccugaccaauuugcugccugccaucuuuguuuuaugagucucccaguuguugugagacguauacaacagccaaugcugcccuugcugagcagucccgcuuuagcuuuucguacugaaacuguuugcagagaugauuguagaaauuggcaguucagcucaccuucgucaaguucucugcaaggacuaggaacuuugcauacacgaaauugcccuguaggucugccaggcaaaugcuugcugucguccauuugaauguuucaacuccuucugcuuuuguauugggaagcaugauagaauagggaagaugguagauuugugauuucuuuggguuguuuuuguuuuauuuguauuuuuugguuuguugcuguuuguugggguuuucuugggguguugguugguuuuccauuugagaagauauuacauguacuguuacugugcuagucacuguacaggaaaacucagaaggcuuaauuacuauggccuacaaauaaauccucccgcauagcauauacagauggccacugacgaaugcaaaaaucagguuuccauucgugaucuuucuucacaaacaguucgagcgguaacaugaaagaugguuaccaguauuaccgccuucugcuuuucuccugucuuuccucuaaggagcucaagaaucuccaacagcauauuuuccucugccuugauuagauuuuugaagcugugccugauauuuugaaugcagugcauaguggaauuccacccgccaccccacuucuagacgcuggaggaugaaauauggccaagucucagggaccuguaagccugcaccuagauugacuuuaaucucuucagcugcucucucccaaacaaaggauuaucagaguucuugcugggcaauaaaugucauuuuuaagguaggauuuagacaguaucaucacccgacucucucaauaugagcaaacguucaacuuuaguuuuguauggacaaaaaucgccuugaguuuucucacauuuuuggcaggggagggacaggaagugaaagccaaguuuguaccaagcaaagcucaaugcaugcugccugcguucuagauaaucuuaccccucacacagcuuuaguguugauaccgcauaagauaggagugguucuaaaguauuuccugagacugaguugucuuaugcucguaagcuagcuguaugaagccuacucaauaaagacuguaaaucucagccauauguuuauagaaugcccugcccucccgcagucaacacguggggugccuuggugucaaacaucuugcuaaaggugauaggagagagcacaccuuguagugauauuaauccauuuucaaugucuggcaaauaagcacaaugucuagggcacauuaaauugagucauccaaaaauagaaauucaaaguggcuuugaggcaggaagcagaacauugcuucucugaugguggaccugcccacaucucacuuugcucgcuuaccuccagcaucucauauggcggucacuacagugcccaggugcuuuacaacuuguuucucuuucugcuucccacaccucacugggagcuucuugcaggaagaaaauacguucuauucaugcugggacauucaaucaacgugugguugguaaacaauaaguagaugcugaauaaauaccuuaagagagcaaaaucuuguccuucccucgagguuaaagcuaaagauacucugauuugggacaagcugguaguuuuguuuucuuugugcagagaaucuuuucauuauucuucgcugccauuuuauuaugugaucuggauuuuaaaauggaauaaaaagaaguaugcauuauguauauuggucuaacaugcuaaaauuguuucacuuaccuaguuguaacacacuauaaccagcauauaauccagcuguuccauuccuggguuuauuuccaaaggaaauuuaauacguguuucguacauauguguauaccuguguuuucaguaacucuucucaguggccaggaugcagcaagacacccaugccuggaugaguggauaaagaaagugugauguauuuauucaacuauaaaaaagauugaaacccuuucaucuguagugcaauggauggggcuggaggacauuguauuaagugaaguaugccaggcuacagaguccaacucaucuuaaagcugaaaucuagaggcuagaagaguaagagcuugaaugccauagguccugagagauggguaccagaauacagauggcuaggagugaguucuugcaucccccugcaagguagagugcuuuacagcagcucuuauguagcauauaaggaaguggaagagaaagaguucugggguuuuugacacaaagaaugauuugaucaucauucauuuacauauucaguguuccacaaugcagcaccaugccaauuaagggugucccccccacccauuaaguaaagggaauucucuuaugugagguucuugggcgccaaggcgagguccuagaccacuauaagcuagugcaaccaccugugaaugugguugaccagugggacuuagccuggggccucuugugagcuccaaaugagauccuugguaugaagaauuugacccagccaaggucagccaugaagguaacaguggucucuguggguuguuccucucccuggggaugagccauguucauucaaucuuguugaacucuuaagaacuaagguccuuuggcacugugaugagagccgaagugcaggcacaguugugcauagucacagaaagugggagagugugcgauggaugguccuucucccuacuuucuagggacguuagauuguggauuagucgacccaugcauguucgguggcagugguuuguuuuuccaguauacaguguguguaacuaauagacuccucugcugucagaugguucugaaagccacucacagcauagugaagugauaaggcucugcagauguguguguccccugaaauauuucucuccuccauuuaaaaauguguuucuaggucagaagcugaaauguauccaagaccaucucucuguccucagacuuuuauuaaaugacuauuuccuauucuugcuaggaucuagugauguggaguucagcacugccucgcuuaccugggggugggggugggggcuauguaucggauaaccucagcaaucuggaccacaacacacacacacacacacacacaagccacauaugcauacacguauauagucacauucauuuuaaaagggcugauccuauaagcuuugggguuauuucaucaauauaauuuuauuaagauuuguuuuucuauacugucugauuccauauaaguggagaauuccuuuuuuuuuuaaguuaugaaacuucuugggccaugcaccuucuugucuuuguaguuuuuaauaaguuaucuuuauuuuugugccuguuccuaguacaaacaugacucaccucuaccuuauuuuuaccuuugagggaacuucaacuuguguuuuagagaauagagaaaauuugaugguaccaaauauagaaguuaucaaagcuugugucuuuaauuuucagcauguuaccucaaauuaacucuuuucccacauaauaauauugaucaccaccaccaacagcaaacagcucaacauggacaagucuuuucucacagguagauccaccagcuuacagugggcaaggagcuugccuggagucccaagcuucucacacaagagaauacccucuucuuaugaaaaaaaaaauguauuugacauugugcuccugugcugaugcauuuuugaaacaaaguaauccguagauugaccagagagugguuuggcagccaugucacaccaugugauuuugacccaagaguggguugaggagccacaccaccccaugucacuaacagugcucccucacugcccccuuaccaucuccaggagaaaugcucuucucguccccauuuauauucaaggucguggaaggucagacaguuugagugauggcucaaguuacucugccagagcauggaucaagaaugggugucuugccucacugagccauuagaugcugcucaguuuguucuggucacauggcucacagcucagcuuccuggacaguuuacugucacuggucuagcucucuaugguggacaguccucagaagagccgagagcuggcugguaacagugguacauaugcagaaggggccgugaagagaccugugugcagagaucuuuucgccagacaaccgcccagccaaccuacugccgauuuguguuucauaauugauaaaaagacaaauaauuaaaaaaaaaaggacugguugaaaaacgacuucucccaacaggagcagcccauccaucuugcuaagaacccaacgcuuaaagaacaaacuuucuccaagcacugaaauuucaccaugccuuucccccuucaucgucucuuuuauuuuccuuuucacuuugacagaauucuugguuguguugaauugaaaaggcccacuggguugaggccaaucuguauguuuaaaauuaugcacugccaaguccuccucuggugcuccuuuuuuaaaaacuucguuuuuuagaagguugacaacuuuaaaagaaaugguguguuccuuuaaccccuagaacauuuuauuuaaauuuagucacugguuuggagaacgaauaaacagaaccuugacuuaaauguucccgugucugagaaugaaugggaagugauaugauuuauagcuaguuggaaggaaaaaaauaaagaagauaaaagagaauugaaaccccaaauuauugguuucugcagugcguuucugaucuaacucucaaucgugaguacaguuuaugccuugcuuaaaugcuacuugccaggccacggaagcaaaucucugccuuuuauauaacgucagcuuaauuggauguuugucagcucuguagcagucugaaguggaaagaggagaucaucuguauucauagccagcagggucuugauaaauauuucuuaauugacuaaauagaggaaugaaugaaugaauuguauucagaaauuuacaggauagcacaguaguauuugucaucuguguaauacaaaugguguguauaugagugaugaaguugcugguaccauuaucaacuguguuucuagcuacaagaaacagaccacugugggagacacagcagaagaccuugugggagaauucaugcucgucccacuguuguccaugagugcucauugaaucagcuugcuucuuaaugcuuaguaguauauuuagcgagucaaaacgccauucuagaaugagcuugugguucuaguuucugaauguauaaagcguuaucuguuacuucaccucucaugucagccacagguuuuuuucuaaagguacuucgagaacacagaaguggauuucuucaacuggcaugagaaugcuucauaccagcauauuaauauuaaaccuuugguuguggcauuuaucuaguugaccauauuccauaaagaagacaauaaacacauaaaaccuuugucuuuuacaguaaucacuuuuaaaaggccagguagguaggcuuguuucacugacgguguauuuagccaaaccuguucuuaugacuugcauguggguagccuuuguacagacucgcuggcagcaggucuuuguucucuaugguaauuuauuuaggacugagccauuggaaauugguaugaagguggacacugcacuugaggauuucaaacaaaagaauccuggaaguaacucuaaagcggaagcgccaaggaagaugugccaggcccgcugccaugcaagggaagguuaugaggaauaauugaggguguguggaaccuuugacagaacauagcugugcauugcagcuagcgcaaggcauaauaccacuuuaaaccuuugucuuucauuuccgugacaguuuuaaccuuauuaguuuaaagucuuacuauauacagacuuaaaaacugacaaacaaucuuaagacaagaaacucuuggauacuugggaccuaguuaguucuguaugguauagauccacaccagccucagcaugagacagucuuaggaacuggaccccaguguuuucuccuuggcuuaaguauggggacuggauuuaaaauguucccauagccuuuugcuguugguuauagguuuguuuguuuuuuuuuuuuucucacuuuggaaacaauguaacugcuuuggaggggaagacauggggucuucucuacuaauagaagguaaaucuuuuaaggaauaugguuuuauuuuuuuggaucuagcuaucuggggcauuuuaucuuugcaguuaacuuuuuccaaaggaaaauaaugucaaagaauauuuaggcucuaguuaucuuaaauacuucuaauugaaguucuuaccaacuuucccccaccaacaaaaaaaaaaaaaacuuuuagaagguuggagguuuaucuauagcaaauauucuugccaugugggcaaugcaaucugcucucaaguuugaagaucuggaucaguagaugagcguauuuaaaucacuaucauaacuauuacauucauauguuugauuagccagagauacuuucaauaccaaugaacugcaacuggaagaugcaagucucucuuauuuuugacugcaucacucacuccauccauccugcuguuuccuuccaugagacauugauggacaguuuaaaugcaucucguuuuggagagugaagcauaggcaauucaacaaugcauccauaaguugguuaccagguuucaaccgaggcccaauaaugaaugagaagugcauuaaacaaauuaaaacucugaccuggccauacguuuggcucucagcauauguuuguggaucccccuacagcacagcauagucauguccaugaaaggacuucccagcaguguccccgcuccuugaggguuaguuaacaucuauagaggucgauggauuuaucucaugacauuuaaucuugcucacuaaugaucccaguuuacaguuauucaagaaaguggaauauacauagcaguucccuuggguucaguaccuaaguguuuccucauauucugcuuuauauaagagacuguaagguucuuuaauacuacaucuccauguggguggauggcuauucgucuuaguagauauugugugugaagucuguucccugauggauaaaccuuaauuaaagauuugacaguaagugauguugccuggacaaaaggggguugauguauagaaaagcacauaagcauucuauaucaaaaucacacuuuaugcuucauaaaaguuugugucucaaggcucuugugcauuuagaagaaucuggugagaauggaaugucuuggaacaagugacuggccagucugauuccaacccuuucucaagccacucauaaauuaacagggguacagugugcuguaccucuuugaauacuucagaacugggcuguugccuaucuucccacacccuacaaaagaaaccugaagccaagaugucaguuuccuauuagccacagaaaacacaaaagggggaggaagcuugcgguggcagaaggaacuugguuuuaauagaacuuuaaagaaacucuccuccauugugaccaacugauucucuauuuauccuuucuccauugugcugcaagccucuaagcuggagaggagagaauagauugauacucaaaggcauauaaguagcagagaccaaaaggacugagcugcagaaccugacuagaggaagcaggggcuggaaacagggaaaaugagaggaauuucaaagucagcguuggacaguugcauguggagacaagcgaaagaagaguucuuugacaauguaaacuggguugaggucugugugcaucaucagagacuugcaugagcuggaaggugccccgaagcaguauauagagaaucuuaugaucuggggguugggggcuuaucuggcaccuaaggcuagaagcuugcuugcuuuuauuuauuuauuuauuuauuuauuuauuuauuuauuuauuuauuuauuuauccuauccauccuaucuaucuaucuauccuaucuaucuaucaucuaucuauccauuaauccaucuaucuauccaucuauguaucuaucuaucaucucuacaguagcuccauuaagcacuccucaagcaagggcucgagguucugggugauuugguuuccugugugucucccaaaagucaguuucuugucuugcuugaaugaauucuuucagcaucugagcuucccauaccucuucucugugugucuguuccuaccaugguugagacagucuaagcauucuuggcuugcuggucuuuccuccucaucccugcccaggauggaggaugaggggcucugcauuuugucuguaauuaucacguguggcuagaaacagaggcagucauguugcugccacuagcuaccauggccacuccaaaaacaaugacaaaaacuacaaaaugaaagugaagcuugucacaguuccuuuuccuugagucugaauuuggaucuaucugcucgacugucacccacuuuauuaguauugcuguguguacaacgggauugaucacaggcaguuuuaauucuuuguauaucuguguaccuguuugauguaugagauccaaucagauuaauucuuugauaacucuagguugaaauagauaggcaguggaugugucgcuuuuagcacaaugucucuauuuaaguuuucuuugaagccaggaaguuuggguguaagauguuuauuaugccacacuucuguguccccccaaagaaaaccaccauugaauuaacuuuugcauaguguauuucuaucaaagcauuugauccuuguuucugcaagcuaauccuaagaacuuuuuauuuugagaauagaagaccaugauggauuuaauucauaaagggaagccgcugcaaggaauguaaauguaagcgcuugauaagguaggauuuccuaguugcuauggcaaccuuugggucaugagccugagaaaauauaaaguaaguccuggagcuguaaagaugauuauaaaauuuaacugucauucuucauuuagaguugauggcaaacauuauuuacuuaaguuuaucucaaggcaggcaaggaucugguuuuggaaaucugagacucggaucacaacugaauccauguuguaccugucuaacauuauaaagcacaggcggcauuuauuauucuaagcagacuguuuguauauaaugucccuguagauuuagucaccuuccuauggaagccaacagugcucaucucgugaauucuuaauaaaaacagcggaaugcagcuguauauguugaguaaauuugcaaaaacguguguacuuuccaugccaaaagagaaggccuaggggaucguguaggaaggauggcuuugugccuucuuuucagguucacauauaaauaguacacuguuuggaguggacaggagccaagauguucauauaauuguguguuuccaauauauaccauaucccuuucauaauugcacccacuuuccucuggggcccaggggugaguguauggguggggagacccaguuuacuacaguggaggaagggauugggagaugucaaguuccuaacuaaaauaugauguggagcugugcauuuugacggagcaccaguuuuucuugcuuuaucguuuacaggccgcucuuagucugugcuaaugaccuaugagacccacugcaaauuacccaaucuugcaaauuagagaguaugugagcaaacacuauaaaacuaucagauaccacaucaaacaaauguaguuuauugcaggaagaaaaauagacuugcauaucgagaggggaugucuuuucacaaccagauaagugcuuuccugcuugcacaucagggagcuucaacacauuauauggucugugucagccaauggcucgcuggcucuugagcaaaaaacaucagucuuuaaaaugcaggcacagaacagcucaugagugcaugcaugcuggaaucuugcagcacugaauuguuuucccuaucgguugccuuuauuaaaaaaaaaauccuuucgaacuguauaugcuggaucuuugcacuaggaaagggaacagaauuuaggguuauuaagaacagaacaucuacuuugcugguguucucauucugcacccaguugagucugcaccaguaggauucuucccccccccucccuugccaaggacgaggagggauccagcccacacacccggcagcacacacucugcucaucaaagcacucuucucaguugcuuuguuuucgucucuagcagcagaaauagcugcucuuuuucuuuuccuuuuuuuuccccccuccuaacaucuuguaauugcagcugguaauguguuuucuucuaaccugagacuggccaagggauagcaauaucuggacccacacaugguagaccucguggcaggaccccagugaccuguugauggcacaguacacuuaucucccauauauucagaaccuuaccugggcuagucagugcccccauuauuucaugucacccugauuagguuauuuuacccagccuccuaauaacagcuguaucaguaaugcauagucugauacuucgcuuaugcugaccacugugguggggggaucuguguguguuuauucaauauuuguuuucuuuauagguauguauauauuuuuauaucuuuuaaaaaauaucaugcgguacauuuuuguuuauuuuucauguuugguucucuguaagccuugcuuuaauggaugcauauaauaugcucaagugagagccacccauuccccccaaaccugccuucauguggugcggugagccuuuguaagacacuugcuacccaguccucauaaagauaugagacuuagacuguuagaucucucuuguccaucuuuauuuauuuuuacaauguauucacuguaauacacauacacagugcacaccuaugcaggugcccacaggcauggaagagggcgucaagucuucuggagcuguaaucacaggccaucgugagccaccggaugugagugcuaagaacggaauccugguccucucugagagcagcaggagcucagaacuccugaggcaucucuccagcauuccauuuuuccuuuugcuuguuuuuaaggaaaaugaggacuucagagaacuuaaucacuuugucauggugacacaccugguaacuagggaagccgcaguggcagucaucagagcucaagcugucccaagucacuuccuuugguugcuccguuucaguguugguuucucaggugaugcagacaugauagugugccuugucuaggauuccaggauacauuucugauaugugcuuuagagagauaguaaaaguccgggggauguggggguccuuuguuguuguugcuguugaauguucuguuugggcuucagguaagacuggcaauagguuucagcugaacaccacugggggucaccuggauacccuuagugcuuuaggagccaaacucccuguggucaaucagacacacagccagugaugcuggccuucgcuguuagcuguggucagcucccacuagucuaucucuguuuugaaaacucaggcuccuuucaggagcugugggcgggcccucugugugcaugagucaaccuuugggauaauaaccagacucuuucauccuggcuccccucuaaugugcugacgcgcacaccaucuuaaauaucaauaugcaauugugcuuuagaccaggauucugcugccgacucucuggauagaucccccugacgagcaaaagaagcuaugaacaaugaugaaagugcuauaguucucaugaggagggggugggguggguacagaggugcaaaucaccuccuucaagggaaggcccuguuucagaaauacauugggaagcucccaucaccaacagugugcagcccuaucuuaaacuggaugugaccaggaucagauagacuguaggcccagggcucacacgcacauuugaaugauggccuccaugauagccuccucucuucagaggucccaggaucagcagggagcugccuuggcaggaaggccgugaguagaccgcccucugugaaggcugcccucugaguucaugucugacuguccucgguggcuucuucguugaaauaagaacagguccaggcuguuauguacugugcuacugagguuagcacuccaggcugauuugguuucaaggguucuucaguaaagaaucuggaaagcacugguuuugugugacaaacugauugauagcugucugcgcuauaaaacccaccugguaucggucugaagcgggaaggaaccagauguuaacauggggcuguugcuuuacaguuuaauuuuaguuccuuaguugaauccuucaggagggagcauuguggggccuccuucccauucagaaagguaucuguguuuaaagacagaugauggaauuuacugggggaaaaaaaaguuuuggcggugugcagugguagaugggucagaggguaagaaugugugcugcucuugcagaagacccagguuuaguaccuaguacccaugcugagugaucgcaaucacauguaacucuagguuccgugggaucugacaucuccagccuugguaggcacgugcacugcgcgugcacacauaaacacacacacacacacauuuacacacauaauuaaaauaaaaguuuaaaaaauuagguagccuacaaaaugaugaaauucauuaugaaauuucagacauauauauuaucccuugcucuuauccaccucccccccacaacucuccccuccccugcuucucccucaugcaaguccucuucucccccgacuaccagauaaucccucuucuacagucuugccaucuucacguauaggcuauuuauacguguguguguguguguguguguguguguguguguguguguguauguguguguguguguguguguguguguguguguguaugugugugugugugugugugugugugugugugugugugugugugugugugugagaugggagagcagauuuaccucauucucacccuccacucuaccuuucagcacccuuccccaaguugagaucguuuuaaagagcacaugccugauacagaaagacaagcauagcauauuucucaaauauguaaaacacacacagagagaaugaaaguagaaggaguaugcuuuugaacugaagaugugugaaauauauaaguugggacuggagaugacacaguuaagaacacguacugcucuccgugaggaccaaaguuagguucccagccccucaguaggcagcucacaagugccuacaacuucagcucuagggagucucaugcccucuucuaggaucuguagauaaucuguugucaugugcauuuagauacacggguauacauagaacugaaaguaaaaucuguagaagcaugaugcugggaaauuauuucuuucuaguacucacagcacuacuugugguaaaggaggaggagaaauuauugccauaauuuaccugacaaagacccucaaauuguuuucucuugaaaugcacagcuagaaguuuucccagucaguauuggccacaugcuaguacugaguuuguuccagcuauuuagguaauauuuuucuucucuuccuuuuaauguuuuacuuuccuguuuguugucaggauuguugccuaauuuaguuuggaucaacgagaagaguccguugcgguugcuuguuauaacacauuuagagucgugaaucuaaagucagcuuucaaucaggaaggacuaguggaugcuuuaauggaaagauuaccacaaaguccccaccccuuugugauuuagauuccuugaauucaccucauuaauggcugagcauugaaucgaauaagguauuucuccgaguuuuaaacauugaaaauucaaggcaaaggccucuccuucuaucuucaaaugaaugagaaagccauccuaaaggaagauggcggccgaggugucauugcucugugucaccucuaucaaagagacugauuacacuguugauggugguucuccgggccaucacugucuugccucugcuucuuaagaauguauaaugcaguccaaccuuaagacaaauaggucaagcugcaaaacucugcgggaauaugagaaugagucucaaaauaauaaagcaguccaacuuggagaugcgauauacuuuauaaauaucuccugagagggaacacuguccaaggccuuuccauagcagccugccuugccaguccuauguauuucuagcugcuauuucuagaauguauuaggagccacugaugguugaucuuuuacugugguugacaggggaacauaugcauacacuguguucaucaauuuuuuuuuuuaaccucugguguacucugaaaaaaaauuguucuccuauggguuagaaaaauaauauuuuugaggauaucccaucugcagauaaagucauuggccauuucuggucuugucaaagauaaaaauaaaccauuuucaacuguauuaaauaccauacucgggcauaagggagaacacauuugucguguuucauuugucggcucagucugcacauuuagcacggcaauagcagugaacuucacggacagucaggcccacucuuucauguuuccuuccaguucuaaauugaaaauauuuuuuuugaaaagaacuaugacaaaagcaauuugaguuagugauaucuugaaagagaagccaauuucagaucaccuuuauggcuggucauuguuaccuacagcaggcagaugucauggugaucuucucgauauuaguauucugagagagucugaccugacaguguucaggugacaucacaaauggaacucuaauauugagauuucaaguuguagagcaaaagggccgcucguggaaauccagggcagacagaacuacuauuggcgagaaguguagccauuccccucaucuggcucuuguucuguauggugcacaagugugguuagcaaugaccacaugaugcuagaugacuaauuaaagcacgugcugagaauaaacuccccgguaacagagaauguaugaaaguguugcaaccacuguggcgacuuggcugauuuccaaccuguagcugccaguguugucuccaucucuucaucagagacccaccacccugguccuuccgagcugugcugugcauuuguaacaagguuggugauucaugggcacgcaacaccgaaagcucucacgagcccaagagaugacccugaaaggagaaauugugguucaaaaggaucaucugucuccgaaagugugauuuacugagacacccaccccuaccccgagccuuaaaaauaggaucuaaugacuagaucucuuccucuuucucucucugccuucugcucuuucucuucccccucagccuaacccuggagccagaaucaguccacggguucuguaagaaaccaugccacugugagucauacugcuucuuacagcaucauagcuguucuuucucucaaaacccuucuagacagauaacaaguguuggguuguuuucaugucucagaugaggaaccaaggcaaggggugcacugacacgcccaccuacuacagaagggugucggcgacacugcugagacuugugcucaagccuuuuguuuguggcuuauucccaacaaaccccuaaucagcgccucuggccuugucgguugguguguggcacccacaucugccauugcuggugcaucuguaacgguccgugaacuguacauucugccugugugugaucugagaagccaaucucauuuucaacucuacagaaaugaagugagaggccaaugugacuucuaagggaccaugcagugcauuucagagucaaaugugaauggcguuuaggucugccaugcuagcuccuccauauuagcguggcuuucucuucuucuaaauaacuaagagauaauuauucuuaagucccaguguccugccuacugccuucacaguacaccugcauuuucugaguauaccaucuugcgcuguguuaggcauuuaaauccaucuuggcacucuacucacugucauguuaguaguugcccuggggaauguucuggaucacauaggauacacuauugaacagaaauuaguuucuugaucccaguagaguaacagauccugaaacauuucagcaagauguauucuguaacuauugggaacuguacaccccgccugugucagaagcacaccacguaugauuuuauuuguggcuuaaucaacaggaagaaaugccaagcagcuuugacuagcuggcaguggaucuguuuguguuugcgguauuuucucucuaagacaccugcuggagaugagagccgccacaaacaccgaguggguauccagggcuucauuauagaggcuucucuaaugaucaaagaagccuuuuuauacaaucuuguuccugaucaugcagcugaacaucugucuaccugucuguccaccuuuuaauugcaucauccaggccucucugauccuagacagcucugucgaugcugcucugccucccaccauuucugaucauggcaaacacaaaauuucucacaaagcaaaaaaccaguaaaacagagugcuuucuaauaaauucgaacggagccauuuuauaagaaguuaauuuucgaucacauacccagugaaguccuugugcuaauuuauucuucaaagccaaacucuugcacagugaggaauguagcgcgcugugggaauacucaagguauuaggcacucaauucaggagaacuugguacuacuggcuuuucacaaucugcucaaaguugauuuguauuuucaacaggagggguguaauaauucaggaauuuaacucaaauuuuauucauuaauucauuugauaaauacuuagucacaucaaucuguuauguuuagggccaucugugugacuuaaaagugagauaccauacccaauguaaaaugaucuuuaauagaaaugaauugauugcgagaaucggacagauaguccuccaguagauagaaaacccaccuccacuuagggauaucaacaguggcucaaggauuagagcuuuauggcuauaaaaaacacaaaagcugaagggcuccucugcagugccgugagauaaagcauagaagcagaaaaucccacaucaugcccagaacaugguagcuguaaguuaguuugauuaaacuugaguagaggcagcgugagggaucgugcugcagauguggacugugguaugucuguggguaaagauguggcuucagcuuuagaggauauugagguuaauguggcuaugaugcaauaugaaaagcagugugggcuacagaaaagagagccuucaggcuauagaguggccacauagggaauauuccagcuauggcagggugaauacccugggaaguagggcaaagcgugacacucaaaaagagucauuucgaugguagagggaccaggaaaaaaggaagucacugauggagguagcuuuuguuauugacuugccuagcagucauugauguacauggaauuaggcaggacuuccuuuucaguauggauaggagagugggugaaguacaucagauguguaccccauuaauaguuaaauugauaccaucuggcgaaaugucucuaaacacaguguauuuauuagguaacaagccuugcugucuccuugagaugucaugugucuggagugagcagccucaucacuaguacacucuguuuaaucagucagaaauguuuacacccgucugagagucuucucucugcucucuuuauggggacagaaagaguaggaaacauaaaaccuaaauuaacuggagaugggaaaagggcugggaaagauaggagcucccauggcuccauggagggagcaugccuaggugggagugcucagccacuuguggaugcucugugaguuagagguagaugaggacagacugugaauguauccaaaugacagacacuuaauuacacuucgcaggauccaauccugaggccuccuuucucaaaugucgucccuggagagucccccaguuccuugugaggaagcuuuggugggugucccagagaucugagguaucuguuucuagagucuagaugccguguuucacaguggccugguuauuagucagagucuggggguguuuuuucccugcuucucugaguggagccaugguggauaccagaagccauuguaaauucccaauaugcugugcuucuaaaauaacucaaacuaucuuguuuucauuuucuuacauagcuauuuaaaugaauacuuuuacaggccuguuaaucuaaaggcugaguucuguuacagagcuuaaaacugggacuucaauaaauggaccgacuguauguuacaaacucaaaugugugaaaaauccugaaucuucucuuagguaaagcaguguuguacuaaaaucacagccaauaauauuauuaaguaaaggugcauuaaaaacugcuauaguaaucuccuaggcacaugacuccagcauauuguaacacuuuuuaugaugcuucaaaugaauaguucagcauuuggucagauaguaggauagaaaccaaagugccaguuggguuugguuguuuacagggugaagggcucuguagggcagaggagucaucuuuaaucuucuagcuguaaagaagucacuggaaauguugguuucuauucucccucuuuaauguuguuuucucacaguagcuuaagugaaggcuaauugcugcagcauuugguaaaugucauauauccuacuuuucuaaaggcagugaagcaguguaaacauguggcuucuuucuucaaaagauccaucccauaauuaucuugaaggcuauuacaauaugcaaauagcaagggccguccuugucuccuaaauuagaauaucaauauugauucaacaugugcaaaaagaaaacaacauuucugacaaauguuaauuccguuucaagauaggagagaaagcuccaguugucaagggguugguaagucccagguccaggccauugagugcacccaaauagcaccugccccugugguucccuccuuggcguggcaaugcacuugguucacaauacacaccacauaaggguagauuauuauuauuuuagaagaaacguuuucaucccugaauuauuaaucaucacuaauguaaaauauaguaagcgucugauuuggcccagccuccaaagaauguuaguugggagcuuguaaggaugugucgcucccgcuuugugacaggggaacugaggcacacagaauugacucccucagguuuguuuuguuuuguuuuguuuuuuuaaaucacuuccccuuguauauaagugaggagccugagacccuuaguguacauuaacuagauugcuugauguaagguaucagaaaugaacuuccucugcacgugaaccaauaaucuugcauguguuuguaugguaauauaaaauuaauguaaauauggcggccuuggaucugaucugcuaaucuccccaucugggugugccuguguguaucuggaaucucuuugacuuuacacuugaacaagguugucaguggcugcucagaaaccagugucucugcugccacacuaggucuuugaccccuccagcuguuguuucaguggggggcaagcaaacagaagacaggccuuguagucuucauuacuccuagaugagaaguuuuucaguugggucuguuugcccuagcuuucccauauacagcucacucucuaaugccacccaggccccucugaucucagaaaugccacggaagggcugcucugcugucucucagaauucuguuuccagcugaauuugucaggccaaauuuaaaagcgccaacaugcaauuaaauauucauuuuuaacuuuuuuuuuucuguucaccgcugcaagucgcaggcuuuccaagcauucucuggccguggaguacugcauaagcucuguuuuaguggagucauuucauacuccuuccuaagcccaaguaacaguaagggagauuuaguugggcauuuuggcaaagucacacuaauuuauaggcccuaucaggggaguauuauggaaguguguaaugauacuaucagagcugcauuuaauuccugaagaggaaggaaggccugcacaggagccccaaaucugcuguucucuuugugagugaaaggucacacugcugagcgcugcgggguggauuggugagaaaugagcucccguuugcuaggaauuagaaugagucuaucugauuuuccuucacucaugaccuuuaaagaugcagcuuuuagauugauaagcagguggaugcuuugaggaacccaaugcagaauuuguuucauaugaaaagacuaucuuugagacaccgaagauauugcuuccacaaagggcuuuuuuuuuccccuuuuccuuuuuuacaaagccucggaaggaagaaauucaaugauuuuaucuuaucacacaaaaagaaaauucagaauuacuguauguucauuuagaaugcccccucccagcguuaaucauugugugggacacacauccuccagugaaggaucuccaggacggcuugagagugggcacuccugcucuggguuuccugccacacgacacccagccuccuccgugcugauaaaaagagcuucccgcucguugcuauaguaauccuuucauguugggcacugcacuaucuugaaggcaaucagaggagaacaaggggugggggcaggauggaguuaaugucaggcagccgaaggugaucugugcuuuauauuuagagauguuuugguaugcugaagagagcaugccagucaacacaaaccagugcccacucugggcccaauuugaugcuuggcuguuuaaauauagcugcuucuuccuuuuuccuuuuuuuuuuuuuuuuuuuaacaguauguaugcauuucaacucagccuuacuuuggagauacguuugaaaucgcucacuucccguggccaugaagcccuggucccucucccucaucccuugauuucagauccuaauuacaucaucugucuuauuuguuccaguccccuccuuuucucuccuuaucucucagccaucaacuguacaagcccaucagcacagcccuuauuuugucaaguucuggugguuuacuggggcuucucuggggcuucuuuuucuuguuugauauucgucccugaucaaguacagcaggcccucaugccuuuccuguguacagcuuuuaauuuccuacucaaaaucacaaaugagguuaaaaaauucauuccucccacacagugcgccugauuuuuuuucuuuucuuuuuuuucuuuuuuuucuuuucuuuuuuuucuuuuuuuuuuuuuuuuuuuuuggagauguuuaggaaaagcagacauaaguagaguugcuuucgcucugucaggcuuccugcaguggucuauaacaagaaugcucagcucugcagaagccgcucccaugggccagaaagucuccucuaauuugaaaauauucuguuuucuguuguuauuguugcugcugcugcuguauuguuguuuguuuguugcuggguuauuuuaaagcccaccacaguagcuugcuguacagacuacagacaaacacuccagucugagguacccuggggccagcaaaaugacucagcagguucaagggcuugcuuccuucccauccuguucacccugaguucaauccccaggacaccauuuagugaaaggaaaaaaaaaaaacaacuccugaaggauguucucugacuuccauguguagcacacaaacgcacacacucucucugucacacacacacaaauuucagaggcagaacuucccaccauucggguagagggcugguagggcacacuaguaucccauucugacugggauguaacagaguccauugcaaacccauucagggcuggaagugauggggcacauguucucccagcacuccagagguagaggcaggccugccagcuccugaccaaucugggcuacuuaccauguagccaaacguugucucaagacaaaaaugucagcuucucauugucuccagcuacaugugacucaggugcugaguugcugcauguucuguagccacuguuuuggacaguacaggugcgugguagagaauaucuucccuaccccaggaggcucucuuacacaguuguguuccugcacauccacagaagaacaggagacucccucuccaucccuagacauguagaagcuuccucagcauccucaguucuucagcacgcaguaugaagaucuucugggaugguuguuuugaaagaaggucucaauauacaguacagucuugccugaaauuagcagcaauccuccugccucaaccuccaaggaauuauagccacuuuucccagcuuaagaaaagcugcuuuaaacaaguagcuuguugucaccuaggccuacccagaucagggaauaggccgacaccugugacugaggugaccucugggcuaucugggucgucugucucuuuuguagaaaagaaggccaagcugggaaaagugagccauuuccuauuguucauucacucuuuccgccuauuaggcccugcgaggcuauugcagugacgguaacuaaaauuuuauagcuaguguaagagacaaaggucagacagugacagcaaagccuuguaagugccaagcuguaggcaugcaugagcucuacaggagucaggaagaaacggaaccugacucccgagagaugacgaugaaguagagaaacaaaggaaacucaccagaggacucuaagcuccgcuaguccagugguuuugucuucucugucuuccaugugccuucuucauuguaaacuaguuuaaacacaauggcuuuuauacaaacagauugguggcuguggauuacauaaaauaugcagucauaaaauucuugacauagaagagacuuacaguaguuuauuugaaagcuuaccauaaaacaugguuguuuuucucucccgccuccuaguguucuagaggggagacuuauuucaucucacuccaccugugaguuccuagaugcuaagccauccucucucuggcagcaucucuugcccuggcuguagcuggcuuccuugcuguuccuggcacacaccaaagucauucuuccucuuaggcccuuguucgaaugcucauuugccuagaacgaagcauacuugcucccagcuguccaccugacugucucauuccagucuuccagcucuaucuaccaggaugcuguguccuuacacaugcuugccaacugcucugugugaacuaccagccugcucacacucccccccaucuccacucuaccugcagugcuuuucaaagcuaccauggucuguguugucacaguugcgguugauucccauuucuggaaugcaagcucucugaaccagaacuuggacuuguuuauggucuuauauccaugaccuugaagaauacccagugugguaggucucaggucauugguaaggauugggucuguucugucucuaugcagaggaaugauuagauuugccauucuagugauguaguucacuguuccucuugaaaagauaauugggauuuggaucuuagagcauugugucauucucuguggccuaaccuuagagagcacccucaccuuuacagagccaccuuaccauucuuccagccgcugguuugcugcccacuggaugcccgagaugucuacacugcacuggguuugccauuucucccugguuggauacagcauacucugucucugggaccaaugucauggcagucucauaggacuguccugguuuucugaacuuugccccuuuguuauuuguuuuucuaaauuuaaacuaggucccuuccaucacuucucggccauuuaccuaugaucaaguauaaauaagccagucccacgugagcuugcuuuucuucuuucccucucauccuuucuucuguccuuucuucuucccccuuuccuuccucucuuccuucugucugucguaacuuucauuagaauaggaagaacuaguaaugggaucaucccuguagauccaguaucuccagccuccugccuccuuguuuucugagcuggaagaucaacauaaaaucccaagaagaaaagccuuguuucaagauuccagcuccucccuuuguggagugccauucguuaacuuagccagcacacugucacugccucucuuuggcauuuuggucuucagucuaacuaagagccaaaaggcaagacaauauuucagagaggcaacgauuaggagaaggggucugggagagaacuacuucucuuuuauugaucuugugaaaauuguuugaagaaugauucagcauuuuggggucuaaaaauaacagcuuggaguggcuuuucaauuagggggauauacuuucucugaaagguucuguugauccuuaaauggacucucccuccuuccuuccaaggcucuuuaaugaguggugaugugacaggagggacagcaaccucccugacacccuuacuuuccuucccucucugucuaggaggcugaggcuccaacagagcugaugggcaaaauuguugcuuaguugggaaaagguaguuuuauuaagacuggcaccaucagagcauaaugaguuggauuccaccagaaugcauguuuuaucccacuuagcuuuugucucaaccaggaauuccacauggccaccacuggcuuugaaucgacauuugcagguacauggacauaggaccaaaguccagacugccaucuuuaauaauaagagucuugcuucaagauucucuuaguagucgggucacuguguuuaaauuacuuuuaaaaugcauauaauguugaguauugcauauaagcugaacacuccugaccuuggcaaaauggcuauagguguuuagugaccuaaggaaaguaggauuugguuuguuacuuggcuguggagguguuggucugcaggaaaggguuauaauauaacccuguguuagcucuuggugacuauauaguauaucgaaugagcaaacuugucuaguugcaaaauaaacuuuucaguagucuaguaacagauuuuaaguuuacucacaaagaaaagcuuuuuauacauaucucaaaugucagaaggccagcuggagauguggggacagcuaguggagccauggggacagcuaguggaggcauggggacagcuaguggagcugugggguggaucauggguuuugguuguuguucugcuuuugguuuugguuuuuccugaugcucuugacccgaaucugugacguuagagaucacaugugcugcucucuuguaaauugccucuuuucuccuuacuagaauguuuucuauaauaaccauauaaaugaaagauacagaggccaugagacaugaaccagcaccuaugcagucacuacaucggagcagauguugggugucaaggcugguacugaguucugggcagcucugaugaguaacagggacucagcacugcagagugcuggugacuagagacuugcagaggcccagagggaggggcuucucuaacugcugaguccugagggcacuuccccaacaaccuacaugcugugcucuuguauaaauuuuugcucuuguauuuuauuuuucuuugcucauuugucaguuaaaaggugagacuauuaaccccauuucauauuuuugauccuuccguuccagauaaaauauguggaaacaugcaagucacuuagugagugaagcucuuccucauauguccauccaaaguuauguauucuacccaccugccaucaccaaugcuaugcuuguagcucccuaccagugaccucauaugucaccccucacccucuaggugacauuaagccagcugggaaacucauugcuucaguuuccuccccuguaaaaagaagcuaggaauacugccaccuuguugggcuauccaugaggacauagcaacuaagcaucccacguguaucagacagucccuaagagucaggugguacaacacguguuacgauauaugaaugaagcugcuuucucaccuuuaacauuauaaauugcauucacaauagucuuugcuguuaauuacagugaguucuaugguguuugaucugaugguaaacccgcaagguaagaugauccucuccugagccucuggacugcauaaaucaggggguugccaguuugguuucugaugccuuggcauugacugaucaacauuugguucauuggugagcauuuaagaaccaccagugagagcacaagaaauuagcaauccuucauacugucaggaagcauugagauugagcugucaggggccgagggugaaugcuucauuggacugagccacccaauugcuuggguucuuugucuuucuuggcguucuuggacagaguccauugaacuaggaagcaaggacuuuggucauuccauuuaauagaaaugaacuuaaaaaauccagggcuaaccacuuagacauauuaaaaauaggagaacauuaguuauugauuaaacgccuuuaaauauaaaucagaacaguacugaggcacaaaguaguauagaccgucaacuuucauguacaacguuaaccaugcuuuuugagaguuagaaaaaaaauucuuuuuuuuuuuuuuuuuuuuuuuuuaauucaucaccauggcuguauuuaugagguacaggggcagaagugacagaagaaaaugagaaauggaacauuuggagugcacuuaguaacaaaaaccuaaacuuuugugacuguguuuuauuguuguguugguucuuuuuuuuuuuuucuuucuuucuuucuuauuuuuuacucuguuuuccuuuauguuuaaacaagccuuguuugacugacucuaaccuuuaaguaauugggaagcgggaggagggagauugacauuaacaucuguugaaagauggagagaaggagcaguauucagccaguuggucagacaauuguccccucuuuugcugcguagaaauuacuuuuguguagaaacgacuucuccuuaacuggcagcauugucaguuagugguauuaaaugacucacaucgcuuccuauuguuaauaaugagucaacucuuggcccugacacaguugacccauuucuaggaguagaaagucgucuaacuacaaauacucugaccauccauguccacucuacugcugcuuccugcucuaagacaugcauggggcauucugugcuuggcacccuccaggcaguuuggcagcuucgcaugguggaacagcuuuucugucucagcaacuuucugaccuuucaaaacuuaaccaagaugcagccccuucauucuccuauugcauucgguccaggucgguaaaugugcauuggguucuggguccuaagacaauggacugaaggauaauaggcauggcuugugcccucauaagacucugggaacuuggggauauaagcacugugauguuacucagcccucaguggauaguaaauacucuagagaugcaaucuaaguugaucucagugcauccccccauccccacccccaguuucuucucuugccuuugcagauggaugguuucaucucucuacuucuuugaugucauccauaaagcuggccuguuacccuggcuuaugggucaugaacucuagcuacuguuaggugcuauccucuggcucuccacuccugaacagucagccaccugucuuccuccacccuguccuuguuucucuaggcccccaucaguucccccaguuauccucagauucuccaggcucagaccuaccaucuucuccuccucaugggucuauacugcuuucagcuuucuggucucuuuuccuaaugagggcggaguauaauuuagaggcuuaauuuuagagaacuauaugaagcagcagacccauaaaacguuaugauucaugaccacuuguuuuguucucguaaugcaaccuaaacuaaaacgccauucaucaaagcuauaaaagccguucguggcugucuuuaguauaucguguagaauguaauucaguccacagagaggcaagagauggauucauggggucauuugccuuggugugcauuaaagggcaguaauuucuaagcuaggcagaagacccuuuuuuacuacaaguccugcacucuuccuuaaccccucuugguucgucuugccaucuuaauaucaacauggucauucuuauauacaaacuuucuuuauugauagauaauuucaaaguaccugcuucucuucucccucaugaccuuucugaucuugguggucuucaucugugcaggacauuggcauaugaagggguguuagcuaaaagcccaggcauagauugcauaaguaauaucuuggucaucugucacuuagaauaauacuuuaggagaggcacugcuucucccuucucugcuccccagagggaaaauuaccaacauuuuucuuggagugaaggaacacagccuugggcagccucagcuguuuuccuauagcauuauaauuagaaaucgguagugguaguuaaccuacgugguuaacaaugcuauccucaaagggugaggugucucugguauuguaauuuguguuugaauacugaggucugcgcuuuugcauuuucucauacuugugucuguaggucaucaugcauuaggaaucacauaggagauccuauuucagaagugaagccuaaagccauaguauagaucaaccauuguuugagcccugcauaagacagcuugccagcuuugcacuucccucauuuggaacauaaguuagucaauguccuguaaggcuccugggaagauaauaugagaaaaaucuauguaaucuaucacuucacuaguuagcuccugcuaauuggaaauaauuccuugaaaauuaggacuuguuauuaagagucuauaaugaugacaaugaugcggcugaugaugaagagcgcuugcagaguccagauaaacugaagggucucaguuagagcugcagggugggugacucggacgaaugagucacucuguaaaacuagcccaggcgcuuuuguaaauagacguacaccuuaaaaacgaaccagguauuuaaccccaugauuaagcauuagcuaccuggcauuuugucuuuuugguuugcuguuaaauacagcaucaugacuuugaacuuaccuucugcgcauugguuguucagcugagaagucgauucuuuccuguaugaagaaauaaacuuuguuucaccauaaacugcugcaguuggagaucagcucacauauucccacuuagggcgccccuuguacugcuuauuucccuggaucccaacauccaucuuuuuuagcagacuuguuguuuuguuuuguuuugaaaccccugugaaacuaaaugauuuccuugaagaacaagcuucguuguuuggcagaugaaaccagcagugcccauuaggaaucuuaagcugaauaaguuuucaaaugcuuaacaacuuugagcauaauuuacgcuaggaaauagguuaaaaugguuugagaauuguuuugaaaauaucaucgccguccuuuuaaaaaaaaagucuucccauucaagauauaaaaauagcauuuaugaggauauucucuucaagugcagagccugagagcagacuaucuucuagaauuaagcuuuugcuuuuggcugaauuaauguucccauuauauuuucucuugagaguucuuaggccuuuucuauaacuacaaaaggccugucuccagugcuccacaaauauaaaacauaaauauauauuuucuuccauauguauuugugugaauguugguggucaugguuuaugugugugcauguuugugcggaggggugugcaugggugucccagaaguuaaggccaggcauuaguccucaguagcuaucugucuugugcuugagauagggucuagguggccuggggcucucuaaucagggaugcacguuggccagugacuugcccugagguuauuagugacaccaugcccauacauucuucuguguauauucuagggauugaacucagguccuccugcuugcagagcaaauacuuuacaacugaaucauccuccaguccccaaagaagugccuuacuucucuucagaauagccuaucacagcucugaucgaaggucuucuaugacacguggcuauagaaaggcgaaggcaguagaucuagccuauuauuuuguuuauuuguuguuuguuugucgcuucuguugcccuuuuccauaaagagagaaacacauugugucuugaacuugcauggguuuccccaauccucugggaauccaagccauuuauagcuaacaucaggucaaggccaaagaggccauggccuccugcaguugucauuagugagcucuuauuucucuuccauagagaagcugaaauugacaaacugucuagggagaugcgcugcucucugcugccuguuuuuaagcaggacgcauuaaggauaaguuacuugucaaggcagaauucuucaucauuaaucaccgagagaccacauuccuagguaaauaagcuccuugauaaagccacaucuugcuagaaaauaucccuucuugacaccuuccugccugccagccuggucacagugugcuacccacucagaacaggcugccucuucuaguugagauagggguggugcggugcagaucugugaggaucugagccuuggaggcuaugagaggccugcuuugauaaguaugaaugaguguccguguauuaagcaugguaugcuuuuuuuuuuuuuccccaucucugugccgacagggacuauauucccuaucagaguaaaguuuguucugugaggcugaugauucacccccuguuucguuucuuuuccugccuucucauccagugguugcauuauguacgaauucuagcaguuuucuucguuucaaguaaagcucuucugagaugcgaacaauaaaaaucauauuuuuauaagccuucuuggaagaagaccgugcgaauuccauuuuaguggaaaaggacauuccauuuuuugaucauguuaaugucuacucccaagcagugcugggagggugggugaccaccugcacagaaucucagaaaaaguggccuauauguucccauagucuugauaugcaugacuccugugcccacuaccccaucucaguugcuucucuuguuuuguaaccuugaaggcagaagcaaccuaggcaugaauguagcucacccaccauugacuagauagcaacuguguuacuaaccccagccuacaguuaacuggauuggauccaguggcuucauugcaguguggucaaguccccugucccuuuaugaaaaggagguuaguuuugugcagccauucaguaugcaagucacaugcucauucuaggguauauugcugcaugagagcuugguaggaacuaaauauuuuagauguagaaagggauauuguucuaauuaaacugagugugaugcccauggcaaaauaugugcuuaauauauuggaguacaugugggaaaauuacauguguuuucaccaguuggcuccuccccacuuauauccuugcugggggcuauuuggauauugguuaccauaggagaauuauuuucuuacuaaucugggcugcacaguaaaugcgggggaaccauaaguuccacugauccuuaagggcauaaaguuggauagguagggaagugaggaccuggagagaguuaggagugggagaaaccaugaucaaaauauaguucaugauuuuucuuucuuuuugucuuagucgcuguucuauugcugugagaggaugccaugaccagggcaacucuuauaagagaaggcauuuaauuggaacuuucuuacaguuuccgaguuuaguccauugucaugguggggagcauggcagcacacaggcagacguggugcuggcaaaguagcugagaguucuacaucuggaucaucaggcagaaagaagaagaaagauacuaggccugaauugggcuuuuaaaaccucaaagccuaccccaguacuucucuaccaaagccacaccuacaccaacaaggccacaccuauaccagcaagguuacaccuauacaaacaaggccacaccuauaccaacaaggccauaccuccuaauccuucuccuuggugauggaaacauucaaauauaaagggggggggcauucuuuuucaaaccauuacacaauuaaaggaaaucuuucucuuagaaagaauggaaaaagcuaguauuugacucuuguaauccagaauuccugguacaaaccccugcauucuuagcugguuaucauuuuaggaagaaaagcaaucgcugccucuucaccucuuagcucagguacgacugcacuguuacacacucuuugagucgacuguacuguuacccacuauuugaguccuuguauggaucaaccauccuagcccacuuccuucaucggcagagccugccccuccagacucggucuucauuccacugccucucaccauuuggcuuucccccaggcugucucagcugccuuuguauucaugucuaccagguccagacagcauugcccucuuacccaugcuccaguagccucccauccuggguaaugcaguccuugguuuauaguuggguugcacaugaucucucucuaccuuguucuuccaugcucauucuucagcaucuacagaaugaagucuuuuucucagcccaccauucagagccucucucaucuuagcaucuucuaccccauucauagguauucauguaaucuguaucauaucuguccuacaucuuaguuuacugaagaccuugcucauuugcccuaugaaauccaagauagcuagugcacaugcuugccuuuuuaaaaccuguuuaugucuacuucauauaauuacaauaaauuaugaccacuauuaauuucagcuaacaucuacugaaucuguauuauaugaccauuacuauuuaaauccuuuacauaguuccccugucacauuuuagcucaugugacacccauccuuccuuuuguuaucguuuccauuuauaacagugcacauagaauucaaaggguagaagagagcaugccuaugcaacauaaucagacacagcuucauggccacccacagggucuaggagagagggaauucauuauagagaugggcggcugucuauagggguuugagaauguggcugggagggaaugagagucacugagcagauagagagauaugggggcacuauaagcauggggacagcggcagcagacacuggugacaggagcacauccucugagucauggaaggagagaaacauggcuuaguuuggguuuucagcauucaguguaguaaccugugaucaaaguguaguauaaagaauaguugagccucuguacuucucugcaauagagauuccugugagccaggcuuaagcaugauagcuuacaggacauagaggggggccgugggguauaggggggacucucagucacucucuuucccagcucgaccuugguaaccacacuguuuuacucucuggcuagaaacaguauaaacugaagcgguccuggcucguccaggauccacaucugcuuaaguccucggucugcucuuagcagacuguagcacuacugugagcagucucaguaguagaguuuucugaagauucuuuucuuaucaaauuaagggagaaagcaugccuugcucuuuagcacgugcucuaagcccaguguauuuugucaggcccugguuuucgucaagucucgguagcagcauuagagccccauggcugauugcaagcuuuggggugucagucauuucuacauaaugaucccaacaggugaaucaaaacagaaaccuaacagggcaaaagaugucucugcagcagaucuuccggugggacauuguauugcuagucagcaguaugucccugucuacucaagcuggcuauuggcuaccaacugugagauguucccuugcugacaagccccccccaauucuguacuuugcccucaggcuggcaauuuacugcaugcaaucucguugagaaaauguggucuuuauuaguguucggcacagaucgacuuugcuuugucuggaucugcagagcuaguuggaugcuuggugcugggaaagagggaaaaaaaugaaaccaaaacaaaacgggacagaugacaguaugaggacaggaggagagguguuuucagauauuaagaaucagagugcuggccuuguguagagaaagacgcaagcuggaugaguagaaauagcuagaaacaggucauuaaacccacagacugggcacauucugaucgacaacuaaucuucaaagaaaugcucuugacaauagaagugcgguaugcugguuucuacauacggaaaaaaaaagaaauaaauaaacacccuuaaauggaaaaggcaguucuugcccuccagacgucgauaccuccccuaucacgacaggugugugcaacuuucuguacauuuccugugucacugugagcagauaugcacauauucuugugucuauuuuccccucugucucuucuuagcuuugucuguugacuuggcuccaucuuccuggucuaauguauucuaccgagggauuugggaguggcaaagccccagcuccuccuucuccaucucccauaugcugucucuguaacaagugcccacauguguggcuucuucgccuccugauccugcuggugccuauuguucuaagcaguucuuaaguucauagaugcccccgagucgcuuuuuaagcacaaacacaaaugccuugccaguagaaauuaaaugccagaguguagguaacaaauauaaaucauagucauuuaaaguagucauuuuguaaagaacucgagaaagcuagccugggcauuaaauauucacugcccaccuccucugaaauggugaaacagcuucauuuuuuaacgauggguaauaauaagacacaucaaguuuaaauaaccuuccuucuucucucccuccuuccaaagcuaugacuuggcaagcuugaaauuaaacacaaguaagggugauaacuagacugccacuaacuggucgugggcuagacucuccucugcuguuuucuggaugcucuguggcuauuugaagagacuguucaauuggaaauugcugcuaaugggaucagcuugaauuuaaagaaaaaauagaucucuguuagugaaaacaaguaauguggacccuuaaguagcaagugugugauuauccucuaaugcauucugauuugucucccuauuaagucucacugcguccucuuggaauaguuaaaacaaaccuuuaagugaauguauacccacucccuccucccugcacaacacccuagauucaacugcacuuucccuguccucaaacaaguuacaugcaaauacaagggugggaucaaagagaaaauuauauauguugaauucauaucgcccuuugcuaucaaagagcuguauacaccuuuuaucuucagucuuacaugcaguaugcauuuacuugacagugaguuuucucuuuacaccauacauggaacauacugaggcaguguuuccuauggucacauccuaaagcguauguaucuguccucugaugggaagaagcuugcugugucugggacucucuagagaguguggagucagguaagaccugcucagaaaacagaagcuaagcuaggaucuggaaaaugaguuggaauugggcaggcagcaagagguaagcaggaagugugugaggggugauuugcaaugcacauggagaugagaguacgcuagccaucagggaacugaaggcacagcgaggugccacaggugcugcugguucugggcagugaugccacauggaagugacuggugggacugaccaaccagguuucccucccuguuugcuuuguaguucucucuugagcugguuaagaaaaugacagaccauuuauagugguugaaauguaaccuuagcugaaggguaaacuuacuucagcuggaaagguuuauggggacagagggucuggagucaaauuucugggaaaggguuuuagagaggagcugggauucaagggacagucaagacagagaccaaggaagagggcuauuuguaguggaaccaggucagaucuggagguaagcaccagcucugcgcuucccugggcagcguccccaccuagugcugguguuuauagaugccucaagcauccagagaaagguauaggaauugcacaaaaugaaacuggcucuggugaccccgcccucgcagcccuucaggagaugguugcuagacuuccagauuuuccagguacuguuuuugucuuuuaacucuuacaauuuuuaggugcuacaaaggacaggagagacuccgacgacagacacaggccaauggcauuauugcccuggaccauugucaaaauuuuguauuaacaaguugugugagguagaaauggggacgagggaagacagagacuuuuuaagcccagccauuuuguuuuucaagggacaaaucucccugggcgauaacuaccagauugauguggguagugaaacggcacucagagaggagagcuguuaacacagugugcuggcagagccucgugcucgugcuuaagcaccugcgcuguucugugacucagagcaagaaauacgaaacaaacccccgucgucaaacgggaaccuggcaggaauagucccuggguuuccauuugaacagaacuccauuaagagauuaccaagaagcaccaaggcuguggcugaauaagcaauugaaacccaacccuaaagcucaucuagaugaauucacacggcccucgcucugcagaggguggcugggauuaugcgcaccuuauguugguguuuaaaagcaugggguuggagguauggggaagaaaauaggccuugaagccccaccaaaauguucuguagcuggguccuuuccuagaagagagaaugccuucuaccacguggggaugagaccccagaccaccccuuuaccacgccaguguguuuaugguggcguuccuuuucauucauuucaaagaugcuauugaauuugucacaagccacagccaucucauucuuucuccaggcgauguuuuuuugauaaauguugaugaguuuauaacuguaaaaccaaaugacauuucuagugugauacacgauuuacuucuugcauaauuauaucuaauggcuuugcguguagaaaggcauuuaccauuuacuuuuguguaaaaugacaaucuaaacccccaggccugaguuuuuaaauuuuuuuuuuuacacaaagauaaagacuuaauuaaaaaccaaacacaauuuauuuuuguaaccagcauuuaagguaccuaguccuuugguuaaauaugugauaaaaaucacaaugcuuucaguagcaaagaucagugaguuucauuuucccucugucuuugaaacacugucgaacccauuuaauuaucaaacugauauccaggauggcuucuuguuucucauuucuaguuaaaagagcuuuuuugaaauuuagcagagaauugaauaauguguucaguuaaugaggaacauuuaagagauguuucugaauucagugugauagcccgaugauaaaccaccaccacagugcaggcagacugucuaagcagcaacgacauuguaguccauugacugugggcaagcuuagcuuaguuuuauuuuccuuuuuuuuuuuuuuccuguuuugguuuuauauccuggcuauucuaguaugugguguagaaauguccuuuauauauuuugagguguuuauugucauaaaguagauggcuuccuagagaaaaacaguucuguucuuuagccuuccuugugggagauagagccuuauagucugguaaggccgacgcaugcucagacagacagacagacagacagcugggugacuuuccagacagaagccugcuguggcuccaggucuacuacuggcuaguaucagugagaaguucaaguucucucuuuccacaggaaaagguccugaugcuguuucuuuauugaggaaauagacuaggcaguuggagagacagguccacguguaagagcacuggcugcucuugcagaggaccuggguuugaguccuaguacccacagagcaguucaaaacugccuguaacuccagucccaggagacccuacauacuuuucuggccuccaaggucacuguaaacacauggugcaugaacacacauguacacaaaacgcccauaaaugaaagaaugaacaaauuccuuaagaaagaaaggagagagaacuaaaucuaauuagucucuucuaugggacuuaaaagaauguucuuauuuucugcuucaauauuucucagaaacucuuauugaauacuugucagcaucauggggucucuccuuuucacauugauacuaggaagcagcauuugcugaauuuuuuggaguuaaugguuugguuugguuuggggguuuguauuuaaggcuaagcuauggcauuauacguucacacaaguacuauuaaguggcuuuuuuugagacauggucucacuguguaguucaggcuagccuccaagccuucugcucuuggccuccuacuccuagccacagccuuacaccaucacagcagacuccugguuuuguucgucugguuuuaaggggugugugggcauugcuagugaucaaacuaagggucccagacuugauagauaaauucucgacgacucugcuaccucugccucuuacuccuaaguggauggaauuguggccaccugaccaaaucccaaagccaaggaagcuauugguaaggaagaaaaaauuagggaagaggagcagggaaacuguuuaucauaguaagcacacaaacagggguagguaguuaucugacaccugagcugggcuucaaaauuuggagaaacgcugcagccaaaucuaauucguggguuuugagguaugagagaugugaggagugcacagacuuauaauuaaaaugcuagggggagccuccagcuuguaucucaggucgggguuuuaauaaugcaucugugaacugccuucuauugccuuuaacaaaaucaugcagccauagucacugcaaguuucuuuuuaaaaaucuauaacgaaccaguguguaugugugugugugugugggggggugauguuaaacuaacauuuaagaccuuucagaaggccuucagaauuuauuggaggaaggcacagagucacuuucuauggaagaguggcuaggaagaagcauuuucaugcucuuaggcugcgacaggugguauagauuaauguugaauacauacagaaucuauugagacuaauuaaagaugcauauccacauggaauaccacaucucagugguucuuuggcagccagucuaaccagcacauggaauguuuauaccaagcauuuuucaaaauuagccaagaaugguagcagugaaacuccucaaaacugcccuaaaagaauucuuaguuucuucguguuauagagaauccccugagagucucugccucugaacaguacuccucggacuagaaaagguuauaaagucugcucaccucugauaauacagugauaugcagcagcccuuaaaauacuacauggcgguacaaaaccauggcugacuguauccagaucuuauaugcagaacucaguuuagcaacuuagcauugacuuguaagaagguauccaggaccuuuccuuccuaggagggcauccaucucucacccaaggaggugagauggaagggccugucacuggagcuucacucaggagaccgaauuagcacauuggcuccuagcccuccaucccuuccccagguugacugaauacccuuuggugaguagaauguuucucaccaaugcuaaugagcaguucacuuugacacuguacacaaacacaaucuggugguugcguucagauguuuuuccuuccugcuaaugaauaaacucccaguggcucacaguuagcugagguaagcagugacucgagguguaccccccaaaaugauuuauuaacugccauaaauggaaugagcuggauuuuagagaaaguacaggguugucuugaccucaaaaauccaggguaaaaagauaauuuuaaauaaaugagcuuaauacuuuuagagcauaucccauaccaaaguuuuuauuuaagaccaaggaugucacucagugguacagcaugugugaugaacauuguguagcccuggcuucaauccccaccaccauaauaaauaaauauguguguguauguguguguguguguguguguguguguguguguguguguguguguguguauguauaacuuugaaguggggauuguaaaguugagagucaggagaacauacgacauguaagaguuccugauucucaacuggcugaagaggugucaucuggcaguuuucuuuuuuaguaagcucugacuugagcuucacugggccgccagcuaccugcucuguaauaagaaagaggcaguuucuccauuccuuuuaagauuuuaaccaaaaaaagcaaauccuauagacuucaggaagaguguguauguagggugugggguguguucuggaagacgcgagaaggggcuucgagaacuuacaccaaagagauuaauauuuauagacaucagcauuggucucucaccagcauuuauaacccuagcaguggcagauugagggcugaaucaacguuuuccgccccucuguaaaauaauaaaugccguagaguagcucucagaacugccuuucucauagggauaaaucaggacaguuuguguugcaggagagacuuaaaacuuauaaauauguugcccuuuaggcuacuauucaucaaauugucugauaugaaaucuagacuaaaggcuuuuguuauugugugucugcguauucucuuuuagaaguauaaauuggaaagagcgcugucauuuuggucaugcuggccugcugugcuacuuaaaugcaugucccuuuugggaugaauuugaagagaaggaaauagugggaguugacgacugcacacuuuucuacagauccuuuuggucgccugaacuucccuagcagaaggcauaauuuccagcaggaaaaauacaguaaauaacugcuugacaaaugaccuauuuuacugcagccgacuuucuaagacacuggaguggaggcauuguuccuuacaggucccaucuggguucagagagaccccugcuuuucuccucaguccccagugcgagugggcccagccacagcucugcacagggccaguugagccaaggcuugugacagaugcugcaggucacguggcucuguaggucucagagcaucucaaaucucacucgacuuugcaguucugcagcugaaguuccuggcuucugugguuuggagucagaguugaagcucgagcgcuacccugugcuccccucggugccuuuagcuguugaauggcauaugguguguggaaucaccugcuguuaggaggcccccacagaguauguacuaagcaguuuuccuuucuaaagugugguacagcuccuaguuuuccagaauaacuaauugggagcauaaaccucacuuugcccuugaaugguuugcaauuuaggagaccugaauaaugaaaacggaggaccuaugaaagcagccaacaggcccugccgcagcucgaguguuuguuugcccaguuggucagggagagcuguugggggaucgcuacccugggaagaaauggcagcucuuaggagcuugcgugcuggugacuugggagcaucuugagagucguuaccacuugaggucuguaucuugccaugucaaguuauacaggaacaagacucaacccccugguugauucucuuuagaauuggccugaaugccauuauguggccagaaaugcacuguuuguguucgggccgaggaaugauccuugggaguccagucucaggggccuggcaagguagagcacagccuugaaccagacagugcaaggaaacucaugcccagauauuuucaccucugguuggucagcacagccagcaggaacaagcugugucccaaauccuaccugcauguggcuucacagacugcggcccuggagcugugcuuguccugagccccacuuguccguuugagaugguggcaguuugacuugccaagucagauuucuuguacuugguacaagucagaaugcacaaccuuaucacugguaacugacucgaaagaggggcucagggacaggagagcacaggcuuucucuuuaucagaugccuuucaagccgcuccgcaugcgugugauggcuagcaccaugaugaagacugacaguuucaucaagaaagcaaggaagaaaaucugcagacaauaagugggggcugugguuggcccugcucuguuuacccuccauggugccuccuggacaucgagcggggagcuggggggacccuuccucaggacucccggcacuugguccuuucuuuugcugcccuuugugagccacaaggguaacuugaagacuuacugagugaaaagcucaggagaguuuauggacagaccuacugaguggugcugguagcaaccagguguggggguugggugggggguggcuggccuugccuugcaugaacaaacugccagcuuugcucagccucucguccuccucugcagcugaaauccaucucaaacugcaaauaucuuagcaaagugcgcagaccagagaagcucaaguguagaaaucaagccugaauuuauagacacagaacuucucaguacuguuacccaucacuuauagcuacugacuuagcccccagucucuuuccugccccuaagauagcagcaagcaaggccaguggucugugagaucccauaccaugcuaaccgucccaggccacucaaaaaucccuucuuuccuugacuuagcagggaucaguagacgucauugguggcggcggaagggagcagcauggucuccagaagggaauccuguugcugacagucaucuucccuugagguuucagcucagcccaaugacccugucauaaugagauggugacguucaugaagccguuccuaaagcuccuuuuggaaaguguccuccaacguuaggcuccccacccagccucaccaucuccuaagcaucacauucuuuuauagaaacaaaggggagaauuggaugccucaggaaggagccuuugccaaagaaagcaauucuggguuaguuugugugguagccaaggaaauguaucgagcaggguagaacaugucuguuguucacagaaccuacauaaugcuucagaaaugugugauuuccaguguguguuaaaauaagaagugguuguuugauuuaucucccacaaugguaugguauucuucuucuaagaggcauuucauuugcaagccaggcacuguaaauuugaacugaauauguaaguaaauacuccguaaggagauggagugauggcuguccuuggcagagaagauguuauaagaaugaagcauuugguuuuggggaaagauucagcauuggaaguacauuagaauccagaggggucaagacaguuacugugccagccaagcaagcucaaaguuguccugagccauaauuauagauguccgccuacaaacagaguaguuuagguguuauagcucccauauuugcccucaagcacucagaaauacauuggagccauuaguugacuuugaacuucauuuuuggggacauugccuggcugcacggcagcuugguguguuacaguuuuuacuguggcaucucugcauggcagugacaaaggcagugacaguguuuuaucaaguccuaacaagauugccuccgugcauaauuguuaaacuaaagagcugucgauccacugauguggaacaggcgagaaacuuaaagaauagagaaaacccauaaucgcagaguaacuuguaucucugauuuauucugauuuauuauuuaucacaucacgguuaaaacaauuuccuacgguuuuguguauuuuuaauauuauuuugacauugaauuuucaccuaaugcaaaggaagguuucagcaacuuuuugagcauuuauauaugcagguaguuaggggggcggaaaucccuuuuuuauuaagauacaggaugcauguuuaucaaaauucaucucagauuccauuuagaaauagagauaucuugguuuugaaagagcuuacugagcugcgaagaaugacagauauuacugacagaacaaaguuacgaaugauaaaagagcccagcaaaugcguauccccgaguggcuauaaauuaaccagcagaagcaagagugcuguugguuggugggcauagagcaagcauuaaguugcugugcguaggagggaaugucuagugagcaucccuguagcuucuugccaaaguaucuagccacucaguagcccaauccugaaugguggcuggugugagagcccaccacucugcgggacuccugccaccagacagaauguagagccagagcccuaaaggagaccacaggcacagcagcugcacaguggguccugcagagaguccagcugagaaagucauacuuccuugaaaaaugaggggauguaaauguuagccuaggguuuggaaauguuaaauuuugccgcucugagcagagccugucaaaaccucucugaagaacaguuaccaaauaggaagacagagcuggcuaaugucaccuuuauuuuaagcacagcaacucuccccagaacaauggguacaguguagccauuugacagaucuugcuggugauaccuacugcauacuggauggagguggguaaggcccacccuuuccacaccuccagcucccagacuccaggaggccucagaaucaccuggaagacuuauucaaacagauugcagucuccacuucugugguaaccauaucagcagcgcgggaagggagccugugcauuuguguuugauauguuucuuuguggugggagccaggggugaucacuuggggacuuaguugagugacacgcauaccgaguuaguuuuauuggugcacaaacuauucuaagagaagauuuggacuuuacaucaaaagauaaggguuuuucuccuccugauucuuccuuuccaucuuccucuggaagaagccugugauccuccagcuauaaacacaucauccuagacagccugugcaugcagcacuuggggcacagagagggccaggagcaggugagaauauuagacacugacgcuggaagugcucuucuugaggguagagacagaacugaaaggccaagugaugaaaaucaagagagcaagcauucacuggcuauggcccugggguugagccagcccucagcauaagaaccuaaccucuccuccaccccuugcugccccugaacccaguuaaacaccuagauuacuucccucucugagguuuagguggagaguccccucccccaacuccuaagaaacgcaaauuuucagaaaccguauugaauuccuaaaaauagagugguagacuucugugguuuagcaaauaggcagagcagcucucugaggugugaucgggaagguguguggaagguggcaggccaucgagucuccucaguuucacaagcaagugucagcuaaugaauguucuuaauuuuucuuaacgcucacugacuuccccacacucuccuauguuuuccauguguacuguccuccaaagagauggagaaaucacuacuugccucuauggaauuccuuuucuggccaacaguagacuuucagccauauucccaccuagucaggcuaccucuuguuuuuaaaugugaaagcuggguaagaaaggcaaucauuagcauaacauuucuggaaccuucagaagcucagcacagucauugucucuuuuaacccccaaaucagccaucuggagccauucuuaaagucucauagaugacaagaugggggugaaguuagagaauugacucaaggucauagagccaugcaagucgaaccaggguuuaagcuuaccuccuucaacaccccguuaggguuccauuguuacugggaacagccuugccuaggagcccucaguaccucuagauaaaacugagggccugaaaaccuugguuuuacaaagccuguuugucugaugucucaagauaggguacaccuguccuuggucacuacaaugaaagacagagauggaagugacuguuuuagacuugaauaugcuaucccuuugucauagaaaggaaacauuuuuuuuugaauguuuguuuuuccuaauuguguguguuaaguaaagugauuggacaaacagcccucuccuccagccuggugaucugucauaaaucaaccuucagauguuaauaaaacaagucagggcugacaaaggaagcuccauuuguauuuucaacucccaauucaucaggguccccuccuucagaucuucugcgagaguguccuuggucuuaauguagcugcaagauaaaacgcagauaaaagagccauugucucagaagagcauuaauaaaaaaugaguguugauccuaauugaggaguauuuaaacauacggauggaagccggagucuguggggagcaucugagccuguuagaauuugacugucucgucuuccuccucuuacuacacugcccucacugugcagauaacuugugagacuguaagugucacagugaaaccagaaagugugugcaugugcgcgcgcgcgcgcguguguguguguguguguguguguguguguguguguacacuaucacaaauggccagcuugacagcucuuguucuuaugucuaaaaaugugcuauuuuccucuguccuuuccugaaguauucaacugccucaucgucuguuucccuucacaccguucgucuguuuauauuugucgcuaugaauuugguuuugaguuuccuuacaucuguuuggcuagauggaacagagcaagcuccuaggagccaaggguaggccagucugaauaauaaauaacaucaauagugaacuauaagccaaagaauaaaauaaacguccaggagucuacauuaguauaaauaaauuauugaauaaauaaauaaacgggagaaaagccucaucuucagaagaauuucaauuaaagacguaaaaggacuuuuuuuuccaagaauacgacuuggauuccauuguaauaauugcuaucugccagguccaucagugagugcuauauuauugagugcaaguguaaggagaugcaugguagguacacugcccaaguaucucccccuaaauguauauuaauuaauuacccagagguucugagguaugcauauagccacauucuuugaugcuacccccucugggagauggagcauaauuucuuucccgggaugugggcuuuaguaugugccauucuagccaggagauucaggcuaauaucaccaauaagaagacauuaguaucacacaggcuguuacgugacacagugccucuucacuccucuccagcuaagucugccaucccagucuaagcuggaaagaacacagaacaaacccaagcugacggugggugugcuaggccagacucaucagacugucagggucagucacguucauugcuuuguuugcucuguaaguaaauaaugucagccuugcggagggggccagggagagggucaggggaacuugcugcuugcaaguuuucacauccacaucuuaaaaaucuuaaaaauaaacugaaaaguaugacccgucaaaggcauaaaauagcuuaggcagaggagaaaaguggguccuaucuguccacucacuuccuuauuaguugguucauucagucguucauuuauugaaguaguuccugcaagacaccaccggccuccgcaacaguggccaagagaacaagcacgugaccuuccucagcacacccuccacagggccugcuuuggagaacacaucugauccaugccguaggcuucuccacgugcugaaauggggugggucaaggagugcuuccggaggcacccaggagacaaguucgccugguugguuaaagaccagguggcacugcagcaauuugccucuguggugugagccagucuugcucaaucccucguuucagguggucaguguugucugugagaaugcuauauucauuacuuauauucucaaguucauuucacucuaauaacuuccaaauacuuuaagaauaccauugaaauacuuccuguguacuucagguacugaagcugcugcaauguuagggguauuauuuuguuguuguuguuguuguuguuuguuuguuuguuuguuuguuuuguuuuccagaggaaucauuugggauuagaaucaugguuauuuagaauuuuguauggcaacagcaacgucuuaauguagauaacaacuaguuuuuaaaacaaguugacuaccaaauguaaauuauucuuguuagaguacaugaaaauuugaugcuaauucucuagcagaaaccaguacaaauauuuacauacaaagucuuuucacagucagccauugguggcucaugccuucagucccaguacuugggaggcagaaacaggauugucugugaguucaaggccagccuagucuacagagagaguuccaggccagccaaggcuauaaagagaaacugucucaaacaaacaaaaacaaaacagaaaacaaaaagaagccuuucacuacagcaauuugaggggggaaacuuaguaauuaucuaaacaugacaaaaaauggucucagaaaugucaauaugguaacacaggcauuaagauuaugagccaaauauguauacaaauacacagccauaugugaaaacaaggcuccacuaaaguaauuacaugagcagagguguugugagauauauuuguuuauuuuugagauagggucucauuagcgggccuuaaacuugagaccuuucugccucggccuucugaguacuaaaaugucagcuaugugccaccaugaaccaggaaacugaauguggaaccacauacaggcuaggcgagaucccugccacugagcaacacugcuagacuucccaaaacccuuugccuuuugagacagggucuuacaaaguuggccuugaagcaucuguauguguggcccaugcaaaccuggaacuaggcauucuccugccucacucuucugaguagcuguacuaaacgucuuugucaccagcccuggcugaaagguguccuuaaaagcaguguuagagaauuucuaguauauggcuugaaugauggcuaauacuguaauuaaaacaagaauccuucuagagcucugaaauucuagcuucagucaccuggugucauggaugauauuuccagacuaacugauuuuacaugcuguuucuugguacauuucuaaauauaucucugauggucuuccaggcuaaaguaugguaucccugagaaauguaauaacuucauggcaaggcauuuagcccgccaaauagcuccucucuccuugcuugcaaguuguacacuuugcaaagaacuuggcuuauguagcaaggaaguacacgguucucaaagguacugagaguuucauuaaaaauaccuggaaauccuuugcuugaaauuuguuucaaauugguaaauaccaagacucuguguauuccauucucauguaaccaucugaucuaacgugagcgacgcacacguaaugauucugaaugcuggagcuggccuaggccaucaggcacauggggaccaccugauaccaagcauuuaagagacaagucagugacagaccagacaguuccaggcucugccugccacacauuuuggacguacauggagcucuggagguuaaccugagacagggacaaagaggucagaacauggcaaaaagcaagaggguggagauggucaccagagaagagaugcuggggaaaaagucagacgcuggagcccuggcacaagacuagacccaugauaaaauaagguggagagaccuggggucaggauggcgagagggaguugccaugcacaggaguucuagggcuggucuugggggacauaauucuguacucuuagcagacaccccuccuuuuucacuuccuuuaggcuguauucagccauagcaagguguacuccugauguguucuguuuucuugaaagaaaaucaaaaaguugucuugcauggucuuuuaaaaauaguaacucacuauaucagucacaccugauggcgccauucccugggccgagcauagacaaaccaucacacuccccagaucggaacucuuccuaauugaaaucuggcugaaauaaaugaauagcauaaaugcaguuaccuguucuucuuagauugguuuugauacuugccuccaaaaaacucaaauaugagcuugauccugagaaaauagauaauacagauagagcuuuagccacaugacauuaccuccugguguccucaauaagggucaccagaaguaauguugcuccccaggccuucuucucagcaucucuauaucauaugaccucaaacugagaccacugagagucuggcaagccuggguucuggaguaggucaggaagcagagcaaguaccaccaagcaccguggaguucugucugaccugcucacggccucucauugagccuuguuuaccaugcuuuucuugugguuugugacagauaagagccauauugauucucagcaucugcuggcaguaaccuuugaaagggcaggcaaugcaucaccaccgaauuuuaucuaucaauaucggagucauagaaagacaggaauggcaucucaucacaacggcacuggcacaucauaaaucugagcugagacggggcuaguacuaggcaauagggaaaggggggacaugguuuaauauccagauaaugucaggaggacaggauagggcauucagaugaaaaggacaagacuuggcugcaggagaaguacuaaauggugauggucauggcacaggacccaaagauguucagcuuuacagccagugagugguagguccuccuuccagccuuagucuucucaucuauacaauuggcuugaccaugcucuacagaauugugaagguuugggggaaguuuguuugcucuaagagcauaggcccuucagcagcugccaucccccucacuuggaaacucuuuucucuuguauuucaauccuuuuacugggcugagacccagaagacaaauuacgagguaacccuaagacaaacacaagcucagguauacagucagucgguuccuggaacagagguagacuucaaaaagguagcauacaauugaugcuuugguauuucuguacuuuauuccaccaguaaugccaauaaucgauucuguggacaauccccucauuccucaagcauuuguauucacaaggaaucauaaaaggaauggagaaacuagugagaaaagcaaacaauuuugacauguaaacaaugucauaaaauuaaauacauugauuccuggaauagaaagaugguucagcaggcagagauguuugcugccgugucuagugcuuaauccauaggaccuccaugauggauggggaggacagauucccacuagauaucuucugacuacuacuugcaugcuguggcgugcuugcacacacgcccacgucuacacauguauguauucucuguauagauacuauauggauggauggauccauuaauuaaggaaaauguagcaaaauaaugugccugccaauucuuauacucgucugcacucucccggguggugaggcugaaggcuguguucucugugugcuugggacuucuuucgugcuuucgacaugccaggaagcuuccagccuggacagugaguagugcuacaauuucauaacuuaaguggagucugucugauucugcaaagaaacagccuuccuuuggggcccagaauacacagucccuucugcagcuacacucaugguauuuuuaaucauuccauguuuuuauuauaucuugaguacaaggugcuacaaagagucccuggugcuggcagucacucagaaaaaauugacaaaucuaaaaagugagcagaacagcaagucgcacauuagggauuuccuuuuucucuuuuucccccuuuucuuuuucuuuauuuaaaaaaaaagacuuuuuaaaaaagaaaaauuaccuuauaacauuggaaggguugaauuuggcaucuuauccaugaaaaguaguuguaauaaacuuccccaauuguuggugccuucucugcaaaaauuauggcugugcgcaagugugagguuuuaacuguuuccgugaagcucguaauucaggcucuaaaugugccgagccugacugcccagaaaccuaacgacuuuuuuaagagacuggaauucggaacauuauucucucugaaacugcacucugguaacccagcagaaaacugcucagagauccgcuccugcucuaguaaaggcaucugggcaugccaguggcuuacaaagaaaaugcugaaaucucuuguaugagagccaauuuguuagaggaaugaugugugagccgauugcaacugccccuuguaaggggaggggacauggacauggcaguggcgaugugcugcucccucaguaccaaguuaaacguauuaguaaacuaacauggaaccgacagagugacaggacagacguucccaaccugugcuucuuacuuuggguaacaucuuugcuuucaugggaaaugacauuuucuccggaaacaguaagaaugcuauuagccugcuugcaaggcacaguugcuccagcaguugagagcgggccagagguccaggacagucuguggauguucauuaagagguggugaaaaaaagugaagccauuguuuaucuuucuuuccccugagcauucuuccaccaggcucucugcagaccugauucuuugcugccuccagccgaacacucuuauuauuuuccuuaaacuucuguuuaugccguuaccuguauuuuugcagcaaauuuuaucugcuagguagagugaaaaggccugcuguaauagauacugucgcuuuuguuuuuguccucccuccaaaucauagaguuggauuucaucacuuguaacaaaccucagcagccucuucggguuuuguuuggggcugcuugcuuuguuuccugauuuacuggguuuugucuucacuggcuuaaugcucacaagcacagaacagacaggcaaaccaaauaagcaaaaauuuaacuaggguacugcagccugugaacugacaaacccacucugugugacagcgcugacuagaaguggguguuuuugcagcuaagugcacaauaaucuauuugcacuggucacaggcgguugcugggcaagggaaguuugcauaucuccaguguuagauaugugcagcuggaggacggaugguggauucugguaccuccugacuuggugaaugguccauaccaauuucucuucuuucauaucugcuuugcuuuuaaacaugucucuuccuggaaacugaccucacucgaucguggggauucccgacucucuguccagugaccuacuugagauauauuugguccuugaaacagggugucuaugugccuccuccugggaucugccuugccuuaagccaguggucucacguugccugugacaucuauuuaaggaaggaaugacagugacagcuguagcacuuuagccagagguucucaaacccacauggcccuagucucuuguuaaaaugcagguccugacugauacuacugguaugaguuuggauuuauguauguuuugcagucauggagacauuauuaauauugcuggugggccacaccgaagacauaagacaccagaagggaaggaagcuggacugucucacugcauuuagauauaaauggauacuacagaaagcaaaucgcaucucguggcuccucaccccauauccaugaauaucuacaagggcagcacaaaccaggcuuagcggguuauuuaaagaagagggggacaugaaauugacaagguggguucagggagagucaaguguauauacuuguaugaaauucucaauaaaaaguauuauauuuaaagacaucugagucauuacugcaaguguugagaagugugugucauuugucuucugacuuccuuucuaucaguguagccuggcuggccuagaacucccuuguagaacaggcuagucucaaacucagagauccacccgccucuggccccaagugcugggagugaacgaugcgccaccacacccagcucucggaccacuguagaguuagcuccuugcugaucuuuccuuaaggugguaacuggcauugagcugugugauuaaugagaaccaagcaaagggccacugagcccuuuugcugaguugcccucaugccuguccucuauagaccugucagucugcccuguuucucagagcccaucucuacuuucuguuccucauuccuguccuaggucuuaccagccuuccauagccgguaucucauacaacucugccuucuugcaaucccccuuccucuccuuagaaaacaucuuccaguccaggugugaucguaucacucccuggauccaaaucacucccuggcucuguauuaauuacaaggugaaauauaaacugccuagccuaccagaugauagccuuccuuaaucagccuaugaccucuguggaaaacauccccugugcucucucuucuggacacuagagccgucacagaguuucaaauaagccagggucuucucaaacauucccucuccacucaugcgagcugggccugcagcucucugaucacuuuggggggugggggggugggaaacgucagucagucugucuuccuugaagcauugcugugcugaauaaauacaccaaaaagaccugcuugcuuucuaaccuuguaaacauccuugauuuauuuuuauuuuagaauauucuauuguaaaucauuucaaaaacaaaacuuauauaggaauccuuuucaaaguuuuaauucaaaaccuauguggcacuuaaauauauuugaaaauguuugaacacuacauggacuaauuucuaaaauugagaguguccagaccaugugaaauccuaagacucucagucaauaaccuaccucagcguuggccaauuccugagcaccugccauauauggugacacugugcuggauuuuagggauucaaagaaaaauaagaugacaguaaaaauacuuaaaguaacaacacagguaaauaauuaaaguuuuuauuugaagauacacaggaauaaagagcuuaacauaauuaaaauaacaguaaguaauuuugggucuguacaacucacauuaaguucgcugcucuaucaauccauugauuuggcucaaauccacugauucucaacauaaccugguaaaggagacauuuucauguccugucugcuuguggggaauugugagacuucgagacugaagccauuggcccaaggucaagcugauaagggcagagauaggauugaccccuuggaagacaaauucgggacagcacccuguaacaagugggacagugugcaugcauaaugaagaacgagccguaugugcaugcacauaaucaaugcaugcagcaagucaagaagcacaggucaauccacagaaccgauauaaaaagcugcucuuggugucaauauuuuuguacucccagcacgacggaggcugagacaugcagcuuucuggugcugacuggcuagggcgccuagccaacuuagugaacucacacuagugaauggcagucucaaaacccaaggaauaacacucagguuugaccucuagacggcaugcacacuccacgaacaugcccugcacaaacaccuacagcaguaaccuuacaaccauacaaaacaaagucgcguaguugcacucaaaccuguaggaucggugugggguuccuccagguccgcuuuucugcuuuuaugaauagauugguggugggggacauggguugauccagugauuaaaauaagaauuuaaugccaauaaucaccaacuauugucagacaucaauuauguauugauuugcuacuucauucgaccgguguauuuuuaccuaagaauaucuacuggugucaggguauaacugucaagcuaaaucauauauuauuauuaaacuuugucuaugaucuuuucuuuccuccagugucauauggaaggggggugauuacacccccacaugcaugcuacaggagagcagcacuuagugaagguugcauuucuagagaccucagacaucgcaggcacacccaggaacucauuagugagcaggacaggucucaaugcuugguagcuuuaucccaagcucuugcacuuaguaagaaaggaggaaauuaugugugaggaguggcggccuacagugggcgaagaacaggggacguagaggagccuaucaggcuaaggugagcuagacaggggucagccaucccugcuuaugucaauauuucaugggcccuuccuguguugaaaacuaggacaaagggaguggccaguuugcaaguguugagacuuuuuuuuuuguuuguuucuuuccauuuagccuuaguuuuggcauuuagaaagaaaugcccucucuaaggcuuguacaucaugccugauuagucugccagguaucugagauguugacugugaaguuugccaaggaagaugcugugugguguugccagcuugaugcugucuaccccuucucuccugggaagauggacguuguucucgggacuuacuaugauggagagagcccguagaguaaacccuuuuugaaagcuguacauugugucuaauuccaguguaggcccucugcccacaucugcugugugccuugcguuuuuccuauacacagccgugaguaggugguuuaaccuaaauguuucucaacaaacauguuuacuuuuucucucuucuuuuccguuaauuuuauaauagcaugaggugaugguugacaggaccuggaaucauuuccgggaauaucuaugggggauuuccuugguuauggucauugauguuaacuauaggcaggacuguuuccuggguaggagauccugaacuguauaaauuaaaaacacagccucugacuugugcucauccgucucugauuccugacuagacgcaacaugaugggcugcuucaagccccagugccuugacuuucuugcugugauggauugugccuuggaccgugaggcacaaugggcucuuccuccuuuaaguugcuuucgucagaguguucuaacaugauaacaagaauagaaauuaagagaggugaauaacaucuaaaauucuaagcuuaaaaaaauccaacagauuuugaagauguuaaaaaggucuuggugaugaugacuguaugauuguagagagauuugaaggauaauauaauccuuuauguagaauuuucagaguugucuuuucuacagcagagagagagagagagagagagagagaaagagagagaacauuucuucacucaagucuccuuauaacccuguuagagagauacccuuuucccaauuuaaauauguaagaaaauucagaauuauagauuugcaucaccaggaagcguugaaccauagcaaagacuccuguuuuccaagucuaaugcucuucuccuuucuccucugcugcccccuuacuccugaaaaacaagucaugaguaaugaaugcccuuaucacuuaucucuaauuucagugaugauuaaucagcagcccacacuuggaugauacuaaucaaguuauuuguauaauggcaccaauuuggaucguuacugugcaucucugccugacaugggcuuggcaccgggcaaucagcaagugugagcauggaaucuggaaggaaagcuccuugcgcugcugccucucuccuuacgagauccuaucaucaaacucuggcugagcacagcucccugguccagcguguuuccuucagacuuagcugagaacggccgcucaagcacccagagguuuaaauccuaagccacccaccaccugcuugcugacuggcagaugauauagugaauaacucaccaauaagggccaauuuuccagcuaagaaauuguuguuucguguaauaguccaaagcugcuuggguuccugguaggagguguaagcugaguggugagcauucuaugcauggugauuaucguggauuuacagcugugucucgagcaaaccacaguacaugcucuagaauaagaauacgaaacaucucucgccuugcgucuccccguuuccugugucuggaguuaugucauuugaagcugacauucacuuggaguccagaucugaugugcuccaacugauagccauacuugcuuguccugacuucucuaagcuuuaaauuuggaagguuuucaguagcucuuguuggcaggggaaaaaaugaccagaagagauacgaggagagacugcuauuacagugauauuuuggucacauaggcugucgauacuaaugaaugcccuugaagcagguacuguaaaugccugaagcuggggcugagccgcugagccuggaucagucugcagaauggcugucuccuccuuaaauacuaaagaccugauuaguggccucuggcuguggcacugguuuuaucaguaucgcauauuggagccuggauugccaauggauggacagcauggcuccacauuccugucugugcugggcauguuguuugguuuuauuccugagucauaaaugagauguugcagaguguuccauuaguucccgccauucuucuagcaucauaaaaugcaauguccuuuuagcuacuucccugauacacuggaaugguuaguaccagcagaucaaggguuaaacagacuagaucagguccaaacacuucuuaguuuccuugugguuaugugggguacagucagaagacagcaaaccacaugggaguauagugggguuuaaaugagaucacagagaauuuuaaauacaucauaccuaguacguugaaaaagaagaaccuuaaaaauaaauuagcuuugguuuucaugcagaggacuugaauuauggccccucuagauaauagugggaguuguccugaugcuaaaaaauuaauaguaacaagcacuuuagaaaaucauuuggcauuuuugccucuagacauaaagaauagcugcuacuucccuuuucuucuguauauuuguagaaugacaguuccuugcaauaaccuugugguuuuaaauaucuuacacuaauuguuaaucuuuuaacccccuagaggcaaacauaaagaggaaaagaaaacucagcuuuuagugaguugaagcgaaaagcgacaaaaguucaaucaugguaccuuuuaucaaagggaaagugauacugagucggggguuggaaagcagggcauaugcaugggcuaucuccauugagacuggaggcuggaguucuacagaaauucaauuuagagaauuuuguugaggcguaacugguaggagcaagugcugaacggugucuaucucugcugugccuacugcuuagggggacuggaaaggcauauuucaguaccacugacugcagcgggagccauguccaugcuccuaaagucugugcuuuugauuuaguuaggaaguuuuaacauagaaucuguguagcccaguccuggcuguuguugugcauauacuaaauaguuggccacagaguucuggguaagagaaaauucuguauaguaacaacaaaaccuaauguuugugcuuuggggugacugucaagugugguaacaagugauuuggaucucagucuuacaaacccuuugucucccuuguggauagcuguagcuucagaaguggagcuaguucuguuaccucaauugaagcagccauuuccugucaucucagacuuuagcuaaucugggggcccaagucacaaccccauaggaugcacuccauccacucucagcugcuugauacaccacucaucccuuuugugugauuccccuccccccaacccccuugugcauccgugcuuuuggacagcagggcuugcucggcccccugucacucugcagaaccgucacuuaagagucccagggaacggcauauaucuuauuaucaguucauuagcaaaguggcugacacagacgaucaacaguuggccuucagcacagcuccacuuugucugggagaagcauaaugcauuucgaaaugcuggcauagcagccagccuugaguuggacugaggcagcuccaucuaacacuguccuuucuucuuucgccauaaacgcgcaucgcagaaucgagcccauugaggggaaagcauuugcucugccaacacaauuaguuuuauaaaaagccucugucuucagauuguucuuccccaaaguccaaguuggauggcugugguuauuuuuuaauuaauauuuuuaagagccucccuccuucucccaagagccucuaagcagauuuaacaggcuuaaaagggacucuuucacaagguaacuucaaugccaucucccaagcaaauaaaauuccauuugaggguucuguuuuuccccaucucuuuuuaaaauuuuccauaaagccuacccagugggggcaguuuuucuucaggguuagguaguauucgcuccaaacaacaacaacaacaaaauacguuaucuuguugcugaaggauggagccaugcaagcuguccagcaggagcaggaguggagggaaucugugcuccuucccauccagcgugaacagcagcaggauucagcaaucacuaguaaucuuucugguuuauuuuuauauucucauuucguuuguugcugucaguuucuuugauucuugcauuuuaauugaaaagcuaauucagaccuuugguuuucacgacuggcaccacuccauagauacauuccgugugguggcucacaccuccuccuuuugggagaucagacgagcuuagaccuuaagcgucauaauuggcuuggccuuuuuaguggugaaggccuugauuaggaaguuauugaaccuggagucuuucaaagggaagaaagcuaaugugaugguuggaauugaaacagcacagacacgcaugcucugucacuacuuccuuugucacucacuuccuugaaaagaguuuucaugugucuuugcacaaaagagaugcccauccauguaaauucagcuuguacuguacuugaucccaguucuucagccuccaugcugaaaaccaauaaaggaaacgguaaaaauagcgaaguguguguucauuuuuaaaguugagacucuggucaccuuuaguuuggcaugguauaaggaucaguccccugggagggaaaagcagaaauagcucuucuuguagcugagauuaaagaguuucauggggccaagaaaaacuuuacauaauuccuuacaguaacuuuucuccuauuuuaaaaccagacuacuuugcagucuguaaggucaggguagaauuaucaaaaaucucuucacucuggaagauguguuggccuuagaucuguggaaaccccgggugcuagggcugugaaggagacaucuugcugugcuguuucauagcucucuccaccccaagggacuucaaaauacaagggagacaggagaggcgagauuuacagaaucgggccuuugugucccuugguguggcugaugcucacggagaccugagcugcauccacuguggcaagccaccugcaugagcaucuguauucucuccugugcuuccuucccuugcauuguggagucaaaggugaaauuccaucuuuaacccccguaugguugucugagcugugauuaaugaaguagaugugacucccggcacagcuuucagagggugggugggagaaagaugaaauuucagccuuaaagaaaacaaaaacaaaagcaaaauaaacauaaaccaggccuuuugcuuaauacagcuuuuaaaauuaauauccauuuucgaaugccaagaaaacaaaggggauuucucagaaguguaugcagcuugccacaauaggccuuaauuggugucaaggagauguugggaugaacgaggaaaugcccauuuagcugauaaagacugaaaaguggaaccuuguuaugagcugucaucucagcauguauuuaaacuauagcaaaacugaaacauauuugccauauagaucauaaugacuccaaaggagccauuauacucuauuauguaauuacauaaucaaagcaugcauaguaaucagcuuuuggaauucaaugcuaaucaaacauaccuauacuauguguuuaagcuaaaauagagagcguuaauuugccauuagucaacuaaacaagaguguguauacagaauauucaugaauagcuuaauguugugucagauacuuuuuguuuuguacgcggggggaaaucaacaauuauacucgaagaaaaaccaguaccaaggaugaauacucuuuagcucgccguucagaaaucugccucaccuuuuacugauugucaaaggagauuagcguaaauucaauauuuuuuccuucuauaagcucaaaugaugcaauaguaauuauagaacaguagaugcuuaggagggucugggcaccugcgugcauaggacacaacuuagaacuacuagcugaaaacauagcaaagccuucagaaccaaauucgagccuauauugcuuuuauaauuagaaacacaucaauacauguuauuucgaaagaggugagcagagucacuccuugagggcuccgugacagguuaucuggccuguccucuuggagacauuggugcuugcccuggagucucugcccagggucuagcucugucaagaagaauugcucuuggaaguuucuuuggcuucuuugaauaaagaaggugguaccgagugcuuggaccagcaucagaaaucuuugucauuucaguuacuguuggucuguaagcucacggucacaguuguuuugaccguuaugaagccaggacugguccuuggaacagacagucucaacacucccauuucacuuugggagacagaaaaacauggauaaggaucaaaaagguuaacagaagcuuuguaaaccauagauggguugauugcuuuugacuuugaauaaauauucaaguauucauguaccuuccuuaaaaauaaaaaauuguauuuguuuugaagcggucaucuccuuaaccuuuaacccccagugauggaacucucuuuuaggacucggcuuuugcugucucucaucaguauguggccgacucagaauguuacugucauguuuaaaugggacugaauucuuucaucaaaagcuuucguggcuugaacuucaaauaauuuauuuucaaauuacuuuuacuguaauucuuauuaauucaaauagguuucugauuugauauaaaacucuguaaauguagggaacaguuuaaugaauugaaagauaggauugagucuuuuaaaggaaauguacaaaauaugcugacaauaauugcuuagauagaaaucaaaucuuaauggcuuuguuaaugauuuguagcgcacacuguguuuacguugacuugagggaacguauguaguuagauuucucccucuggguuucaacagaaucuuaauuuuuuuuccuuucauuucuuuuccuggaacauacucaucucuguuccggcuccugaaaacuuuagcugaaacugcagugccuuugccuuuaauaauaguuucacuuggucaggauggacugucuucuucugaguuagguacaucuuuaacaggguaguaaaaauaggauccaauagaagggaacauggccgacaaaccagggcaagcuucaggugacauggggcacccauaauagucaaaaauaagguuuccaaagucaugcagguguuuuguuucuuugauaguuucaaacuuugaugccucuuggagaauaagaauguauaacccugagucuuugacugcuacaaagcuuccagaauugggccugaggagauggugggaaagaguucgugcuggucaagccagaggaccugagucugaaccuucauggugggcaucaaagcuggguguggcuacuccugucuauagccuaguguggggugacuagagagacaggcuguccugcgggcucacugaccacgaggcuagcaaaaauaccaugaguucccaaguccaauaggaaccccaguauucaggaagugggguagaggggcagagcagggcacccccccccauccugcguuggccucuacaccugcuugcacuggcuccuguucccgcacacagaauuccagaaggacacuuucaaggacuguaguacagguuuuuaaguguucacugaguuugucaucauuagcauggguuuucuguuagcccucugcauuugggacuugagugccuccuguuuggacaguaacccugccaaguuaauguuggggguucagcuuuuuccuagagcagggauguggacagaguuucucuaauaugauuuagcugaugggggagcagcccaggggcuuuauguguugcuccauugggcaagccgcccgcccaguuaagugucacaguaccuggucccccucuguguguguggguagguggcaguugccauagcugccaccacauaagcuaaaaucuguuuuaacucugacuuauccuuuuauuaugggcuggacuggggagccucccccaguaugaaugaagaguuuuauuuguuaacagccaggcagcaagggcgagagcuuugggcacuggcaaaugcccaccgugccguaguaauaaaggcuuucucugggggcagagagugcugagugcagaaggaggaggaggagacagcaguaaacagguauuuuacauucaggacggccucucucucaucuugaaguguguaauuguguucaggauaaauuauggaaauaaaaaaaaucacaaguugcucauaaggaaauaacccucucuaaaaacaaguaaauuuuucaagacagagcccaaagggccuuagcaaccaguucugaaauauuggcugguaagcagggugugugugugggagggggggaguguuccagaaccagguucuaacaccaguucagcucacccacuuaguggaacuggaccaggcaacuuccuucccuaagucagacucugcaguccaaucguuacggcagaggcagugaaacaggaaaagucuggagauggggaagcagcccagcacugggcacaccuuaguucuccaucauguuucucacugccaauucuggcuuugagauccugucacuugugacuuccauaaggacauacuguugauugaauagacucgauugaguucagcauuuuauacaauaccaucuaaagggagaguauaaaaauaugggguuugagcaaaguaucucgaacaauuauauuaacugaaaagagcuaauaaggaauuaaugucccuauaccacuccuaacaaggggcuauuauggccacugguagucaucagaguaaguuucaccuuuuguagacaauaagcuuucuugucauugucugucuaagaaaugucugguuuaauggaaggugcuugcucauggaugaagggcucucuuugauucucagauuuguuuuggggaauuauggagcaacucugaaaguuagucaauguggugggcgugucuguaauccuagugcacuucacagugaagaaaggcuagccugugcuacauagcuaggagcagaccagccagaggcacagagcaagacugaguuggaaaaacaaacuacagggcuaucgugauggaacagugagcaaaggcugggagcccacaugguagaaggaaauaacugacuccagaaagccacccucugaccuccacacgugcacaugugcacaugcgcacacgaauagauacagagaacuauguuaaggaaaauagaaaacaaaaagucugaaauuuauaggaaacagcccuauaucacaauaaguucuuguauaaauuaaaauucagcuugauucugucucccaaacuucauccaaauauaccaauuaguggucaaaaaugucuacacacgccagccacugcucuacccuuaaaguaaauuaccuggcuguuaacagccucauuuaaucgcuagauauucuaccuguuugauuucuguuccccagaacguguacuguuccuuccuugacagucugucagcuaauugaguuuuagaaaacucggaaggauuuuuuaaugcagucuuuaaaaacgauacggaaggugcuuguuucucuccugcuacacaugagauugcauuuugugacaaccuaauugucucaacauccauuucaagggggaaauuuaucaaguccuaguauguacccuuucuuuuggaagacauacuugaggaugugagcagaaauuauuuuuacauaaaggcuucaggcaguagaguacugacauauauacuguauuuuccuugcugucacucaaguccuuugccucaaauaaauaggucauuauuaucccacugcagccaucuaugguaccucaaaguauagggcucuguuuaauauaacugucauccagcugacccggauaauuuauuggugguuuuuaaagaauggcauccuugggccaccaccaucaaccaaagcacuuugauucuuucagccagauauuucauuaucacauaauguuuuuguauugauaguacaaccauauuagcauagcuagaaguugacaugucucugagacacugggcuucugguuggucuuaauuaaaaaaaauaauaaguccgugauguuaacaucacauaacaacaucaccguguaucuucagagcagcccagcaaaggcagaaguuuacacauggccaaaguuuaccugagugacuuguucuguagugacaugguaaacgggcuagacauguaauacccccacuuucaggcauguguaguguguguuauaaacaacuuugacuugauguugucacuauuuuuguuuuuaaaaugcaaaaccaugcuccacucuuugacuuccaucccccgugcauacaggcuacuaugaauauaauaaaggcgccuccucucagaauauacuggccuuagggcuuccaugaaaggcuaaaauuaaagccaaguuauuuccacagaaacugucuuauuagaacaggauuaaauuagaggcagcuuuaagucucggaagcuucagagaaguaguugguauccaaagggguugaugccugucggcucacagccucugcacguggaccuucuguggauugaagaaucuuguuuguguugcuaauaaacucuccgaagauagaagaaaucccugccugcccccaaaaggucuuguuugguguccucaucuccuaaaggcaagcccaugguuuaacacugcuucauccucacacuauacagugucauuuuccuuaauuuccucgguuaggucucccagcaaacacccagugucugguguccugcuuucuagucacuuuugugcaguacuaucagauccaccuggcagagcuggcucgguuggcaggaauuucugucaccuuguucuuagcuugugccuuggaauaacccaucccuucaugcuggcuucuguauucuguguuuaccacaggaaucucaggacaaacaauaaacccccaguugcuuuuucugaucaccuuucacuuugcuguuggucuguaacagccuucagccccuagaagcuuccgcaggacagucugccucccuccugcuacacaggccaguguccucaccacggggucauucucuggggucacagagcucagggucaagauucauugggguuuucucugcaagcauucuguuuaucugugucccuaaucaugucuccuuauucuucugguuuccucucuucuaauccucugucaggcagcuggucuauuucuagguggauuuggcuuugagccaucuuagacacccaucacacuucccccacuguguccugccaagaaaggauccuucagagggaaugugaucgcagguggaaauccuccauuuauucuaauuguaccucuguuuaugcugccucgauauuuuuuuaaaaguagcauuuaucuuugaccuuugcuucuugaugugacaacauuucuucaagaagugaagaagccacccuaagcugauacaucccagcuacacagagagcuccuacagagcaggaauccuuagccugcguucuuguauuuacuacccccacacaugacaguggcuuaguaccuguggggauuuggaggucuagagaaaugaggagggugauguggugauggaagugguggugauggugauggugauggugauggugaugguguugauagugcuagcaguuaccaucuguuugguuugacaagaagcuagacacaguguuaacugcuuuguguguaugacaacucugugggauagcuguuaauuacugcccccauuuuguagaugggaaacugucucggggacuuuacauaaauuuccugauauaagagcagucuguuuuucccccuucgugacugacuguuacaucugcugccuguaaauacaccuuuugcuugggaaguagagauuuggugucuguuuuacccgcaucucggcuucuuaaaggcuaggagagugucccacacuucccuguccccugcuaugccaaccacagaaucaaacacaucacaauuccuuaucuucugcuucuaaauugaacuucugccuugugcuguggaucuuuuucacacauuuaggagaugcucuggcugcuggaacaaaucuugaugcugcaaacuagagcagauacggagauaagccuuguaucaguggagcugaaagcucucacauuuuggcauguucuggaaauuuuuucacagcugaaggggugaucugcagggagggcagugagcucggggcugucuucagcuuugggugaguuaugaagguauauuuuugagagcugaaucagacucucaaccguaagccuucuggaucuuacugaagucccaaagaguuauagguaguuugguccucacucucauacaggacaaaauggacugccugugcauugggaaugucagcaucugcuaacuagacaaggccauuaaaugagucuuccuguuucugcuucaguaauugacccaugaguuuagcucggaucaaggacauguggucuaagcuuggccauaccuucuguguuuuagaugggagagcuuccauguucauagcagcuaguacucugaucuuucugguuccaccucagcauacuguggggcaguucaaaauacuggagguugggacaccagcacuacuuccuuucuuagagccacgucaguuccaagcuucauuguaucucggccuagaucucccuuaguuugacucauuuugugaacgggagaaaaguacuuagggccauaucagauguuaguuuuguaaugcguuucucacuucauuugugcuuuaauggagcucuuggaccaaaauguaacugaugggacuuccaucugaccuuucucuuucuuuucuuaaaggugauggacagaaucuguuuacuaaagacgugacagugauugaaggagaaguggcaaccaucagcugccaggucaauaagagugacgacucagugauccagcuccugaaccccaacaggcagaccauuuacuucagggacuucaggcguaagugucugcccaccggauuagacagcaacuuuuguuuaccuauguguugucuugauaaagagauugccaaggccaccucuuucuaauuuaauguuagaugcuuaaaguuuagucaauucuugagagagaagaagagacgggcaaucauaaucuuucuacuuaauagaaaccuugaaugguccccuuuaaaagucuuacuuugcaauaggaauugauuguaguaauucaaggugaauugcaaucgagucccaaauacuuagcugacacaaacaacucaaauaggguucggcaaggaaaauauagcauucugauagggaaucuguuugguuuaaagagugguguuucuaaggcaaucuauaccuguaaugacaggaccagagcuuucaccauaaccucugcuguacagagauagccauaagcugaauuccauuuaaaugcaauuuaacaaaagccagccuuugaaacugaauuguauaugacaccaaaggcucacgccguugccauggcuuggcaagacaccucacugaagcaaguaucaucaugccuguuuugggcuacuuggccuccuguccuuccuaguauuuugggccauccugugggaaaaguugauaaauaagguggaacauuuaaaggacucaagaagggcccaugacaugucugaagugcuugucccaagccugaccuccugagucccaguccaaaacccaccugguggaagaagagugccucuccacaggguggucccauuucacaugcaugugcugcuaacagcuuuugcuaaaugaagaagacuuugaaaaacccuucucauauuaaacaagaagccugcauacaguacuuugugaugguucuaauuuccuuuugugggguuugaucaguuuuccacugggagguggacaugccuaaaaaucuauguaaccagcuacagccucuaaaagcccugccugagucaggcucucccacccaauucauguccccuaaauucauucagauguggccaaguuaaacggucuucuaaagcauguuuaaaauugauauuuuacauugaaauuacuuuuuuuuuuuuuuuuuaguuuucuuucaugauuuggaccaccuuguuuuuguuguuuguuucauuguuguuauugguuuuguuccuuuguuuuuggcuuugcauuugcauucuaaaaguacuuuuguuucugaaccucugcuuuccaccugaccuguccucccagccugcuccuuccuucccacuucacuuugccuaucucuaauaggaaacuguaaacaguaguguugaagaggcacagugccuggaauugccccaaguaggguggcgauggugcuguguguguguguauguguguguuuguguauguguaugccuaaguuuccuuaggucaucaggguugugugucugcaugcagcuacuacagaagccuaacauaguaccauacagauacagaaagacagaaauuguuuccauucuguggcugucuuucuagcaucugacguuuuuccuuugccuaguuaaggaaaguagauugucggucaucuuuugcacaaucacugacuguguucuguuucacagcuuugaaggacagcagguuucagcugcugaauuuuucuagcagugaacucaaagugucacugacgaaugucucaaucucggaugaagggagauacuucugccagcucuacacggaccccccacaggagaguuacaccaccaucacaguccuggguaagacaugcuuguuagucccagagccagugggguggcucgggcuaccaaauggcuuccaguagcaaggaagggguuaagagugggucucgcugcugcaacuuguuggagggagaaucaccgcccaucuugcugaauuuuaaaaauagccuauuuucccaaaugcucucagggauagcaaucagcugucuguauagacuccaccugcucuuggguuucagcccugaagcuucggaagcaaagaucaacaaaguuagagcccucaaaagagucacucaccacaugaaauggcaucagcuuuaacuaccccgaauuuuuuuuuucuucugagcauaagaggagaagaugggcucccaaaucuacagccacgacaaagcugagcuguccuguaaugaugcuccgucuaacgggcauccucgugugaauguggaccaucuuauuuucuuuggcucuauuauucugucacccuauuuauuacugauagcccagaucgucgugcuacagagcagaaagucacacccagggacaccagguuucuuguaaccaggugcagacgucaacaugaagcaacugagagcagggagcagcagagaaccauuggcaggcugagaggucgcugccacugauugaccauugucauuagugguccccagauugggcuuuucacugaaaucccgguggccagcgugauagguuugugcuuugauacggucaacagguauuucuccgcuaaagggucugagucugucacaguuuacacaaacauauacucugguucguaacagcagcuggucccaggguuuuggaacugaauguucaagggcauaacacugcagagugagaccagagcucugguuuacacccucaggaagaugaugaaucaaucuauuugaggcagaaggcugugacuuuuugguguaaugaugugaagauuaaagaagaaagauagauauaaaggacacuuucacugggugugugcacacacauguauuuaugaacaugcauauugagcugcuuccucguuacuucaguuaaacacagcuguaacgggaaaaauaguuuuaauucacuaagccaacgugugugcccaaagccuguguauauuuuugauaugaccaauuaugcuuuuagaaagucggcccuaaugucuggccacacaguuccuagcguggucugcguauagcuuucauuuguacgucacuuccugaugcaaucuguaggagaucuucauggaaaguucugggaagaguauuuugcuauugugcagaugaacuaaacuuaccaagaggcccuuaagguuuuccacuucugcuugucugcaagugugugaauagaccuuugugaauucaagggugcgcagugaccaucuaaauuugagcugccaucacuugcaccaucucugcaggagugacggcagggaaacacgacauacacgugacaguuugaauuuucagagugauuuuuacugccugggcuuuagguuucgaucuuuuaauuucauagaaacucugccaagguuacaaagcacacaauaagaauuagaaaucugaggaccuggggagauagcucaguucgugaaagaaccugacuucaguccuuaggauugagacgugauagugugcuuuuauaguucacacauuaaauaggcagggggauggucccuggggugggucugccucccuaaucuauuuagagaauccugagccacugagagacuugucugcguaaacaggguagcuaguaccagaggaacaauaucugaggucucggcuccacauagaugcacaugugcacauggauguguugaacauggacaugggaacacacacacccagcaauuccauguuucaggacauuucuggaguuuaacauuuagcuuucaggaacacaacuuugggaccauugucaagacauugcuaucugucagcugucagugucucagucacugggcugaccaguucaacugugcaaguacccugugcuuggagucagcuacccacauguaggcuucugagugguaucgugccuguaauccauuugaggucucauuauucuagaaguaauaggugccugcuuguauuucauugaagcauuaacuuaaguguacuugaaaggaauacuagucaauguucuuuuugaggauauuaugcauucuuuuaauauucuucccacugaaguuacuuuaggauuccuugacagaguaaaauuguugucaucagugugagagucuuucauauucuaagaucugacaauuuccacugauacacauucaagccuuccuccuaagguuuagaguuuuagauuuuguaaugaauggagaaugauggauuagcaucccuagugcucugaauaggauuccauauggacuuacacagcugucaaacuccuccauagguugaagaugcacauuuuagugcauaugacuguuagcuauuugacgcauucaacaaaaacuuuagcauaauuauaagauacaaaaaugacuguuaauguuuucuaugcuauugcauuguguuuaggucucauccauguguaaaucaaaaacccuccugugaugguuucuguaugcguugugggccuuucauucaguccuuccacuugugacaaguuccuguccuuauccacacacaugauauaggauucuuucuauuccuuauauuccuuucuuaagaggagaugaacaggagagagaagccacugugccgagaugaaugcacuuacuguaaucguggcuaacauuacuacagccccauccuccuaagaucagugcucacucuuaaggcuccgggaacaggagaaccuaauuauuuuaaagggucuuagagugagguuucacauacugaucagcuuuaagucuccucuuuugugguaauuaaugugacucaucuugauauugcuuauuuuuuuucucaauguuguaggcguaauguuuauaauuagcacucuuauaggcuugagguuagcuaacagguaccuugacauucggggcuguauuccccgugugugauuuuacucaggguuuccucugcgugcuccuucucagacaggucugugcuuguucccacugauggcugcaggcaguucugacuggcuguuuguaucuguauaguggaucguguauauguguucucuggcuagcgacaguuugaauucauuuuucuagaauggauuccauacuuuaccucuuuuguauuagaauagacauugugaagucaggauggaguuaaggagaaaagugggauagaauuaauaggccaaaauacauuuuccuucuccaaccuucuguuuucgggagggcaaguuuaaaucaccugaucuauauuguccaauucuucauugcucuuuaaaaguccaagaaauauagaacucugugaguggaucuaguucaaaggaaguaggggggaaaguccgagagaugugucuuuuuagcaccaaaagagauacaaauaaucaaaccuuacccuuguaacuagacagccccacucccacuugcucuuucuuccucugaucucagccaagaggagcaacacugcucauaacucugagaaaacuaauucugggcuuggggacaucacugggcuacugcuucucaaaaugaugaccucagcgacacgcaagcccauuguguguguacacagggugugcuuucuagcuuuuggaguuuuccacacgauucccuuggcuuaagguaaagaagaugccagcugcacaggaggguaacccugggaaccagaauuacgcaauuacuugaaggucauagggacagacaguggaccauuuacagcagaggugaagggcacacagcuaagaccagcaguggagaaagccagagaugaacuuuaaccaccugucaagcuuucagcccucaaaccaaaguugaaagauguuagucaucuugucuguccuguacaccugccuguuuuuaucaccuuacuuugauccugaacuccuccauuccccuccccaucuucucuccuacccaguucccccuccaugugccucuuacgacaauuuuauucccccuucaaagugagauucaagcaucuuugcuugugccuucuucuugcuuagauucuuuggaucuguagaguguagcauggauaucauauuuuauggcuaauacccacuuauaagugaguacauaccauguauguccuuuggguacuggguuaccucacucaggaugauauucucaagaugcauccauuuugccugcaaaauucaggaugccuuuguuuuuaauaguugaauaauauuccauuguguagauggaacacauuuucuuuauccauucuucaguugagggauaucuagguuguuucuaguuucuggcuauuacgaguaaaacauaauugcucaauuauaaacauaauugaacaaguguccuugugagauggugaagcaucuuuuggguauaauuccaucuuacauuggucagaguagcuaagaucaaaaacuaagaugauaguacgugcuggugaguauguggaacagagagacacuccuccuuugcuagugagaauacaaacuuggacaaccacuuuggaaauuaaguugacgguuucucagaaaacugggaauaguucuaccucaagauccagcuacaccacuucugaacguauacccaaaagauguuccaccaucccacaaagacucuugcuaccaaaagauauucuaccaucucacaaagacacuugcucaacucuuuccuuacuuugaauuagcagacauuuuuggugaugugaaaggaacagacacaaucuuuaagaccacauagaggcaguaaaaguuuucccccacgaguugccacuggcgaugguuacaguuugaacgugaauugucuguuaaggcuuuauguguucugggcuuuuucacgagcugccaugcuuugggaaagugguuaggucccgaggucucccaccugaucagcaucugugauaauaugauaauaugauaauaugauagcaucugugagagaguggcuggggccucccugaaagcaauguccaugggacacacguccuuggagcuacaucuuccugcucuggcccuucuagguccguucuccuugcuuccuuucugccaugacgugagcagccucauccucuacuuggcuucaucacugugcagcuaugggccccaagacagagcacaggacuucugcaaugaugugcugaaaggaacagucacccuuaggaaaaguaacucggaaagaaaugagugggcagggaaggccaugagaggcauccggggaggaguuuugaugugucaucagaccuaccaucugaugaaagugagagaauaagcauaauauacccaaaacacagagcacagccgacagacagcguccauaccacaugccucuacgacuuaguaucuggguggcaucucagcuaccccuggaucuguucccauuaagagagugccugcauucugagugcccaugaccguguuucucaggaagugggagaaauccuccauucagaggaauuccagcauuguccguguggcuuuagcugucugcccucucuuggguccuuaguaccauacuuggacaaugacauuagugauuauugcucucaucaggaaaugcccagugugccaacuucaaggaccuuuucauccaguuguuaguuccccuggggaccucaaggccaccucuucucuucugggcccuaauuugucugugagaaugcucuauggccuuugacacccuagucuucuuucucccucucuggugcugucacuucccaugaucuuugucccuuaggcuuagugagugguuuccaggacaucuggauccacaggagcaugucucccuucuucguugcuagcccggugcccagaguucaagggcugcuuauucccaguaccuacuguccauggcagucuguggcccgccuggccaucauuugcacaaauaaaccauguaaaggacacagccaaaucagcccaauuucucugucacccccuuuuugggucuuuaaaaauugcaucagauguacccaucuaaacugcauguuaaauugucuccuacuuaguuuuuaaaauguaagccagggguacuucuuugccacaaguaaguaaguacucauuugggccagaccaugucagcaagccaccugauugaacaagcguggacuuuuuuuuuuuccucaugcaaggggaccagagagcagagugccugcuccagcagcugcccccucccugcugccacagugugccgucuugcugagaaacacaugcaacaaaccguuuuguuuucccccuuuucaucagccccuagaagacuuuucaaucgcucuaauucaguaugaaagucuuccuguggacagaauuuucacauuggacuggaacaguuggaaaucccaaauaacaugguuuaaucccauaauuuauugaagccguaucagagauguauuauucaacuugauggucaggauggcauguuuauacauauuuaauuucuuguuucucuucugaguugagaaacuuauuaaucauaagucucagcccugucuuugcuuauucaugguggccagggcucguauucuuagacucacacuacugaauucuguauucuuacugauuuuuauuucaggaggcucagucuugagguaggacgacacauuguaugaaguuucaccuucaacuuaguuucauuuuuuuuuuaaauaaaaaagguagcuuuagucaucaacuucacuacugucacacacagaaccucgauuguugucagugugucagcccccaagccuuuuguuuuaacuacuuuauuacagagauauuuaauaugcucauagacaaauguuuuaauucugauaucugagggccuuucaagcgccugggagucucuuucuccuuugguuccugagaucugagcuuugggacucugaguaugguaaaugccugcacacaccuggcauuuccuguauugucgagcauucuuuucagugaugcucugcccacuagaggacaggccugugccucgacuucuuucaguccugguucaguggagccggcuccgaggcguacuuuuuccaucaguguuuguggugagugguucuucuaagggaccccgagcuuuuuauccuuguuaguagacuuugaagucuuuuuuuaugaagauugaaauccaaggguugaauucaaggagaauuauugcuuucaggggcuuccagguaagggcguugauuucaauacugucugcuacucuugauuuuauaucuguucccuuacccauuuucuuaugaugaaugucuagacuguuaauccucagucagugauaauucaggaaucggagaggucacuggugacuaacuaggagacauuuaggaaagacauucugaguuaacugaugaugccugauccaccuuacaugacauugucuauccaguuccuccccuccucuggcaguuugucaucuggaagugaucccaucagcagugucccuugucugccucuuuauugguaacaaugacacuggucccuaaggaagaggagaaucuguccuuaaacaggcccugugcuuauaaagcauauguguuuaauuuguaguuccuccacguaacuugaugaucgauauccagaaagacacggcaguugaaggggaggagauugaagucaacuguacugccauggccagcaagccagcgacgaccaucaggugguucaaagggaacaaggaacucaaagguaugauggagaccgcccaggcaugaggcauuuagcuggcccucaacucuaucuagcaaggggcccuuugcggaaauuacaaacaguugcuucugagccaaaacuauccauucagaucugguuucuaaucaauuagcaaaaacauccgaggcggaacggaauggguuucuuugccuucucucaucuccaacccuguguaguucgagagcugguggugaaccaaauaugaaugcuucagacaaggaagagccugugucagagauauccugaagucugaggcuguuucugucugugccucaaaauucuaucauguuuuguggugacuugauggcucagaaccccacauuuucaugcugugcauuuuuguaaaguuccaggccauucauucuaacaugcaucgcaccguccuucagcuguagguaugugcucuccugcaagaccguugcauuacaaaguaagagcuuauguuaauuaugaauuuacagagaugacuuugauggugaacauguaauucugaugcccgauuugccauccuagucuucugcaaagucucugacuuuggagugacccuacaggcagcuuuuauggcccugggcauuuuauauugcuuauccugucucucacgguuggcagccuuuggcucuguuucuuuucuagguugcccugaaaguaaugccugaacaaaggacucuggaacucaccucuauuuaacagaaauacuuagccaugugcuucaguucccucuaaaaaggaaacaguaauacuaggguauuguuaggaggaucaaaugagugaauauuuacaaagcaucgaggaagugccugaagcacaguaagugcugaacgugcacucauuaaauaaauaaauaaauaaauaaauaaauaaauaaauaaauaaauaaauaaguaaacagugcgaguggaguggaugucuauauccagaaaaggagaccagcaaaccuccaaaagcucacuccgccuuaaaccccuccuuccuagguaugccuuuagaagggaggaguuuuuuauuuccccucugcuucugucuaagugaauugagccauuaaauguagacugcuauguacaaagcauucacagaaaguuaauggugugccgugcuuugggagugcugggugcaggaagggacggccuaggccuauucacucccuccggaagccuucucccuccuuuucugggcguucuuggacuugucucccaucuggcccaaagcccuaugucuuucuuugcucuaacccacugccacugcauuucuuguggucuuccagaagucuccaaguuuaaacauuucaauuacaauuucaauuagauaaauccauuuaguuacuuuuccucuuaaucaugggugauagggguaggcagugaggcuuguuuuugucuccacugcugacggaauuacuuaggggauuuggacuucacccuggguuuucaguggcaugacagccuuguagauauuugaaguucucaugguuguaggagagaaaagcuuauuuuccuuccuccuccuaaugccacaggcagccaagugucaaaaugguugaacuuuggacugacuuggcaggaagguucaagauagaagaaauauacauaauauauuugaauuaaacuaguguguauugccuagcuuuggaauauaucuggaccacuguuacacaaggaugaaagaaggaaacuaagggaaauaaccauuguaugaggucucgggucccagaucgcccugaccuaugacguugccaucuuguuaccuaagguaacacuguuagggguggggagaaagggaaaggaugaugaucugcuuugucucccgcaggcaaaucagagguggaggaguggucggacauguacacugugaccagucagcugaugcugaaggugcacaaggaggacgacggggucccggugaucugccagguggagcacccugcggucacuggaaaccugcagacccagcgcuaucuagaagugcagugugaguagccgagcaccuuguuuugaggccugugcuuggaagcuccuucccuugaaguccguaugcaaucuguaugguguacgaggguuguuccucuguuguucugguagaagagugaucaaaagaucauccugcugaagggcuacuguaauaccaagugccaaugagaacgugaagauacugcggccaacucaaacaugaagcuaaagcagugccagucugcuuuaauguggcuuaaaaucggcuucuuuccguguucacugucaucauuccugggccaacaaagucuucagugauucccccucccucucuaauccaccguaaaccggauguuuacaauuuuauucccauuucuuacuaacauuuuguucuaagguuuauguucuauguagcuuuaguuagaaaaagguguugaaaguuaaagucgauccguaauucugcacgguagcgagacugucccuagccauccccuguaaaccagagaagagggucuccuugucuucuccuccaggcccuucugcuucagaggcagaggguggagggaucuuuccguccaaagccgugcuccauccaagacugugaccacaugacccucugcucucacuuuucuccagaagauuccuccuguaggcuggccuguggcgguccgaggauacaguggaaugggucuagugggugguggugugaggauuugggugggugagcagugauuagggaucugauuggggaaaggcauugccaacugugggaguucuuauguuagugccuuagggcugccaugucaauuggcagugucacagaccugucccaaaaccacagagauccacucacaauucuaaauaccaaaggagcaaauugggggcuuauuugggccaccuucccuccaagaccuuagagaguccuuucugcuucuuagauggcaagugcucugcgaauuuccccaaggaguuagggcagugcuucucacccuuccuagugcuaugacccauuauguuccucauguuguggugacccaccaacccuaaaauuauuuucauugcuacuuuauaacuguaguuuuugcuacuguuaugaauuguaauaugaguaucuguauuuucugacggucuugggugacgcuucagagccuguugccagccaucauucaggaggcuugggugucacauaagacacagugucgcugaguuuagagcccacccaaaugauccagaguuuucucaucuuaagaucuucaagacugcacgugcaaagugucuuuuccaaacuaggccauaugcauggguucuuggggcuugaauuugccuuuggaagccauuuuucagcugcuacccuuuuuauuguguauuuaaauuguccaaguagaacaaguuauaaacuugcuuauaagagaccaucuugucccaaccucuucuugcccuucgagcauggcucaauuuacauuacagaguguagguuuuucuuguuaauucauuuccucuacuucauuauauagcuucauuaggagcaucaugcuuauaauuuucauaucacuaaaacuauugugguguaaugucccuauaaugggaaaacagaaaugaucagauauuaucuaaauuggcagauacuagauuucuugugacuuuguuaauauguaauucauuuaagcaaacuuaauauccauuaacguuccuuguaggggcccauuagcuuuaauaauacauuagcuccuuugugaguccugaguggauauccacccaguuuccaccccuaaacccuuuaaguaguuucccggaguaucuuuuaaauagagaauagccccucccaccuacaaaauugcauucacugccaaauacagaauauuucaagccgucugccuccuacccuggaaaaugugguaaugauuccuagccuuguuuucauuuucuguagacucaaaagggauuuguccuucaaggaaaaugaauacaggucuguaucugaauccauuuggcuccaaucuaacaaaaugcugugggcuccucucuucaggagaggcacuggaacaccuuccaaagaugagacugcagcuacugaucauuucaucacgacagccuuucccucaacuaaaauuauauaaacauuacguucuugaugcuuuuaauagauagagagagagagagagaugaaaaacaucuuguauaaaggaagguuauacauugcagcacuuuauauaauucagaaagggaauuggggggggggucuaguuuucuaucuuaauuaagacucuuggaacuuaagaaagucaccuggcccuucagucuaugaauaucauucuauucccagaucuguguugugcuuguggaaucagccagcaagucuucguucccaaccaacaugagucuccuugaacacuauuagcccuucccuaucagaggccuccugcccccaaggcuccggugccuuaggccccaaguccgcucucagugaguggugggagcuuagcuccagucccucacagcgguucuuucucuacagccaggcaucgcugucuaagggaaaggauaggauccuucaucuguguagacacugaguuacugagauacccagaaggaauaacagugcacuucuccccuccuccccuuuaaguugacucaagucccugaaguuaucaccuuuauagggucacuaaucccuaaaaccuccuuuaauaucaguacacugugggguggagaggggugaauuaaaucaaucaccacauuuugcuugcaauauaaggauuucaucugcccaauagaguucugcuaauuucuucaaucacugauaagaccuauuuuccuuaggccacguuauuguuugaaccugacuaugaucuguauguuaaaagccauaaaauuauguauuuuauuaugugauuuaaucuaaaaaaaauuaaauauaccauuguucuuuuuaaugucaucuccuuuguaagcuaagauuucuucaggauaucaucggggaucaacagaaucaccaggaaauagugaccccacagcccucacacuguccccaguuaggaggcuggaggggacauuggucugaguacucuuuaguagccucaguuguucucauccuggccaauuuuggacaaagaagguuuaugggaugagcucucugccccaucuaagauaaaugcaugucaccaggccaugagcagagcuaugugacugguggugaaaucccauacaagcuagggucuccuuuacaaaugguguucagagggaaacgaaauuucccucacugugcccguugacuguccuacuugaaaggagacagagggagaagccguaaaaagaaagggaggcauguacgucuucccuuaagcuggaauccuccauguugcauaguagacaagauuugagcugugacugggccuggcuucuuuugugucuuguggauucaaguccuaauuaauugaacuaguauuuguaguguuuguuuguuagcaccucuuauuugugguaccaggagaaauuguugugcccaauuaugugaaaaaucagccagaugugugugcugucauacuuuuaauaacccuuaaauuuuggugaguacagauauuaauuguguaguaugcauugaagugauuaacaucaauguaauuuaucaucuggagauuucugaacauaaauaaaugaguuguuuuguugagcaagguguugaccccuccagaaucagugaauuaaaaguucccccuccucuuuuuuauuauaaauaugaaaggcaccacagucagccaaguguugaguuauuugauuuucuggggcauuagccgcucuuguuugugacauuccccuguugggugcucgcuugcaagcucauuaauaagguuuucucauaggaacauugcugggaauguuguaugaagaacauacaguagggcucuugcuuugcuagcuuucauucugaggcccagcaaggguacagcagcaugcagcuaaauguuuaaaacagaaaauaauuauguuagcaagguagaauuccgagcucugcauucuuagaagcuacgcagagaacgaacgcuugugcuuuuuggaucugcugaucuggaugacccuaaaguccuucugugcugcuuuucuucuuccucaucuugcaaacgccuuguagguguguuacgcagcuguacacggcggcugauuagagcagagugugauucuguccuaaaacuguuaguacagcuucagcucugaaggaaugcgcuccugucagauaacagccuguuuaaacagaccaguucacugucugugugcuaaaagaaaccugucuaaauagcaucaagguggcaacacauggcgacauaagcugggaauucaaagggaaguugugaccuccaguauggaauucugagugcgagcugaaggaaacaaagccuugcucuggacacaaggcagccugagcugggauuccugcugugcgccuuccgucuuccccaccagagccuugcucuuuagaauguuuugcaaaacauccucauuuuguucagguuuugcccauuuauaaaaagagagaaacaaaugaagagcugagucuagaagggaaaaaugaaaacaaagcuuccagaaaccgguauuagagcacuuccccgcccagauuaccaccugacagcuaaucacagacaugggcaugacucucaaaaugaguuuuauugacuggguguagccagguauuuuauaaauccauauccccauccauccaaggucuagagaaggguaggugucucucccugcaucccuaccucccauccccucaacuagaggaaaauugggcauuggagagaugaucaaaauuuguucuuuaucugugacaaaaugaauguuucugugauauugauagugcccuguggugauggaggaugaaaaaccuggaaauugggaacucccuccuguuuagacuggaggauaaagcuucccacagcaggugcuuggcuccucccuggcucucccagguuaauucuguucccagguuguauucuuaaagugaaaacagcuguguucucagguugggccaguugcuaucuggucucuguguucuguguccagcaggcuccaguguguguaucaaugagcuggguucagagagguuaucuuagugauuauuauuccuuaugagaaacaaucaaggcagagagaccgcugauugaagcccaguuuguaaccuagcauucuuugugcaaggccagaccagggacaucuuggaguuccuggaguuuccauggacuguggguaauggagcccacaggaccaaagcaggcaggguugggcaaguugagaaugaucccugggagaaaggccuuugccuuccuuagcacagacaacccagugcugcugccccugaccuuaguggauaaaagauggcucugguuugguguacagauccaguucuuacauagauaguaagcucgucuccuaauguacacccugccugauggcuuuuagcucaccauaagauucugauucugugggaagguuaaacgauuucaauuuaaaaagaauagucaaggaaauuucuugauccuaucccuagagauuccagaaaugccagguaaccaugccaaaaaaugcagguucaacagucaaauuaccugggcugcuccucaaacuuggggaacuggcuugaucuccaaaacagacaaaccuacagacuuaccguauuuugaggcuaagacagacuuguguauuuguuacuauuguaccuaguggauucuuagugggaaauagcauugucuggugcugcugaugcucucuuaaguagaguuguuuuaugcccgucuuaaucuuuuaugauagccccucccucuucaagaaguguaguugguugguuuuuuauuguccuuucuucuuuccuuuguuuguuuguuuguuuguuuguuuguuuggaggcaaaugucucacucaguaauccaggcuguuauccaacucauggaaauccuccugccucagccucccagcuguugggguuacagguagugaguauaauuuuaagugcugcaaaccauaccagacaaagaccuuuaaccuagagagcaaacaaacagcuggggaaguugucacucaugucucaggacaauaggaaggaagcacuuuacagccugccccuuucccuucucugggagcucuguggaccuguucccagccagguguauguagucuccuugggugcccuacauugcccucuucucauuacaaagcugucuuccccggcacuuuagacaaccgaauuguaggagcugauuuuggcuuugcgcucaaacagcuucuaauacgaaccaaaucucggguuaaucuuugcauuguuguucuacuccacacugcaguaauccuccaugauugacagacuccucagccagccacugcuuccugcaagcuccagugcacagggacugacccagacccucuccuagccagacugguagcagccuuaacugaugcugcccugagggguggggacugaaaacgugagcccuugaucuacaggcgccaaaccccacacacaguguguuucugaacauuagaugaaaaugaaacauggaacuuggagauuugcacucaagcccuuguaguuacagguagagauuuucaugcaaagcccuugggccugguuauaguagccaugucaaagaacauuugaugucagcaugcccugauuuagaacuucuaggaaaaagagggaaaguugcaggugccccugggauaauagcucuccugcugagguaucaggacacacacccccccccccccccaggccucaguucuucugcucucugccacgggaaagacggcauccuagucaaagggacuggggaccacagaccugauaugcuagggucaggcuucugacaggagccugcgcgucuucauuugcauaggaaauugacauacagauuacagaaucuugaguuucaucuucuaagaagaucacagaacagagugcaaggucagacuggcaugaaaucaauuguaaucugccagcaagccauucagaccucuuuaagaguuuccuuuauauuuuccccuuuauagacagagggaaaguacauuuaaggaaugucucaucaaaucagaaugccuuccuaaaauuauuuuuuuaauugguugcuacuauagugugcccuauggccuccugguauuuaacccucugugcaacuuugacuaaugaacaaauuuugucggcuguagcagucuugcuaaguguauuguagaggguuuaagagaaauuacaguguauuaugaaaaccucagaucuuuccaccuaauugauuggcuguugcugaugccagcgcuacaagugugaugcuccuuaagugcacaggccuaacuauuuccuuauuuuuuuauagagcaguuccauuuuauaaugacauuaagccauucugagggauaugucgcuggacaguuaucgcacuuggguagaaagugucgucuggcuuuuagccuugcgccugacgacaccaaccgaggcguaaaaugaucccccagaaaauguacuaggcuuuaccucauuacucaaagauaaaacuuggagccugauucuguuucagagaagauuugguaaguuauaacauuugauuuaugaacauaauuaaaauauaaauggugagcucuugcucugcagucaacugucuggaugguuggacauuuugccauccuccuauagcagccagggucuuuucugggagcacucaacgccccugagacaucacuggaauccccaggacucuguuccaccugcugaagagccuuacguuccucaguuagggcagagcaaggagaugagacuugccuucaaguuuccugucgccucggggauagaucuuagaguucaggccuucugugugguuuauagggaaugaagacagcucggcugcccaugggcagauaauaugccauaaauacugugugugucuauggaaagggaacuuuucuauauaauacaggcaauauugaugugcgcguuuccugccagccauuaaggucauguggcagcuguguccacacauaacgugguacaaguuuuccugggacuggaccauaaucagagaaaagaaaucaguuaucaaaacugaagguguagcuuuuguggcuuaaaauacaaauuuuaggugugacaagcccuucacuuauucuuccugauuggugugugauugacaacuaguacacauguuuuuaaauauguauauauauauauauauauauauauauauauauauauauauauauauauauauaacgaaaacaaacucacugguuccagagaggcaggguggacuagaacuguuccugcucucuuauuacuaauggaagcugagcauggaaagaccagaaugcauucucuggaaauccacucuuccaguuugcuuguaaauuacacagaggagagaaacaauagaaauuuuacaugcaggccacaaagcauagaccagcaacuccagaccagaaagaaagagcagcaagcacacauuaguagcacaaaccaaccagugcagacuaagagagcaagaagcaugcucuggcaagcacagguagcaagugcagaugagcugcugaagucagcagggcaugaaaauuaaccuauaaacaaacaguaaguugcugcccagauuugggcuccauguuuaugucagaaguccccuaagcaagaguucuuggaugcuuuuugguuucugagugugaauuauuagacagguuuuuccguuaucugugugucacaaccucacauucauuucucuuucuccuuuuaaaacacaaaauuucaucaaauagcuacgugccaggcagaagaaguuguaucacuaaaaauaauaguccugcagugcacucuagggcucugcuuggucugagauaugaucuaaacaugguuguccaggagcucuugauucagccccggagccagagcuagcucaaggucacccuguuuauucuaugcaaacauuuccuccuuucucugauaacauuuaucaggauccucaacaucuuccuuugccuguaaguccaagaaaaggacugugucacuuggcaguggccauccgggucuuuugucaucuuuauguccucugacaagugaauauuguucuucagaaaacagcaccuauuccagugggcagugcacacaggugggcguucagggggcucuuuuaaaaggaccguaauaucuugugugacauugcagaaggcaugugguggaaucaagacuaaaguuucaucugguaacagcuguccuaggcggggugucccaugugaugacuucacugugcagcggccauagcugcaugaggggugagguuggcagagccuggccauauuucugucuucucucguguuccuuaggagcaauacuaaugagcccaccacuacuugugaaaggccaaggggcuguuguuuaaguggugggauugugugggaaaguaaaacugugguaauuguuuuaacuucucagccaacugauguccugcccucucacacuugguacuccuggguccguuugcaaaaauacacauuuacagagccacagaauuaaaugagaagcauaggaaaauaucugauuccacucagguucuguuuagaaaugucuuuguguaucuauccauguugauucuaaguacuacugcuucccucccuacucccuguggcccuccgucauucaucucugguacccaugcauccccucgcuagcagucacagcuuuaagccacugaccgaagugaaaagaacuugugucacuuccuagaaugcacaacucuauuagaaagauauacucugcuuuaauuguggacugccauugagaaaugcacuucagaaucagaacucucccccacucuauuccacggagcugucuggaauuguguuaucucugagaccuucaacuagcugcaucauucuauggguaccaaaguuaaaacucuugguuauuccacuaugauugcaugguuccucagauaauaggcucgggaugaaugucauuucucuuuccucuauguuuaugucaggauaguuuuauuugggaccacccaucucuccuggaucuuuucuucauaaagcaguuugaguggaauucgggaaacaguuugauagaaagagcauagaagagauaacuuauuaauaugcagugucaaaacacauugucacaugguaauaugugugauauaugauaaaauauaucaauuuugaacaccacaaaaaucugcagcuucaccucagcaugaaggcaaaugaguuucccuuagcuugacugaguuuagagauaaacuucaauguaacaaaauguauuucacaggaauuguuugaugugccacaguuggcuuaugaaucucuuaucuauucaagguucacuccuuagaguuauuagucaauuuaaugugaacaaaugccaggauuacuaacuaauuagaaggauguugcugaaggcacauggauggggacagaguaagagcuggcggugugggcuuugugacaggaugcgggucugaucugccugaugcuaucguuugcuaaacaccgugcuuuguguugccacacagauaaaccgcaagugcauauccagaugacuuacccucugcaaggccuaacccgggaaggggaugcauuugaguuaacgugugaagccaucgggaagccccaguaaguucugaaggccaagguuggcagagggucgugagcaguaaaugucacaacaugaagaugugcauucacagcucauuggccugucaccugucucccaauguaaaaaggaugggugacuuuucagaaaacgaagaauauucaaugacaggggaauaaauaucugugauucuuagugguuagaauuaggagggaaugccuuccuagucuaaaauucuagugaauucugucuguauuagugucauuaacaggauggccagggcaauucauucucucucucucucucucucucucucucucucucucucucucucucucgguuuuucaagacaggguuucucuguguagcucuggcuguccuggaacucacucuguagaccaggcuggccucgaacucagaaauucaccugucucucccucccaagugcugggauuaaaggcgugcgccaccacugccuggcggcuauuuucucuuacaucaaauuucaacauacugggccuggaaagauggcucagcaguuaagaguucuuacugcuaguguagaagcucuaaguuugcaucccagcaccccagucagguggccuacagcaagcauuucucuccagcuccagggacccaacguccucuucugacccccacagauacccacauaugugugcacacacacaaauaaaaauggucuaaaaugucaguauagucucagugcacuaggaugucugcuaacagugguggacuugguacagcuggaagauaagguuuucuagacucugaugugcagagguugaggccagauguaaggcaaaagaauuugcuuccaagaaaagcucaguacucaacugagagaugcagggaugcucccaugggcgaaugugacuguucugccuaggagaaagggaggccaacagccuugugcugcugaggagugaugcucuacuuaccacacaguaguccaaugugaggcagaagggcggcguggaccaccacuaacacagccaacaagcuuugaggcugugcucccacaaguaccucacagucuccuuagacaagaagagagccuuucaucuuucuaguaaaacaaauuaucuuuaacuguuuuuaagggggggggaucccaauucacagacugaugaaguggaggacaggucaaguuggaauuaaggucacucaaacuuuuagugguaccaaaccagaaaagcagcagugagcucccucugcugucccuguggcaugauuucuuucuuccccucacaguucagguaagcggcaucuuccugauuuuuauauaaagaccuuagagcaucuucacagcuucccucccaguccuuagagagaacucacccugugacagcuauggagccaaaagugcacuacguuugagaggagccuggcuauggccagucccuuugccugcuucuacucuccuuuauccaggggcuagggccuucccucugcuagaggagggagagcucuaaagauaaccuuuggagggaggugggucugguucuguuuugcugcuucucugcggcugguggcuuauuugaucccagcuuugacagagcagucuuuuucucuuuuaagcccuucaaaaagauccagaucauuccuuuuauaaacugauuuaugcccuaauuagaagcuucccuugucucuccaaaaucccauggguggaggggaacccuucucagggccucugacuguuuacagcaacugcauucaaccaccuacgucacauuuauguuguuuggauugcuaaccuauauuuugcgucuguaauuuuuuuuucuccugaagaagguacuauguucguuugccugugccacagggacaguaaauuacauguuuccuucaggacauuuuugccagagaggguauuuguucguuccucucaaauuggaaagggcauguggcugugugagcaagcaggcauuacucggcaacuagcccuccuugcauauuaccuauuuauuuucucaagaaauuguauacaauaaaaaugguaauuuaacuugccauuaaaugugugaauauucucagugcuuacccccacugauuguuucagcugucaagcagcaggacgcgaggccugauugccaggcagccccauuuuccacugccuacaaggaggacaugugcaguacuaccugcaauaauucaccgcauucugaugacaaacccuuaugcaauuaaagagacuuguaaccucccaucucuuuugaacaguggaacacuacuuaacaggccucgcuuaagugucaggguggcauuuacaccugagucccugcccaugucgcugcuccuaaagguaguaguagggaccaagagaggaaugcuaauguguucaggccaguagcauccuaccugucaaauaaaaaucaggacugaggauauaaguguuugccuagcauucaucaggcccuggguuccgucucuagaaucacauaccacccaaaagaugauuuucagacacucuagguauacccuugguuuuguaggaggaugaaagagucaccuucaagaacacagguuucaaguucagugagugaaagguauuuggugugugugcacuccucucucuagagcaucuugucaaauuugcuuuucccuaauggcuaugauaagauauguguaguauuuuaagucacuaaaacuuguuuuugauaagcaaguucccuuguuggaccuaaagagucuauuuuaagauguguucauucaucauuaauccaagagccagaugcacucacagggaaaguccagcuauaucuggcccuagaggagcuaauagagagagggccaguuacuggccaggggcagauagagaagguagacagagccauucacguggcaucucagguggggagagucaggcuaaggggagaggaagugauuggaucuuuccagaaucaaaggugauuuuuccaaacacagauuaaaaauaaagcucuguucaagccagggcuguaaucucagcugcucuggaggcaaucaggagacucacugcaauuucaaggguagauuggucuccauaccaaauuacagacuagcuagggcaaccuugagagcaaauagaaauaaaagaaggucaaggcuauaaccuagcguagagcuagcauaugccaguauccaccagagaaagggacggacaggaggagggcugauccaguguaaaacucacacgugccuucugagcaagcaaaugugcaguguauuaguaaccauugggcugaugcguguaccguuagccaagaccuugcuuuuuuucucccuaauuauugagaugauuaacacugggugagcucuguccugccugagcuggugugaaaccgcacagcugggcaugugaguugggcauguuggcuuguuugcugacuuacuaaaaacgacuuagaaaucauaagacuccugcuuauaucaagucuggaaagcuuaucaauagcugauucugguuuuuaagaauuauaugguagacauguuugcauagccuuaguuuuaugaauuuagcaucucucucauggguccaguuacuugcaucacccugcaugggauucguuugccgcauggguuaagaaacuggauacagauaccuuagugggaaaugauucucugaccugucuuucuugccuucccacaggccugugaugguaacuugggugagagucgaugaugaaaugccucaacaugccguacugucugggccaaaccuguucaucaauaaccuaaacaaaacagauaacgguacuuaccgcugugaggcuuccaacauagugggaaaggcucauucggacuauaugcuguauguauacgguacgugagaagauacagugcucgcccacucacuccucugcauguagcugcugccugggcuucaccccaaagccuuuggucaaguugaaaaccaaaaaaaaaaaaaaaaaaaaaaucaguuggucuccuucaggaacuuaaagaagccuggccugagguggaccccagugguccccaccugggucgacagugacuguuguucucucccucugaucguggggguuccccacaagaucauagucucuggucaugcugagaaggaaggcuguccucaggcacaggccauagagcuuauguuagaaguagugucugaaaaauucaacccuaccaauuaguggcguucagccgagaaaguuuauucccaguggguuuuuuucccacgaugccugggcuagccuuccuccugcuuugaugagcagagcuagcuucuuuuccacaugaagccauuaaguccagaagacucugcaagucaguaaacucuccaaagaaauauaagguucuugguuuacuugcagagaccaccuacaccuucuguuuuagacacaaaugccaacuuuuuaaaauaugucuuguuuucuuaacaucuuucuacaggguuauuaaagcauauuacuguuaauuucauuuuggaaucaacagauauauauauggaacaccuauggugcuggguauuucccguuuauaucuugcuguugauuuuacauacugugaauaugcucucuuuaguugagaacuacacucucuuuauagucuuaugcuaccaaauugagucucuucuguccaauugaacucucuucauucuacaccaagaaauagucaugcauuggcccaacacaaaaugaguacccagaggcaaaaguaaaauccuaauguuauaaauauuugaauauggggaccacgugucugccuucauauuagcuuuguaagcaagccaaguuaaguuacauguguacgaauauaggcacugacacauacauuauacauauggaauaauauuugcacugcacugucucagaaccuguggauccuccucaugaaggaagaaaggagagagguuugaacagagacacauccuuuauaccaugccuauaugaauaugaaauuauaauccuuagccuguacuugaggauucuuucccauagcacagugauucucaaccuuccuaaugcuguggcccuauuugacaguuccucauguuguggugacccccaaccauaaaguuauuuuguugcuacuucauauuauaaauuguaaugauauguaggauaucugauaugugaccccaaagaggucaugacccacagguugagacccacugccuuuacauaaugcaaaauuaaaagauccuaucaaauuccuauauuggcaaacgucuagucuuuguccagucucauuagugauccacagacagcuauguucuccuggggaguuaaggaaauauacaaauauccuucucugcuauauagaugagaaaggacacaaggcacccaguuuuagcaugcagaacugcccuguugcacugucuggccgggauggaagauacauuccucucugugcuuugcauauacccuuuccacucugaggcuuaagccucaugggagcaacucugacauuagcgcccaagucuauagacaucaguauagcucuuuuuagagacuuuauccacguucucccagucuuugauacacucuggagacuagauuaucuggaaaaacaauugagcuuacaguacauacuauuccuacagcucaagaggagaagcauuuuugaggccuuguugggcaaacguauuugcauaauuuggaaaauuagcuuauaaccagcauguguugagcguucccuucaugcuguuucuggcauugacaguuuuacacacucucaucugauguccacaacaccaccaugauaugugcuuauuuuccaucccauuugacauacaauacagugaagcuucgaaagaucauacaguguagucuacuucacacugaagacugcuuaaggccaccauacugugaacccaaugccugcugcaagguuggucuuugcaauccccuguuucucacagauuuucaagccaagucuuuaaagugggccuuuuuagauuagcguccuagauauuauuacauuauuugaaaaccaaguauuguaggagcccaccuacuuagacaaacacaucuguauacaaguguaucccugauccaggaugauccaucuagccuccuagggauucucuaucucuuggucccugcucagagcaccauuggaauggcagacuagcauacuaaacugaagucuugcuagucuaguaacaaaacagucugacaauuagggcagggaugggcagauagucuuuucagagcaauaugcugcgauacugcagcaguuuuuuaaguacucagugaacuaaaaguugacacacuuggaaagcguuuaauucucuggaaguaauuucucuacuugaagcuucugacugucucuagcccaagucccaguuggguuuggucuucuagcauccguauucccagcacagcuuauuuagcuucagcucuuuguguuucucccuguuuguuguaaugcugcauguugauuucagggccucugcauacuggguaagcacucugaugagcuacaucccagcccuucgggcuucuuaaauaguggccuugugcugcccuucuuacuggaaaggaccucagcaaggauguuucacccaauaauggaauaugacucauucaagauuuccugaaccaggugugaaggacaagaauugccuaguagcaauggagaucacugaaugugugccauuuuugcauaaggagagggacuaugcccucucccugacgucuaccccuucguucaucucgucugccuuuugguucauaaucaugucuuccgaucacauucacacucauucuuacuuugucacaccauccugagcuuugugccauuacauuuagaaauggguugggaaauagcaucggaguguagcagggccaggcuucugaguggccguucugccuuucaguggcuacacuagaauugaaaaccacaggauuugcccccuggaagggcaggagauacucuggacaguuuccuuguugaagaaggaaccagaaucucagugccaucgagggucucggggcacucggcucgucuguuucugaguuggcaccugucauggauguaacuguguucaaauaaguugccuagucacaaaacaaacaagcaaacaaacaacgcuuccuuacuuguggcuucuguaaaccaaagggcagaacugaaaugacgcucacacaucauuccaucaucagcuaauccuguucuuucaagaagggaauuuaaauuuuaaauuucaucauuucaccauccuagaaugagauuuuacauggaauucuuuuuuucuucuucuucuucuucuuuuuuuuuuuuuuuuuuuuuugaggcugcaauuaaacaacaguuuaauuugcuugucuccacaucuucaaggagaagucugucauaaagcagaaccauuugcuguugguucuuccuuaccaaguucauacaaguaugacugugugcgagaagcaguuugugaaggaaaugaaaaccuuugauuauugaucaaugauagucaucauuuuaugcagacuuugcagccaagcaccaaaagagucauccaucaacuuccaggaaguugucccaaacccaguaaaggugcaauguauaauuaaaguuuugauguauuaauuagacaauccgagagcucacuugaagauaaaaggacaccagaugugucagggagaaaaaguugacgugcuuuagauaaaauuuaaaaucaaaagccuucaaaucgucuuaugcucuauuauagcgaaaugauugcuuaguucaaagucucacugacaauuuaacauauucaguuugaucaucugggcuuagauuuuuuuuucuuuuuuugcccuuuccuuauccccaaauaauuuuugagacgauggaagauacagugcaacaagaaccagacagcagcuuccuaucaggcuccugguuucgagggucaaaccucauuuauauuuagcucucuuguuuacaagauggaaaauguccuuucauuuuuaucacugugguccacuuaggucaagcuuuuaacacaagcaaaggcaacuuauuaauauuuauuagguggaaaaaauuauugacuuuaaaaaaaaauaacaucucaguaaaaucucacuugccuggaaccugguacucaguccgcgguggcauccucucuucuuuguacuuauggauacagaaguggccuuccuuccugcugggauguauugauggggaauaaugaacuuagcauuugcagggagcuugugugcagugucacguucauccuuggcugguacaggcccuuuaaagcagcagccccuucuccucuuuccucccaucugugcagcagaaaggaagggacggucauugugcuuucuuggcaccgaggugacuuagccuugcuuuuaaggucaggccgggcaagggguauccaguguuuuagauuuucguuccucaccuuucuauaucucauuccaauucugauucacucuguaaauaagaaagcuguucuucuuuucuuagcucuugcaacuaaggcuuuagggauaguuucagaccuacaucuuccaaggagaaaggauuuggugguguaaagagggaagccauucaacaaacaucucaaugucuccaugccuuuguuugucauuacuggucauuguuguguucagcauuguggguuugauuuuccuuuuuuuuuuuauccagauccccccacaacuaucccuccucccacaacaaccaccaccacuaccaccaccaccaccaccaccauccuuaccaucaucacagguaugguaccuucauugccauuggaaauguccugaauguuuauugucuuuuugguauaaucaaaaagaagacuagcuguucccuggaaggccucugagcuuaacuguuccucuacuuuggaacucuagagacacccaauacuauguuauugaauugagucuuaaggacccaggaagaacuuuuaacaucugagcuguuagcagaucagaugcugcgcaccuuagcaugagggaauucuuuacgaagcgaucacuacucaaagcaaaaacacuagaaaaauggcagccuggcuacucgcuuggccacagcuggugaaaugguaaguaccauggccuagaucacauaaugccuuggucuaagcuucaucuuaauccccacaaagcaaauauaugcaccaaguuucagaaugucuacgugggccacauaugugucauccuccaucuugugacgggugccugcuggcaugguggcugcacaggccaguuguugccugagagauugcaggaaucaggcggagucauugucuuuucuaagcacuugaaugcaccaccucuuuauauauauuauauauccucccuccucaucccaguguccaguggaucucaacgguuugauguuucaugacuggaagccuuggaguuucuucuagucuagcaagauaugacagugcaugccaauaccauuccaacacagugugccaggcuuccuuagaccaagccuuuccuggcaaccauuuccagguguccacucuaaggaaggaaagacacucuugcaaaagugacuuuuccccuuaggaacauuacccaacaagugucugagguuucuuugaaccgugagugcugucauugugucccuggaccccuugauacccacugaauaucucacugggugcucuuccguguuuacauccuuagcgcccaagaucuaacagccacuuccuagagucauguucaucuccugaagacauuuuauuuuccauuugcucaagaguugaugagaugacagaaagcagagugcucugugagagagggaggccucaucacagauacuggaauggauggucuaauccaggguuucuucaucuuucagcuauuacacugggacaaagaacugugccauaagccaccacugaggggcuuccuaaacacugguuacaaacacgugugccuauacuaaacgucaacccuucugaaaauccaucaauugauguggugucucgcuccaaaccuggcuuccucuagagaaucugcuuccugagucuugucuguuucugcuugagcucucugucaguucccucggcuucuuagugaacucaguuuggagcacaguagaccagugccuggcaucuucuguaucguucauuagcauauggaagauguuccuccucugucagaucuccacaaaagcuauccugccaaugcuucauccuaagaauccaauuccucaucugucucuuaucugauuaguaaagcuggauuggguguguacuuauucucucuuguuugccuggcguugcugguguggaauccagggccucuagaaugcuaugccaggcgagcacuguguagcugagcucuauccuccauccuuuaggcaugugcuuuucuuagcagguuucaugguuuccucuggaagacccuuuggaugucagacuagauaaccaagccucagauaucauuagcaguauguucaucuuaggagaaguaugucacagccuuuauaucucccguaguagaagguuccaucuagguaucuguaaggguuuauaucugacguccauaaagcccucucccauucugugaaaacagccccauuucucaugaauguagagugacacuuuuccagugugacuggcuucaucgcuucagcagcugucccugacacuuccccaccaccacaauccgucucacaagucaccugagucgcucuaagucaccgcucuuaauccuuugcucccaaggaccuccuucuccugugaggcccucaaacauguacaacucacugugaucacagcucugacugcagcgacacugucagggaagaaauucuuagaagaaauggcaccauauuucuagccacaucagagaagacuuuaauuggaacaugucuacuucugucucuaccacuggccucucaguucaaaauaacuuaggaugaucucacaggugcacuuuggucuguggauguuagccuugaaugcuuucuacaacaccgaaugcaucugugguaacgaaugcccaggucuucagcggcacacccaagagucauuaaacuaaaauugcuacuaaaacacguaguagaaucuguccccuuaauggaugugaucuuucaggcugacugugucuuaacaagccgccuucuauauauauuuaucuuguccagaaagcaacuuguagaauuuaacauuuguuccuuucugcagacagauuagagguuauggacuugaaugguucucugucccauuuuaaagguccaggcuaucuucuagauuuagauugguuccuacagaauauuccagacggaauccugacaaauggauagcuaaauuaauuuccacuccuccccuccugcacuguuugguccguuuacagccaccauuagccuuaaaagcuucaauagccgaaucuagcgacaagaacauaaaccuggggcucuacaaagaaaaagaagcacccguagucggcuauuucuuuccuccuagucaaaugcaauaacugaaagccauuccccaggucagaguuucauuacuagaaaaauguacaaaugcaauagaaaaauauuuuucaagcucaaaaggcccuaguugauuucugauuuccccuaaagaagcguugcauagcuaccuuuuaucuucccuaccuaggguaauggaauuguucccuuuguuaggaaggcauucuguccccaggcaccuggcucucaaaacauacugcagcucccucguggagauaccugaaggaaucccauaccccuccaacucuuuguccccccaucccccaaaauucuuagauuucuugcucuccucagagagcaguggccucugccugcuguccucuccgcuugaagcagagcuagugacaugucagacucaccagaaggguagcccuauguaaggaaauuuuucugcagugugaagaguauucaggcugagcaugguguucauaccuuuaaucccagugcuugggaggcagaggcagguagaucucugugcguuggaggccauccaggucuacauaaagaggccuugucucaaagaggagagggagggagggagggagggagggagggagggagggagagagagagagagagagaaagagagagagagagagaauucagcaucugucagcuauaucagcagggauguaacuuuacagcugauaagucauugacauuauucuaaggucucuccacauuuaaaaaaaaaaacaauuugaggauggaauugguugagaagccauuuagagccucauuagcauuugcccuaagauccaaagguaucucucucaucuuuccugcuucuuguuguuaugauugguucugcucagcucuuggcuuugggagguccccucacucccaccacuuaguguuuuauuuuauuuuauuguuuugucaugucagguuuuccaugggguuucuuccuuuguaagaguauaugccacgguauaggagagcaacccgaugaaaucauuugaacuugcuuccuagucaaccucauguuucagggaugguagcagcuccugucucugugccucagugcuuggagauagcguuagccucuuccucuuaauugggucaugcauccuuccugaaauuuucuuggaaaagcguucuauguuucucccuuuaauuaaccuggauauugcauuguuccuaccugauggaauccugaccugugugcuugguggagagagccaugaaaaguacucagcauccagcuuccgucauacacaccucuaacaguuuagauacaaagcacaggccaggagaugcucaaccuguaagucacacuauacauacagcugccauagauuuuaaaaauaaaaauaaaaaauaaaauaaaaacagccuuagaguaagaaugaauagcuauagggcuagacugugaaacacauuuaaaaguccucuccucagaacgaaguaggucauuucuaaaugaguuuuuccucuuuuuuuaaaaagcauguauucaauuaaguauuuugaauuucuuagaaaagaaaauagcaagguuucucuuauuggugucaaagcacucaaaagccaauacacuugggaggaagugacuccuacccucagggccuuguauuauuggggcuuucacagcuugaugucauagacuuucuuccauguuaaugugaauuagaucgaguacagaaggcauauacagccuuuuccuucagugguauuuggaaagcaugccaguaggggagcuggcaccaagcaugcccgugucuucacuguaaaggagggacacaugugacaccaagucgcugguguggcugucuaaauaguaacagcuuucuccacaccgagcucucgguuccccagugauuccagcccugagcugcugcuguuggcagggugcaaaggcuauaaagaugaucuacgucuaggugugcauuuagcaaagauugagcacccuuaguacguguagaaaaggacuuuuuaaaccccaucuugugugguugagagaugccaugccccuggaguguuugugccaaaggcaacaggugcgacagggcagcgucacagaaguggucuuugcucaaugccaucaaagaauggauagaauguagauacaaaaauaggcaugaagaaccaauaaugcuucuagcaucucucuucaagacagguguauuucuguugccuagagugacccccccccuuucccuagaaaacacgcauccuucauccuagaguguuucugaguugccuuuuuccugggauugccauccacacuccauuuagaccgucuucccucagacacugaacacuuauagagcauacugagaucccaguaugcccgaggacaggaauguuauuagggcacuaguuaauaucaaugagccucuuuuuaccuagucuaccaccuuugcauguccaucucuuuucauacuguccugucuacauuuucauuuugccaguaauugucaacccacuaccuguugccucauagccaaccauuuuugacccaugcugguuuagcaaggaacagaagaaaguaagaaugccacaaauauuaaaaguaaucagacuccaccuuuuuuuuuuuaauggugaggguugaaaagugaggugagcucuguuuauucuacuacuucuaucauaauuuuccuaaguguacauucuuuauuuaaaacuuaauccuggagauagaguuccaaccaguguccguacucagcaucugucagcgaagcacauaagugagaguagcagggauucggaucucuugggauuucagaagugaaaccuggaguucucccaaugguaggagcaugggcaugaagagcucagucguccaggaucucaagagaugagucuuagccuugcagagccccucccucuucugcccuggcuaccacccacccuaugucaccccuacuuuaguccccagucugcucuuccuccccuggcuugugucccgaccccuaggucccauucccaaccgcauucagagacaaugccauagggauuguuuuccuuguuaaaggaaaccacucuauagauugugauuauuguacagaacaucugguuugcaaacgagaggaucucuggggcuugggcugcccggagugaacaauuuugaagaagcuuuuaacaaaacuugaaacugcuuaacagcaaccaggaaaccagcuccucuucccgcuguucuggggcucacagucucgucacugcacggaaaaggugacauuuaaaagauaaucuagggcuggugagguggcuccauggcuaaagagcuuauuccucaagcgugaaagccuggguuaggauuuccagcacucacagaagagccgggcauagcgggcgcucugugcucauagucucugcacuugggagcagagacccaggguccaggagcucacagccuucagguucagugagagacucugucucaaaaaauaaggugaagaagaagaaacaguugaaggcauccuaaugucaacugcuugucuucacgugcacccaugcagggaguauacacacgcgcgcgcgcgcgcgcgcgcgcacacacacacacacacacacacacacacacacacacacacacacacaauggcuuucuuagggcauccaguuaaggccuuuuuagcucagcucuguucuuggccacuuucuccaucauuaaggaaugauagguuaauuaggcagaacauagguggcaaggaaauuaauuggaaaaccaguagaaaauacaguucaaaacuugaauuuuccagcacuuauuuuucucuuucaacagauuucaaauaaauggagagggggaaggggggagaagaaaacacccauauuuaauauauauuggcaagcauggcacagcuaugaaguuaaauugucaggggaauucuuugccugcccuggugcugagauuuaaaaccucuccauugcagagacugaagaggaauucaauuaagaaagcccguugguucuguauugacuuuaguuaagaaaauaaaguagggaaaguguauuaaaauguggcuaggcugcucgccucacuuccagcuaagcuuauggcuggcaagacaggguugucugaauuccccacagcucuagggcaggcuguuuuuuccagguuguacccacagcauuuucuaguguccacccugaucucacauagccaugugcugcccuacagugacucuaucauaacacaagaaccgcacaggucaauugguaagaaaaguauuuaagguugggaauuuaauuuuguucuuggauuuccauuuauggcccccguuguguuugagaccacggacuaauuuauggauuaguuuuaagcccccagucugucacacucagugaacaauucuaaguuggagagaauccaucugaaaggauuagaaugaaccacugugggacuuacacaugacuguuucaacuaaauauugcccagcugccacucagcaggcugagggucccccccccccccacacacacacacccuuccucuuggcuacuugguuaaauggcuacugucucuaaucucacacauugucaaagccuucucauuucguaaauaucuuaaccucggcaugaaagaucuguggugguuucauuuguuugaggcagggucacauuaacugcuugcaggccucugagccuaagaagagaagucagcuuugaggggaagacugacaagggaagucagugcaaggccugucucaggcaccuucuuuggauuguaaacucauaaacagcuaagaauugccuaggaagaugagguacccacacagucuucgugagaaggggauuggcucgguuucguuuguuucauguaucuuuuaaaaugguauuguauauuauuauaaaauaauauacaauacauuugcccucaucauaauuaaaacuagagagaaaggcauaacuuggccauuuuauauauuaucacccagugcuucccaaucaacuuuuugugaccuauuuuucucauaggccuagcucaaagauuuuuuuuuuuaagacaacaaaauuagcuuuuaaaagccuuucugagggcaaccagacacuauuuuucaagccaauuauugcauuuauaacuucguuuggaaacguuugccuuugcccacacaauuaaaauguuaugaaauacuccacugaccaccccugcagcugauucuugaggguggguuuguguuuuucucuacuuccuguugaagacacccuaauaaaaugugcuucacggcuuuaggcucaccccagagccaaguugucugugaugucugcauggugucauaaugcaauuauaaaggagaauuagauccugucccagugucccuguggggagcacacagucacuuguaaaguguuuucccuucucucuucacuugaaauagccucugcucaggucguauaccagaugcucucugagaaagagucaauagcucccggacacacuccuaauccugauuucagccccguagccaaccugaguuccugcugcagccccccuccuggugcugcucauggguuuacccuuuccagcugcaauaaccaugcuguuugacuugaguauguguuugcuuaacuguuuuagaguguuuuccugcaaugucccuuuuucucuucuguugggugcaauugauggauuucgcaucccuggaguuggggugcaaaaugcacgauggccguggcugcauuuauuguccggugcccauguuaagagcugacgccuggcuucaccugguuuaauuuugucaugcagcugacauaaugcccuaaugcaggaagacaguaaauugggaucauuggucaaugcucagaucugacuuuggaaacuuuuaacuccuugcuuucguuuuacacuaaugauuuaccugguucaaaagaaaagaacaauacaaaaaugaaaacaaaacccaagugcauauuagaaacgcuaccaugaaaauaauaauaagugccaaagcauugauugcuuuuccuuuucuguuuggaaaggggccagugccugcccaucaacuguacuaauguauuaaugcguagaaauuauacaaaugugcuuuugauccugccccucaaauuuaaaguuucucacacuaguguuggacucagaugucucaacuauggagaggugucugucccuuuaaggaucuaguguaggguuuguuucaacugcacaguuuucugugccguuccuaccgcuaugguaggcacacagacuugacuuguaaguaaguauuguccucuuugcuuuaugcuuuuucccuccuuccuccacucucaagaaauguagugcuugguuauaccaagcugcauuggccucgcagaccucugguuaaucuggcuccuugggagggcucugaguucuuuaugguaacugggucccucuugacccagaaagcaugccaauugagggggaacaccggugugaauucaugugucauauuuauacaucagaagcuccaggcucauuguacccccuuccuaaaaaaguucuguuuggagugccagugcauuuaaacauugccugugucaagaugcagagaguccauggaaacaauugccagccagagaacugcaucauaaaaagggcggggauuacuugugauuuuuagcccucacuauuccacuucaccagcagcagcuucugacuagagagggccugguaggagaaacaccauugaaaacugcagaacugaagaagaaaguagguccuggugcgacgacauuaagaugaaguuugucagaagcaccaagucugaaacaaacaucacugcauauauuguuacuuaugcaccccacuucuguagcuaaaagaaagggcaaacccaugccucaagugccugggggugggagggaauguuccugugaagaaaagccacugccacaaccugauaggaacgaacuugaacaaccucaaaaaaugaagacagagacaggccacagcgggagagaacagcauuaaagaugaugguggcucugucuccugacccagccaugacagcagaauccugacaaccaaaccugggccauggugcacugaguacuugagacuuugaaauucacaaguaguguuuggcaguugugugagcauguguguuauugugacaggccuuggagaugauaacaucugguaaaauggaaggaucagagugugagugagugagugagugugugugugugugugugugugugugugugugugugugugugugugugucuugaacacauucacucccacggccucuccaugaacugaacuugccagcuaucuucugaugaaauaacaacaguggauggagaaccugaaucuggguguggcacguucaccugcaagcaucugagcuucagcuggaaaaguauccuccuaagcguggggcugauugcugugauguucacuugcugauggagaggcacggugccccgccccggggggugggguggggggcguggcuaacacaaaggcaauguuugaaugucugaauccauuguuuaacuagccuuccgacugagcuuuucugucgcaguccugagcuuugaugccuugagaaccauguagcagucgcugaguuugcacugguguuucucgucacuuugcaugugccccugacuauucacucgcaaacgcguguguccuggcaagacccccagaaccaaagaguuuacuguuuuccuccccggcucggcucgcagcuuugggcucaaggcaugucuuaaaacagugcaacucacuucaaaugcuuuuggcuuuucauuuauuauugcuugucacgcgguguucuuugaaagcuugcucauauauuaucuguuccauuuuuuuuccauucucccuuuuuuugcaugccguuccuccuguuucuucccuuccuccaauccucuguuccugucuguagacaccacggcgacgacagaaccagcaguucacgguugguaccacauuacuguuuaucuacuuucucagcgcugcugagaggcaaggcaagccuggggaaaagaaaugcagucuucaagggaacucaugcuucaaauagacugaucucaugaaugcacucuaguuuuuuuaacgcuugacauuacgcugagucuugucauuucuguugugaguucaguggccagugguugcagucugagaugagcccuccccucugguggcaaacggggcaagauguccaucccauguuccucugauauauaaaacuccaccacaccuuggaauaaaggagccuucaaaaauguuuuaauuaaaaauguaaaguguauuugucuacagagcuaggagcuguaggccagaguguuccaggacucaccagcuuuuaccucaggauuuuggaagggaguucuucgucccucagugcuugaggcagaggauccaggaggaaaaucucuaguuugaccccugacguggacagagaaagccugcuagucuucuccauagaaguccugacuuuucuuacauccugcugggaauuuacccaccccaccuccccaggcccucugcucacugccgcuccccaagaauguuccccaugcccguuugaacagcaucaaguaagguuuuaaggaagucuuggaugugugccacuuggcaagccaaauaguaaaaagagcauuaaguuucuuuuuagccaaaaggugauuaaaaaacagagugcauacacuucagacagggacaucagggcacucugccuccuuuccccugucaccgaaauggggacaagucugucaacuuuuguuuuuguguuuuauucagucagaaaaugagaguccuuuuucaucaguguauuauuuugcuccucagcucaaaucuaacuuuggcaagacaauacuuagagcagauauuuuaguuuaaagggggagucauaacugaauccaagggaaucauuugguaaagggucugcaucaaucacuuuauaugcugugcagagugaaaagucuguuacuucagugacaggaggugaucacagccagccuuguagucaacucaguugcuagaauaacaucugucccacacugacuaccguagauaacuaugucugagaacuuauaaguuaggaauuugaauaaaaccuguugggcagugcuuggucaagaucagcagggaaccccuucccccuuuccucugcucccuuccccuccuccccucaugccucucuugcaaaguaacacaagcuuaaguaggagaccuaaccuacccccacuucacugcccuuuccugccauugggacaaagggaaauguccaugcaguaaguuagaggggccagguacacugggcggccaugagaaaucaguuagguauagaaugugcaucuccaaaguaguguccauuagagcuaacuauaucucaggcagcaacuccauuauacuuaguuguugguauaguggcccauaccuuuauccuagcaccugggaggcagagucagauggaucucugugaguucaaggccaguguggucuacagaggagcccugucucaggauuggggggugggggguggggggcguacuuuaguuguuuguuuuaccuauaguugaguaccuccugacucuuaucgauuauccucugaucuuuaaguugguuucaguguaguucaagagauuuuguuuuauucuuucuaaaguacucuuaaguuuugggcuuucuauaauuagcuccagggucaagugcauucccaacauucccaaauucucugggcucuuuaaagaaauagugaccauuucuucccuaaagccccaaaguucuauguuuuaguuccucgagaaaaaaagaagcacacgcccuuguaggcucauccuuaagcucccggacagggcgagcaaacuagagaccuuguccucucgucuaaaguauugaggcaucaacuaaaagccaauucugauuuggggcaacucauguuaauuacgacugucucuuuagaaagagaacaaaggagagaggagucucuggacacauggauuggcaugauucuauagcacacugaccgcaggacauaggguuggcugugccaugagaagcagccgcugucauucuaucuggaaacagcaucaagcuggguguaaagggugagaccaacugguaugagauguuugugggagaaaguagcaaggccaucuucccugugcccuguauuccucgugccuucaguuggccugcuuagcagcaaacaaguagguaauccgagcuggucccuguauaauguauuuauaaaugcauuccucaacuugucucugauccucauagcuucuccucaaagggucucccacuguuuuaaccagcugacucucaagcccacagccaaaagcucuaacaagaacuaagauaaugccuggaauuuaacuugaugaaaagggaagacauuucugagucaguuguaaaggguaacaauguggugagagcuacagaccaaggcagcagagcaacaaggccauuauaugauaucgucaauuuuagccuagugcuagaggcucagcucuucaguacagcaaccgcaugacagauucacuugaugaccucaagaugguccuaacagugacuugucccaggggggggcgggagggggaacaaguuaaguggcuugauaacucagcaacuuaaaugacaagacauccuaagucagccagcugugaccaucuuaguggucucaaaaguguuauacuggguuuuccagauggcuguuuucuuugauuuaaaaaaaaaaaaaaaaaaaaagacauuuugaagauuucccuuugaagacucauuaaacuauuugauucaagcuuguguugcuagagucuguaugaaguuucuucuaguuguuucuguauguugacuguuuguucuuaccaauaacugauugcaauaagcauggacuggaagguuggaagugcaugggcaugaacugagaccaaauggauuuucuccaaaagaaaaccaagcaacaagucaccaccguauguuguuaaggcucucacugagaauacagauaaauguaagaacgagauguucacgccaggcugacccgggggucucuuugaauaagggaucuugagcauugugguuuuguggcucauccuuaagggccugcacagggggaagaaaacaccccuguguuguugugugcauguugaacgaugcaaaaagaaaaagaaaaaaaagaaaaaaaccacugccaaauccugauagcucauggccagaagcugcaggcagacaugcaugggugguuaacgcacgggcggggucgucgucauucugguuauucgguguaugggugugugugaugguuucugucuuucuguuucacuguggacgcuucucuguaaaugucuugugccuuguucuuuucuguucuguguguccccucucccuuucccuccccuccccccugcccccacgaggggugggguaacagcaugcccacggucuggaauagcgcuugugccucuguuacacugcagacagcuggcuucuggguugggggucucuccucucucuaucugucuguuugucuaucuaucuaucuaucuaccuaccuaccuaccuaccaauccaccuaccuaucuaucuaccucuucccauuccccuucucacucucuuaauucugccugccuuuucuaccuguugagacaguggaggcugacaaucccauggauuuccuuaucucagauuauuuuuuaaauagauuuuuaacucauuccaaaaugaagaacccaaucugaagcauuuuucauuuucuauuuugguuucagaguguuugcccagugcuagguaacaacccccccccccagaccacugccccaugugucucccuuucccugauuuaugacuagcgcagaccaugauaggaugcuagaagcacuguguucuguccuuaccuuacuugauauucaguuguggggaaguucuuaagcccauuugaaagaagacuagccagcagugcacacgguuacaaccgcuauguccaccgucuguguaugugccucuguguacaucucucuguaugaguacguaacaguggcauucaaaggcugucauucagucaagggacucugcagaccuuguaugcucuacccaagaacaaagcuaaagagguuuacgaauggcugcaggaccugaagauugcguugcagccuugauaugcaguuuggaaaccguuuaacggcgugaaccaaauuucugcuaaugggaagaagggaaaaacucuccacaaaagcugacaaagcaggaagaacaggaugacugagcuuuuagauuaaaacuaccgggggcgucugaacucuuauggcuggugguggaaguaucaguuuccacgacauggccaagugaucagaugcgugcugcguagguaagagagagaccgucgccuacuuuguuuuuauaaugggaguggcacuaggccacugggccaagguuuugcuuccuagggauuuuauuucauuguuauuuuuuuuuguaauuuucuguggaauauuuacaugaugaccugaugaaucgaaccaaggaaccuuuuuagguauacuugauuuuugcacuuauggaaauggcuaggauuucugacugauucugauucuuuggggucuuucucuucugguuuaaaauugccaugucaagaagaaaucacagcuucagaagcccacagugcugcaccauagcaccuguaacccagaaaagaccaaacaggagucucggcagaagauaccgccacugugcauaaauuaaauuaucauaucugcaccuuaggacuuccuuaauugcucaaaaaauaucccauaugcaacaaaaguaaacuuucauuuguuuaacaguuuaaagaaaugcacugcaugcauuuuaauuagaagugacuagaaagagcgugaauagaugauaggaaauuuugaauagaagaaccaagaaguaauuucccacugacuguucagucacaguguuuccuuuugagaaauauucucugcuucauaaaaugcaucuuugucauuuucuuugagagaaugagaggagucuaauuuuuaauaugaaagaaaaauaccuaagccaaagcaauucuagggguaaguuuuguuuuuccuuacugugccucgagugcuauggcaaaguccccuaauuauauuuauucaaaaauuauccagcuaugacagugugcuguagauuucauuuaaaacacacacacacacacacacacacacacacacacacaaucgaacugcaaaaacaaauguaaugccacuguccuaaauggcuucucggucuggaacauaaucuaagcaggagauuccagaugauuuggucuauuuuaaaguuuaugccauuaaaaaugacaguuuuagcucuaaugagguguauaucaacugucugucgcuucuuaauggaaaacuuugcauaucaaugauacuucauaaacauauuugucuuuauuuuuuaaaauuagcuuucuagugcccuccccaaggaaacaggucuucagcaguaaagcugccuacuugaagcguccuuguuuaaugugguucagugggcaccaagcacguauguagaacacuuugauauucaucgggccacguaagaagugagggauuagccuucugagaacugcaaauuuauaauuaacuacaaagaacuacuuuauguuacccauuuauaacaguuauucaaauaauuguauucaucagucuuuauucaauggauaaagccaauuagaaauagaaacacuuucagccaaucagauuucaggacaaaaggcuagcauuucuccucagcugccuguauaauuuaucacguugccacacucccuuuagucaccugguuccauagcuugggaacaccugugaacucugaaggcuuuaguguugguuuggcuucugcucgggagcuuuuggcauccaggguucaugugggaaaauguccuccccuaggaguggcgguggagccaccuccucacgagcucagccagcucuccacguucaugugucagugaccucagaagucucaagauuuaaugaccacucauauaaacuuguuuaguucauuugauauauguauauaugcaugaauauauggcaacccgucagccauaauguauuuucagagcacuguuuugguugccuuaaagcucugguaaguaauucaccaagaaugacucucaaaacauucuuucagcaaauacuuacugagaauacacuuugugccaagcugcagggagggggaggauacaaaauaagcgaaauccgugucucuccaaagaccuugcagcugaauuagauccacaccaucuucaaaaugacagcuaaagacuauaggacagauagugugggaauuugaguuccuggggcaguaagucggauugaagaagaacagcaaccaauaagcaaagggccccgugaccaccuuaacauguccugugcuuuaauaagcuucagcuuccuuaaaagaucagcgcaggaaggaggaugaggacauggaagccauugcuagcugaaccucgcuccgcuuagcugggcuccucuucgccucucucaauucaaauuagagcugguggagaaccauccaagcagaccagcacugggguugacuggaguacagucaccucaagccccacucgauuaucuccugaccuaacugcuuuuucagcuuugaggguuuuauuuuuccagaaugccauugaucuauaaaauucuuuuucuuaaaaaaaaggggguuguaagucaccuuuuucugaugaaggcauaaccugugaucugcauuuagcaggugauggaccauuuugacaucaugggaucuaagauugugcuaaauuaauaguguacuguguuugucaguauuggcaaaggauuucaauuuucaggaaaaugcaagauaaaacuuacauacaucaguauguagcaucuaaauacauucauauucaagagaccuguaucagagugcccacagcuaacacuccggcuuugcuuuuuccuuucugcaugcuguuuugagugagugauuuuuaaacauucaccccucauguuucaugugcuuucaacaguggaggccgaggauuccuucugccucgauugucuaucaauaacaaaaaaauuacauaguuaaagaaaugaacguauggauuaauauauucuagcucuccaaaaaaagugagagauagcaagagauuuggcucauguuuuauuuuaaaaagacaacaaaaacagaaucccuccucaguucuuaaguguuuuguuuaugucccucgaggaaugaaaagaaaaacgauuuguuuuuacuuguaaggccuuacucaguugcccaauuccgcagaagaacuggacagugaggaucucucagguaagggcuagucacuagguaaggcacugcaguguccaaccugugggugacuuuguccacugugacccaaugaccacuugguuugcuaagcaaucaaucaauguggauccugagacuaagaagagaaugaauuuguggagcuaacucuccuucucuguucacucacccaccuuucucuccucugguaacagugugucucguuucggaccaaggccugcaccauaaauacaguagagagcagagcgccaaggccaccucugcuccaugacuugaaguaauguguuccuuccuacauauguaauggcucaggacaaauuugguuguaucauaaagcaguugauguuggauuaugugacacgaucuaaagucauauugacugucgacuucuguggaauagacgagaaggccacuuggaaguagcugguggaaagcagguucgggugggcaguugauuuuucagacaccgggcuguaaacucuuuauccaccucagaccuuuuccacagcauagugagcucuugugaaaguagguuucaugccugacuccaggauuuagguguuacuaauccagaauaagaagcauauccuaaaaaggccggaggaaggagauuuaaaguggucagggcuaaacaauuauaugagcucccauugauaucaugagauuucagugccaacugccuacagcuucugaagcucucugauuggucacuuagugaaucaguaagcaagccccuugacauugcauuggagaaaccaaagcacacauaugguugcuuccuggagaacacaggaaagcaggauuccauauuggucuuucccaaauaauguucucuauaguugguuugaauggcugguacuuuaggugccaucuugaacacagcuaguacucacucccccccccccaaugucucagagcacauaggauuuauccagucuugugcuucucucagaccucaggggugcucucacuuuucuucucugucccaugugugagggugagcugagcuguuggagacccccagaguagaagcuuccaggaggaggcuauaggcugggucuguuuccugcugugcaccuguccugcaauaagcagccagcuaauacuuucugaacaaauggacaaauucuaaguacuugugaauuucaguaaaucaguuguuuagaaaggaaacuaccuauuagccaugucauucccucaucucuuacuugugauagauauauuuaaagaaguuguaaaagaaaaaaaaaagaaaagaaaccacacuaacuuuacuuuccuuaaaaacaagaguaggcauguccuaccuggcaguaauacaacaccagaaguauaaacaaaugcuugccuccccaggugacagugggcauuguucuggcacacccccccccccaccgccccuaaacagagcagcccucaggugcagacccugcacaacuggaucuuucaagaauccugaaguucuccuggguugacccugaucuccuuuggcacauauuccaggcaaggaucccucagacaggcaaacagaacuuaauccucuuuaggaaaacacgaaucagccaggucccucuucucccagcaccaucaauuaggggcacugcaggccucagccugccccugguuagaugggcccccacugcugcucuaucaaucacccgagucaggagcaauaaaccaacaaccuuuuguguucauaauaauuugguuaaauuaauaauuacaccgccuccccccccucccguaccgaccccccccccccccguuggcgggagucaugagucaugcagaacggugauaaaccggcagggcggcuggggcagggcugccuuugcaucugguuugaugaacuaaucaaaaacugauuagcaccuuuguucaaaggggaugcugauuaaucaauuacuauugauugugagcuuggcuucuccaggcagcgaagagacgucuaaagggagaaaaaacaaccaauaaaaauugagcagcugucauaguguuuaaauuuauuaaaacaaaauacauuauuuuuuaugaagcugucuugaaaugggucacugaaggggagcguauugacugaggaaggaugaacuucucaaguuucuguagccugcagacugaauucaauuauaaugcaagacaaacagguuaacacccgccuuaaacagcccgucgauaaauuagaguagguguugcccauuuaaugcuaaacugugauaaugaauaauguuacccacucccugcuguacuggguagagaguccauccuuuccacauuagggauuaauguuucacacuuucagagcuuccccugcccugcccccaccuccauuccccggugccugccucaguuaaugacaguuucauaggcagcauaugguaugccgcccucaaccagcaaagcgggaugcccggcugauccuccuuuguaaucugcauuuaaacaaaaaaaaaaaaaaaaagauuuggggccuaguucacugauuuaauuauuggccaacuugggggggcggggcuuauccgauucuuucucgaacccuuuuauuuaguuuuugggucuuaacuuuauugacuauagauccacacuacuuuugaauuguuuuaucaauuacaucugcuguuucucggugacagcuggugguuauuaccacccauguggaauagaauagcuuuaagcauauuuauccuucuacuuuauuuuaaaacuuuaacaaaaaugucuccaacugccucccuccccgcagcauggaggagccucugggaacuguucaguggagugcggugguaaauagugugccagagaauggcccucagcagcggcagggcagcccauccgucuucagcuggggaagcagggcaccaacaaggcauuccagcacugcuuucuuguuacucucaaaaugagagagugaucuggaaaauuccuccacgcccuucacacgccacagaaacacgcgggggaggggcaggcuuccgccuggcuucccugaccccugcguaggugcugggagcaacccagugacccagcuccuggcuccccagguggauuacaagagcuugggcuuuacccccccagcccucaucuccagggugucucaagcagggugcaguacaugguggacucaugugugcgugcgugcauucccgcacaggugaacgcacuugugcauacaagcacacacacacagccacucaguaacccuucaguuagcaccacaggaugugugacccugcuuuggaaaacaggcuguuggaugucaggagaaggaaagaaagacucuaccauuaagcaaugccccuggcccuccuauauaucaccuaauuucuuauuccacaaaagcauuugagcaccaugugcuugguucugggcuagccccuacuacacagugguaaagaagacccaguaggaguuggagcagccuuggaucucacaggcucguccugccaccccaugauaacuuuccacuggggaacacagacugcuuacccaaguugccuguggcuauggagaaguagcaccaaguagugagagauggagagcaggggcaggaaggccugguggaugagaugagccacagcugcaggggaucccggagcaauccaugcagguuaguuagggaggguugaucauaagugaggaaagcaggcagccauaggggcccacgcaguuuacaaggacagaguuuaaacguggguccuccgauucagggugcccggccucugagaucaccacagcucccuuuacucagcagucucacacuccuccuggcccuucuucauccauuuuagggugggcaucggggaucaugcagcggaaagcugggcucugagcagccuaucagauacacagccaugggugcuaacugaccuggaaacacuauuuuaaucacuaaaugaagccccuuccccuucagaaaagcuccauccugcccugcucugguguuuccagugcagguggcccuaaaugccguuauaaccaauacuugggaagcuccggucuuuaaaguuuaaguuguguucccuggugcauaccuguaacaucaguguuugggggcugaaacagaaggaucuuaagguuaguguaaaucagaucuuugagagaucucgggaagcccguggucagugacuuucccacaacagaaguuuggguuuccuccuaauacugaccuuucccauaauccaacaugcaacuguuuuaaccauggagagcaagguggucauggccaaguagaccaaacauuuccuucagacuacaaagucgcuagccacagugcgaagugugaguuccaguuccacagguuggacacugcuuuggggugacuucaccacauucaugauuccaucuccucacaccccuaaaugccugaggccccccaaagcaucuauagagacagauucuagugggaaugccgguuacacucuguccucuuuaccagguuccuauaaggaaaaccccagugucguccucggugccuccccuuugcuuaaaacggagaaggcaaucccacugucaggguccuguuacaggaugaggagugguccagggucccucugaagaugcuaaacaccuugggauuggcacggcuccaugaagccauuucugcugaugguuaaauuaacuaaaccaaauggcuagagaagggagagacaccaacauuuucaaagacugguccugacuuuuagcuguggaggguuuagcguugugguucucaaaugguauaccugaaccauaacgugcauccgauggccuggugcuuccuuaguccccauggaaaccagcaaagccucagcuacagcacaugccaauucuguauaagugaaaugacaguuugguccuuguuccuaaagagcugacaaacauuggccuaggaucagugauacgaaccaaaaagcucuuccucggguuuuuauagagcagacugaugcucagcagacaucaagucccaccagccugcucuagccccugacagcaacccuggcagaaucucauuggggccagugucuuagaguaggugauuggcuugccugaagucacacagaauagaaugaaguucagcuucugacccaggucugauggcaaaugggcuccuaucccaucccuugugccuaggcacuggcaggcagggagagccugaguccuggucacugagagugcacagcaagugucugugcacaguugucauuuaagugagccucugcugagauccaggguacacacugaggacgaccucggguuuucuuugcaguggccucgcacagccccucuaaaugucggaauagccgcaugccauugcuagaauggaacacagcuaauggcugaugcuggccgccuggcaugcuguaugggaaucuucaugauuuucuugccuccguugaugccuugccuucccuucucugagaagauggaaagggaagguuaugcugcauaaaggcuagugugcuccaauauauauuaacaucuuaaugggaaagcugugcauguacuguauacauuuacuacucucugacaagagggaauuaaaugucagaaggauuuguagcaucuauaauugaauuggugcugagaaaagcaaaucuuaagagaagaauaacauauuaggauuagcaaacaacauggcguuuugucagcgcuugccauucaguguguuccccuccaguaauaaagcugugcuuuuaaagcacgagcuuagcucgguugccuuaggugagagcuaccauaggugaugagacucgguagcuuuaccuuucagauagcacugugugugugugugugugugugugugugugugugugugugugugugugugugugugugucugugugugugugugugugugugugugugucugugugugugugugagauugugugugugugucugugugugugugucuguguaugugucugugugugauuguguguaucugugugugugccugugugugauugugugugucuguguguaugugucugugugugugugugagauugugugugucugugugugugugugauuguguguguuugugugugugauuguguguaucugugugugugggugugugauugugugugggugucugugugugugugugugauuugagguuuugcuuuguuuuacauuuuugcuuuagcuuugggauguggaccaccagccuccccucccucauccuuagcaagaagcagcaagugacaucacagccauuaagccuuuucugagauagacuaauccguccagcucuaggaagccagaggcagcauuuccaucauaaacaccaauucuaagaguuuuuaauuaaaccaacuuguccagagagaccuccgcugcaccaagcgacagaacuguugcaaaaugucagccucagcucaggcuccagucaccccugggcaggagaggcccccccggggaggggguugaaggaggcuuagaagugccccacuuuaaaugagacugaaaagaacagaucggugggugcuagagcagugucuagccugccccaaggaagccugagaugugaagguacaucagugcaguuauggccaugaugccugacacugcaugcuuacacuccaccuucuccaaagcagggacucaguaaguauccuuuagauuauucacccugagguugccaugagggcucugcuccgugagucccucugccaguccuuccuugccaggagcuugucaagaacauccuagccauucccugguuacccauccaucccugcuuuggcagcacagccagcaaggcuuaugccagauccacgaucauggcauucuccuggcaguucgugugccacaucuccugccaggugguaagguagccauagaaaccugccccuucgcagacgccugauccucccauaggcagcaggggcuggggagugcugugugaaggaagugcuccacuuugguaagcguuuaaggagugaaugcaaggagaaaaagugagagaugaagggguagggaggaccuggaaguccagucuggccuuuggaguuauccccauucacauugccuuuggguccggucaacugcagagcugcagaaagcugagcagguugggacaucccugggguuuugaugaaaggauuuguguuuauuuuucauuguuuuauuguuauucugagaugucuaaaauacuaaagucaaggccagggugguugaagcgauggcggagcguuuuguuuuguuuuguuuugucucaucuuguugccaacuugacauucugcaagcaacuuagaaaccuccccuucaacuacguuguuucagcuucuugccagaagaaaagcuaacacacaguuauaaguaacucaugauguauccggcacccuuggaacuacacaaguggugcaggaugguaccggacagaacaggcaagccagaaguuguaccacaacaacuugucucgcucaguguucaguguugugcaguuuagacuugcauccaccucacucauuuaucugaauuuguguauggagguugacuacacacagaccgugguuaccugaagcuagagugacugucuauguauaugcauguaccacgcauguauuugacauuccucuccaggacaacaaggacacaccuuuaucccaaaauagaaacgugcuaacacuggugaccauauaugaggaagaaucguacccucuuaggaagcaagaaagcaagauugcgcaagccccagagguuucccuuugccugaaguuaggcuccuuuauaagagcuuacacccccauagucacuucucaccugagaagcugcagcaaugcaaagggcacaggacccacauggaugcauggacuuccucagaggaacaagaccuuccacugauggggacggacgcacauggccuucccaccuaguaauucucaccuugugagcaggacaggugagauggaggcuggcagacuuuaccagggauccucccaccgucuccuguuucaauccaucaccugucaaccaacugcaucccucuagcaucgcaugcuacugcucuccguaaccagcaaggugccagcugcagguacggguggugcucaccugguagcaggugaccagcaucaccccuuccacuuuggaccaauccacagcacuguuggaaucuccucccauucccacaagaagaaauaaaagagacagugagaaacaacugcucuccccagggaaagccagaccaugacaggcacuuaggaacagucacggcucuauuacuaccucccauggucagccaggggugggaguggggaggaggagaggugggaagaggcggcaaggagcucauagccagcaguguucccuguaaauuaaacaucaguuacccucuguguccaucugcuauaauugaagguaggaaaagugucuugaugaugaacuagcggugguaaacuuucugaucaaagugaauauagagagauuacacauauaaauaaguaucugaaaaguguuuguguguccuugaggguagggaagagaagucaaacagguauuuaguguggacugugugcagggggaaauagcuagacugagcacauuuggagggcacaggucagaugaguaguugggcucagguaaggaaucccacagauguuuuuacccuuguuuugagaagguucauaguccuuccauauuccuacccuuucccaaagcucaaacauaccaccacaucucucuggagauggagaaauuggucuuuuaauaguggacaggaauugccuggcucugguggcuggggacugucuuaaacagcuucuagagacguccauguacccucauguccucuuacauggcuccucccccucuuccuugccucauguagccguuuucccucuucuccaucacugucccaagucuaagacacucagaguuuguuaaaauauagucaaaccucaauugguuugaagcaacugaagaugaguugauuucauucccacacaggaaacauagcuggcagguuuugcuauugcucgaucccugugagaacauuuaggugguuuuguggugggcugugucuccacgauguagagagugauccuccagcaggcaccaggacccaguaccacccugugaugccccuccaucagcagcuugacuggcuuuaggaucaccauggaaacacacucaaggauguaucuuuaaugguaucuccagaaagauuuaacugaaaagagagggccaauccuaaaugugggguggcuccguuccauggaccagacuccagaccaauagaaagaaaaaagcaagccaaggaccagugucugcuuccugcuuccugacuggggaugccgugugaccagcugccccacucagcccuaccaccuucccucccugucaugauggacucagucuuuaaaaugggaaccaaagcaagcccuccguuacauuauuugaggccaguguuuuguuccugaacaagaacagaaauuaaugcgcgcgugcgcauacacacacacacacacacacacacacacacacacacacacacgguacuucccaacaaugggcuguuucuuaaaaggcaaaacguuuccaagaucaccuucugcuccgcggaaaggacuuugaggacaguagaggcugcauuggcuggagucagcaacacuugggcugagacagaaaggagauuccucacaaccacaucucaagcggagcuuauuagacacguugcugaagaggcuugcacaucacggaguagacuaauuggcugcagcacucugccuccaacccucuccauccuccaauuaaacucccaucauccuguuguccgggcgaccugcugcugccucugacuuggcauuucuguugggguuugagguuugaguuaucccguaguccuuccaaagcuaacuccauggaacacuuuaaauacuccacguuuuaauugaagcucuuuaauuaaagcacuuuccauagaagccacaguuauuuugccacauccuuccguguuuagucuccaagcagaauuggaaauaucgauagaaagugugagcccugcgcucccgcugaaagcguuguaucagguuucggcucagaagaguaccauuaccuuuagcugucacggaucuguacacuugaucgauaaacuucaaauauuauuagagguggaggcuucagagauuugcucuguucuuuggagagagacagagauaaaucuuucuuagaaauugacuugaauuugcacucucggucuucccggugaaacgcauuucucuuaggcauccagcaacuacaaggggggcagauuuauaggccaugugcuucauguacugaaagauuuaaaugguaaauccuucacauaugacuucacaaaucauguaaaguuaaaagauuuuuaccguuucuguugcugcugugcuuaaauuguaagguacagccaguaaaucauuuuaauggaggugucguacuugacucaauaaaaagaagaaaaaaaaaagacaaugguuuagcuucuacuccaaaauguuaauguauuaaucaacgggagaauaauuguuucuuacuauguuauaaaucucaggugccauuaggauuucagcaaagggugauauagccaccacauuccuaaauuacaguuguuuacccugccaugcuuccauccugcaucaccauagcucauucuggguucauucugaaguuguuccccagccaaagagccaaaggggacacccugagggagugaggcuuauaagagaaaacuaauuacauuuugagggguuaaauaacaucaaaacugucuguggugaggggcaagcaucccuuuccaccauaguuuucucucuuuuuuuuuuccuuuuuuuuaaaaaauuagguuuuuagaucuuaaaucgaggcucucuccuuccucacaccuuuaaguguggcuggcauauuauaugccucuaguccucacaagccugccuuccuucccuuugcgaguucuucuaaggaagugagcugugggucuucugucguucccuccccugcccccaguuccugugauagccugaggguucccuccgugauguccauaaauaguuaggccacccuccuuaauuauuaggagccagaagucccaggauguguacagugggcacuaagaauagguucaaacaggcagaauccagcaccuucccuccccacccccacccccacccuggcagcuuccuaagcuccccccccccccccaugcaguagcacuccugugcugccucuaaugaaauggccuuguggggggagaacagaucaauuccggacuggucaggucagucuguucccuccguguaacuugauccaucugguuuguucucucugacuccuccauuaaaaaaaggaagguguucuucugacccuggaggcagugucccuggggcccuuggugucuugucauccguucuacaucccuguuccucuucugauuucaacagauucucgagcaggugaagaggggaccauuggggcaguggaccacgcagugauugguggcgucguagccguggugguguuugccaugcuaugcuugcucaucauucugggccgcuauuuugccagacauaaagguaagcaggguucucuggcaggcuggagcaacaugucaccacagcccuggcucuggggggcuucacugcuggcauuauaguaggcaguuugguguaaaggacggcacagccuauaugguuucuaaaucagagagaaggggauuggggcggguggagaaaccuuagccacggcugcugaggacucugggaggauuucgauucccucugaauacaaagcgguauaagucugcgguucuccagucuacauuugggaaucaaaaugguaaggucagggcuggcgugacaaggagccugagcccuggaagguuguguaugcauggcaagcauagccacagccugcucgcuucccaggagacaggaggacccauuugcugccccugaacucugaguaagcugguccccagagccagaauauuucccucucgaugugauaugccugggcuuuguugguuuuuuuuuuuuaauccuuugccuuaaaagccacauaaauauguauuuuuuaaauuaucggggcaauugauuuaaauugccauuaaucaucacacuuaccaacugugcagacuggaugggcaaucaucuuugccgaugcucuuccucucugccucaugcugcucugggccucuucuccccuccugguaauuuagucuuucuuuucuuugucggcccuugucuuucucucgguuguuuuucucaagcauugugcacugagcuuuggggcagagggggagggagguguagaugcuugcauacagcuugauuguuacuuggguuuggcgaaggucccuggagcccagcaguggagguccaggguacuuaauaaaagccuuuaggauccagaagugucuguuugaagcauggaacaguuggggagcccuggagcuaugugggucagaaccucugccuuucagugcuuagcuugguaaagccagagaguggagcagagugugcacagcaucuguggaggaucaggggaaggggauacacgugcaagcgcucucugcaagagagaacauagcaagggaacacuugaccaccugcuugcucaguuuaucacuuuaagaucugagaguucggcaaaaugucuuaggcuuuuuuuuaaguauaagaaucguuaaagucagaucauaaugguaaguggaugaucagauucccccaggcaguuugaguucuaccugccugcuacuccaaggugaagucuugucucucuccauguaaacguuugggauuuggugauagaaaugucaccaacuugguuaauguucugucuauugucauuauaaaguggcugugacaauuagcaaauccaugaauccggguccaggcuccagucagguggugagaacgaaucccuugcucaugaagacagagcccaagccuccauugcagcccuuaaaaugucaaaucaccugcucugccuggagccccucucugaaucggaaggcacaggggaaacagcccuuacccagcgcaucacagucuccccguggguagccaguagccauucaugaagccaggagacuaugguuggaguaacugguucaagauggcaguagaagcaucuuuggggcccuaauucauuuauuggcuaauugcucuuccuugcuuuggucuuuaaccaugugcgaacauuucuugucaucggucuuugguguucacuguuaauucgguagucagcagcucuccagcuuucugcauuuuagccccacucacgccuucuucucuggucauaaucacugcucuaaugucucguuugcugaauuacaucgcagcggcucaguuggagugguuaccuuuggagcccggauucccaucugucucacccacccugcucucuucuuccuauuguuuuuuccccccucugcugccugcacaccacuucggcugaugauggccauaaagcaacuugccaucucuguaccacuucucacagaggccaccagagagucacagugcuuuaccccuucaucuuucagguacauacuucacucaugaagccaaaggagccgaugacgcagcagacgcagacacagcuauaaucaaugcagaaggaggacagaacaacuccgaagaaaagaaagaguacuucaucuagaucagccuuuuuguuccaaugagguguccaacuggccuguuuagaugauaaagagacagugauacuggaacuuucgagaagcucgugugguuuuuuguuuuguuuuguuuuuuuaugaguggguggagagaugcgagacugggaaggcuugggauuugcaauguacaaacaaaaacaaagaauguucuuugaaaguacacucugcuguuugacaccucuuuuuaaucugguuuuaauuugcuuuggguuuuggguuuuuuugguuuuuuguuuuuuucauuuauauuucuuccuaccaagucaaacuuggguacuuggauuugguuucgguagauugcagaaaauucugugccuuguuuuucauucguuuguuguguuucuucccucuugcccauuuauuuuucccaaaaucaaauuuguuuuuuucccccucccaaaccucccauuuuuuggaauugaccugcuggaauuccuaagacuuucucccuguugccaguuucuuuuauuuguguuaacggugacugcuuucuguuccaaauucaguuucauaaaaggaaaaccagcacaauuuagauuucauaguucagaauuuagugucuccaugaugcauccuucucuguuguuguaaagauuugggugaagaaaaaaaaaaaaaaagaaaaaaaaaagaaaaaaaaaagaaaacacugaaaacucuuugcugcugcccaugucuuaaauacguagagcagcgaagacuagaaacguagacugugacccagacgcugucgucugcuguggaucuucauuacuguacaggguuaucugcaagugaggugugucgcaaugagauugaaucugucguuaauucuuuaucuguaggcggcucaguauagauuaccccacgcugugcagaaaguuuuuggaguggaaaggucuccuccuuccucguugcccuaaacagacccgacaugugaggucugucuguuuuauguaaguggacaaauuugagaugucacaggaggggaagcagggaggggguacgacaguucugcucugauuauuucuacucucaacaauuccauccaccuuucccaauuggccuuacugcucacuaaugcaggagagagcaaguccgugugccgugugacugacuggaggggacaggcuuuguuuagguuuuuuuuacccccacuuugguuuugguucuggguuguuuugcuuuguuuuguuuuccuuuguucuuauuaaggacggcagugggcuguguccuguguguacuguauguuacagacaccguccugcugggacacuuguccugcugggauucccagcucccacccccaacuccucucauuccuucagauuuggcuugacaaaggcaggagguacaaaagaagggccaauuuuguucuggaaaggucagagcccagagucgaggugggaaaguggcauauagggauuuccaguuacuuaaucaaaacucaaaaugugaguguuucugucuuucgugcacuaggccuggccucuuaccucagccuuaagaaccaucugccaaaaacuacucaucucgcaugauggcagccagagcgcauagcuacuaaaauaaguuuccgugaacauaucuuacaccggagccugaggaaagauagaggcgcaaaggaacccuuugcauucucuaaagcuaaguggggguuugcagaagugcuggggucaucuagcaguaguucugaaggacagaaccuaaacucuuaccacacgugucgguaagcuccagacuccaaaacagccccucuggaaagauggcaucagaaaagauagaucuaucuauauauauaaauauauaaauauauauuauauauaacauuuucagucaguacuuuuggauuuugcaaggugcauuuuuacuauuguuacauuauguggaaaaccuacgcugauuuauuuaaggggaaaaaagugucgacucuguucuuugaaagcguauuucuuuuucuugucuuuauuuuaacuucugauagaaccacugcaauaugggggccuuuugggaacggacugguuuguaaaggaaaauucauuauggagcaguguuuuguuaaccccucuccugccccuaggcacuuaaccaagacaaaaagccacaaggaacaucccuuuuucaaaaauuuuauaaugugcaucuauuccgagcccuuagcacccauccugaccauagugaccauaucaaagggugacaaccaguuagcaugucguugaaaggguuuuucagcuguucuuuuuagaaaaaaaauauauauaaaaaauauuuaaaaaaaaacaaaaaacaaacaaacacaaaaaaacuaccauuguucacagaauuggcaucucauuuucgggaccgcccaucuuucuguuuugacaaguguacaguagugcaguguucugauguaacuuuauggcuuacaauguugacaugucucagguuccuguguuucaauugguguuuuuccgucucagguagauugcaaaguguaggccccacacauuggaaaaauaauaauaauaauaaauaauaauaauaauaauaauaauaaaacaaagcaaaaacaggaaauuauggauuuuaguuguauauugguuuauguauuuuucuuaaguauacagugcacuguuugaaauguauuguugaguauuacuuuguacagguugaucacuuuuuuuagagugaagaaagaacaaacuuggguuuuuuuuguguuuuuuuuaaaggaguauaaaauaaugaaggauguauaauugaugccaaauaagcuuguucuuuagucacgaugacgucuuguuuuucccucuaggccaguucuguuucuaagguguacaaggaccauguuacaguguaagaaacuccacauccguguguucccauucgcauuuuguaucgguucauguauaccauuuuuacaaaaagaaaaaagaaaaaaaaagaaguacuauaaaauaucugucuucuuaauaaaaaaauuaauguuacaaguga

SEQ ID NO: 12437 - RNA, 37296 nt, Mus musculus
cguggucugggcacggggccuucggcggcgaccagccagaggaggaagaacauggcgggcgcagcagggccaggguccgguccgggggcagcggguggagauggagacgauucgcucuacccgaucgcgguuuuaaucgacgagcuccgcaaugaggacgugcagguacuaggcugggcuggggagccgaggcgagggcggaagcgcacaugguagggaagcggaaaggccggcucagcccugggggcgacccccgggguggcagagucguauucagccccgggacggaggcguggggcggcgggugcgcggugguccgucucagcuccgcugcccuccuccgacccucuggggugguggcguccaucugcucccggcagugggcggggaaccgguucgcaccucggguggaccagcgcaggcgggcugcggggccgccgggagcggaggagcggcccccggcccccguucccuuugaagugaugcggaguguccguccccgggcaaacuagcugggcugguuggguggaaagagcgcggcggcugauuaacccagaugaguggugcaucaguugugauagaacuuuucccugaaaagggaggaguugugcuuaaccguuucuuucacccacuucucuccauccagaguucucucuuuucagacccucucauuguccgcguguuuucauucauucguuucuuccccggcccuucaguguucucccuaagauagcuucuggcuaaugacguguuaaacgguccuugaguuuuccuaggauuaagaucuaagugaaaggcucauucaucauuauacugugucccaguaucucaccuauuugcuucuuugaccagaauugcaaucaucucuuugcuuuguucucccucccacuuuguuuuuaaagcuccgucucaacaguauuaagaaguuaucaacuauagcucuagcacucgggguagaaaggacucgaacggaacugcugccuuuccuuacagguuugugucccuugaaagauacacgcuccauuucuauuggcuuuuaaacuauuuuuauuuaauuuucuuaguuuguuaccuagaguagcgauaaguacuagacugagccuugccuucugcaagguguauagaaaugcuacauauagucagacauacucaaacauaaaccguguagcuagugggaaggugauugaugugaaauauggauuucuuuguaaaugauuuauuuuauaugcauugguguuuugccugcaugugaaagugacagauccccuggaacuggaguuauaggcaguuguuaaguugccaugugggugcugggcauugaacgcugcuucucuggaagagcagccagugcccuuaaccacugagccaucucuccagcuccaggaugugaguuucuuaauaauugugugaaacauucaggaagacuugugguagucaucuauaagauggaacacagcuccaauauagcuccaauauaggagcuagagaaagcacccaaggagcugaaggggucugcagcccuauagguggaacaacaauaugaacuaaccaguacccccggagcucgugucucuagcugcauauguagcagaagauggccuagucggccaucacugggaagagaggccccuugaucuugcaaacuuuauaugccccaguacaggggaacgccagggccaagaagugggaguggguggguaggggagcagggcgggggugggggguauagggaacuuucgggauagcauuugaaauuugaaauguauauaaagaaaauaucuaauaaaaaaacugacaaaaaaagacuugugauuuagagagggaugaaaaugcuuuuaggauucuaguugcaaccgcucugugagagccagcgcaguggcccuugccccugugguaaccagcuguuguuguuuucagauacuauuuaugaugaagaugaggugcuguuagcucucgccgagcagcugggaaauuucacugguuuggugggcgguccugacuuugcccacugucugcuggugaguacuuuucuaucgucuaugcuccuucuagaacuuuguaggaucaacagugccuuuauuaacuggugauaggcacauugcagcauuuuaugcagacuucuuaugggcagaugacaauaauaauacuaacaagacuuagaucuuaccagccgaauguaagcuuguuucugccucuauagacuuauuauuucagagaugcggagggaaagaacuugauuugguuccccuuuuucuuuuguuuguaauuuuuuuuauuagauauuuucuuuauauacauuucuaaugcuaucccgaaaguucccuauaaccacccugcuccccugcucccuuccuccccacuccugcuucuuggcccuggcauuguuuguauuuuuugaggcaaggucuuguuuuguagccuugguucuauauagaacaggcuagcuuugaacucauagagauccuccugccucugccuccagagugcugagauuaaagguaugcaucacuaugcagaugaacuagaccuuaaaggaugacuagaagcugaccagcugacaaggcagggcugucuguuuagggguuuaagcacuguguauucaaugcuggcucccaugguuccuagcucuaccuugaugguucuguagaacuccagacauagauggagaagagguaaguggacacuuguagaaaucacaacagauuuagauacggguugucauuuuucccucaaaacgugccucuuuuugagucauaucacuagcuaccuagcuauacaaggccagccuagaagauagcuuugaugucaaauuacgucagagaaguugaagccugggccuuugcaugcuaggugaguguuccuucaccgagcuacagcccagcagaggaaggccuccuuaaauccucucccccuucacgccuaagcuauuagucuugucgacugcauccaucccaguucagucuucauuugugcauucaugggcacuugugccuggcuaguagcauuguuguggggcuucuguccuuggacucguuugcuuccuugcagugagucagaaaaacucuucugccacacuuuauuacugccauguuguugugcugaggcucauguuguuucuucugguagcuauuuggauucacagcagugaaaaacucauuauauauacgcauguuccucuugguaacuucauuccaugcacauuggucuuuccuuauaagcccaggucauuguugcccagacguuggcuguagauguuaucuucagagagaugcuauuuagaguuuucuauaguggaguccguguaagucggacaacuccauuuuguaucuugagaggccuugccugucacaaccaccccuugcccgucacccuguuguaauuugacaucucccccauuagaauguaggcucccuuagagcauccuguguguucauuccuucuggauccuuggcguuacugcacagcaguauucaucgauggcuugcagcugugaagcuuguuggguucagagcugcgugagugaaaagcuagggcuggugacgcacucaccagggcucagagaagggcacugggaauaggcagaauucaaaugaagggacaacucauaaggcauuugccggaguuuggccaucuccgugguagugcuagaauauguugcaguaggcaggggacagaucaugaaagacugccuaguaagaagccaugucuuuucaguggaccuuugacccacccucuaggaaagcuacaaagcucucuauuuuuuugaaugguauugagcggcacauuucuucucuuggaguccugauccucuuuccugguuagccugccguggaguucuguucugaucucacagcuuuagcuuaugcugagucaccugggaccaaauacaaauguuuagaagggcagcuagagguucagagaagcagccuguuucugcuguccaccaggcugcgucacaucggcuuacugacgagcucgaccuugaaccucuuugucuuuuaugucucuggaucugcaagcucacccccaucucugcauuuguuuuugacuguucuuuggcucauggaaagauucugaauauauuuggggaaaaaaugguguuguagucagcuuuuuauugguugggaaaauugcguugcuuacaccuccaggaaugguaggauggugcaggaaagggcaugaacucuguagccuggcaagagaugaucaggcaguguggcccccacgcuuggccauaguuuuggacuuguuccuaaggaaauagcacauuuguuucuugguguggcugcauaucauuuaaacacccccuccaaauaauaguaauucugugucaagucucuuccacagugucauuuguagacaccaucugggaauugccaucugggacaugcgaucuuggcuuuucuacagaagucgugucuucagguuggccacaccauauguuaucacugugugaauugaaaguaaccauuugguaugauguaguuaacauucugguuacauguacuguuucccuucagucacauaaaaggugacaaucgguguccaaccugauuuaauaaguugucaucucugguuuuccuuuuugaucuugcagccuccuuuggaaaguuuggcuacgguggaggagacugucguucgagacaaggcuguggagucgcugaggcagaucucgcaggagcacacuccuguugcccuugaagcucauuuugugccucuggugaagcgccuggcaagcggggacugguucacgucgcgcacgucugcauguggcuuguucagcguuugcuaucccagagcuucaaaugcugucaaggcagagauucgacaguaagacaguaguuucuaguguuugggaugacuggggacucacagagcaggguuuacccggugcucagcuucaugugaggccagugggguugaugacacuuuuccauguagcuguauacacugauggcuuauuuuguucgugugugugugugugugugugugugugugcgcacgugugcgcgugcgcgcguaucgcaugugugcauguguguuuguauuucaugugaaagccucugguguugauccccagguaccuuccuucuuuccuuugagacaagcuuucucauuagccuugaauucacuucauagacuagccuaccaggcccgccgcacacuuuggggaucugccugccucugccucccaacuugcccccucugggguuauaggcacagccacugugcucagcuguguacauagguccuggggaggguggaaggcaggcccuuuccugacuaagcuguuuuuccaguccuuucuuuaccacugugaguagaaaccuagucccugauguuuauaagagagagacuuuaaaggcucuguguugcacuuggugcacgcuuacccauguguuugacaggaagcaccuuguuuuaugcugcaggcacuuccguucucucugcucggaugauacaccaauggugcgacgugcugcugcuuccaaauugggugaauuugcaaaaguuuuggaauuagacagugugaaaacugaaauugucccauuguucacgaauuuggcuucagaugaacagguaacuggaggccuuuggccuaaugaagggucguuuugcaccauuagaacuuaguucugaccuggggcuucuuucuuagcuaggccccacguuucuuugugcucagagggagaguuggagaugaauuggguuccauaacuaggaagccagggcugccuuggggacaggugccuuucagaauuguggccuguauuauguauggagaugaagcauuuccuggaauucugacuuuguuaauuucugcacuaaaguaugguuguacuacacacaauagcgaucuuaaagccaaaggucuggguuuccuugguguagagaugauaaaaaccgggaaccccuaaauuacuuacuacaguuguuucucuguacagaguuugggggugauccuaggaucagguagggcuguuucucuuagaguucaggucccauauguaaaauggugugcuauuugccacugcuuguacacauccuccugaguacuuacucuaagucaccuaaguuagauaacuugcaaugccuaauucaaugucaacgaggguuggagagaaggcuaaucuuuaaaggugagagcugcccaugccugaggaccugugucugacacccagagcccacggagaagauuggauguagugguucucaucuguaacccagccuuccuacaguaggugggagacagagguaggagagucacccugagacucaugggccgucuagccuggguauacagggcagcagcagcagcagaaacaagggagacccugauucaauaagguggaaggcaaaaaccaaaucccgaaaguugcccucugaccuccacagaggugcugugguaugcaugacccacacucucucacauaaacacaguagauaaauaacaaaacaaaguugccuguaaucccaguacuugggaggcagacacaggcagauuucugaguucgaggccagccuggucuacagagugaguuccaggacagccaggacugcacagagaaacccugccucaaaaaauaaaacaaaacaaaaacaaaaccaaaacaacaaaaaaagccaaaguauaguguaaaugaccuguaaauaguuuuauuauuuuuuucuaaggaauagugacaagaaaauguuuguauguguuugguacagauuagaaaacauuucccaaauauucgugauccacgguuggaauacauugaugugggggaaccaugggcaugacugacuaucucuugcucgaagcuuguuuucaguggcuacguguauuauagaauuagguucuccuaggagcccaugacacagauacucaggggaauggaagcccagcuaguuuuugaggcuugugcaaggcuauauuuagcuaguugaguguacauaggcuccagccacaaguuucuaaguuuuauaauuugaacauuggcaguaguguugcugagcacggagaugccacgugugcauggcggguucucuguguugggcuaggcaggcuuagcauccuuauuuggaauuuagcugguuacauuucccaugacauaauuugacuuuuucuuuugucuucuauacuuccuguuugcagauuuuuuugaugaaggccagccaggaaauacuuuaggcuuugagggucauauaguuccuguaaaacucagcucccgugcuccaaaagcagccagaggaugggaaccaaugggcaugaaacuuaacuauguccuagguaggagcuggcugugagcuuuggugcucagaaaaauuucagugcuuuguuaagaaauacaaauacauuguguucccucugacuacuuauagaagaccugcucauggcuuacucauggacagaaacauuuauuaaguaccuacauagaauuccuacauauguaaggcacaguucuaguguuaagugagguguuacagguauacagggauccggcucucauggaacaugaaaaaaauuuuuuuuaacuuuuuuuuuuuaagauuuauuuauuuuauauaugugaguacacuguugcugucuucagacaccagaagagggaaucggaucccauuacagcaaccacaugguggcucacaaccauguaguugugagccaccaugugguugcugggaauugaacucaggaccucuggaagagcaaucagugcucuuaaccucugagccaucuccagcccggaacuuauauuuuaauggagaaaagcaaacaugauaaaaauuaggcaugaauguuauacaaauaaaugaaaccugauagagcacuggcugcuaggcggugcagaacucugaagaagggaccagcaggcgagagacaguguugucgguaaagagaguguuguugggcuagaaacaccaaccuuagaacauggagguugaaagaagccagugaagacaggaguggagaaggaaggguggaggagaccauuagccaggaaagacugcaguuuugauuuucuacucuagauucagugaggcucuaguagaucuggagaagagguguggcauguaauuuacauuucugaaaggucauucuggcuuguguguggaaacaaacuucucggagggauaagaauagaaagagaaggcaguaagguaggugacauugauaggaaccaggcaaguggugagggcgcuuuguucugugugugugucccguaguauuacauagacagugauuucuugccccgggguuuuuuugaugcucauccgauuauaugucuaaaguuucucuuuaucugauuuuccuaagucugaagucagaacuccuaaugucuaacugagcuuuaaguuuguguguccacuuacucagaagacauucaagugucccacuuggcauuuggcagcuuuauaaacagacagcaaguuagcuccccgccuuuccaacuccccacugcugugucuuacgaggcuuccuuaucucaguaucuugagccugacuuuguuauuuggcggcugucacccugucccguucuguguugucccuuacugccccaucucaugcagcuguggucagugaugagcuggcaagagguuucaagaugaucuccuuuguccuuuaaauucuucaaauguguuauuacguacguaugcaaggauaauucuucaacuccucauuauaauaaggcuuugaauauagcauuuuaaaaaaauaauuagucuuuauaugagaugugaguaaaguguuugcuucauuucaaugcucagaacccauggaaagguggaaggggaaaccugacuccaggauguugucaugugcugaccccacacacauuauuuacaugcaauaaauaacauuuagaacaucuuuuuuaaaucuuacuuaauaaaaacuuggugcuguagucaagauaauuuaaaugaaaugccauuugugguuuucacaugccagucugggcaaagcaagagcugaugcagccauuugaagacauaaagccacaccagcgcguguggcgggcagcugucuuaguuaggguggcugcugcugcaaugagacagccacgaccagaagcaagcuggggaggaaggggugguuuggcuuccacuuccgccuuaugguuuaucauugaaggaagcuggaacaggagcucagacagggcgggagcuggugcagagaccuuggaggggugcuugcuccccucccugugggcuugcgucccacauggcuuauccugcuuucuucuagaacucaggacgaccugcccugcccagguuuagcacuguccacaaugggcuugcccuuuccccauaagucauuaauuaauaagguguccuggaggcuugugaauagccugauguuguggaggcaucuugucaguugaggcucccuccucacgaaugacuucagcuuaugugucgcuuucuccccugcuuucugaaguaguaccuguggcagcagucucucacugcacucagugugcccuuucagcaaacugacaaaugggauguuuuucucuuuaggacucugugcggcugcuagcuguggaagccugcgucagcauugcccaguuacugucucaggaggaccuggaagccuugguaaugccuacacuucgacaagcagcagaagauaaguccuggcggguucgauauaugguggcugacaaguuuucagagguaaaaugcaccggcauuucaaguguuaaaaaccucagacacacuuacccuacagaguuucugucggacacagcuuacaaauccuacugagugguugugaacuuaaaaaaagugagagagccugcuuaaucuuuccauuuugguuacagcaugcuuuugaugauuguacuauuuucuguuuuuacuauuaugcuaguauacaguaaaccuguauaaauuguuuucuagcuccagaaagcggugggcccuaagauugcacucagcgaccucauccccgccuuccagagccuccuccgagacugcgaagcugaaguccgagcagccgcugcccacaaaguaagaggugagacuggccgugggguccuuugacuuugguggugucagcucgcuauaguuugguuugguuaggaccgaaaacauaaaccagggagagaugaguccacgcagcagcauuuccgcccacgcugaugcauuuguuguguuaggaaguuuggcaugguuuugauuuauaagaugcugcagacggauggcaccagcauggcagguggcaccgucagacugucccauagguuaggucaggagggccuccaggcugugcuguguggaccaggcuuacugccccuccacacuuuauuugcucagacugacuuaacuuggacuguugggaagagcuggguaauugucuuuggcuccuugacagcauugccuuuucuguuucuguuucagagcuuugugagaaccugcccgcugaagguagagagacuguaauuaugaaucaaauccugcccuauauaaaggugaaugugacuucauuuuauuuuguuuacucuaccuacgaagcucuuagcaucuaaagaaggaagaggcauaaauuaaucaaauacauaauaacauuagugcaaauguuuagaguugauuugugcgcguugcacuguagagcuugugggcgcauagcuguuacuacagacggccaggucagcugugcuguuggcuggugcugcuguggacuccucgggaggugcuguagaggcuuuuguugucuuuaauuuuuauucucuuuuaggaauuagugucugauaccaaccaacaugucaagucagcgcuagcuucuguaauuaugggauuaucuacaguuuugggcaaagagaauaccauugaacaucuucugccucuauuuuuagcucaguuaaaggacgaggugagucuggguaugaauccuuuugcuuugauauaauugauuugauaugauuuuguuucuuuuuuuuucuuuuggguuuucugagacaggauuucuuuguguagcccuggcuguccuggaacuugucgcuuuguagaccaggcuggccuugcacuuagagauccaucugccucucucugucucccaagugcugggacuaaagggacuguaaagcuuugguuuggugauuuuacuaaaauaggacccaaaguguaaagauggggaaaaucauagucuagauauuugacaguccuucuguuuggguguagggcuacagguuuccccaaaaaugggcacaaggacuaacuaaaaacaaaccaacugggugugguggagcaugccuuuaaucccagcacucugaaggcugaggcagggggaucucugaguucaaggccagccugguccauaggucaaguuccaggacagucaggguuacccagagaaacccugucucuaaaaccagaaucaaccaaacaaccaaaaaagaggagcuggagagggagggagccucguagcaaacagcacuggcucauucuugguuugguucccagaacccacauggguuccucaacugucaguggcucuaguucagggaucugaugccucuguggucacccgcaggcaccaggcacacaaauagugcauaaacauguucaugcaaaacagucaugaaauaagucuuaaaaccauccaagaaaugccuauuaaauguuuuauauuauagucacugauuccuuauauuuaaagcucauauaucuuugcuuaaacugugucuuuuuauuuaaguuuaaaguguagcuucagauacuaacauuuaguggcuggagauuuggcucagcaguuaggaggccugucgcuuguagaggacuagagcuccaguucugguggccauguugaguggcccucaacuguucauaacuccaucuccagagggucuggucccuugcuggccuuugugggcacacacacacacacacacacacacacacacacacacacacacacacacacacacacacacgggcacaugugcacguuacacagacaauacauacauucggauaaaaauguaacagguagugccaggcauggucugagagcuuuggauaugucauuaacuguaacugcugcagugggcucugggcuugguuccucccgguguagaggaaggagagaccagggaguaagaugucugcggucucccugcaguggcagagcugagucccagggccugggcccuuuacaucucauagacucugugcuuacuuauuaauuaaaagucugaaaaucuuuauuauuaugugagcgagcguacacugugugcacauacagaguucagaggcugucucuguggaguccguucucuccauccacuuuauguuggauguucuggggauaacucauguucuggggaucggauccuggcugcuagguuugugagggaagccccucuuucugcucagccaucucgccugccaauuuguuaauugauuuuuuaacuuaguguacaaucucccguagauggaugguacaggcuuuuuacugacguguggcuaaggucagugacauuguaucugugcacuuaguguuaaggauuuccuucugcaguagcuuuucuauaguucuggugguugaguccagggcucugcaggauggacgaaugccuuuccuacccagccacaccacagcuuacccccaccuuuuaaagccugagccuuuucuuuucuuuucuuuucuuuucuuuucuuuucuuuucuuuucuuuucuuuuucuuucccuuucccuuucccuuucccuuucccuuucccuuucccuuucccuuucccuuucccuuucccuuucccuuucccuuucccuuucccuuucccuuuccuuuuccuuuuccuuuuccuuuuuuccuuccuuccuuccuuccucucuuuuucuuucuuucuuguuuuuuuugguuuguuuguuuuuguuuuuuuguuuuuuuuuaagaugggagucuaucuguguaucccuggcuguccuggaacucacguuguagaccaggcuggucuugaacucaagagaucugccugccuccacugcccaagugcuggguuuaaaggugugcgccaccacccagauuaguacuuuuuaauuugaaauucuacuuagcacuuuuuauuuucucaugccaggagacuacugggcaaaagaguuaauuuucacauguagucucuggggcuuguguguuuauaguguccagaaguucguuuaaauaucaucuccaauuuggauugugugaaugaagugauuggaauccgucagcucucucagucucuccuuccggccauaguggaacuggcugaagaugccaaguggaggguccgccuggcuaucauugaguacaugccgcugcuggcuggccagcuggugaguaccugggcuuugccaugguuugagggugguuuugguuuucagugaucuauuauggccuaacaggaggguggugcagaaacacagucaccuugcugccuccucagguugaagguguagaaugugcuucugugauagcaauguuguauuauuuaaacccuauauaauuuaaggacucguguauggaagggaaaauacaguuucaggauaagucgguuuggcuuuuuguuugacucuguccuaagcaaaaugaauuugggagcaauuuuuucugcauccugaugaaaaguugaagauccacuacacagggcuuauaaugugcuguucuggauaaagguauuacacugccuauuucucuggguucguuauuaguuuaguucugguagauaugacuaauuaaaaugucaaagcagacuuuauugccacaccuuugccuuuuucucaguaggugaagauggcgacaagcuugauagccaugccccugugguagcuaccuguguggugugguuuccagcggcuucguagcgcuuguuauuagacacuuagcauuuucuacuagguggaugaaggggccugagugauucucagugcucacauaucaguuugcugcugacauuucuguacuuugcccccaccccaaggccccaccccgcccaaaggcccauucccacucuuuugaggucacagcaccaugcucauguuuucuugaccacugcaccauauuacuaauuuggguggccauugagcaugcgccuguagauggccauagcauugcgcuuuaucagaucagaauugucugugucucaaaugaagggcaaagauccuaacuuauccacaugucaagugacaucaccaugcuucuccaccauccaguccaaguggaggggucauuuucuguuccuuagucaucuucugugccacugucuggaguagaaagcagugguggcuaaugauggguuugcuaggcugggaagcagcuguguggaaggagguggaugguauuuaccgucucugggaaaucuccagggcugccagcaguauacagaauagcguggaaagaagacagacggcgucuuggcugguuuacaccuuucuggcaggggcaacaucccucagucauggacacuggcugagguggcaucugucagucauggacacuaucuuucuugagguuuacuuuuuaagauuuacuuguguguguguguguguguaucuuccaguaguacuauguccaauuuucugaggaaccuccagacugacuuccagagugguuguaccagcuugcaaucccaccagcaauggaggaguguuccucuuucuccacauccuugccagcaucugcugucaccugaauuuuugaucuuagccauucuaacuggugugagguggaaucucaagguuguuuugauuugcauuucccugaugacuaaggauguugaacauuuuuucaggugcuucucagccauucgguauuugucaguugagaauucguuguuuagcucuguaccccauuuuuuaauggaguuguuugaauuucuggaguccagcuucuugagcucuuuguauauauuggcuacuagucuccuaucagauuuaggauugguaaaaauccuuucccaaucuguugguggccuuuuugucuuauugacagugucuuuugucuuacagaagcuuugcaauuuuaugaggucccauuugucaauucuugaucuuacagcacaagccauugcuguucuauucaggaauuuuuccccugugcccauaucuuugaggccuucccccacuuucuccucuauuaauuucagugucucugguuuuauguggaggucuuugauccacuuagacuugagcuuuguacaaggagauaagaauggaucaauucucauucuucuacaugauaaccgccaguugugccagcaccauuuguugaaaaugcugucuuuuuuccagugggugguuuuagcucccuugucaaagaucaagugaccauagguuuauggauuaauuucugggucuucaauugaucuguguguguguguguguguguguguguguguguguguguguguaugugugagagagagagaaugguuuccuuguauagguaugugaagcauauacacgccugguaccuguggaagcagaguaauucccuagaacuggaguuacagaccuuugcgagcugccauguaggugcugggaaccaaacccaggccucguguaagagccucaaauguccuggauggcugagccaucucucuugccucaauagauguagucuuaguuuuucuuuuuguguaaauuuuuggucaauuuauaaaauguucucaggacuccccagcccggcucguaggccugaugagugaauagaguuaaacugcagacugucugaggagaugacagaaacuccuuagccugggauacaauaggagucugaggacgaaaugccugccaggauuggucaggcagggugaagccguccuggguaaagcacagagcccuggucauuggucaggaaggucucagaauugacccagaagaauacgcauaaugaaggcaggcgugguggcucaugcguuuaaucccagcacucaggaggcagaggcaggugaauuucugagcucgaggccagccuggucuacagagugaguuccaggacagccagggcuacacagagaaacccugucucaaaaacaaaaaacaaaaaacaaaaaacaaaaacaccaccaacaacaaaaaaaaacugcauaauggccucagaaggaaggcacccggaaaguguauccugggcuuaccuguguggugugugugcccuguggccagaggucucaggguuuguucccagcuuguguggacugaccagcaggcuggggagccaggcuccaacucuuacuucugccuuuugcccuguacacuggugccuccucuuuucucuccugccuucugccaugcccuagaaacacuguccucuguuggugucacuuggaguacccugccucgugcucaaggacuuguuaacuagaaaggagagaggacgacccccaaagcccucagcagcuauuuuucuggguaacuggcuuucccaugaugucuggauuuguucugcagacuuccuccuguguugugcuggccuguucuguucugcucagcccugcgcgugcgugugugaguguguggguggcucagucccaucuucuguaagcgcggcccucggcgcucacucccuugguuuugcuuucuaugauaguguaaugguuuguaauuccaugcuacuguuuuuauggcuuuugugguucagcuugugugcaggugugccuuuagcucuuaggugauuacugugcaguguaaauagaacaucuuguccuaacuuuggaaauuuuuacuaauggaaucuucuauauccauaggguguggaguucuuugaugaaaaacucaauucuuuguguauggccuggcuuguggaucauggugaguagacaaguuaaacacagagacuguggcgaguccaggcuucugcauguuugugguguucacacauacuguuuacagaggaacccugugggauacuccuuugccuugacaauguaaggcggaagaaaggauggugagguuccacuggcuuccccuuauuacauaaacauuucacguacuuaauuuggacagggucucauugugcagcucugccugucuccugagugcugggacuaaagcaggugcaagcugacuacaggcugacauuuguacuugcguuauuuucuguuuuaaguguguuuucugugcugaguaagucuguccucuucuacuuccugcugccuuugagcuucagauucuuagcuggacauuuccuccagcgccaggguuugcagccgaccugcugccauuggcgucuucaguaucugaagagcaggcugagacuggacagaccuggcuggaaagaauuggcuccgugggcuuucugagaugaggugcaaagguccaguaguaguggggaugugugcugcacccugggacagagccagagcuucgggguuaugaaaggaaagcuuauuguuucuucuuugccugcugcugcugugcuggcggauguaagcucaggccaguugagauuggacaggaaugagcaggugccuuccuggugaugccucagggcagugugugcacaugucuaucucccuggcagcugaugacagaggggcccucugugccagguccuagccuuagcagcuucaguaucagggagggccuucaauuuucaugugcuaugucccgugggcucuggguccguguuuuggugggugugauaagcagccuguuguggucccagugugcuguguagacucuauagauugcuugcauuuaucuuuggguacuugugacuagguaguaggaaaagaauaagaauaucugugucugcuuacacuuguaggugguuuuguuaaaagcgcauuugcaucauaugucuaagaguguaaagggagguuaugaagcuguguaugucaguguguuagggcauguauggauacaucuguacuuuaaauaacaguguagacuucuuuauuccuuuuuucucgaguuaaguuuuuaauuaucauuuauuuaaaaaaaaacuugguaaaucauaggaaagcaucuguaaguauguauaaguagcaugccuguaugugcaaggagcgugccuguaugugcaaggagcgugccuguaugugcaaggagcgugccuguauguguaaggagcgugccuguauguguaaguagcgugccuguauguguaaguagcgugccuguauguguaaguagcgugccuguauguguaaggagugugccuguauguguaaggagcgugccuguauguguaaguagcgugccuguauguguaaguagcgugccuguauguguaaguagcgugccuguauguguaaggagugugccuguauguguaaggggcgugucuguaugugcaagguaaggagcgugccuguauguguaaggagcgugucuguauguguaaggagugugucuguguaaguaguguaucuguaugugaguuugugcuugugcucggguguacucuuggaggccaaagagggcaucggauccugcuugggagcuggaauuguuguugugagcccucuggcuuagguacugagggcugaaauccagucuucuguaagagcaguauauauuuucuuaaccacuaaggcaucuccccauccaagagacuuuuuuauuuaaccaaguuuacuuuggguguaaguagcccugucagugguguucccagagaccuuucuguuacuuccuuugaaagcaauuaaggauuaagacuggccuuuuucuguccuucaaauuaggaaggccuguuaagguuccagucuuccacaaguugagaaaugacagcuguucuguguaggugguggcucuaugugacuuaagcaucccgccuccugaguuccuuccagcuugggaguuagcagguuggaguucauggacugcaggaucccugaugcauuggguggcuggcagcugagagcgggccuuugccaugggcuuccucccagcuuuuguaguuucgguuagauuuuuauaauuugaagaagagugauguuuugcaccguaggugguauacagugaguggugagcagguuucuugggaacuaucccuuuaucccucccuggcaugaagcuucucugcuguaagacuugaggagucuggagaagcuggggggaggguaugaagguuggguuucuguccgugggcagugugacaagaaggcaggggggccaagcagugguggcgcaugccuuuaauccuagcacuugggaggcagagacagguggauuucugaguuccaggcuagccuggucuacagagugaguuccaggacagccagggcuacacagagaaaccuugucuugaaaaacaaaacaaacaaacaaacaaaaaagaaggcagggcucagugagggaaaguuaagugguggguaccucauaaauuuaucuuuuauaggauaaagauacguauccagucaaaguuagugagaacugauagaauuagauauguaaagaaaccuuucagaucagccuaaccuugaagggaaagacagacacagacaaaacaaggagugagaacuugggaaaggcuugcauuccucugaaaacagaauugagaggugcuagagacacaguaggccucuggccaaguagaguugagugcaguugaggucuuggucaaagcucagucucuggguacuguggcacuggaacccugccacauggccuuguaguaagacugaucauucaaaaccaguagcuaggagcaaaacacaggugcugcccuuagcuccccuuuacguccgugugugugugugugugugugugugugugugcauacaugcgaguauucugucuucuuauaugucuacaggacagaagagggcaucagauuccauuauagaugguuguaagcaacugugugguuacuaggaauugaacccaggaccuguagaagagcagccagugcucuuaaccauugagccgucucuccagcuucauuagcucuacuuuaaaggaagaauggaggagaggucuggagcacaaauuauguacgagaugaaaaagagcucguguguguguguguguguguguguguguguguguguguguguguaaggcacuucugggcaucuugguguguguuucucugcugacugaagucugagcaugggcugugcgaguagagcuccuugucuccugucucuguguuuuccguucuuagucuuuagagcaggauuugaguuggggaaaguuggcucucaucucucuggaagcuugcaggauugccaaggauuggggccuuggcuugggggguuugugcuugccaggugagaggaggaggaggaaccaguaacccgaucguucaccuugauuuguuaucuaaguccaagguuugagucuuacugagucugaagugaaggcaccagaccuuucuguguucaggccugcacagaaugacuaauuuuggggguauaauaacccagacuucauuguuuaguuuuaugaugucguugauaaauuauuuugaaugggauuauuauguguuggugcaggcacauguaucagcuugucuuaauuaacacaagcauuuucaguggggaacaacugugauuugcagcuguguaggugacaauggugaccuguguaggauuucuucaauauuuuucucagcugcuuucugaugccacuugaauaaucuugcuaaaaucucuuuagaugcuuuugaaaccuguuuguguuagaaaugcucuguggucagggcugucccucaagucucauggguuuggcucauucccuuggcccucacgcuccucgcugcagcugcacccagagcuccucccaguugccaaaggccaugcaccucucuccuccuagagucccuucuuuccacucagccuucucuguucagugcuguaugugacgauugguccucugccaugugacucucugagagccuaguuuucauucccugauaagaguauuuggucuuugagggaaggcaucugcugucuccuucuguagcacauacuacuagcaggcagcuggguuuacuaauugaugaugcauagaccaagucccucccauccuuuuccuugguugacauggacauuuagaacugcauuaggugugccucagugugauuaucauguaagcuacaguaggcuugcccagaguuuguuuugggugugugugcugugggugaaguagaugguguguaaagcaagcauccucuuggacucuccuacagucuaugccauucgggaggcagccaccaacaaccucaugaaguuaguccagaaguucgguacagagugggcccagaauaccauugucccuaaaguguugguaauggcaaaugacccuaacuacuuacacagaaugaccacgcucuucugcauuaauguaaguauuacauguguuacugcucagcuugggcguuuuguuuuauuuuuguuuuuuugguuauucacguucuaaauuucugugugagcuaucuuauguuagagguacauuucuuauacuguucaauuugaauagagaaaacauugauuuaaaauuuuggagcuggagagauggcucagugucacaggugguucacaacugcccagagcucggcugguggugagaacaggcagaccggacugucucuaagcaucaccccuccccacagucacaccaauagugagaugaaacaguauuuaaacauuucauuauuuuaaaaguugcaauuugcuguauguuuuggcagaggucuuccaucuuuugagccacuucauguucuuuagaugcucaaguaggaaacaguuuucuauuggccaauuaccuucccuuuauauauuaguuuguuucucuagauuuggggugucuuaaggaaguguuaaauguacugucuuauuuauuuuucuaggcacugucugaagccugugguaaggaaauaaccacuaagcaaauguugcccaucguguugaaaauggcaggagaccagguagcaaauguccgcuucaauguggccaaaucacugcagaaaauuggaccgauucuagacaccaaguaagacuucaguauugcuguugauuugaaaguauaacuucauggugaggaguagccucuaaaauaaguccagaauuccuuucuuuaucuagaauccgggcuuauucagagaaaauaauccagucuugagacuguccaguuugacuuuuacacuuaagcucuaggcguguaaagcucacugcccaaaagcgaauuucaccaauaacuucuuuagaaauuauuugaugugcuugucauguuuguauuuaaaaguaauuucauuuuaaauauaaaacuugccaucgaugaaacccuaaguuugaugcagacuguaucacguugcacucugccugcccagccguccuuuucacagugacuuuugaauuucagcgccuugcagggggaagugaagccggugcugcagaaauugggucaggacgaagacauggaugucaaauauuuugcacaggaagcuauaagugguaugccuuguguuuugugcuaggcucggguugcuagggugcuuucuuuuauagugugagugucgggggagggggcagugugcugagcaugaugggagaugggguggcaagugucuguuacacugggccuguuggguuagguuaggaauuucuuagccccugcugggcuuggcagcacacacuugcaaucccagcacuugggagacugaggcaggaggaugucagaguagaggagccugggcuacguugugagacccuaucuaaaauaaagaaaagucuuggcccacuguucucagcugagugaggaggccauguucucagcuccuguguagggugcugauuguuucuggcaagaacaguuuaguuugcacucgaguaagucuuuaauuuccagucagccucacugacuaaagcagcaggugcaggcccacaguaggaccucagccuccugcuuugccauuguuacaugcuaaauggugaagcgaucacucaugaaccuucuguaccacuaaugugauuuuguuuggaauuuuccaguucuugccuuggcauaaagaugaacaggagggaaaagccuuuacuaaauucuuaucacagaucucuagucaauguguucuugcccuggguggagaaaaauggaaaccuucaagaucucauccaagcaaauggcaacaacauagaagaaaucagauuucagugacuugauucucucuacacaugaccucagacugacuugacuucucucuguugggauaacuguacgcucuucuucugcccaguugcugaugcuccucauacagucaucucuugagugucucccaggguuucucuccagcaccauugaggcuccugccuccucccuuuugaaucaggccccagccacuuacgauuccagacagacccuggauggauuuggaccccgacacggaguggagugaaucccuuauuguuuacacaucucuguguggcgcuccaucuuuccaauguuaagaguaaaugguuuagaauaacuuauuuauaucugcuuggagcuaauauugagauuugacuguagcgaaagccacaugcuccugguuucgaugguccgcaucagcaucucacaugaaggagauguggaaggcuaacgaauggcuggucugguuuucauuugcucaguuugacuguaaucaugucaugcaggagcuggaaguggguguaucuugcugcuaaugugugauguugaaagaaaacaauuucaacggcucagcacugugacugccuucaaaaacucagaagaaacuuuagugccuccuacuaaguugugguucuacuguuucauugugaaguguuguguuucaaguaaguguaggaaccaguggccccaggcucugcucccagcacuguuagugagcauugugcuguugcgauaccgugcaguaccaaacugaagcuuccuugcucaguguuuucuuguggugugggugaugcuagaacuuuuuucuacuuuugcaguaaaauuucauuaauauguccagaaauuuaaggugacaggucaagcugaaggguuugcugaagcaaauuaauugugucuauggaaggcugcuggacacuaauuuuaggaaguacccccuucucagugggugugccugugaccagugucccugcucugucauaacccagcccuuccaggagcagcgcacacaucacacuuuuccugaauaucccuguggguaauuuaaauauuuucaucugacuccuugucucggguggacucaaguuaaugaggcuuuacugcggccuguuuuacucaaugcaucauaccauguaguuugauguuuccauuuugguuucugaauuguugauuuuacuuacaaauccuuuuagauauaacaagcccuguucuguuuugugaaggcccaaagauaccuacaaaucuuuguacauuaaacauguuacauaaaaccaaauuguguaaaugcuuuuaaguuuaucauaccuuagaaaaacagaacagaccguuucuaucagagaccaugugccugcauuuuaaacugcugguuacuucuuaguaaguuuucauuuuuguguucuagggccaaaguuugacuauuuuccuaagcauuuuagugccuuaaauuagucugcuguaaacauuuuaauuucacaguuucuuuuucgucaccugcaggcuguauuccucuuuaaugauuaguuuuauauuugagagagauaauugucuugauuguggaaaugugcauugggacagcugcuucaccuuugguuggaaaugccacaugguacacucacucgggaauaaaccucuaaagugucucugcuccccuaccccccagccuugugcauuuagcuuucugccagcaacuacugaagggagagacgguggacccuugccuucucaaauaagggucacauagcaugcaggaucuguuuugagaggccagcagagucgucacuguucuuucugguggcugcagugaacucccuugaguuaaccugcauagcaauugcucuucagcuucacuuuggccauuuucucuacauaguagcuuuuauacuugaugccuucaagagcucugugaugcaggcuuggucucuucugucuuguguuguaccauugacugggccagugucugggguauauuguuggugcuucauaaaaccgaguucauugugugauuucuaaaggauguccucuaaugggaacaaagucaccagacugucucacucuuucauuaauaaaauuagccacuucuuugcucuuaggaagcaagagccucuagccuagaccaguccccagcuccaggauuuuuuuuuuuuuuucuuuuugagacaaggaucucuauggaagguagcccuggcuguccuggaacucacuauguagaccaggcugguccugcgucugccucccaagugcugggaugaaaggcaugccacuaccucuggcuugaggaauuauccuuuuggaacugccuaguugccuugaacauaauauugcuccuguuuuacaucuaagcagcuuauaccauuguucaacuuguuaggaaagggaaaagccaagacaaacaaacacauccugugccaauuaaaagugagccauuaacaguggaguucauuuuagugauucucuucaacauauuguuuggggugugcccaucaggagccaaauauuagauccugugcgucuacuguacugccaaugaucaggagccugaagauagauguuguucccuagggauaaacagauuaaugugggauuuggaaugaagcaaccuucaguucauggcaacaccaagcuugacuguagugaugugggccuugaggugggggcugggaggaguauguuugcuccuuauuuaagagacagcaugacaggucucgucuaagcauccagaaugcuugcauaacacccaggaagagcaggguuucuuccugacaccacugagcuguccagaguuguauuaaccuccgugucccuuguguccaucacaggaguccuuugggccaucacacuggggaugguaggucagggccucugcucacaucccugcaugcuaguuuuccuuucucuggaaugucagcugcagagaaagugucccaccccaccccccggccuccauguucuuugggaacagaugaagugguugcuagccuuuuggcucacugcucuccucccuguucuacccauuucccugcuugucuuuucucuuuccucacacaucuucaguccucgguaucuagaauagccuuuacugcuccucauccgccuccacaggccugccauuuccaggaaauuacgucagguucaguugacauggaaaucuuuugagggggauaaaguacucaacugggaagaaaagccaagccauuucuuucuugggagugguuguccuuaacugcggugaucaggucugaaaggagcuagguucuguguuggcucaggguucuacaggcuacccauggccaagaugugggggaacccccaguuagaucucgggaugacuggagcaaaaaggcacuggugauggcuggcuuucucugcacagcugcccaggaccugugcugcuggcccaucagaguugcuagggcagcugagggcaucccaguugggaagcacagguggcuugggagggaugugcccuggucagggacggucacauugcugucuauaucucuagugguggcacaaaggcugaggaagcuagauuuuccugugaaggacagugaagagcccagcaucccugggguugacaagaaucucuuccugagaccccgagggccuggagaggacacugggaagguaagugcccuuggaacuuggggccagagcccuguccuuucuggggcugaggguagccagcagagcuugcugcugcuauagggagucacagcaaagugggcagagaaguaguucccaccacacuugcccaggcgagauaccuggcucuagagaaguguauuguaaagucuugcucuguucucccuuuguagagagugguggucuuuuccagaucugugacuugaggucuuuuaaaucuuccacagucugagaugagacccauguaacacaaggguagacuggaagagcuggucaacuuucuucccgggcugguucuguuuagggaguugucucccuucaggacgaagaguccaugccugaugguuuccaugcccaguuugcuuccuacaaccacauggagaagggaugcagaauccuaguucagcagucaccggggccagugagagaagggcgguuaugauuuaaauuaaauaggaauggagagccuggacugccuagggcugacgucaggguagauacaguaacugcaagaggcuggugcucucauagccacuccagcagauuuuaugcuuaaaccacugacagacaaaaggggcugucuuuaaauuaccgggcucuucacuugaugucaauggaggccacgcaaugucuccuguucugaacacuuuucuuucuguggccaagcccacucuuguucccugccugaguugccagcugccucaguucaggcagucccaggggugcuguguggugggaggaaguguugcuuccaaagucucagcagccuaggccuggcagacaccgagaugccagcccuucauguuccuucgacugcuuuguacaauuucacugaaagagacguggccggagcuguaagagcugggauucuucggggccugagccacaccuuucuuaaaugauaauggaguuguucuguuuuucaacauucuuagggccauuuagcuuagcccugaccacuucaguggucaucuguccccugccacagcugacuaggucagcucugaagaacucuguccagcugaggacagcauuaguggucauuucuugagcuugcuuuacugccauaccucgucaagcauuuacccacacaccuuugcaguacauguuuaccuuggacacauuucaggugguuggguacccuuccccagaagccagcugugcuauuucucugaggcugcaguucauuugauccacaaaacccccuucucugugagucagggugccugccuugcuuuuguuucacaaaugcucugggguugaaauggaaaggacuuuugcuguugcugggcaguguuucaugucaggggccuauagccaagugagugagccaggaagucauccaguugcaaaccagaaguuguucuuaacccuuuucugugguguguggccagcucacugauuugcccucauacggagaacuuugggaaccuauuucuugacuggucucaaagcccuaagggaaucauuugacgucuuaaggcugugcuugcugcuucguccaagaaggcagcccaggcuuccuccuggugaaagguggguguuguugcuucagugccauggagagagaggcucuugaagucugcauggucuuugugcuugaugaaucauguucucaaaugcaagaccugcuagggaacagccuggaccacgggcacgggucacacugcuaccucuaggguggcacagccacgcucuccaggguagagguugcccucugaccacagcugcuggcaaggcugucaggcaagaguuaacaguggauuuguuuauugaaucaugaaguagcugucaugugauuuuaaucaaaacacgauuucccugacaacagugacgucagucuuguuguugcaggaaggagcagcugugagggacauucagucucccugagcccagguuuggagacucaaaccaagcgcaacauccauaaauccugggugcagacgcuggcuugacaauccacacucuucuuccucuucuaucucccuggacagucuguccuggacagacacagucccugcauggagucucagcuaagagcucccugccccuggcucccccacccucgcuucuacagaugcuuuuuauugcucuuuucccuuucugccacuuaauuucugggccccuaaggucucuggucugugucuucuggcauuugucuccucugggaucuaagccagcacuugcuggugaccugagauguucugguaggcaguugguuuauuccucagacuaagagguaccagggcugccagaagaugugaagggcaacucugaggagccuagcucugggugcuugaaggguagggcuuuaagagccuaacugccuggccagaggaugucuugaacccuaaaagacuagaauccaggaguccccaguccagucagaggacugcugcacaugaugugugaucgucuccagagcacuccagcuaagggaguugugucccacaggcuacugagaggucagaagcagggacagaaguaaagggaucacagcccagcuagagcaggucccucccuaggcucuggucuccugugguucccugaggacugagaccugucugugcagaaagacucccccaggcccucuacacccaugaguuuaauuacuucaaagauggggaggaaaaagcugccuagauaggccuuguuacugugacaaaaaaaucugaccaaagccaccuggcucacagcuugaggggacaguccaugguggauagucacacugugucuggucagaucagaugaaugcugaucgucuacuuggcuuucuuuucucauuuucuuuaucuaagacaccuaccuaugguguggccacccaccuucaggaugcuuccuccauacuuaaacacuucuggaaacuuccucacagacagaugcagaguauuucccccaugauuccaaauccagucaaggagacagugaagaugaacccucagauucuuagggcuggacuuaaguuguggcacucaugaccaguguuacccagaacucacugccaaaaauucagagaucucaggacugaguuaccagugaggguaaucaccuuucaguuagugagaagagacuucacaggcaccugcauagccauuuccuagccuagugucagacagaguaguggcaaguggucaaggggaguugguccaaucauaauguuuccauguuaaagggaggugcugagucaggcugcucccaucacggguggggacagugagcccuuagagugaccugcauagguuaguggcaggucuagggacuaaggauugaguucagauuuguugcugccuccugugcuaucugacaggacggagugguacuacucaccuguagugccugucuagcuacccacugguuuggacuggggagccagccucucucuucauuuccugguacccuucugacugccugccugcccuuuggccuucacuuugaugaguaaacuucuggguuucuguggugacuuguaguuccagugggucucaggugaggcacaggcaaugagcugggucccuugcauggugugcuuugccauccucauagcucagcugaacccaucccaucagcuugguggggugucuugggggucagaauucucaggcccucucuugggcagccaaggcuuuguuauuccaucuuugaggaauaaggaggaggaagacggaguaagaggcuuucaaaacuuaucuguggagggagugacucagcuccagagguucaacacucagcugccucauuuucucugggcuuugaaucuucugaccuuucugcccagccagcuuuggggguuuggcuccaggguagucugcgccucugcagucagucguuacucacccacuuaaguguuugcuuguuuuacccccucacugccaguucagaucagucuagcaguacuugggaaaucccaucagaagcacauacaaagggagggagcagggcucccuggcucuguaaccauagauacagaggaauucagccaacagacuccuuaggacagggcaagcuccccacucugccuggcugaccucaggcucagggaucuguggucacgucucugugccuggauuguggauaggugugucacugaugacagcuccacguuugaugugaaguucuauccacucugcuacauucaagacccauauuuauuuccucuuucuggauucugcccaaaaauaaucuauguaucaaauucauugcucgagagcuguuuagccuuugaaauucuuggcuggagccaaaguggaagagcagagccaugcuuuacugagcccaaggugggacaacuguggucugugagauuuccuauguggcacauagccccagacacagcacagugcuugcucaggcaaaacaguucauaacacuggaacaauacagggagauuagcauggccccuacacaaggaugacaugcaaguucaugcagugcucugcacaucaugggagggcagaaggguaagaggguggguaugaggggagaacuggauauguagguaggugugaagucaucaaaauaaaacccauuauccuauacacuaaaaaaguuaaaaaguauucauaccaagauuaaaaaaaauaacuuuaguguacaaagccagucuugcuccugagaacugcaggcugaucuuggguuccuccuuuccuggacccacuuggagguaugagcaccccucagaugccaagugucacugucugaacuuuuaacucugaaggcguagaguaagggcuuuucccauuggcccagggugagccucuagauccuggaugcauucuucuagaaacugagcugcuuucuguaggugagguuucuggagaagaguccagagaguucccugcacacccaaggacucugauccuacaauggacagcauggggaggaaaggaaagggccgcucccaggagggaagccucgucuguuagcacuggccacaggagggcuagaggcuuuggaaaugugcuuccugcuggccugcagcguuccgagcugcucaggcagaggccacaggguagugcucugcccucuguggccaauucuuuacuguucuucauaggguuuuguacuugguauggaagugaaggguguccuuagacucggggaggccugggugguuaccuaugacaacuuuacaaugauggagugauuucaaugggcaaggguaaaguuugcuaagcaagcacugacauggggggggggggaagaaacuuguacuuuuccaaggcuggcagagcugcgcacaugcacagugaggguucugugcccccaguccuauacauaccacauacccucagccucacagccacugggcuugccuccuuuugagagcugcugcaguucuggucuauauaauauuggcccaggggaauguccuaaguaauggaaaccaaaucucaucugcacucacugccagcaagcgggauuuaguccugcccuuuacuuagggucuggccccugcaaguccagcuuggcaaagggauucuccagaaccccaagggcaaaagaauguaugucuuugugagaaguucuuggugcgcaugcaugugugcauuuugugugcauguagcucgcucaugucccauucacagaccccagaggugacaaggugacacugacuaauaacagugcucuuugcuggccuuccuguauuacuuguucugggggagccgacuuagagcacggugugcuugccuuugucuucuuccugugcagaugcagugaugggcucuauuacaccaggagcauuagccaggcucagagaggcccugacugugugagggcugugcuuagcaguguuuccaucggccaucuguaguggcuaacguguacucaggcaauuuagggcgagguauuauuuacccugcugacgucaaugagaacauauuauccagugucuuuucuguaguuugaaaugagcaccagagcucagagaacacagccaccuuccacagucugaaaacucuacucacugcucaaugagguggauggaguccugccuauaaucucaugagucugauauucauaucaccaggcuuuuagaaaacaagguguuuuuauuuuaauucaggagaguuggaaacauaaaaacaguacauuuuccuggcagaaaaugaccccauuuacauuacaauuugguacaaagaucauuuauuaaacugcauuuuaggcaauuuucuaacacugagugacaggugacauuuugauuuuuucacacuggaucuauuaugauuugcacacaaaauaccaaagcuauugaagucgccaaauuucucuuaguaauuaaaaagcaugaaagaaaaaaaugacuacagucagauuaaguuuauggaaaguaacucacagagcaagcugaauucagcaagcuguucuuucugcaauaagcaaauggccuugccuuucuagaaagugcaaauaguuucuaccacucuucuucaacugcagucccccagaggcagacuggcccccacuaggcugcccccuccugcugcuuucuucuucuucuuuuuacccacgagaacugaggaugcuuugccacuugaauuuccgugacuuagcaauccugucggguaggcaucgguuaucugcacuugguaauguaacacuacuccauccaccaggguguuguuuguauuucuauuuuuaaagcuacccuuacucacccauuuugguuaugaaaaaugguagcacucuaccaucaaagcauauuaccauuuuguaauccucaaagugucuaauaagccuuccuacuugacaggacuuaaugguaaagaaauucaaugggcauagugacacacuccuuuaaccccagcacuuggaggcagaggcaggugcaucucugaguuugaggccagccugcucuacagagugaguuccaggacagccagggcuacacagugagacuguguuuaaaaaaauuaaaaaaaauuuuaagaaaaaaagauguucuagugccuuuccuuuaggguaaagguugaguucauaauuucuagucagucucuuggguugacuguguugacuaaguagugggcccuuuuggcccuuuggcaaucaaggaggagguauguccuucaaauauauacuuauagagaaaaguacuagauugcauaacuuugaauaagcaaacgucuuugauguaagcccaagcuuuugcaacuuacuggacauuaagacggccaaucuguggugucuauguuucccugugcagugcagucccccagagagcuacagguaucauuuaagggcacuuagagccaggcagcugucaaauggaggcugcagcugugggggcagggcuccaacacaagccaaaagccaaaagccaggcaaggaagguguguaucccugccauccccacuucugagcucugugaccucagcuaagucgugcauccuuaagagcuuugcuucccucagaaaaaugggcagaaucucucuagcuaauccugcagagccaaugugggggaucuaagcaagcacucagaagugccugguacauugcugagaacacggacggcaggcugaguaaacaugacuuguaagacccauccgugguuaagcugucugucaaucaaugcagccagccacaugcccaaaucugcucacauaguauauggacauaugauguguggugcaacuaggaaugcugggagucuucuagaaucagcuagguuguuguaacugggugaaaauggcucaacaaaucagugagaagguguucggagaggagauuuuagggcccaaaggaccuuuuaaggcucaauaucucauuucacaugccacugaaguggugcaaaaagccaugaaaucucucacuucucugagcccccaagccagggaagacauguguguguucugaaguguguuuuuguccaguguugaaacagguugacucugcucuugucucccacaaaucauucugaagguaaguucuauaaaaaguuuccagaagcaacaaagugaugaagauccugccugggcagcgacuccaacuuacuaccuguucuccaguuucuaccuuugaugucuaggcacagagagacggagcggcuccaguggcuuccgaggaggcaguagaggcagcccagcuuaggggcacaaacacagcaaaggucagcccagcacagggacucuguaagacccacugugaucgcuggcaucaagugacacuccauauugucugucucuaagugacacuucauacugucugucucuaaggagaagggguguaaaaaaguugccuggacuaugaauuuucuguaaacuaacagggaacuuaacucacuguugguaugaguguaauccagaccagagaaaguccgauccugauauauuuaagaagcaggcuugauuagagacuggagaaccugcagaggaaggagagcccacuggaucccauguccugagcugcuggcacaccuggggcccuugaucaucuggccuagaagcugcuacuuuuagcuccuucaguuucugguucauccccagcugagaacagccuuuccccagucccuuagguauaauggcuccugggguauagguagagaggucugugaugaaugcuugcugaguacucuauuuaacagagcucucgggagggcagagggugcuacuccacagggugcacuguacggggggggggggggggggcaggaacucaguuauaaaaguuagggagggcacaugagagggagaggcugaaguccucccucccugacaccaggaacacaucucuaagauagagaggccuuggcuuccgcuuuccuaggaugcaaagcaccaggaagggcuuuguucagaccagcucucauaccucacgucacucccaaaggcuucuccuggguccucacuaucccacuggguagauuuagagggcuauggacauaaagaacugcccccacccccgaccuuuguucccaagguggcaguucaggcagccaugcuggggcaaguugagggcuggugcuggucacgcagcucccuggaauagaggagugggacccguaucgguugucuucuguugcauuaacauccucuauuugccuuacagggaccagcaugucaguugcauauaaauacuagagacacacuugcccaacuggaaauugcagaagcaaugcauuucccccaaagcagagaguaauaccccuggauaacaagaccauaaacaaaaaaauaaaagaguaccacacauauugcacuuuuugccgaauggaaauuuuaccucauguuuggaucaccagucucuuuggagaggcuaguuuacaguaacaaagcuaaggguuacuauacaguaguguacacacugcugaugugaaccgacaggcagacacgucaguauuacaaagcugccucuccacgagagagccuaagccuucuuaguguuacuuuaguacuugugaggagaaaaggcuuggaagcuuccaugagucacuaggugggggcagacacagaagcaaucagaugaguggagggcccauugcucucaccagcuuccaccucaggacauaaagguagccguggaacuagggaugucuacuugaaaggaaggaaggaggaaaugggagcuuacgacagguuccggcaggaugguucucggucuucacaaggcgacuguccucaccuccucucugugucagugccuaacaggcuuggccgcugaugagcguucccagcuucucucugcagccuuuaaacuucugacagccucuccgcagccccucaucuguugccuaacuguccugccauagcugcuaggucucccgggcuaagcagcucacaacccuguugggggacagggguuuaugccaaucugcuguggucugauccugcaguccugaaaugagcagcccccauuuucaaucuggaaggcauuuucauuuugucaauauuacagcacuugugcaguaaaugcugggacaacauucuccuucagucuaaagaaaucaagccccacuuuauaacuuggcuuauuuugcaaagcuuuaaacauaucagagaucuuaaugaaaugaucucuccaaugaaauuaucaaucuuaaguacgaggaggaauagaaugaauaaaagaaacacaaauuauccuuacuggauuuuuaguuauuaaaucacaaaaugacagucccuccugcuaucuacuccugcuguaacccacagcccaauuccaagcagagcgcauuuccaaagcagccuggcaccaguggggagcccaacaacuacagucucuggccagccucaaggacugcuugagucaccaacacuggcaggggcugagcugggcugggcugcgggccaggauggcucuccggagacuucccaugccuagucuucccuugccugccuggacacuuacuacagagaggaaaggcaacuuauagguguuucuagaggcagcaucuguggaguagcucucuucuugugcuuuaaggaagacgcuuugugcuuagugcauucaucugcugauuggacaagccacucuaaagaauagaaauuauaauuuuauaaacaauacugagccuguaacaccuggaugucacugugcaaacaacagauuacuaguuacuuuuagauaucuguugacuagguacagcaucuauuuuucaauuaaaggguuaagcuuuucuc

SEQ ID NO: 12438 - RNA, 99551 nt, Mus musculus
uuuauagagccggaagcgggaaggcgugcguacagaaccagcugcuagauccgugcacgcgggaaaaggcgaagcgaccuggguuugcauuggcaggcagaaugcagcgguaggagcgagggacgaacgcucggggacuucugugaggggaaaauucucuucugagcccaucuuuccucagcuuccgaauggcucuuaccccuucucugcagaacggccgucaucuucucccucuuucugcagacccuagauggagugagccuaaaucuucccuucugcacgucccucuuuccuaucugucaucuuaaggguucuggucgaucuagauuuuuuaaaucucauacuuuagucucagagcguuuauuuauauuuaagcuacagguuugcacauguucguaguuaagagcacuggcccuuggaaaucacagucucguauucucauugucaguuguauugccuguguugucuguaguagguaaguggcagccacucugagccuuugaaaauguuuaaccugcgcuccuuccccggucccacccccgccaccuggcacagauaaguagacagcuacuuuuucaaagcgacaaugugauaggaaaaacuguguuagccgaggaaggacugguucuguggaaacugagccugaaagaaucgacuuugcugcuagaucuugccggguguaaauucuucugcaagaugguagcgaagcuuucagacagaaggaagugcauggaaaggcacaaaguguaacgagcucuuguuauugagugauacagauuuugcaaguuuccaguguauugaagccagaggaagggaugagagcaagaagaggaggaaaaaaacagucaucaaauagauuuauaaagcgaucguaagagaagacaguaacaggaugacaguuauacugaauauuugcugugugugugugugugugugagagagagagagagagagagagaaagagagagagagagagagagaaagagugagauaguaagagagagaaagagaaaguagguguguggugggggagagggaaacagaaacggaaacgaacuccuuaaaguagauacugguaucauuuucucaucuagcauccagaaaacaggugccaguuuaaccaacauguugcagguuggauaacuguuaauugaauggaccuggauccgaacaauacagccugaccauagaacccacccuuuugcaacccaggcuagccccuaacucacaauugugcugccugagccuccccuaggccugcaauaccugacugagccccagugcuuuuuaccacuagccaagacuaacaugccacaggugggguuauuucugggaaggggagauguaauuauugucaaaaugcaucaacuugacugaacccucaaaaggaagauuugauuugucuguucaggggcuguugcuuaggaagcuuuuuuaguugaauguugggagcugaacuauguuacuuguuuuaaugucucagcauuuguucacuugauagcucucuucaucuaguuggauagcuuugguucugccacccaccacuauuugguugguugguuuguuuguuuuugagucaggguuucucuguugcccuggcuguccuggaacucuuucuguagaccaggcuagccuugaauucaacagaucuaccugccucucucucuuuccuucccucccccuccucccucccuccccuacucccucucccucccucccuuccucucccucuccucucccucacugccccccccuuucugccucuuucugccauucaguucauucagaucuugcauuuacuuaauucauaacaauuuaaucuaaaugauaaacuguuguaauuuggggggggguaugagcuucuuuagcucaguguggcauugaucucacugagggugaccuuaaacuucuauccuccuuucuuuaccuucccacugguauugggauuacacuaaugugcuguggcacucucuguucucuucuuuuguuuucuacuguauuuugauuuccuuugaggcauaaguugcaacuuggaacuauggauuaauacuuguaucaucaccauugucaccagaugucuccaagaggguaggcuguguaucaguaugguucaguuauuuucuagcuguccauagcaugccuaaccugauacacuguacaugugaaacaaauauuguuugcuguuaucaaugaauguuuuccuuuuuuuuuuuuuuuguuuuuugagacaggguuucucugugaagcccuggcugccuuggaacucacuuuguagaccaagcuggccucgaacucagaaauccgccugccucugccucccaagugcugggauuaaaggcgugugccaccacgcccagcgaauguuuuccuuuuauagagauaauacugaacuguuucauuuuauucaaaauaauagauuaccaugcuaggcaaagcacacauuugagaauuagagccuaauuuugauauacuuuaagaaaauguccuauagaaauguuaagaaaaauuauugugccuuugaucacagugugccucugcauguauaguuagguuuaaauguguaguuaaugucuaaaauaguuacguacaggucuaaaguacagcuuacuggcacaucacauguuuaguaugcuuaaagcaccaagccaguccuuagcaaaaaaaaaaaaaaaaaaucaaugaaauuuguauauuucuuuuuacaggugaggaugcauguucugaaaucuuaaaccaugagucuagcacucaaugaucugcucauuugcugccggcaguuagagcaugacagagcuacagaaagaaggguaauauaguauuugaaguuguuuuucuugaagcaaaugugugauagguaacauaguauguuauuauuauuauuauguuuuuuuauuuucagaaagaaguggauaaauuuaagcgccugauucaggauccugaaacaguucaacauuuagauaggcauucugauuccaaacaaggaaaauaucugaauugggaugcuguuuucagguauccucuuugaacuuguguuucuuuuucuguuuugugaugccauuuuacucuuuaauuuuguuugcuguauaucauuauguguuacauaggaaguugacccuuagugguuaucugaaaguuuuaaaaacauacauaacacuggaagguuuaugucauuucuuugauagaauauuuuagauguauauccuguaacaacaagaaagaugcaucagggugcuggcgagauggcucggaggguaagagcacugacugcucuuccuaagguccuggcucacaacuaccuguaaugagaucugacacccucuucuggcaugucugaagacagcuacaguguacuuauguauaaaauaaauaaaucuaugggccggagcuagcagggaugagcuaguggggccgaccagagugagcagagguucuaaaaauucaauucccaacaaccucaugaaggcucacaaccaucuguucaguuauaguguacccauauacauaaaguaaauaaauaauaacuaaauuguuuuaagaaaacaagaggcaucauaggauuccugucauacugcuuucuugaggcugaggcaggaggccaggccagucuggcuuucauagugaguucuuguccuaucuggucuauauagggaaacucugucucaaauagagcaaaaacaacaugaggauucuguucauuuuuacuauaagaaucuguuucaaauuuguuuuaaacauaaguuacaguagcugggcgaugguagcacucuggagaugaggugggcaaaucucugaauucuaggccugccugagccauaaaaguuccaggacagccagggcuaacagaucuugucucaaaucaacaaaaaaguaaguuauaauauaaguuuaucauuuuauuauugcugauuauaaguaucuggcauuagcuugguauaaucauuccacccuggaucaugacaucauuuugcgcccuauaaacacaugcaauuauaaaucgucaguuuacaauaaaacuuuuaaaaauuaaaaagagaaaaauacuagccaggcggugguggugcacaccuuuaaucccagcacuucggaggcagaggcagaggcagaggcagaggcagaggcagaggcagaggcaggcggauuuccagccuggucuacaaagugaguuccagggcagccagggcuacacagagaaacccugucuuuaaaaaaaaaaaaaaaaguuuaaaaauuuacuuuuuuguggcagacuugauacgugucuauauugaaacuaaauuuucaaccauaaguucauuuauaauuaaaaacagauauuguaagacuuguuggggaaagaaaaagggcuuuauaaaaaauauuauuuauuuaugugcuucuguagacauuggauauccuuaaacuagaguuauauagagguuguaagcucuccuccauggaugcuggguagugaacccugguccuuuggaagagcaggugaggacccuugaccaucuaacagcccccaaacauuuuaaauucauguagaauuugaccugaagcugguucauugguauauaugacaccuauaaccuuggcucuugggaaggugauagaggaagauaaugcccauggguggguguacaauuacuguuaucuguuuuuacaagcugauuagauaggcuagaugugcaaccauuccugaccagcuuucaguacuuuauaagcagcuuucauuuaaaaacuagaaauauaauaaacugcucauaauguaaggaaaguugaacaagagauuguuucaugugucugguugguacaacagugugguuuaaaagauguuuugggggaagauacacaggaguuuuugaagugauaaaaguauaagcauuaaugaggauaugauuuauuuuuccuugaagguuuuuacagaaguacauucaaaaagaaauggaaagucugagaacagcaaaaucaaauguaucagccaccacacagagcuccagacagaagaagaugcaagagaucagcaguuuggucagauacuucaucaaaugugcaaacaaaaguaaguaaccuuggcugcgugugguggcacacacugcugugguggcgcacaccuuuagucccagcacucaaaaggcagaggcagguggaucuauagccuagccuggacuauagagugaguuccaggacagccagggcuacacagagaaacccugccucaaaaaacccaaagcaacaaaaaacguaaacaacaucauguauuacacacaaaugcuucaggaguuagcguagcauaaauuugaucuuaauacaguagcauaaaaauuaaguucuccuugaaauuccuagcauuacacuggcuuuucauauaguagguccaaaauuuagaguaauuuagcauaaaauguuuaaucucagaaguggaaagauuaaaaauuaauguuucaguuccccauucuuguauucccucuacguguuuuuauacaucagcagaagugcagucuuaaggaggcugaauaacuuuaaggguauaaauugcugucaggccagugagauggcuugccagguaaagaaucuuugccagugccgggcgugguggcgcacgccuuuaaucccagcacucgggaggcagaggcaggcggauuucugaguucgaggccagccuggucuacaaagugaguuccaggacagccagggcuacacagagaaacccugucucgaaaaaccaaaaaaaaaaaaaaagaaucuuugccagcaagccugguggccuccguuugagcccaagaaccgaaacgauggagaaaaccaacgcuuccaaguuguccuaugaccccuacacaggcaccaaggcauggcugauuuagugcacgugugagcaugugagugcacacaaaguaaauacucagaaaauguguaaaaaaaaacauuguuuuuaaaguuuacuuucaucgauuacugcucuuuuuauuuuuaaagauuuuuuuguuuuauauaugugagcacacugucacugucuuccaacacaucagaauagggcaucagaucccauuacagaugguugugagccacccugugguugcugggaacugaacucaggaccucuggaagagcagucagugagugcucucaaccguggagccaucucuccaucuccuuuuuuuuuuuuuuuuuaagguuugcuuauuuauguguaugagugguucugucugcauguauguaaauacacuacauauuccaguucuugaagaagucaggagaauccucuggaacuggguaguuacaugugagugcugggaaccaaacccagauccucugcaagagcaucaaaugcucuuaaccaguaagccauaucuccaccccucuagcugcauaaauuauacacagaaaaccugguauuuauuuccacaugauaucauuugauguauuugaaaauaaccauagcauuccugagugaucuuucccuaaauuaaauggaccuaauuccuucagcucauugacauaguuuuaauuucacuuucucuuuaauauucuugaguuuguuauuucuuaaagaguggcaucagucuuguaguauuaucuaguugguacagccuacagcauauuuguuucaguuuuguuuuuugaaauagggucuuucaguguagcccagguuggccucagauaugugauccuggugccucauaucuucuucaguuccuggauugcaaauaugugcccccaugcuggcucuguacuuacucauucauucauucauuuucgugcucacgcauauauguggugggugcacacggguauuuugguaaaugggaggucugcuuguguuuuggagguugcuaaauaguccagguuuucuggucaacaagccccugaguccugucuuuuuugugcuaggauuacaagugcaugccacaaugcucaacuuuuuuauguagggucuggcaggucaaauguagguccucauccuuguaagguaagcauuuuaccaacuaagcuaucaccccagcauuuauucuuuacauuuauuauuuugagauaacacuagccucuuguagucaaauuuagucuauuuacuuguuuuuuuuuuuuaaauguuauuuuuguuuguucuuuugcaaugguagguacaaaaacccaugguuuaugcaugcugggcaguacugugcuacugaguuuuaaucucgacugagagaauuaggaaauaaaaacauaaauuuuaaaacaauuguguuuggcagagaaagagaauguucugggcaaaaggagacagaaaauuaagauuucaucuuaauauuuaugaaguuaacuuuauuuauugucuauuguuggucuugggcauuugugguaaauuauuccuuuccaaaaucugacaguacaacaaauacuguauauaaaaaaguauuucagaaacugugggagagauagccaaggacuauagaaaaggaucaugcagacgugggcauugucaugggucacacgcccggaaucauaagccaugagugaaagcugcuauuuauacugugauagcauugcguacuuaccauagccugacccuccugaguguagccagucucaucauuaagaaaaugcuaaucuaacacauuuuacuuaugcauauugaguuucauccuaccuguaguucaauuucaaaaugaagucaguacugaagaaaccauggucuuuuaguuucgaugucaguaugauuuuauaaaaagcaagccaguaaggaauaucccuccauggccucugcaucagcuccugcuuccugaucugcuugaguuccaguccugaccuccuuuggugaugaacagcaguguggaaguguaagcugaaaaaacccuuuucuccccaacuugcuuuuuggucaugauguuugugcaggaauagaaacccugacuaagacaaauuggaaacuacaaaauaaacauuuuaauuucuguagccuuggcuauagccuuuaccuggaguuacaggcugacacacccuaaagguaaacuuaaacccugcccucccuuuucuuuagauaggguuuccuuguggcccaagauggucacuuuuauuuuuuaagauuuauauauuuauguguacacuauagcugucuucagacacuccagaagagggugucagaucucauuacggaugguugugagccaccaugugguugcugggauuugacucaggaccucuggaagagcagucagugcucuuaaccacugggccaucucuccagccccaccaagauggucuuaaacuuacuuacuguauagugaagaaugauaccuuaaccagaaucuugcccuaaccaaggacuauuuggauuauugguguguaauacuguuccuggcauaauuuuguuuuuaaauguaauuuugugaucuuuaaaaauauacauuuaggggugggggagauuacacuggcugccuuuccggaagacuuggauuugauucuuagcacccacaugggagcucucaaccauguauaaauucaguccuuaaagaucuggagccuucuucugauuucugaggcacugcaugcaugcagugcacagacauacauggaagcaaaacacccaugcacauacccauuuuagaagaacauuuauuagcaaugaauuuucagaaucuaaacuauugugcuguuaaaacuucagccuuuucuauauguaugcuauuugucuucuguuuagauguaauggaaauaaucuugcuuuuuagaguagcuaggcuauucuuaauagaauauuucaagauuauuuuaauaaauuuauucauaaagcugcucagugacuuagaauccuuuuaauuccagugccacaaauugugaguucaguauaaaaauuaaucuauuuuugcuguauuuuuagagguugguaaauuuaaucuuuaauggugcuaucuagcaaauguuuucuuuuucuuuaacuuucugggucauauauuauccauugcagauacucauuucuugucauuuacaguauuaaaugcagaaaugugauuguguuccaguuaaacuuuauuaacaaaauggccaaccaguugaauuuuacuuaggggcuacccuguugagagaaacuaugagagugaguuaagagaaacuugcugaauggaaucacuuaaagaaguuggcacuuagcugggcgugguggugcacgccuuuaaucccagcacuuuggaggcagaggcagguggauuucugaguucgaggccagccuggucuacaaagugaguuccaggacagccagggcuacacagagaaacccugucucgaaaaacaaaacaacaaaaaaaguuggcacucugaaggagucuuuauuuuuaugaucuauacauuuuuacuauuuuguuuuauuuuuaaauaggagcacccaggcuaaaaugucaagaccucuugaauuaugucauggauacagugaaagacucaucuaauggucuaacguauggagcugacuguagcaacauacuacucaaagacauucuuucugugagaaaauacuggugugaaguaucucagcaacaguggcuagguauguuuugaagccugugauuuuuucccccccuuauaagaugaaauuucaacaauaaaagcagucuauaucccacagacgacucagaguuuaauauuauauugaugaaauuauaucauuguaguuucagagccuucauuuucuuccuuuucaaguaacaucuugcuauauaucccauucuggccuucaacuuguaauccucugcauuggucuguuaaggcuggaauuauaaauauggacuaccaugcccaguucuuaauuuucauuuauuauguacuuugaaaagcauuaagacaagcuggugagauggcucaguggguaagagcacuuacugcucuuccaaagguccugaguucaaaucccagcaaccauaugguggcuuacaaccacucguaaugaaaucugaugcccucuucuggugugucugaagacagcuacaguguacuuauuuauaauaauaaauaaaucuuugggcgaaagcgagcagggacugagcgagcaggguugacugaagcgagcaaagauccaaaauuuaauucccaacaacuacaugaaggcucacaaccaucuguacagcuacaguguacucacauacauuaaauagauaaauacaucuuuuuuuuuaaaaaaguauuaagucacauuguuuauaguagguguuuaccacuagaacuggaauuacagauuucaaagauuacugcucuguuuucaaauauucagccguccagugacugagaaaaauagucagcuaaaaauuaccaugccauucacucucuccaggcuuguuuacaguguguacacagaacagcgauaccuuaacugagccauaaauaaaggaggaaaccaaaagagagaugucacagagguugaaagcaaggguucugaguuaaaaggguugugguagauacuuuaaaugucagaggaaggauaacgugcaaaaguauucacuguguuaggcagagguagauauuagguaacuaguaagggaaugaaaaucaaaugcguuaaaauaucuuuuacucauugacuuacuagauauucaaaguacuauucuuuuuaaauuucuauuuccagacuguucacugcugugauacaaaauuauuucuuccaccuggcauccuggucugagcacuugagagaguuguuauuaaauccuaaucccaaaucacugaaaguaucacuucucggaucauugugaugcaguguagcuuaaggccucaccagagucaaaccugcuucuauagcauuucagcacuacacuucagucagggcauuaaaccgaagcacacacaggucugaaugcuucauaccguuuaguuccauugacacgugacagaauugcucacauauggugucugaagaaccuuaccuuuggugauauuugagauuuuaucuuuuaaacgccacaaacaguuuucacauaugcaguuuuacuguucauggaggagugcauacauugcaccuucugugaagaagcaggauucuacucuucugagacuccuugaggugucucgugcuguccuucaugcccucucuugagcaugauggauucugaaaauguggaccauuccccucgagaaacaugaagcuugaugugcuauaaugagaagcaauggcaguguuggcccuugcucuuucuuuucugucaguaaaagagaaaauuguuaaagaggauucuuccacuucaguaugugugcaugagcauuuuuaccaugcuguggcuaucugauacauugcaaacauguuaacauaauugauagaguuuuaugaacucuuauuacacaguaugauuaaaacuacaauguuugauuuauuuguauuggccauaucucuuguuugauacccaauuuuaagccaauuuuauccacuuuugcagaagcaugacaugagcaauucaaaaggaagauaaagacaguugauauucuucccugucucuaucuucuaguggggauaaagucuuuugccacuagcuuacuuuucauuaagucuggaacaauucucaauagauuauacugcauaucgcugacucuuguuacuguuuuucaccuaaacuacuuucuucaaggguguauuguguagugaaucacuugagagagucauugccuuccuucaaacaaagaaugguuuugcuuuuagccuuauuuauaaaagggcuacuauuuucauuugggugaaccaucccucuucaugaugcuguugagauuggggaccucaugcaaagauggaaguauucugcuuaccguuacugcugugaggaauaaacuuuccuuuuuucuuuuuugagcaagaaccuuauguccuuuacuaaaaauccaagaaacuguccuguuguuguuagguuauauacaaacagagcaaacugugaagccauucauaaagggugauacuuucuauacauauuuuaaaaacaccauugauaggacaccaaaacuuagugacuuuguuaguccuagcuaaaacagcauaggcauggagacagauauuaaguagcuuauuugagguuuaaguacauuaauaaacauugauguauucuauuaaacucaagguuaucuuuaauacuuuugucuuggagaauuguagcauacuuaaguugaauugugauguugaacauaguuaauuuuuaaaauaauuaucuaauacuuucuuuuuucaauuuuuagaauuguuuucacuguacuucaggcuguaucucaagccaucacaggacauuaauagaguuuuaguggcuagaauaauucaugcugucaccagaggaugcuguucacagacugauggauuaccuucaaaguuuuuagaucuuuuuuccaaggcuauucaguaugccagguaauuagaccacuugguuucauauuguaccauauucauauuagauuuucuuuccaucaccauguuuuagauuuaauaacuaaauaauacuaccuuuucaacaguggguauucaguugcucacauuucugauggaaaaugugauuauucagaauauuucuauuuuucuaaauauuaaguuuuuauuaauacauaauuauggauagucaugguucauugugauauuucaauuuugugugcaucuugaccucugcuuuuuauccuauuaaaagcgaaaaaaaaaaaaacccuuaaaacagaccaaagauuugcaaguuagaaacuugaagaaagcaaacagaugaaacacuuggagauagugacacaagggucugaggaggcgacuuaguggguacaaacacuugauguguaagcaugaggaccuggguguggcuccugagcagccaaauagaauagccaagguaacugggcaaauuuuugaucccucgcugaguugaaguugaagauagagacagaaaauaauugggguuugcuaaccaccauuguuauuccacaauggcaagcuccugguugagugagagaccuuguuucaagggaauaauguggagaagaguuggccauccaacauccuccuuuaggucucuucaugcauacauguaugugccuaugugugcauacacacucaauuuuuuguaagauaaaagcggugaucuuuugggacuaaacccccaaaacagaagcaaaaggaaguagguggguuuauauaaacuguaguuucuuccuagaaaggaaaugcugagcauagugaaaagauaccuugccaaaugggagaggcucuugcacacuguggauccaacuaaagacuuaacauccagauuauauaacaacuuuaugaaacuugggaacaaaaacuauguugcuggggagauggaucaaggcacauuguaugaaauucucaacaaauaauaaaaaauagguuacuuaaaauuuuuuuuaaaugcccuagguaaaaaccuaggcaaaggguagugaugcacuucugugacuccaggacuggauggauauacuauaacccuaguacuugggaggcccugcauggcaugauucugaguuuaucgucaucuuggucugcaucaugagaaaauaaaugagaaaagaaaaauaaauaugcaaucaauuaauuuacgaacacauucaacuuccuuagcuaucaaagacaugcaaggaaagucccagugagauaagugguacugaaguuaaaagagcuguguugcuagaaguaaacagcagauacuuugaacagucuggagacaagacuucucacugcauuggugggagugucuuucaaaaggaaccauugacucguaauagaacccguaguuucuugaaggaucauuuugaaccaaauguucuuaaugugugaacacuuaagugacacccuuuaugugugagcccuguggucuuucucaucugauaaaaaggaaagcuggauguugcuuaaguaauaucauucuuuccauuuuaaggauagacguaguauaucgagagcaaaguagugagugggccuggagacauggcucagagguuaagagcacugaucuuccagagguccucaguucaauucccagcaaccacaugguggcucacaaccaucuguaaugggaucugguguccucuucuggugugucugaagacagcugcaguguacuuauauaauaauaaaagaacaaagugguaaaauauuuuggaagcauugguacacaucuguaaggcaaaauucaguucauguuaaaacauguauuacuguagguauacaaauaaauuguguguuuuuagacagugguuuaguagcaaagagguuuaacaggaaaaauuucuuagccccaagugagaaucaguggaguuuuuuuuaaugguuagaaauguuguguuggguuuuuuguuuguuuauuuuuuuuuuauggagagauuugaacccagguuaugauucuguuugaauauuagauuuuauccuuuucaacuguuccuguuacacccaguugacccuaucuucuguugcagacaagaaaagagcucuccuggcuuaagucacaucuuagcagcccuuaacauuuuccucaagucucuggcugucaacuuccgaaaacgggugugugaagcaggagaugaaauucuuccuaccuuacuauauauuuggacucaacauagacuuaaugauucuuuaaaagaaguaauuauugaacuaauucaacugcagauuuauauccaucauccacaaggagccagagcuccugaagaagguauaaagggaauuuuuccugauuugcauauguuucauuaaaauagaagcugucugagcguggcaucaguguucuguagaggaaugaagugucucugguuaggagugugacuaguccugagacggguuucaugcauucucuugggucugaaccagugggaguaaguucugacucgccuuuccauugucaauaaaguaucagaugaaaacuaguggcauuuccugcagcagccacucacccgucaccacuuccuacuaagaggggccguaggcuggagagcaagggguuuauauaaagugggagcuuguuuaucuccaugugagguagacuagccaaaccuggugccucacucuuacacaaggcucauuuccugggagcagaauaaacaguaaagcacugguggugaaugucuugugcucccugauuguuuugcaucccccuccccccuuuuuaaaccaaaaauacuauucuucauucuuuaagaaguguauugaaugagguaguguuggcgcaugccuuuagucccagcacuugggaggcagagacaggcagacuucugaguucgaggccagccuggucuguaaaaugaguuccaggauagucagcucucuacauauuagcucugucuagaaaaacaaaacaaaacaaaaccaaaacuggauugagugacaguugaccucgaugaacucucucguggauggucuuugauuaucuuugggcuuguacuagccuuuagacuaaguucaucuuggguaauagugaugauuuuguugaggugguccgagacauuaagucacaucagcaagaauggagaauaacuguuguaccauucuuuuuucaguagggauauguaucagcucuuugaauguauacauucagguuuauguaguuuaugaaacuacuauaagucaaaagaauugugacuucucaguuuugucuuucaucuuacucuaaccaggauaaagaugaggcugguuaaaaggugauguaauuuguuaguuaacugcauauuuaugguuaauugaaaauuugacaggguuaugagacugucagaaaaauucacauaguuuuagccuucaauauuauguuuuuauguuacuuuguuugugagaaguaauaacccuguaguuuuccaugaggauuguguuuaccagacucugcagacuaguucagcauuuuaagaggggcauaaauugacugaagugugacuugcauggugagauagccacuguaaacggagaacaguguaaguguacuaguagaaggagcaaugagggcagggaggaugggguagggguuuccaguggaggggaggggggccuggaaacgggagaacauuugaaauguaaauaaagaaaauauccaauaaaaaauucaaucauugggcuggugagauggcucaguggguaagagcacccgacugcucuuccggagguccggaguucaaaucccagcaaccacaugguggcucacaaccauccguaacgagaucugacucccucuucuggagugucugaagacagcuacaguguacuuauauaaauaaauaaaucuuaaaaaaaauucaaucauuaaaacagauagaaggagucauaauaaaaauuauacagaagcuggucccauguggaagaagggcauguuaucuuucuuaaggcacaucauacauuagaaaagggaaaguuuuagaugagaacgugaggacauuuauaacaaccacaguuaccugacuaugaagugaagaccaccaggaagugagucuucaaggauauugcccaaagggacauuaguacugaguagaccucggacugggcugccuaagaaggugagucauucugagagcuggcagugccaauggcguuugaauauaaauaugcuguguuucuggguuacaggugcuuaugaauccaugaaauggaaaaguaucuuguacaacuuauaugacuugcuagugaaugagauaagucauauaggaagccgagggaaauauuccucaggaucucguaauauugcugucaaggaaaaucugauugaccugauggcagauaucuguuaccagguauaguagcuguugucacguuggaaauuuccuguuaaccuucucucugcuggaugcuuguacuuugcauuaugacaagucuauaaaauuacucuguauaccuaacaguuauuuucaaauuauguguauuugaaacuaacccuuuucauugaaggaugacuuuuggacaugugucuagagcuaguggugacagucaccuacagggaaggugaaugcauccuagccuaauuuuuaaaaaaaucaacugggcagugguugagaaugccuuuaaucccaguacucgggaagcagagacaggcaggucuguaugaguucaagaucagccuggucuacagagcuaguucaggacagccaaggauacacaaggaaaaccuguuucagaaaaaaaaaaaauuaggauauucauguagcauaaaauucgcgaugauaaauauuuacaauaauuauuaucauugguuuguucugaaaccaucaccaaaaucuauucaaagccuucugucauccccuauagaaacuuuagaccucuuaguuuucauuuaucuuuauuuguuucucuuagccacuaaucuacuucuguuaucuuugaaugauuugucuguuugauacauuuaauagaaauagaaucauauguauguggauuuuugugccuagcuucauuuauauaguguuccacuggguacuauaaaugaguauuuuauucucauauugcccaaagggacauuaguacugaguagaccucggacugggcugccuaagaaggugagucauucugagagcuggcagugccgauggcguuugaauauaaauaugcuguguuucuggguuacaggugcuuaugaauccaugaaagggaaaaguaucuuguacaacuuauaugacuugcuagugaaugagauaagucauauaggaagccgagggaaauauuccucaggaucucguaauauugcugucaaggaaaaucugauugaccugagauuugauugacauauugguacuuauuuugcucucuuaaauguuaauauaaauuuaauuuuuauguaaucucauguaauuaaauauaaauuuaaaauuuaauccuguugaaaauacacuauuugcaguuuugguaaguguccccagaaaauaaauguaguacccuacuuauaaauacuuacuaaaaaugucauuacugcuauguaaaaauauuuaucucuuaaugucuuuagauauuucuauaacuuauuaauaauuaugagucccuauauuuucaguugagaaguauuuuucuccccgaugauucauuuaaaaauuguagcaauaaaaagguguuuuuuauuuugcagcuuuuugaugcagauaccagauccguggagauuucucaaucuuaugugacacaaagggaauccacugauuacaguguaccuugcaaaagaaggaaaauagacguaggcugggaagugauaaaagauuaucuucagaagucacagagugauuuugaucucgugccuugguaaaauguuguauuuucucauuuggugucauuucaaucauuucccccagaaagccuucuuugcugagaguuguuauuugacggugcccagaccugcuguuaguggcaggugaagugugauugcuguagauaaucccuaaaaggcucaucugcugugcuagacaaggcuaccuuuuuagacauguagacacgguuuuuguguuuuccuuuuuccuaacucuuauuuucauucauauuuaaaugugcacaauuccacaaugacagauuaacucugauuaggaucaguagacuguauuuagccaggccaguuuucuuugcugaaagggaccagcucuagaaauguuaaccagcaugccugaagguacuuagagacuuaacagauugugggagggggagggggaauauuuuucaccuuguugcuggaauauguauguuauugaguugugaagaaaagcuauauagacuuuguuaucuauugcuuaaguuuacauuuauucuaugcaguugacaguucuacuucagauuuuauuuauucuuuuuguucuacuuuauucuucucugguguaguacaccuugacuggaguuuccccucucuccgcucuucucacuuccuccucccuccccuccccacagauccacuccuccguucccuguagaaaagggcaggccucccagagauaccauccaaacagcaugacaaccuacaauaagacugagcacacacccucgaauaaaggccagaugaggccaccugggaggaggaaaaggguuccaaagcaaacaaaauagucagaaagaaccgcgcucccacuuuuaggagucccacgagagcacuaaguuacacaaccauaaaauguaugcaggggauccuagcuccauaauuacggcuucagucucugagccccuaugauucuccugggggugaugugcauaauguuuggcugcaucugcuccugucaguugcuggauaaagccucucugaugaucacgguaggcuuaggucugcauacaacagaccuaucacuaggaaucuuuucauugacucuuuuuuucucguuucucuucagauuauauaaaucuuccauggcuuuagauucuuaaucugucuauuuaaucaagaauuacuagcugggugaagguggugcuggcuuucaaccccagcauuuauuuaggaggcauaggcaugugagucucugaguucaaggccagccagggcuacacagagaaacccugccucauaaaacaacaacaacaacaacaaaaacccacaaacaaaaagaauuacugaauggcuuuucugugccacacuuagcagugaauaacauaggcuccuugguuuugauuagcacuccuugagcagugguucuuaauguuuccaaugcugcaaaucuuuaauacaguucucauguugcagugacucccaacagaaaauuauuuuuguugcuacuuuauaacugaacuguaauguuaugauuguuauuaaucacaauguaaauaucugaaauaggcaacccccgugaaaggguugucgacucccaaagggcuugugacccauagguugagaacuauuguucuggaauauucacagaacauuguguugaaugcuaaauuggugucaaagacaaguguuucaguuauauuuuucuaauaugaaguauuuuuggugccaaaagaucagaaaauggguuguuuuugagauuuuauguaaagacauagcuagccagaucgugugauucuuccuucuguaauuggcagcagggccuagucaguaucagcaguuaauuuacuuaaaaaacaauauugaaaagagugaagaugauacuguaguuaggauauagaaagguauaguauuugcaucuuuguuuucuuuuauguuguuaaagauugaaaagaauucacagaaauccuuuucuuuuuuccuuucaggcuacagauuacaacccgauuaauaucaaaauauccuuccaguuuaccuaacugugagcugucuccauuaauacugauacuguaccagcuucugccucaacagcgacguggagaacgcaucccauauguguuacgaugccuuaaggaaguugccuuaugucaaggcaagaaaucaaaccuggaaagcucucagaagucagauuuauugaaacuauggaucaaaauuuggucuauuaccuuucgugguauaaguucuggacaaacacaaacugaaaacuuugguuuacuugaggccaucauucaagguaguuuaguugaacuugacagagaauucuggaaguuauuuacuggcucagccuguaaaccuucuagguagguuguauaauauuugauuuuacauaaacacacaaauguauccuugauuauuuuuguaguuuguuauuauaucagcgaaagauauaauaaaucuuuuguguuuuguuggcccaaaauaaucaauaauacugagauuuuuuugugaaggacaauuuuaauuuuuuuauuuuucauauuuuugaguuaggaucuuccuguguagccuuggcuaacgucuaugauuggcugaccuugcacuuaagacauaggcugcuuaugcuuccuagaugcuagguuuaaagaugugagccauguccuaucuuuuuauuuuuaagaccaguuuucgguauaggauuauaaauuuuaaauucuugacuauaauuuauaauuauucaauauucauacacauucuuguagcucagugcauuuuuauuggacaguuauauguaugagugcucuaucuauauguuuaccugcaugccagaagagggcaucagaucccaucagaucccaagauauauauauaucuugagagagagagagagagagagagagagcaucagaucccaagagauauagauauaugaaugaaugauugugagccauaaugugguugcugggaagugaacucaagaccucugaaagagcaggcagugcucuuaaccucugagccauuucuccugcccccgggacaaaaauuuuacaucagaagaguuuucugaaauguaaucuuucuuucccagcuuuguuuacaaaauguuccucauauugcccugagcaugauagacuuagugagugcuaagcagcagagguaaagcgucugcccuccagagagcuugcugcuaacagucuccuuguguuucuuuguaguccuucaguaugcugcuugacuuuggcacuuagcaucuguguaguuccagaugcaauaaaaaugggaacagaacaaagugugugugaagcaaauagaaguuuuucuguaaaggagucaauaaugagguggcucuuauucuaccaguuagaggaugacuuagaagacagcacagagcugccuccaauucuucagagguaauucugcuuuuuuuggcauacuccugcauucuuguuuugcucugacucugcauguuuucuuguuuaauuuuauaaggcucucucuacauauuugauaucagauagcuuuauuuuaugcucacagugcagaauuuccuggaguuaucucuaaaauauuacaaaucaucuguaucuuugugcuggaucauuucugaaaugcaagguuaacucacuguaggauaugggagauuuucaugaaggauagacacauaauuguuucuuaaaaauuuaacauuuauaaaaaguuuucauauuugugauaugacaucuaguauuugauacacacaugcauuguaaaauguuuaaaucaccauuaauauauuaucuucuuaaguaguuguaaucuucuuaugaggaacacauugaaaaccaugguuucuuuuaaaagaaaaaaaaaacaccgaauuuuucaugauuaccuacuccauuguaggacacuaaaaugucuuucuuucauuaaauuuagcaucuguuuuuugggguuuuuuuccuuuuuuuuccuuuugccuguugguuuuguuuguuugauugguugguuugguugguuuguuacauggucucacuguguaacucugaucuggcuuggaacucccuauauagaccaagacuaagcuagccucuuauaggaauuccccuaccucugccuccugagugcuaggauuaaaggagugugcuaccacaccugcucuguaguguuucuuugugacacuauuguaguuuuacacucuacuggccuuugcuccaagagcagcaggcuaacagcccccuccuggcuucccauuuguucuacccaccuuugcuccaggaggugggcuuugcuaccaggccccacccacuuccuuugaauccuuggacaaaagacacacacaguuuuuuuuuccuuuucaacuugccuuaagacacaauugcugggcacugcuauguccugccuggaaaagcauguccuuaauaauauuuuuaucucuacuccucccaccugcccuaaacuucacuggcuggucucacauagccccuggccacccaccuguaguacugaccacaggcccagcucuucuugaaaccucacaugguuacuggcuucucccuccaaagcauagcaaaagcuccucuucuccuuccuugcgucugccuuuuccuccugagaccuccugagacccggaagucccgcuuguaccuuccacucagcaauuggccccuagcuuucuucacugacaggucaagagccaauugaggaacaggaccuuagcuucagguccgcccccuucauucuauaucuuaucuuauuccuuaaucauaauggauaucgagaaauuugauacaugaaugaugagaaaacaaaguagggcuuaagcccuaggacuagcccaguuuacuguuccccaggaggguagagcauaguguuuuaccuuuaguucauaaccuuuuaucucagaaauauuguuagggcagagggugcuggaaagauggcuuaaacaagaacaagcacuuggcugcguucaauucuuagcaccuacauggaagcccacaacugugagcaucuacuccaauuuauaugugucuauaacucuaguuucaaaguaucuugaugccuucuuuuggcgauuuugugcaucaggcacacaagaagcauagacauugaugcagggaaauucacauaacaacaauaaauaaacaauccagaaaaagaaauccugcuuuuaaaauuauauguaaccagcaguuuuagaaaccauaguacauugcucuaaccucuuuaauaaacuuucaauacuagugauucaggacaaaugaaagcauuuuuaguguggaaucugaauuuuaaggaucauaauugguagcuauauauacaugcauauuaaaguucuuuuuaaugguguauggucuuuuaaguaaaguuuuuuguuuucuuuuuuaguaauuuuccucaucuuguagucgaaaaaauucuuguaagucucacuaugaaaaacucaaaagcugcaaugaaguuuuuucaaagugugccagaaugguauguuauauaagaaaguaugugauguuuugagauauaguauuaauaguauuaauuagaaagauaauucuaucauggugggaguucaucuuauuaguaauuuugauauaaauuggucugauugaagaaauaucacaacagcuaagcagaaagaaguuuuuuauuggugauuauaauuuauguucuauuacuuuagaugaagguuaccauuuuauugcuguauauuauaacaugucuaacaaguguuaagagaaaaaaagcugaacagcuaugcaaaauuaagaacauaaaauuuaugugaagugaguuuuuaguagggacccacuguuuguauguugacuaaauuuuauuaaguuuuaaaacgugccagugagauugcuuagcagguaaaggcauuuuucaauccugauaaccugaguucaguccguggggccugagacucaccggcuggaaggaugaacugacucuugacaagugugacaagugcaucuggcgugugugugcacacacagucacucacuccaucucacuagcuaaauccauggcagaacaaaggaaaaacuaaugagaguuggcuaucauuauguucugugguccagacucugggaagcugaggcaagagaauuuugaaaucauaaguugaagacccuccugaacaguguaacuagaagcaauacugaaaagcaaagcuuaauuuuaauuacaaugugaaaauauuuaaaaacucguuuuuaauugauuggcucaguucauugccacauuuggcacugugacugaaaauagcucaaugauaugaggauauccagucucacuucuuuaaaauuaaaguaaaaucacuaauuuuggaaaucaggugagaagaaagcagauguuuuugguaauuacauucagcuaucuaguguuagugucuaaauauaucucugaauuuguauuuggaacugucacuucuauauuuuugugaguaaaauuugcuaccaauaaugaaauuauccaaugucaauucaauuugccauaaaagcccaaagaagagaagcauuucacagaauaacucaaaaaucuuauuagcagucuuugaaugguauaaauguuuucuugaugauuuuauuuguaauguguugugaacuaguugaaaaaauauuagaucaugguuuuaaucauuaaucucacuccugaagugaacaacacugcgaagauaaagaagagccuucauuuucagaaguagaagaacuguuucuucagacuacuuuugacaagauggauuuuuuaacuacugucaaagaguaugcuguagaaaaauuucagucuaguguuggcuucucuguccagcaaaaucucaaggaaucauuggaucacuaucuucugggauuaucagaacagcuuuuaaguaauuacucuucugaggugagauuucuuaaaacgaauucagguguauucuugagcauuuauggguuguuaggaagggaaaaugggagugugaaagguaugaaagaugagagaggccugguuguaaauaaacgguggcacagcccaacaaguaggaaaaauaggcagggaggaaagggaaacgauaauuuugagauucuuuguucaggaacucuguagacaauucuugagguagguuagugggaaggagugcuggugugagucuaagaacuucaugaugggaugaacauauugguacaaagcauggaaauuuagucauaggagaagagaaaucuaguuguugcauuugaaacaaguagaaugauuauaaagcuaugaaauggacgagcaaauacccagucauuagaagccaaaugauuuaucuuuguaacaucacaaauacagcuacucucuauaaaucaugcuuuccuagaugguguguauccuauuccauguauuuagauagccacauguugcauuuguuguaacaugugccuuagguucacucagccacaguaauuuuucacauacuaguuucaguuuuuggguguaguggcauauacuuuuaaugccaauucucaggaggcagaggcaggcagauuucugaguucaagguccaucuggacuaaaagcuaguuccaggacgucagagauacacagagaaacccugucuugaaaaacaacaauucauacuauguagcauuucaauuuuaagggcacuuaauuaguaucuucuuuguaccauggauccuuugcauaauuugcuuaaagggcauacuaguuuguuaaucuguaucuuccacaaaguggucuguuauguaaauaacgaaauugaaaaacacuuauaaacucacaaaggagugaaaugagcagcccuagaaaaugacccaagaaaccaggugggggcaguguggcuguugcccugucacugccacuuacuaauggggcuuugucagcuggagcuagcuuugcucuaacaugauucaguuuucuuggaauguuauugauuugucuacuugcuugcuugcuuauuuauuuauguauuuauuuaauuugguuggcugguugguuuuucaagauaugguuucucuguaguacccuuggcuauccugaaacuuacucuguagaccaccagcuucugccucccaagugcugggauuaaagguaugugcaccaccacuggguauucuugccuguuuuuagcauauugguuauauuucuacagugaucuuugagcuaguuuuaaagcaugaccuagaguaucccagcuuuaacucuguuggauuuuuauuucuccauauuuacggaaacuuguucuuccagggguaauuccaaacuccauagguuuauuuauaucuaauacugucuuuuuaaauuuaugauuuauuuuuaagauuacaaguucugaaacccuuguccgguguucaagucuuuugguggguguucuuggcugcuauuguuacauggguauaauaacugaagacgaagcccauaaaucagaauuauuccagaaagccaagguaggaaaacuuacucugaugaagguuuagaugcauuuaagugaacugacauccuggaaaaauuaugugaaauaaauuuuuuguauaaguugaaugucccuaaucugaaaauagggaaucucaaauacuuuauagaguuguaaaguuuuaguuacagcacaaccauaaaggugaacauuuccacaucuguccucauacagucaaaauguagacgugggucaccaucaggcauguacgagacagacgcugucuuuaguuuucuggugcuaugauaaagaccgcgaucaaaagccuccccggggaggaaagguuuaucugguuuacccuucaggaucguagaacaucauagagggcagccacgguagcauccuggagguggaaagcagaggccauggaggaaugcuguauguauauuggcuugcucccccacuuugguuuuuuaccucaggaucugcccauggauggcacugccuacagaggacccuccuacagcaaugaucaaucaagucccuacaagcuugucuaucaaccaguuucucaauuaagguucucuguucucauaugaguaguuugugucaaguugaaaaaaaaauauaaccaacgcagaguugaugaaacaaaugaguuuuguauuuagauuugggauagcccaaagagaccacguuguuaugugucuauaaauauuccagauucugaaacauuuuuguucucuguauuuuagauaugcucaauauguauagauuaacuuuuuucuuucacagucuaaaauaaauacugugcccuuccuuagaauaugaaauuauuacaagccaguaauuaauacauaugguaaaugaucucauaucacaauguaaccuuauuagaauacugguuuuugagguagggucccuaacugucuuggaacuugcagaauguuugccuuggaccuccuaaauucugggguugaaaguguguacuaccauccuuagcuauacauauugauuuuuaucuguacucuuaaaauuuuucccucagauaaucuauaauaaggaacucuuuauugaguauauuauucaaguauuuucuaagcuuaaaacuuuguuuaucuccauuuauuuauguauuuauuuauuuuugagacaagguuucuuuguguaacccucacugucuuggaacucggaacucacccuguagacuaggcuacuacucagagaaauccuccugccucugccuccccagcggaagaaucaaagccaugggccaccacugccuagcuuaaagcuuucuucaucucucaacacuaguguaucaguguugggauugcaaaggaaacaggauguuaagauuguggugggauuuuuguuguaguuaauuuugcugagacaaagucuuacuuuauaguccaaccuggccgggaacuuaauguccuuuauacucucugagcacuaagauuacagguucauugccacacauagcuuagauuugccauuuucuuuuuggauguuugucacuuguaaucuuauugcaugacaaugugcccuuuuuuucccuugguagucuguugcguguagcuuuugcuaccccgccuaagcucuugaagcaggcugagcuaccagcucccacucagcuucccuugaaucuaaggauaaaagacacacacacacacacacacacacacacacacacacacacacacacacacacacacacacacacacacacacacacacacaguucaacuugcccuuugacacaauugcugggcguuacuaccucccgccuggaaaagcuccacaccucccaccuggccuaaacuuuacucaguuacaucuagacccugcuaaacuccccugaccacccaccuguuuggagcggcauguguggccacuccguuuagagauuguacauugcuggucuacuuuucucagaagcauggccaacucuugucucuucucuccuugagucucucccuuuccuucagggacccggaggucccgccucuuccuucuguccagcaauuggcccauggcuucuuuacugacauaucaagaaccaauuggggaacaggaucagaacuagcaucagaacuagcccuaccggagucaggguuuagcccaagcaucagccuuucuuaaaugcuagugucagcccaagucccaguuucauauucaguuuguaaauauauugaauuuuuguccuuaaaugaaauuucaaaaauagcaaugcgaaguuguuauuucaacuggaauuugucuucuuuuuaucuucuguucuaaauagucucugaugcaaugugcaggagaaaguaucucucuguuuaaaaauaaaacaaaugaggaaucaagaauugguucauugagaaaugugaugcaucuguguacaaguugcuuguguauacauaccaagguaagagugacuucuuaguaguauagccuauucaugggacauauuauuuagugguguugaguuuuugguccauuuauaaguuuauaugcugaucuaaaauuaaauugaauaauaaagaagaacauucagagaauauugguuucucaugaaacaauuucauaacuuugauuuuuuuaucauuacauacacacacacacacacacacacacacacacacacacgcacgcacgcacgcauagaugagucuuuuauugugaguauacuuucauuaauuuguugauuauuaagaaguauguuuuuuuuuuucccauaacaacuauaccacaggagaugagugccacaaagauaaauaaugccauccuaggauggagcuuauucuguagagcgccaacaaagauaaaugacacaaguacaaaugcuacuuccuuuaacccauaucaucauagguaacauuugguagaaaaagugccucuguuagucauccuuuuuugguuuugccugguggaguaacuaaaccaugcuagaguguuaccagcaauuggaacaguauuuggaagcugguaugcaagcagcuugcucuucauaaaguaugguuuuguuuuccauuaucuuuccuguauuuauauaaguguagaaggcaugaaaggacagaauaaaccucacaguuaauugcuuauuauguuuaggaucaguagcugguacuuuagugaugcauaaacacaaagauauuuacuuuguuuauauuuccuuaaggaaaguaguuaggcuguaguugcuauucugguuacuuccuaguuuacugcccucuugaauggacuuaauaaguccuauucuuaaaaaacagaaagaaagaaagaaagaaagaaagaaagaaagaaagaaagaaagaaagagggaaagaaagaaagaaagaaagaaagaaagaagagggaaaggcaaggcaaaggaaggaaggaagauagauagauagauagauagauagauagauagauagauagauagauagauggugguguaucuuaacuuagaacuugaccucaguucugaacuccuaucuacaucucauucaagguagagaaaaugguacuacgaaaacuauguauuuguuuuauuguucacugcuuauaucuguuuucaaauuacagcauacgccaaacaagauugccucuggcuuuuuccuacgauuauuaacaucaaagcuuaugaaugacauugcagauauuuguaaaaguuuaguaaguaugaauccuuuuuuuauuaauaaauuucuuugauacuaagauguaguaaaauuauauguauaugugugaguguguauguauguguauauauauauauuguguguauguauguacgaauguaugugucagagaggaggggaggugagcaagcauaagcaagccagugcauguguacuacaauauauguagaagucaggacaacuccugggagugggugcucauugaucauuuuucggauccagugauugcacucaggaugucaggcuugcaugagaaaaccucuacccaggcuggagagauggcucagagguuaagagcacugacugcucuuccagagguccugaguucaauucccagcaaccacaugguagcuuacaaccaucucuaaggggaucugauacccucuucuggugugucugaagacagcuauaguauauucauguauguaaauaaaauaaauaaaccuuaaaaaaaaaaacaaagaagaaaaauaccucuacccacugaccuagauugccaauccuuuaaauugcaaauuuuuguugaaauaccuauugaguagauaagcauuucaugguauauaacauguuggauuuuuaaaaaauaauuguagccuuuaauaagcuuuugcauuuaggggcuauguauuugauuauugacuauuucuucuuuuucuccuucucuuuauccuucuccuucaagauuuauuuauuuauuuuacauacgugaguacacuguagcugucucccgacauaccagagaagagcauagaauccuauuacauaugguugugagccaccaugugguugcugggaauugaacuuaggaccucugaaagagaauagucagugcuuuuaacugcugagccaucucucugcccugauuucuucuuaagaucaguaccuggcggaguaguuuaguuaucuuuuaguuuccuacuaaauaauugaaagauugcuuuuauuguccaagacauguucucaguauacagcuuggcuagccuagaacuuuauguguagaccaggcugacccugaauucacagagguccaccucugccuccaccuucugggugcugggaucaaaggugugcaucuucauaccaggcaaaauuauuccuuuaaaaaaaaucccaaaguaggggugacaccuugucuucuaggaguauguguuuccugugguguuuauacuucaucuucugugacacuggacuuauacacucuuuuuuacauuuaauuguucacuucuaguaguucacugggugaaaaaauagccuguaacguuauuuuuuuauaucauggcaaauaauuuuccuuguuaguguauuucuuuaugaggcuuacacugcugugcucuguuuggcagucacgauaguccacucuuugggaauaguguaugccuaucucuaaaggaaugacacauuuuaaaagaaucuaccugcucuugcuuuuuuccuuugucagauuggcggugaaucuuugauagucauccugucuaagccuugcaggcagucugcuuggggcucauaccucugucaaucccauucccucuuacuuaacauuucaggucacuuuccccuccuaaccaagagcugccacaaagacgccugcauuuccgcuuugucuucuuguacuugugcacuugaagaauggaagagaaauuccagagagggacucacuuuuucaaaggaauguaugaaaguuuuagggagcauuuuuguuugcuuguuuuaagauaugaucuuaguuauguugcccaggcuggccuugaacucuaggcucaaaugguuccuuuguuucaaguauccaaaaagguaggagaauacaggcacaugccucugugccuagcuuuaauuuuaauuuugauuuuggaugugauuuggauguaggauauugcuauuguccuacauaauagucguuauaauugauacuuuuccuaugcuucugucaauuucucaugcuaacuuuuaacauuuuuauuaaauguugcaagguuuuauucugugggggggaggauacauaguggcauuugaauguguaaauacaguacagaaugacugcuggacuucguuuuuauuacauuuauuuauuuuauaucugugugugucugugugcgcgcaugugucacagugcacguguggaagucagagaacgguugcuagagguuauucucuuccuaaccuguggguuccagggauucaccucaggucaucaggcuugcagcagguuccucuaucccaugagccaucuugcuggccuaugcuacuuuuuaauaaaauaaauuauuuuuguaguuuugauauuauccuacuaucuaaacagauuccaguuuauauauccacuuccccacaaaauuaugaauuaagguccuucugaaagaaguugaaaacgucuuuguuucuccucucgaaaggcauccuguacgaaaaagccauuggaucacggaguacauccaggggaagaugaugaagaugguggugguugugacagucugauggaggcagaggguccaucguccacuggucuuucuacugcuuaccccgcuaguucugugagcgaugcaaaugauuauggagagaaccagaaugcuguugguaaauaaguauuuacugcucugaguuuuguuuuguguguguguguguguguguguguuuuuaaccauuuuacauuaauuuggcacaguaaggggccucacugaaaaaaccuuuaaugauaauuucauuucccauagguauagucuacuuggacugaucuuuuucuauacauuuaagacuuuuaacaacccccgcccuucuccccacccccagggacagaauuuuacucugucgcccuguccuggaacucacuauguagauggggcugaccuauaaacucacaaagauccaucuaccucuggcucccuugauuugagauugcaaguguguacuaccaugccuaggcacucagaaauauacauacauacauauauguguguguguauauauauauauauacauauauauauauauugguuuuaauucuuuucuguguccuuguguguuaauguggguacucacagagauuggagaacaguauucuaggagucaguucucuccaacugugcacuguggguucuggguuucuaauucaguuuuaucagccgucugcaagcccucuuacuuccugagccaaauucacucacuguucuccuuacuacacauucuaagcuacucucauuuuacaaucauauucauuaguuucuuauuuuauucuucaugggaggauuaaaauguaaaguaguuuagaagaaacuaaaggcuagguuauuugaacuuuggaaagcuggaaagcuguuugagguucuaucugucuaccgggucccucucccaguguuaauaagugccuuugauuuuuaggugccaugaguccuuuagcugccgacuaccuguccaaacaagaucaucuucucuuagacaugcucagguucuuaggccgaucuguaacugcaucucagagccauacugugucguuuagaggagcugacauuagaagaaaauuguuacuguugcuugauucuagcauacucgaucucaugaagccccuccaccugcauauggugagucagaagcuuugaguuuggcugcgguugccauuuucugcauguuuguguugcccagaccuagcugaagcagucucaccgaguacacagaguaagaggcccgugcuauuaucgugccuagacuucucagguuuucuuuugacaugcuaugagaagaauugaaguagaugcugaagcauuaaaacuuggauuauuuugaauauuauuaggcguaauuuuuaugaauuauuauagaguggaacaagaggcaucuucuuugagauagguucucucuguguagcccaggcuugccuguauuaaauaaauagucuuucuuccaagcugagauuaugaguguaauuaacauucagaaaaacguagaucuugaccauaaaaauaauuuauaacauggaauuugaggucugaauuuuggccuuugaacucugcuaguacauaccuucaguuccaauuuauaacuuuauggcuuauuucuuguuccucugcacaaauuuguagcuacuuuguuugucuuuauaagacaaaaugaaaaccuucuuuuucacgaacaaauaaugaauuuguucauucaguaauguucuaugaaacuaaauucuuaucauacggaauauugccuuaccucauucccuguaaacaguuggaaauagcuccuggccugguggaacaucaucuggguguguucaagguuauauccuugguucugguaaacuagcagacauaccuggugagcuccuaaccaugcugucuugaacacgcaaaggccauucccuaacaauggacauggguuucauuguguggucccuuggcuuccuucuucaugaacacuagcgagcuauuaccccugaccagucggagggcucauaugcuuuccuuaagguuuuauguuuaaaaucauuucacauucucaguaacauuacauaugaggcauuaaagaggauuuuaacuuuuuuuaagauuuauuuauuuuauguauauaaguauucuguagcuguacagaugguugugagucauuacgugguugguugcugggaauugaacucaggaccucugcucacucuggcccugcucgauccaacucugcucacucugacccaaagauuuauuuauuguucuauguaaguacacuguaucugucuucagacacuccagaagagggcaucagaucucauuacagaugguugugagccaccaugugguugcugggauuugaacucaggaccuucagaagaacaguuagugcucuuaaccacugagccaucucucuagcccgauuuuaacauucuuuauacgauaugagagagauaugaaaaauaucucuuaggauuuuuuugguguuacuagaaaauuucuuaaaccucugagaaauugauugcuuaguuauaacuaccauuauaaauguucacauagaacgcagcucuuugugcauaguaacgcauaauuacaaacuugccaugacgaguagguagguuaggauaguuuacuuuuaaggauuaaaagcuuugcuccccagaauucagucauuuuucaccuuugaacuuaccauagcaagcauuauucuggaacuguagagcuauaguauagucucauauucuuuaucuuuuaacugcauuggugacaguagugcucauuuauugaauuccagaaguugagauuauuguuucuacuccuuaguuacauagccagguaauugauauauccccgaugugagagaauauguuuuccauggcacauggucaagauuuuuuuuaaccauuugaguaaagucuguuaugcugaguuuuaaaucuaguauuugacuuuaaagauauuuuuuuauaugcuguguuuagaaauuuacagcuaugugcauguuugaauucguuuauauaugcuuuuaaaagugagugauuuguggauaaagcuggcuuuugcuuuuuccuucccuuuuuuuaaaccaccguaguacuuagugcuccugaaggaucucccuggaaacgagcacucauugccaauggaagauguuguugaacuucugcaaccauuaucguaagaagugaaagccguguguuaugcucacguugaauuauaaacugacagcgugguuguaagcuuauaaccuucaaccuuuucuaccacagccuuguguguucucugcaccgacgugaccaagaugucuguaaaacgauucuaagcaauguccuucauauagugacaaaccuaggccagggcaguguggacauggagagcacacggauugcucaaggacacuuccugacagugaugggagcauuuugguaggcauaagucucuuucucuaguuacuucacugccucuggaugcagauguaaacucuguacguuagagauuuccugguuaucauguauaaauaacauuuugcaucuuuuaacaauaauauacauaaucugucuuccucuuuuuauuuauuuauugguuugauuuuauuuuuaagauguauuuauuuauuuauuauacguaagugcacuguagcugucuucagacacacuagaagagaacaucugaucucauuacagaugguugugagccaucaugugguugcugggauuugaacucagaacguucagaagggcagucgguccucuuaauugcugagccaucuugccagcccugccuuccucuuuaacaugcauguuugugaaugaucucuuguaugaguauggguacacgugugucgcuccuguagcagucaaagagcaauguuggguuucaguccucagucuguaccuguuugaagcagguauaauguuugcuguugcacacaccugccagacuagcaggucuccaaguuucuucugcugcugcuucccgucucgcugucgacaucuugaguuuacacauaucguugcuacugcaccuuacuuuacaugaguucuggagagccagacucugguucucauacuuaaugaggggugcuuuucuguugagccauuuccccagcuaugucuuccauucccugaaaagcuacuuuguuuucuuauaagguuuucuuuccuacaguguuuagcacauggcccuguaaauuugaaucacauaauaacuugauauagauguugcauaaaaaauccuaaaaaucaacugaauuguugauccaaaugaaccaguugauuuugucacucuuaauuucauucauagucucacaguaacauuuuaaacagcuuucuaaccuuuuauuuauguuguguugggaagucaugcugcacacgggcaggucagugagcagcuagugggagucaauguuuuccaggaauugcacugagguccagcgauugccuuacccacucggucaucgcgauggcaggacaguagcauugggugguuguagauaaucaccugcaugccacuuagaugccaugucauuuaaaugccaugucacuuagaugccuccucauguuuuauuuguaagucaguuuggaaccuagauucucuaagucugugccauaacaaugaaaacuuaaaagauauucuguuuaucuuuaguuugcuauagcaugcaugcccaaagugugucaguuccaagguacaaaacaaauaauguacauuaaaaugauuuuucuaaauuuagcuugaauuuuaggaaagguaaaugcacuggcauuuuccacauaaugagaauuaauaaaauggacauuuuggaacuaaccugugauaauguuaguaucgguuggcuuucuuuuuugucuuugcuuuuguuugaauaauuacuacauugaaaaucuuaccuaauuucaggcauuugacaaaggaaaagaaauguguauucucuguaagaauggcauuaguaaagugucuucaaacauugcuugaggugaguuacuccauguuacuagaaaguucuucuuugagauuguuaaagcuaccucuauaucuguaugcuacucacaaauuuuucucuuaguuuucuuguauuuaacuuauuuuuuaauuguuauuuuacuauaggcugauccauauuccgaaugggcaauucuuaauguaaaaggacaagacuuuccuguaaaugaagcuuuuucacaauuucuugcugacgaucaucaucaaguucggauguuggcugcagggucagucaacagguaaugaguuagguuuucaugaagcucuuguauugcugccgacaucaguguggcacccucacuagcugugauggagcagugacuuacacuuaaucaguaccaggaugugccuggaaucuguguucuuucuuuagucugacaguucuuuugcuuagauagcauuauuuucuccaaguuacaagugaaaacucuggcuuugagagguaacuugccuaguucuauggaacuaauaauccauugauuugagugauaugugugugcaccucugccaccuaaggggguguagaauauuuggauauuaccauggcguuaugugagucaguaaagugguaguuucuucacuucauacagugaugacauaaucauugcuguguuuuaaccuaagauaauauuuggcuguuccaguuguucacugaugaugaaauagaugaauguuuuuggaaaagaaguuauaugcugcuuugaaaacaucaaagcugaaauugcauauuauucagaccuaaguggccaguaaaagaaggucaacauaaugauauuguccaagaagucacauacugaaccucggugauucucaaccuguggaucacgacgccuuggaggguugccuaaguccaucagaaagcaaauauuuacaguucauaacaauagcaaaauuacaguuauggaguagcaaugaaaauaauuuuauguuugaaagucaucauauacaugaggaacuguaugaaagagucgcagcauuaggaaggcugagagccacuggccugugauguuagaauuaaugaguccacacuuugccucugcgacagucauguuuccaugaacgagguguagucacauuccucauuuguuuuaauaagaaaguaguacguugucaggauugcuagugggauuguguggaaguucaaauccuuacugaacugagguuaaagcucucggguuauagaggauucuaguugaguguuauaacucaguguagugguggcauggggaaaaaaaucuacauuucaaaaaaauucaagaaugguuguuaaguaggauucauuggucuuuuugguccuugauuuguuagacauuuaauguugggcuauuucaagaaaagcuagcaaaauaaaggaaucaaaauaacaaauuauaaaaauugguuucuaagaaauaucaaggauaaaauuuaucgcagaguugccuuaaauauguagauauucucuguaagaggcacugauaaccuuuccccaccuaaaauauugugugaacugaacaucgaagcauuaagaugcucacuuuggggcugauuaaauauuagaacauaaugacagagaaguuuguggacucgugugauucauguuugcuaagaggacagugaaucuuucugacaacccgaguuuaauguucaaaucugaacaguaguucaaaaaucuuugaaaucuucuuuucuuacaggagacauugacuuauagauuaacauuuagcaggcugucugaacugcuaaaagagucuuucaaaccaaggccugcuaucuuaccucauggagggguuuucuuuuguuccauaagaugcuuuguuuugauauguaggguuuaaaaugaauuuaauuuuuuuuuuaaagauuauuucaggauaugagacaaggcgauuucuccagaagcuugaaagcacucccucugaaguuucagcagacaucuuuuaacaaugcauacacgacagcagaggcggggaucagaggacugguaacugagauaaccucacaccuguggucugucugugucguauuucucuagcacacuggagucgagaguuuguauucgguaguuuacacuauaaagccggucuaagucaaugguguggacugaauaaaauuuuucugaaugaauuuuauaggucagaaugaguccaauaauagcaauuacuuuugcuuuaacuuaucuaugcuguuuuugugaggacacuccaauuuaauggggauuuugauacauuagagaacuuuaaaagguuuguuuuuuuuuuuuuuuuaguuuaagaaaucuuuaaaaucaaaaagacaaacccaaaacacaacaaaaaauguuguguguguggugauguaugucucuggccuugcuauucaaagacuaagcuaaauuuggacuguagaaugauuacaacuaguuaaaaaaugcagauaggggcuggagaaauggcucuuaguuaagagcacugacuguucucccagaggaccagaguuugauucccagcacccacauggcagcuuacaacuaccuguaacuccaguuccugggggucuuguggcuuuuucugaucucugcaggcacuauacauagacuuacaugcaugcaaaucgcccacacacauaaaaauaaauuuuaaaaauguaaaugguucucuguuggggacuuuugaaaacuaauugaucauugaaaugaaagcaugcccuucuuuuugcaagauuuuguuucuuuuuauaguauagauggugauaaucuuuacagaagaaaacacuauaaagauguaucaguaauaaaaauccuccuagcaguagcagcuauagugaaagaacucuugauacuucuuguucucauuugcuguuugcccuuuaaacuauuuaacaccuuguuaaaaucucuuuuccuuugguaauucuuuccacuagaucuuaagaaauggcagcuuuuuuauuuaacuauagaaaagcuuguuucucgaagucauuuucucuuagcucauuauuauagaauuuaaacuuugcaggcugcuuagagguuagagaaugcuugaauuugagcugguuuaugauuuuaaaaauauuuaugccguucuucuuaugauucuuuuugaaguuaugugauucucagaacccugaucugcuggaugagaucuauaacagaaaaucuguacuacugaugaugauagcuguggucuugcacuguagcccagucugugaaaagcaggcuuuguuugcuuuaugcaagucugugaaggaaaacagacuagaaccucaucuugugaaaaagguauggugaauauguucacucuguauguggcuuuugacacuuagacacaaauauuuuaggcucggaauauugcaagcaagcuuaguuucugugugugugugugugugugugugugugugugugaguguguuggggcuuggacccagagccuuguauuuaacuacugagcuguauuccccuccacagccaaauuugaucauucuuuauguggcauauuaauuuguauucagugugacuuacuucuuagucaguuuaagagcauuuuacacagcacucacugagaauaaacaauaguggauggucugucuccacacagaccauauucucuggaauaguguuuauggagggagacacuuggagaugcuugguugcuuuugccuucuuaguuguggagaagcacauugggauuuaacauaguuaaacagaaaacagaguugaggacagcgugaccuuuacauuacauuuagggaagaggccugggcucagucaauuucaacaauaucaucccauucuuguagaauaugguagccuuccccauucuuccacuccaaguucauuauuuaggaaccuuuacagguuccuguugcauguuuuaauguggugaguauggucugaugggcaauuaauuaacuuuuuguaugagccuggguuccauggagcuuuauuguaggccagucugcagggaauugguccuaaaugaguuuaccuuuuaccuauugguauuaaaaugagaguuuuuaagaaguauuuuauuauacuaccugauuuugcaaguuguauguguugggauuuuuuaaaaauguggacacgaggcugaaaauaauuuuucccuagacuuuccuuugagauauagucagcuguguaaaauuaggcuauuauuuacuuaauguuuauaauguguuuucuaugugcucuaugcuauaccaguuauuaaauacauuuuccauuuucucauuugcuaucuuucugucauucauuggugaagaaaucaaaguagaaaaacauugagcgacugcucuaaaguccuauuauucccauuuucuuaaacaucauguuuuuccuuucugcagguuuuagagaaagucuccgaaucguuuggauguagaaguuuagaagacuucaugauuucucaccuagacuaccugguuuuggaauggcugaaccuucaagauacugaauauagcuuaucuucuuuuccuuuuauguuauuaaacuacacaagcauugaggauuucuaucgguaggcugcagcaguguuucgacaacccccuccucccuagcuucaaguaggaaguagccuaguuuuuuaaaaagucagauugagacgaucagagaaugugcuugaacuuaggacuguuagcacuauuaguaaucagcugugcaucuuugaguaggccaucaauacaucaugcaucuuggucuacacacaaguaucuucccuuuggaaaacaaucaaagauuaauuacuuagucgcuaauuauuuccugcuugcuuuucuuuccuauugcuuaauaguagguuauuuaaacacuaugagguuucaaaacuuacugcaaaguaacugguuuuguggggacugagaccuagcucaguugguacagugcucaccuagcacguucgaaguccugguucagcacugccuacgucaaccagggagaguggaguauacuguaaucccagcacuccgaagguaaauagaugcaggaaacucaguaguucaaggugaucuccaucuacaucgggaguucagugccagcuuauacuauagaagacccuguaauccaaaaaaaaaaaagagagagagagagagaaacagcauuuucugauagauguacacuugauggccuuaucacccauucuuuuuuuuuguaguaacuuguauucuuucaauuuauaaauugcuuuuaccuuugaucuuacaguauuaccuaaguugauuauguguaaaaaauaaaauuccuuagcuggguaugguagugcaugcuguaauuccugaacuuaagaggcagaggcaggaggauuaccacaauuuagaggucagcaugguuuauauaauauuuuccaggcuagucugggcuacagcaugauacuuagucucagaaaaaggggaggaagaauaaaguuacacuauuuuaaagugugauuauuuauauuuuacuuuaauuuccccacuuacaaagugagaaaaagaguauuuaaugaucuauggggcuagagcaauggcucaguaguuaagcgcacuuacuccucuucuagaggacccagguuaaauucccagcacccauuugguaucucacaauuaucuauaacuuuuguuccaagggagccagugcccucuucuguucuucagaggcaccagguaugcacagcaguacauagacauauaugcaggcaaaacaccauauucauaaaacguuuaauaaauaaaagauuaaaaauauaaaaagaauauuuaaagaucuaaauuaauguuuuaaacacugaauguuaaagcauuuugcuguuuugauguaaaauuuuacuuugaaauuuauuauaaccuaaauuuuauacuuaacauuuucaggucuuguuacaagauuuugaucccacauuugguaaucagaagccauuuugaugaggugaaguccauugcuaaucagauucaaaagugcuggaaaagccuguugguagauugcuuuccgaagauucuugugcacauccuuccuuacuuugccuacgagggcacgagagacagcuacgugucacagaaaagagagacugcuaccaaggucuacgauacucuuaaaggggaagacuuccuaggaaaacagguauggcgucaguuuuugucugccuuuauguacuggcaaaagaaguaagcuugaaccuuuaagguuacuggccuuaagcaugacaacuugcguucauaucccuacauccacauaaaagcuggagguggcagcucacacauacaacccagagucggggauccuggauaugcgcuggcagcucuaaagacuuccuguccucugugaggcuaccuguagcagaagcagauuggugagaaaucugccucuuagagaggagucauuuuaaugacuauuaaugaaaggugguacuggcuuccaguauccagagaaguacacaaggcaucuauagggaauagugccagucacaaagauuugcuuuugauaguuaagaucuuuaaagaucuaguggacaaauaaaagauaagaugcaauuuguggaacuuugcuaccuggagaacuuccaguuugaggaauugaaugcuaaauccaaagucaguucaaaucguucugaaaaauagaaagcuugaagugagguuuuccuugcagaacuugggacuuagauaucuuuauuuuguuuuugguuuguuuguuuuaaguuauaaaguaagggaucagcacaugcccuuugugcuguugugaaguucacagauaugaacguguuuguucuauuuuaauuuuguguccuuacagauugaccaaguauucauuaguaauuugccagagauugugguggaguugcugaugacauugcaugagacagcugacucggcugacucggacgccagucaaagcgccaccgccuugugugauuuuucaggguaugccggucucacacuuggagagcuagccgucgcugacgggugaccuuacucuccugucuccuucacuguggucuucugcugcagcuguucuuuccagcugacaucuaucucaucuuuucucucuuccguggaacuuuggcaucgagccaccugaugccuuuugaggcuguuuuucuuuauguguuucaagguguggcuuccuucccuucccacaccuugccuuucucugcuuccuuuuccuugugguauuccuagcugucuaguuuaauuuagaugugaaaucuguugguuguguaugaauauuggugaugggaggcguggcuugaccguaagguacuugaaauuucucaauuuuuaaaaaagauguaaaaauguuuuauuuuuauauguacagguguuuugccugaauguaugcgugcacgcaguggucauggaggccacaagagaacguuagaaccccuccauuccccacucccagcccuggaacuggaguugugguuguuggcuaccauguggguuaggaauugaaccuggauccucuggaaaagcugucagugcucuucacugcugagccaucucuccaguccccaaaauauuuuguuggauuuuguuucugugauacacgguuucacuauggagcgcugcuguccuggugcucuccuuguagaacaggcuggccccaaacucaggagcucugccgacuucugccuccccagugcugggauuaaagucaugugcugcucugcccugcugaaaauacuugguguuuaaauaugcagacuaugcuaagcauguaacuuagcaguaauacugagaaagugcucagacuuuauguuuuaaaugaugcuauuacucuaaugcaucgcccggcuuaagauacuguuggucucgcaauagucauaaaggagaccugaaggcaaguuuuacugagucccaacucuggggcugccauuaacuuuguaaaagguuacauaaacaaauuauguuaaacaaaacaucugacauuaauuccauggggaagaugccuaauuaaugguugugaaucauuuuauugucugugauuuaaaaauaauacaaaaaaacaaaaaacaaaaaacaaaaaaaccaaaaccuaguuuuucaguagaaaaccaguuuuguaacuugggagauauuuuauuuuuaaauaacuacauuucuuuucuucugcuucuuuagggauuuggauccugcccccaacccgccauauuuccccucacaugucauucaggcaacguuugcuuacaucagcaacugucauaaaaccaaguuuaaaagcauucuagaaauucuuucuaaaauccccguaaguacacauugcauuacuaauacaauaauuuauaagaaaaguccucuccgggucuuggaguuggggagaacauaaaauuaguugacuaauuuaaauaggaacgcacuugauuaacaaguuguaucuugauauguuagucgguguuuaacuaauaugcauuacauauuaggucaggauuuuaugaucuugccuuuauaauuagcucagagaacauguuuccuguuuaaucauaauauauuaacuuucaguuuacuuucucaaaacuaacuggcaacuuuuucaaaaguaaaauugggcugggugugguggcacaguccuuuaaaccuagcacuggagagguggaggcagguggaucucugugaguucaaggacagccuggucuacagagugaguuccagggcuguuacacagcgagaaaccuuaugucuggaaagaccgaaaaacaaaaagugaaauggaugcuaauaauuuaauguaacauuuuacaugugauaucaagcccauaucaaaaugaucauuuaauaaaguauaaacuauguugguuguagccaaauauauuuuguuuuaaaaauuucuucucaaugugugccuauuuuguaggauuccuaucagaaaauacuucuggccauuugugaacaagcagcugagacaaauaaugucuuuaaaaagcacagaauucuuaaaauauaucaccuguuuguuaguuuauuacugaaagauauacagaguggccugggaggggcuugggccuuuguccuucgcgauguuauuuauacucugauucacuacaucaacaaaaggugagugagacauuacaacagacaccugcauuagcaguccucuguuucucauaaauccauuugcucugucaguuuuuuuuuccuuaguuccaaaaguuugugauuuuucuuuuuuuguaugucuucaaugaaaaaaaaaauuaaaaaccauucaucauuuugguagaugaaaucaauccuuucuagaagauuuuuuaccuacguaauuguuuccuguugauucucacuuguguagcacacuagacugucuccucccccacugaacccuaguaccugcagaucuucccguucucccacauuccuucucgugggucuucgguaaccucuaucuuauccucaacuuuuaaauuuuaaaauuauuuugaauuccauuuuuaguaacccacugcagugccugaaguucuuuaggaaauguuucuauuugcuuccuuuuaauacuucaugcuuuauuucuuuacguggucuaaaauguuguugcuaaaaucuuaccccuucagcacacaauguggucaaguguggaauuggguucucccuaagguguggcuccgaaugcugcuucgcgcaugucaguaucugggugugcacauggaggccagagugggaaaugcugcaucuuccuggaucucccaccaccuuauuucacugagacagggucucuaagugagaaucuggccauugcagcuagucuagcuggccaacaaguuccuggcccaccaguccugugccagggacagccauggccgggucuuuaccuaggagcuucggauuagcauuuagguugucaggcuuucagaguaaacacucuuacucauugagccuuguuugaccuuuaucccuuuucuucucuguuccuuccuccuuccuuucuuuccucccucccucccugucuuaucauuuauuaugcuuaucuauuacugaacaccagcuguuaaccagcuccugcuuugucagugauuuucuugcugcauguauccaauggagccuggcccucuuugccugcuuuuggacagggcccuucagagguuacgugaauaucaguaguacuagggauguggagagcaugaaagagaauaagacuuucguuuacaaaaaagcacuguccuuccgugcuugcuggcuugcagugauucuuuaaaaucuuucuuccuuucuuuuuugaaugauugugacaguuuuuuuguuuugcaguaauuacaugauguaucuuucagacauccuuugucguuuuuguguuauaaccauugagagauaagcuaugacacuuuuuuugucaaauccuauaagaauuagagacauugaguaaaaaagaacuugaaauuuauuucagaguaguuuguuaggccuugcuaucauucauucauucauucauucauucauuuuuccuguuaggucuucucauuucacagaugugucguugcguagcuuuucccuuugcugugaccuauuaagucgaguuugucauacagcuguaacucaauguaaggaugcucuagaaagccaucuucacguuaucguuggcacacuuauuccccuuguggauuaucaggaaguucaagaacagguaauuucccagugcaucuacaacagaguauuugagacgaaagauacucuuaggaacugaaugcuuuaaguuuaccuuaaugaaaaugcuuuuugauaaaugguggagaagacauuuuuagcaaauuaauccuugaaaucaauuacuaccccuuggugguuuugaucuaauaaauccaauaguuucaucuguuacacugaacuguagucagaaguagagcuaacaguucccaucgugaugguccgugagaucuccuauaaauaacauuccaguaugaauuccuuaugccuccuuguucagcacuguaaguauuuuagaaguguuugaagccauaaccacuaauagcuggguaauacauaugccguuagaacaugucuucuggacuaggguagcagagguuuguuuuuauaaugucauaaugggauuuggcucuuuaaauauaauuaagacuucucugucuucguuugauaauugucuagguauuggaccuguugaaguacuuagugauagauaacaaagacaauaaaaaccucucugucacaauuaagcuuuuggaucccuuuccugaccauguuauuuuuaaggacuugcgucuuacucaacagaaaaucaaauauaguggaggaccuuuuucacucuuagagguaauaaacacuuuauuuauaauuuuguauuauagaacauaggcaaaaguauuauuuuaaaacauuagugcuucacuaauaaggacagaauacuuucaguuguaguaaaauuaauacauaagauuuaccuucuuaaauacaauacaaaucuuuuaaaaauauacauagauauuuuaaauguauacaucugcguguauauguaccuuacgucugcaugugcccaaggaagccaacagguuucagaguccccuaccacugaaguuauguauggcucugagucaucugacaggaguucugggaacugaaugcaggucgccugcaggagcagccagcucuuuuaaucacugggccaucucuucagccucucagaacagaucuuuuuacaucuucuugcauugcauuuaaaguacagauaucaaagcuuccugacagagauaaauuugaauauucagagaauaugauacaaaauaguauuaauuuuaacaugcauaagguccuaugguucauuaauaucucaaaauugccauguguuuuucuuugagagucaguaauguuuauauuagagaugauauuaagaauuuuaucuuuauaaauuguaguuauaucucuaacauuuuucuaaauguuauaauuuuaaaaaucauuccauuaagacuauaauaugaaaaccuuuaauacauuuaagguguacaauacuguuauacuaacaaguaaauaaauuuguaacauuuccuuccaauucaguuauguugacaucuaauauagauaacagaaucucuuggaauuuaagcucuuaaaacauugucagaauucaaguggaagaaggagcuuaguucuuccauguugguuuuaugggucagcagcuauagacaguacuuacuaucuuaccuuguauuguuucacucuucacaguuagccaguacauacucagcuaauauuaaauuaauuuggucuuuuaggaaauaaaccauuuucucucaguaagugcuuacaauccacuuccgcugaccaggcuugaaggacugaaggaucuucgaagacaacuggagcaacauaaagaucagaugcuagaucuucugagagcgucucaagguacuaguuuauuuguuuaucuuaauauuuauuuuauauguauggguguucugcuugcauauauauuaugugcaccacgugaaugccgugcacauaaaaggguauucagugcacguaagaggguauucgauucuccuggaacuugaguuaacagaugguugugagcugccgugugggugcuggggacugaaccaggauccucugcaagagcagcaagugcucuuaacagaugagccaucucuacaacccccuugcaggaauaauuuuaacaugaauuuuuuucuuccuguuucuuucucaaauauucuuugugaauuuuucuuagcuuaccaccaccaccauuugcauuccugucauuacagagaggccacuggauggcacaggucuaaguuccgaauacuaugugggaacaguccaagcaagguuccuucuagcuuuuguguugaacaauucuuauguuucaaguuauuuuuuauuuugcuaagauuauuaacuuuucuguucaacuuguuccaaauauuucuuuauuugauggguaaaucuugcuaaucauuucccugugauuguauuucagaaggaaguucaaauucugucuacauguauuuuuaaaauuuguuuaugauuuaaagccuuuuaaaaugugcuaguuuggggaguggauguauuguccuuaugauaauugaagcauuuuucucuaaauuauuucuagauaacccacaagauggcauuguggugaagcuaguugucagcuuguugcaguuauccaagauggcagugaaccagacuggugaaagagaaguuuuagguaaaugauguaggcaaauggucuucuuuaguauggucagaaugaguauaagcuccucauuugauucacuggaaaauuaaguauggcuugcuaaguuauauaucuguuuaauucagguaacccuggauagccaagugccuuuuguauuuccgaaauagacauuuaagauaaaguuagcaauuauaauuaauacuguauaaauguuaaccguaaaaugccauguaaauaugcagggaaaccauaaaucucugcuuaguuaaguugcgaauuaauuaacuucugaaauguuucauaacuaugacuggugguauuuaauguuuauuuuguuuauaacaagaggaacagagaugcugaaggauggcugucuuagucaggguuccuauuucugcauaaaacaucacaaccaagaagcaaguuggggaggaaaggguuuauucagcuuauacuuucacacuguuguauaucaccaaaggaagucaggacuggaacucaagcaggucaggaagcaggagcugaugcagaggccauggagggaugucccuuacuggcuugcuuccccuggcuugcucagcuugcuuuguuauaaaacccaagacuaccagcccaaagauggaugguaccacccacaauggacucuacccccuugaucacuaauugagaaaaugccuuacggcuggaucucauggaggcauuuccucaacugaagcuccuuucucugugauaacuucagccugugucaaguugacacacaaaaccagccaguacaaugguuaaacucagauuuuuuuuuauaauaccauuuaagucuuugauugcugccguuuaggcauagucuaaucuaagguaacuugcugacauguugaauauaggcacuuaagauuuggcggucuuagggugggagaaucacaugguuaacgcuagccagaggcuggcguggcagcagugcuuucugggaagaguaagugcugguggcgcccaauggugcccaccucuucucucggugggagccugcugcccugcaugccuaauguuuaggcugguuuuuauuuaaauuuaucuuauguauagacuugaauacagcccauguguuccugauuucaaguaucuguacacaaucaaagaauaacugcauucgcuucccagaucuagaaacugaaccugccucaucagaauccucaacucugcccgaccccagauuaacaucuuuguuccucaugcuguuucuggccauaaaccugagcugcucugggaucccucaguagcuuucuuauguaauauaaagugaaccugcuuugaacaugugauacacaucacacuucgugauagaagaaaaagccuuuccucuaacaucaggcaaagagaaguuaucccuuuacugcuuguauucaguacuguaugugaguuccagcucgagguaccaagcacggagcagaacgagaagugugcagagugaaaaagaagcaaagcugcccguguuuguagaugcaugauggccuaugcuuaaaacacucuugauuuucuuuuuaaauuuuuaaagucgauacuucaugcagugccagacauguuaaugcuuuugcuucuaauauucugugacuguaauuguuaacuuauuuccugucaucucuggugaaaaauauauuaccacacugauguauuuuguagcuuucuuuacucccaguguuagaaaacacugaagucuugaaacaugauaaagcaguguuaauacuuuuuaugacucgacuaaaaugagguuccuauaugcagaggcugucggaagguguuugggagaaauagguccucuggauuucuccaccauagcuguccagcauaacaaagauguguccuauaccaaagccuacggguuaccugaagacagagaacuucaguggaccuugauaaugcugacugcccucaacaauacccugguagaggacaggugaguacagaggaugccuuucaucugauagagacaucacaucuggccuucaggaaaaugacacccauacuucacucaaguguacacuuccuuuuucuuuuuuaaacgauuuuauaauuuuuauguaaaucaauguuuugugugcaucuauguaugugcaccacaggcacgccuggugcuccuguggcuccgaagaggguauuggauaucuuagagcaggaguuggaugaucgugaagcaccauguagaaucgagcccagguccucugcaagaacaccgaguacucuuaaccacugugucauacucuagucuuucaaguccuuacauuaaagaaaaaaaauguuguauauuuuaaugaaacucauuuaugacuuugugugaucaaauacccaauauuccugacacuugaugguggugaaguuugucuguucuaaauucgaguaagacgaaguuagacaggauaaaucaguaagcugcaggugguccacacagucaguuaaaauacagaacuacggacuggugggguggcucagcagggaaaaggacugccagcaggugugauagccugaauuugauccccaaagcuaaguggggcgggggagagaaccugcuccugaacguuguuuucugacccccacaggcgugccgugucacgcaccuccacccucacacacacaauaauaauguuaaguacaggaagguaaagaguguuuaaaauaacacuuaaaauagugauucuugcgggggcggugguggcgcacgccuuuaaucccagcacucaggaggcagaggcagguggauuucugaguucgaggccagccuggucuacagaaugaguuccaggacagccagggcuuggggggugguagggaagagugauucuuagaaccagagugcuuuguuccuucaagcuaaucuuuauuuugauuucucuaaaauaauccauggagcaaaagcuuuguaauuucaguccagggcuagaggucaucugaguagacaaaacguuccugaacaaaauugaaccauccuuugguccuugugcuuccuccagucucgggcccaguaacacacucucucugucaguugaccacauuuuuaggucucuuguagcccuccauuuccugggguguuuuuguuuuaguaaaaagagaguucugcuuuuuauuuagagguuuuaaaugcuaaugguuuucaacuaacugcuuugucagaaugaguguauguuccuucaaaaaguaucuuuccaauaguuuuaacauuuggaguaagauauuguacuucacaucaaaaaugauuuguaucucuggagaaaacaucagcuuauuuccucaggugaauuaggauuucgccauuuucacuaaucauauuuauuaggcuacauuauuuccaaacaauucuucuuaaauuuauggucaguguaacagucauugugcagaaugaagagaauugcuauugauuaguaacucguauuuacugagcgacuauuuuaaaaauccuuugacuuuuucucuucaguguuacagaauauuauagauaaguuucuaauauuuuaaauuauuaaguuuaaaacuuuccagucaaauuugcauagcauuccagauuaauaaauuaacuauucauguuuuucagugucaaaauucgaucugcugcugcuaccuguuugaaaaacauuuuggcuacaaagauuggacauauuuucugggagaauuauaagacaucagcggauccaaugcugaccuaucuacaaccuuuuagaacaucgaggaaaaagguauuuuaaguaacuaauauacugcuugcuagaaagacucagacugcacguucugaauucaaggcauuugugauuuuucccuaggcagauuagaaaguugaaauggauacguaaagagaugcuaauuuggggccaagggaaacucuuucccaauauaccugugauauuugcaucauugauccgggauauuuuagggguugugaucagccagcaagcaauuacugcuuagcauaccuuugauaaaauagaagauguuuaagcuucuuugacgcauguuaaucaucauggcaaucccguugaaagcugucugcagugucuuuaagagcuuuugcaucuuugcucuaagcauuucucucuucagaaagugacagagcaauaugcaguuuuuugguguuuugcuuuuuuuuuuuuuuaaccuguuugaauuuaauggaaauacgcaccauugaaauagucauuuuaauguaucauaguuuugguucccaguaaaauuaguaguaaaucagacuguuaaugaaguuaauaauguagccuaauguaaaguauuagguuuuuuauuugguugguuugaguuuuuguuucuuugguuuuuugauuuggggguguuuugguuuggguugggcuuuuguuguuguuguuucagucugggaguuguuguuuggucugguuuugguuuuguuuuuugaggcaggguuucucuauguagccagagcagugcuggaacucacuuuguagaccaggcuagccuugaacucagagauucaccugccucugccuccugaguccugggauuaaaauacguguaugccaccaccucccagcuaaauauuguacuuuuaacauguaauuuuuacauuuuauuuugaaaucaauuuuguguagauuugaaucaguuuuacauaugagccaggugaggcagagguuguggcuuguguggcugccagugaaugacagagcuaacagaggaauucagauuucccgcucccuacacauaauauuuuuacaguuucacucccucaguuuagaucccccaucccacaugugugcuccccacuucacuuguuuguuuuucuagcaaacauugccucuuagggccuugugcuugaccacugacuuguaccccuagcuccgguuuacuuuugagauaggauuccaguaagauaccaagcaggcugugaagguaaaauccucuugccucaacucuuaaauaggugggauuacagaccugaaccaccauuccugaucuaaucuguuuaacuuuuauuaaacauuuuuuucauuuguguguguguguguguacacauguacauguaugugccauggcacacauacacaggugaaagaacaacuugccagagucaguucucuccuuagaccauguacauucuugaaucaaaccuuggucagagaggguugacggcaaguaccuuuacuuccugacuuauuuugugugcacaggccccagguguaguuuaagugcacucaauuuuauuggaagcagauugacuguaccugguuuauuugacauaggaaaugacuuucugccucuaguuuuuagaagugccccgaucuguuaaagaagauguuuuagaaggccuggaugcugugaaucuguggguuccucaaagugaaagucaugacauuuggauaaagacacugacgugugccuuucuggacaguggaggcauaaacagugaaauucuccaguuauuaaagccaaugugugaaguaagagaauuaaucugacuuagagccuguguuuuuguuguuuguuugcuuuucccauuaauuuaaauucugugucucugauugugauuuacauauuugaaaauaacucuaaaugaugaguaaaccauccaccaguguaauguaacccacauccagcugccacaaguccacugaaguggcuaucuccguuuagccagaauaaacagcaggcuuuagguuuaagaaagcaacauacuaguuaaauucuacaaauugcugcaauaauuaguagugaugcuuaaaguaauugagauuauaaguuauuuacguuauugaaagucagcuccuauuucuucacugccauuuggcauucuccaguaugcuuucugggugaagcuauuccguuucacauggaaggucugggacagccaauuucagcagauccuaaguaggugagcuaauaguguuuggggccuggaguguggcucacgggagagcagguuaugaaugcauuagucagucccugggaucaguccuggugcuuugcugccuuuuuguuguugcuguuuugagauagggucucgugucuccugaacucuguguguaaccaggauaacugaccugguguuccugccacccucucccaaggucggaaacccuuugcuugguauugcuggguuguuuuuguucuguucuguuuuucuuuauuuuaaucacuacuagauacacacuuuugcuuguuguaguuuuuaauugaucugucaggggaaugaaccuuuucaguaaaugauguuacucuaauucaaacaauugaguggauauaugccauguccuaggugaaaaccgacuucugucagauguugcugccauacuugauccaugauguuuuacugcaagauacacaugaaucguggagaacucugcugucugcgcacguccgaggauuuuucacuaguuguuuuaagcauuccucccaagcaagccgcucagcaacuccugcaaauucggauucagguauccuguuuguuaguguuuauaccguuagcaucucagcucuagagaaagaugguuccguaaguuacagggcaacuuucugcacacuccuuacaccaggcauugugcuugcaguguggacgugaaccacacagcacucccauuuuaguaguggaaaaaaacauguaaacagacucguccacauguguuguuguaccauggaagaguugagauggaguuuuuauauuuuuagacgucuagccaacuacucuuuaaaaacuuuaccaccagccaggcguggugguacacgccuuugaucccagcacucgggaggcagaggcaggcggauuucugaguucaaggccagccuggucuacaaagugaguucuaggacagccagggcuauacagagaaacccugucucggaaaaacaaaaaacaaaaaacaaaaaacaaaaaaaaaaaaaaaaaggaaaggaaagaaaagagaaguuuaaaaauucaaccuuuaccaccaagucaugcauauuuuuguaggcaauaaaaguucuacaaauuuuuuuaauuacccauaaucauacccauaaccaaagauaucuacauuuggauucauauguauauaaauauaaacuuguauauuuacauauguuuugcauuuagauuauauccaucuaauuuuuuaauuauuuuaaagaaacaauuagauuguguuuuacuuaaucuucaauuuuacuuccauggugagaagugaguauuuuucaggccuuaaaagagcauaucaaauaaaucacgggagcauuuccgauauuauuuacuaacagaaguaauuacauuaaggggguuaggaagacgacucagcagguaagaugucagaguuuggauccccaacacuccuguaaaagacauguuacauuucaagaaguagcauuuuaggggcuggagagauggcccagugguuaagagcacugacugcucuucuggagguccugaguucaguucccagcaaccacaugguagcucacaaccaucuguaauggggucugaugcccucuucuggugugucugaagacagcuacaguguacucauauaaauaaaaauacaaaaauaauuuuaaaaagaaguagcauuuuaauaaaaaccacaccuuuuguguuuauuacaguuauuucagcauaauuguggcuauucaguugucccaguuuucugcuuugacuaugauggggugguuugaaaugucuuuggugcucuuuagacuucauguugcugguuuuauguauccgaguugagagcggcuggggcgaguugacuagugccuacugaguuagaguucuguaggauaagauccaauguccugcugaagaguggaacaacuccugacugugaucauguauggcauguaaaagcagauagguaaaagcagauagacaagccuuugagguacuggaaaguccauaaccugaguucaguucucagcuucacauuggcuggcucaccuauagcuccagcucccuggggaccugacacaccucuccuccauggaugccugcauucaccuacacacacauuuuaaaaaaucuuucuuaaaaaaaaaaaaacaaaaaccuauucuaaacaaauaaaauuuugaggagaugaacauauuuaaccugacuaaaacauuaaaaaauacauccuggauugaaacaucuaauggcaucccauuaauauguaugauuuaaguuaaaaguuuuaaaagaacaaaucuaucugaaaaaaaaaacaugcaaauauaaacauagacaaaguuaccccuuaggagcuauucaucuaaauagucuggaaugugcuuacgaaauuugggggggguugcugaauuaaaaauucuaaagcaugggcuaaggugagaaugguuuauggguaagggugcuugccaccaaagccugaguuucgucuugagaaucccacacagugaaaggagagauccaaccugcacacucugcccucugaccucugcauaagccccgugcagccagugcccacacacacacugauuacuguaauuauguuuauuaauaaauauaaucuuuaaagcccuaaauuaaaaauuauugcagacacucugcaaacuauguaaaauauaucaccuauguuuaauugggaaaauacagauguaaguccacaauuacaaguaaccauuuaaagucuaaauuuauuauaaguacuguuuaaaaccaucuuacuacucacauuuaugcucugaccacauaguagcaaaaucaucucguuucauuucugcauagaguaucaauauuuuuacuaccuuaaaugaaauacugaauuucacauauauaaaacucuuacugaaaaugacaauaaguguagauuccuauaaaucuuuuuuuuaauuuauuuauuuuauuuauuacguauuuuccucaauuacauuuccaaugcuaucccaaaagucccccauacccucccccccacuucccuacccacccauucccauuuuuuuuuuuggcccuggcguuccccuguacuggggcauauaaaguuuguguguccaaugggccucucuuuccagugauggccgacuaggccaucuuuugauacauaucuuaaaugcugugucucaaggucucacaccuuuacuggaaugucucaaacucagcugugugaauaaaaacaaacgcccgcacuaaaacacuuuaucacccaucugaaugcacauccugccaguuguguucccucugugccccucauccuuucugcuuuccagcucugguucagcaguagagauccccucacugucuucugaguucuacuugauacuagccaccucggauggacuucuuuuuucuuuuuuuuuuucuuuuucuuuuucugucuuucuuucccuuucuuucuccuuuugagacagcaacucaaacucagucggcaguacccuaauucuucugccuuugccucucaagugcuggcuauaggugccaugacacccaguuuacacagagcuggggacugagcccauggucuccugcaggcuagccaagcacucuuaccaaccgagcuacucucucagcuccaucacacccugcuaacguccccugggucucuauccucucccuuucccugacugacugguauuuuggcuucagauguaacuuucucuuucaggccuuucuuaguccaggugaggugacucuccugugacuucugcagcauucuuaccuuuucucucacacccuugugcaaccauguuaagagccuccaggcuagucagcaagcucugugcgcaggaacagucuugauuuguucaugguuguaaauguacuaagcaccuagcacauaagacauugcauauaucucaaagcaguagauauaccugcuucagaaacaaauuauaauuuguuuuuuuaauuggauauuuucucuauuuacauuacaaauguuuuccccuuuccaggucuccucuucagaaaccccuuaucccaucccaucccccucccucugccucuaugaaggugcuccugcacccaccuacccacuccugucuuccugcccuggcauuccccuacacuggggcaucaagcauccucaugccgaaaggccucuccucccacugauguccaacaaggucauccucugccacauaugcagcaaaugcccuuuauguauauucuuugguuggugguccagucccugggagcuccgggagggggggggggguucuggccuguugauacuguugcucccucuguggggcugcaaaccuccucagcuccuucaguccuuucuucaacuccucuauuggggacccugggcucaguccaaugguuggcugugagcaucuuccucuguacuugucaggcucugguagagccucucaagagacagccauaucaggcuuccaucagcaaguacuucccaguauccagguuuaguggcuguauauggaauggauccccagguggggcagucucuggauggccuuuccuucagucugugcucuacacuaucuccauauuuccuccuguauuuuguucccccuucuaagaagcacugaagcauccacacuuuggucuuccuucgucuuagguuucauauggucugugaauugaaucuugaguauuccaaacuuuuaagcuaauguccacuuaacagugaguacauaccguguguuuucuuuugugacugaguuacuucacucaggaugauauuuucaaguuccauucauuugccugcgaauuucaucaagucauuguuuuuaauagcugaguaguauuccaugguguaaauguaccacauuuucuguauccauuccucuguugaggaauaucuggguuguuuuuagcuucuggcuauuauauauauauggcugcuaugaacauaguggagcauguguccuuauuacauguuggaguaucuacuggguagaugcccaggagugguauagcuggguccucagguaguacuauguccaauuuucugaggaaccaccauacugauuuccagagugguuguaccagcuuuuaaucccaccagcaauggagaaguguucuuucuuucuccacauccuugccagaaucugcugucaccugaguuuuugaucuuagccauucugacuggugugagguggaaucucaggguuguuuggauuugcauuucccuguugaacauuucuuuagguacuuaucagccauucgaguuuucucaguugagaauucucuguuuagcucugcuccccauuuuuuaauaggguuauuugauucucuggagucuaacuucuugaguucuuuguauauauugaauauuagcccucuaucggaugugagaugguaaagaucuuuucccgaucaguugguugccauuuuguccuauugacaauguccuuugccguacagaagcuuggcgauuuuaugaggucccauuugucaauucuugaucuuagagcauaaaccauugguguucuguucaggaacauuuccccugugcccauguguuggagacuuuuccccacuuucucuucuguuaguuucaguguaucugauuuuauguggaacuccuugauccacuuggacuugagcuuuguacagggaaaaaagaauggaccaauuuguauucuauauguugaccaacaguugaaccagcaccauuuguugaaaaugcucuuuuuuccacuagaugguuuuagcuccuuuguugucaccuaagaucaggugaccauagguucauuucugguuuuccaauucuauuccauugaccuuccugucuauuuuuguacaagcaccaugcaguuuuuaucacuauugcucuguaguacagcuugaagucaaggauggcgauuaacccagaaguucuuuuauuguugagaauaguuuucuggguuuuuuguuuuuuguuauucuaaaugaauuugcaaauuguucuuucuaacuaugaagaauugaguuggaaaccaaauauaauuuauaacaaacucuuuacguuauauuuuuauauuuccuuugaaauaaaaauaaugccacuaaauuaaauugauuucuauuuuuuagaaagugauuuugugaugcuggugagauggcucagugguuaagagcacugacugcucuuccaaagguccugaguucaaaucccagcaaccacaugguagcucacgaccaucaguaacaaaaaucugaugcccucuucuggagugucugaagacagcuacaguguacacacauauaauaaauaaauaaauaaauaaauaaauaaauaaauaaauaaauaaauugaucaaucaaucaaucuuuuuuuuaaaaaguguuuuugugguggacaagccacccaucauaaccuuacaguguagaaggacacacagacaagaaaagacuuucacggcagugugagacuaagaagagauauuucuguuuucguuagagucagagaacuuucuccgaugcuguuuggauaaaaagucacaaagaaccaugcuugcuguugucgacuaucugagaaggcaaaagagguaaaaugauaaccguuguuucucggguuugggaacugggcacucuaacuucuucuaaugcuuuuuaaucugauuauuuuacaugcaacuuuuucagacugcuaaaauugauugguguggugcuugugcauuaaaauuuuaauuuaauaauccauaugcaggacugcaccugggcuaaguaugggagacugucaguuuuguuccagcugucccagcaggcauccugcagaagcuaagucaugcaggcuuuagcuuaucgcagcagggaagaugcgggaacugagcacaugguuuuccgagguuguucucaguacugcagcugcucaugaacucguucucagaguagcugggguuggucaucguuaucgucuuuuaucgucuaaagccuuuccugcucugugccaaacuuaccaugacaaucuguaguaaguuugugacauugucaugggggugauuuagguaaguuacuuuacaguauagugucuuuguuucuauuauaauuuuuuuuugagaccaggucauuguagccuaagguaccuuucaguucuccacguagcucagcauagccuugaauuccugacauucuuccacuuggagugcuggguuuuuaucaguguguaccauugucccagaccuucaaaggguuauuaacaaaguucagaaauagcucaaaauggguagugcaguugaagugugcugcuagcaaguuaccagaacucuggagaaguagcucagaguggucuaguccaucuuacgauuguucaacuuuacaucaauguguggcagcauucagagaaagaaagguggacuucagaguccggucauguuccaggcuggugaaaauacagcaugauccuuuuuucucuuucucaucuuuguagcccuggcuguccuuaaacucacagaaaucuacaugcaucugccuccugagugcugggauuaaaggaugcaccacuauguucagcaaucccuucaugagauucuagauuguggcucuuuaacagcccugugaugaagaggauaaaccauaauuggugcccccauaguauacuguguuguuaugauuuucuauagguuaugugcgauaaaugcauuuuuuaacuuaaaguauuuccaaccugggauggauauauuggccauacucccagcccaagugaaggaacaugcaugauuuggacacguaguuauuaaugccucauaugcuguguauggcgguaaugacagcuguuaguaaagaauggggugaugaacuggaagaauaauagauuauuugacccuacaugcauuuguguuguaagcaaugcaagccuuucauaacauucuauuucacaaacagauuucaucuugcauuuagugacuuugugauuagaaaguuugugacuuacuuuguuuuauuguagauccuuuucuaagaaaaccuuuaacuguagcugugaguaccuuuucuggugucgggagguaguuucaucuuggggccaauuauuucagacuucaugagguagaauaguauuagcaaggcauagagaagauaaaaauccuuuuuuuagagaacauuuuuuagugcugggaagauggcuccgcguggguaaagugcuucuggguaaaccuagcaugcugcacaagccugguggccugacuuuaaguugcagagccugugucaaagcugggcuuaauaacauaugcaucuaaccccaguguuuauaauagguuauaggaagcagagacuggagaaucuccaggaacuucugggccagcaaaccuaguauaugcagcaauaaacauaugaggcccugucuuaaacaggcugaaggcguggacugacccccaagguuguuuucugaccuccacaugugcuguccuuugcagccagugauguaaaggguggguacagagcccagauugguucggcaugaugccuaguggcuuucuuuagauucucugagagguuaugcuccgagucgacggagagccgcccuuguagccaugcugucucagaaugguucuugccauacacucaggaauuauggcuugcgaugaaacaguaccauuuugcuccuuucauuguuuauguuagaauggcaggacacccguguuuaauuccccuccagaccuuccucgggaacagcuuuugaugacgcuuucuggcuggauuugaauuaucuugagguugcgaagguggcucaguccugcucugcucacuucacggccuugcucuacgcagagaucuauucagauaagaaaagcacagacgagcaagagaaaaggcaaguggauuuugagguuuggguuuuguuuuauuuauuuguuuauucuuguuuuuuuuuuucaagaaaagguuucucuauauaacuacccuagcuguccuggaacucacucuguagaccagguuggccucaaauucacagacaucuaccugccucugccucccuagugcugggauuaaaggugugugcuaccagcuaccacuacccagugacauuuugguauauuaaauugauguugauacuguuuuccguucaaauguauaguaaagauuuauuuuugcuccauuuuuccauuuaaaggacauuuuagccagagauuuucuauaucaaagcaaaauacuuuuuuaagaaguaauucucugaaaauauagaaauuguaguuauauaauguguucuauuuuguauuauaaagacuagacauaggaagcuaaugaagagaaacaacauuugguuguuuguauauucccuauagcuaagcuagcauuuggaauguaaaccacccauacauguguucaugacugagugauuuccuaguuuugguuacauuagguuuaccucuaauucacauuucagaauucauuuuacucuuugacuagaaugugaucagucugugugugacuaaauaaguuuuauuuauguguuaccugcuuguauuucuagcuacuucaacucaauuuccucugauugaauuagaacuuuuauaaaaagcuuaaaaauaugaucauagaucgugaugaaaaauaaccaagaaaguaggguauuaaauuacauuauacguuuuauuauaugaaccuccuuuuagaucccugucugaaauagccuaguguuuguguuuauagauagccucacuuucuuaccaguaauucagccuuacuaagaaauuaaaaucacaaaugugaguuaugccaauacauacauuauuuuuguuauuaauaaugguagaugccauuaagcuggaaauguaauauauuuguuuagacuggaaaagugggaccagaauucucauguucuacaagucguuaacauagaucuagacuguucacuugugguuugauauuuaaaucucugccuuuugguugaaaaccauuagagauguacauuauguggucacuauagaacauuguaacccuguguguucguggucacuauaaauccaugaagacaagugcacagcacugaucgcaguuugagugaguuuuaguauuuuggguuuguagaacgguguuuuuuauuaaucaagagcaaauaguauguccucugaguauaaauagaagcauuuuaaauuugaauguuagccauuaugugaauggagcaaacuugugcagagcugcuugccuucaagcaggugugacugcauuugcuuugcuggucucuuugggguucucccccaacuuccagagaacugaugaaaaaaggaggacagacagacaagguguacggagacugagaagugcaggaguccacaguggcucuguuagaagagccaaccuggagaccuaagauaguaagcacacugcguuuguaaauagaauauaggcaagcaguuuaccuguacugucaaagaaacaaaccacaaguauuuucuauucaaguuguuuacuaggauucuucauaguauguacuugaaauaaaguacuguuuuguuagcauguuccugagacacugcaaucucagaguuaguguccucaaucuguguaaaacaaagucagcucaaggcuuaucaauaagacucagagaacggauuuuuacagccucagaugucuuacuguuccaagauccuaaaguaaugccuaacaguaguacgugcagcuguguuauaugugugaugccugacaguaguaugggcagcuguguuacacaugugugaugccugacaguacuacaugcagcuguguuacaugugugaugccugacaguaguaugugcagcugugcuacaugugugaugccugacaguaguacgugcagcuguauuacaugugugaugccugacaguaguacgugcagcuguguuacaugugugaugccugacaguaguaugugcagcugugcuacaugugugaugccugacaguaguaugugcagcuguguugcacauguguugccuugaugaauuggagcuagauggauauuuuacauguguaucauaucuguaccugaaggucacaaagcagaguaucgucaacagcauucugucacuaagugcgccccucccccccauaccagccuccugagacucucccagggguaaaggugaccuucaguguauguuuaucauuccuccagucuagcaaugucauauuacuugucauauuaguauggaucuugaaauacaguguaguauucucuauuuuugaguuuuauaagacauuuucuaugccacauuuuccacccaaguuuuuaauaucuaugcugccuauugcugucauucuuuacugccaugguacacuagagaaggcaccaguuuguuaccugugucagugacauauaccuuauugggagaacuacuggugugcagauuuucaacuuacugagguagugcugaauuguauuaguguguguacuuuauuaaacuguaguugguaagaaaauuaguuuguauaguuauuugcuacauuggaaggaggaaacaaaaguguaacuuuuucuauuuugagggaaaaauauagaaaacacaaaacauguuuuagaaagauauuagagggggcuaucauuuaugguaguauuuaauuuauauauuggauuauuauaggcacaguagcagugaugauacuaaaauugagucacuuaccaagcuauaacacccaaauauauaaaugcuuaaagguaaggucuuacaguggauaaaucugaguucucgucgcauuauuaccucuagauuucaguugcucucgcuuauuuucaucagauuucuuucuuuucaguuuauuggggguuaaauugugucuugugguuuuacuauauauaucuguaauuaucaaguuaaacuuuaaguaagaccacugguagaauacuuaggauauguauugcaaaacuucuguuuuuaaacaggccugucuuagcauauaacugcuguuuauacaauaguguuauuaugaauaauuuccgcauguagaauuaauauucucaaauuuuucuuuuuucaugccaguucuaaaugauauacuguguuaaaguauaaaugguuuacuguucuuuuugaaaccauaauuaguuucuuuauguugaaguauagaaugaauauauuuauaacauuggauaguauguucucauuaaaagagauguuuuuaugauaagcagaaguccaacauuugaagaaggaagucaaggaacaacuauuucuaguuugagugaaaaaaguaaagaagaaacuggaauaagcuuacagguaaauauuagaaacccugugauaauuuguaugugauauguuggauuaucuucucauagggauauaauugauuuuaaaacugaaacuagggcuggugagauggcucagaggcuaacagcacuagcugcucuuccagaggucaugaguucaauucucagcaaccacacgguggcucacaaccaucuguagggggaucugaugcccucuucagacaggcauauauauauguguguguguguguguguguguguguguguguguguguguguguguguguguguguaugcagcagagcacacauacauuaaauauaaaaaaaaauaauuguuauauaacugaaacuacuuauuggaccuagaauauuuauauaaauuuaugcucugauuagagaagugauuuccaaucucgacuccuccacuuguucuauaacacugcauaaauauguggcccuucugaccuugaauaaaggcucuuuuauugcugaccaugacaccaugaccaaggcaacuuauaacagaaaguguuugaucugggcucaugguuuuagaguuucauccaugauggcagagcaaaggcauggcagcaggaacagcugagagacagagacagacagagagagaccgucccaaagcucacguccuccauaagauugcagcucccaauccuucucagacucuuccaccuagggaccaaguauuccaccgugagccuaugggaacauucuuauucagaccaccacaucccauaauugucuuagucucccuaccucugcucuuguccuaaccaucucucuuauuaaacuaacaaacaccuucccuuuaucucgggguauuuguucuuguucagaaacuuuguuaugcugugccuauucuuaacuauaucaugaacauuucagacuucuacuguuuaaaucguuucuguccuuggaucuggaaggaguuucucucuucuguauucucuuaagguguugucuucuuuccuuucacguccagacuuucccaugaugucuguaguugcucucuccauuucuuuccuucauuccauuuaaauggcacuugccuaauguuuuccaugaacuauauauugcuuagucuauuagucaccuuucauuucuuucuccuuaacuuuuuuuuuaaagguuuauuuauuuuauguauaugaguacccugccacugucuucagacacaccagaaaagggcaucagaucucauuagccaccaugugguugcugggaauugaacucaggaccccuggaagagcagucagagcucuuaaccgcugagccauuucuccggcucucuccuuaacuucugacuccacaucuagucaugucuuguaugugugcuuguaugugcaggccauagguugacaucagaugucuuuaauaacuaucuuauuuuuuugagacaaguuaucuuauuaaauguagaacucacugauuuugcuaggcuggcugaugagcgagcucuagggcucugccugucugccucuccagagcuaggaucacacaugcgugcagcugcuuugaguuuucuguguguguccuagggaucuggacacacacuuuagugacuguuuccugagcuccucagcccugucucgggcuugccaugugauccucuauacuaacauuucucuuuuucucuuggaacuauguaguuucaccuuucuguacugauuuucaugaguauuuucuuaugccaaggacuguuagaucccuaguguuucaacucuuaagguuuuauuucaugucuaugaauagaaauacuugaauaagaguuauauguagacuuauaccaauauugauuuguaauuaggaaauauuuaccacagcaaaaaaauaucaaggcaacugacuugcuugcucaguuuccuauggaguguagcuucugguuuuuugguuguuuauuguuuguuucugcuuuauuucauugaaguuaaacaacacuaggcuuuccuguguaaauaucacuagaaguauuuuaagaaauugcugcuuuaaaugcagcauauuucuaaaacuaugggcauuuuaaagaaaauuuauagccuucauuugcuccaauuucaguaguuaagguuugcagaauuuuauucuuccauuuacaguuuuauuuguggacaggauuguuuuguuuugugauuauugcugaaugugauuaaaagucuaguauguugguaugcauaucuguuucaugaaauuccuuaguuuuauuauuuuaugcauaugaguauuuuguuugcauguuuguuaagugcaccacaugcaugccuaguuccugucaaggucagaacagugcaugggaucccguaguccuggaguuacaggugauuguaaaccaccaugugggugcuggggaucaaaccuggguccucuggaagauaagcacuuuuaacuacugagccucucuucagucugugagcauuacuucuaaaguagaccaaccauuuucuuguauaggacaagaccacuguccuauacaaugauuacagugauuaggauacuuucuauuuuuaucauuauauuuuacuuuuacagcacauuuaugaguuguaaguugugaguugauaaugauaaaauuuaaagcuuauaaaauccaugaacugauuuuuauuuucaagucucugccuuugguauuucuguuugcaggaucuucucuuagagaucuacagaaguauaggagagccggacagccuguauggcuguggaggagggaaaauguuacaaccccuuacuagguaaacugcacuuucuagauaguaauucuacuucucgaaggagcuauaugcauacagaaacagaagauguuuucaccaucuuuucuuacagaauacggacauaugaacaugaagcuacgugggagaaagccuuaguaacuuacgaccuggagaccagcaucuccuccuccacccgccagucaggaaucauccaggugcgcuucugucugugucugccaccgucagugcaccuguuagcguuaguucaguguaucagugaaguuuacgcaggcagcaaacuugagaccacuggagcugcacugucagaugugaggcuagcgccucaguacacacaggaaagcugcacgggucaguguaguuuguugauaguaccuuuauuacccgagagcagaagacccuuccugaguguguacaguaugccaggagacacuaguagugcuucauguggcacuucgaguuugcauuagaguuggucccagaaacuguuauaucuauuccuaguuaauaggcuuagguauuucuccaucaaacauuaacauucccuguaaauauacaugcuaagcaauauuuuagaauuuuaagugauacuguuaauuaaaauuuuuuaaauuauuauuauuauuauuauuaccauuauuauuauuugcuguuuucccucuccuaguccagugguucucaaucugugggucgugaccucuuugcgggcucacugacccuuucacagaaguuacacaucagcuauuuaaauuaugauucauaucaguagcaaaauuacaguugugaaguagcauugaaaauaauuuuuaugguuagggucaccacaacgugaggaacuguauuaaaggguggcagcauugggaaagguugagaagcacgggucuacuuugugcugacauauuugauuguguauuuaccuccuuucaggcccugcagaauuuggggcucucccauauccugucugucuaucugaaaggauuagacuaugaaagacgagaguggugcgcugagcugcaggagcugcguuaccaggcggcguggaggaacaugcaguggggccucugcgcuucugccgggugggagaaauggacuuuccaaagcacagcccuuccccaggggucuuucucugacucugaaacugcacauuugauugcuuucucuuaucugugaauauuaacauguugguuuuucuuguuuaauauauuucacagacaguauggccugacuucuuauuuaagauacaguaggcaguuaccacaacgaagcuugaauuacauucuuuuuuuuuucucauuagagaaauuauauccccugcuucaagcauuuugaagauagacauuuaaaaaaugucuuuuccuaugagaauauuguauguuggauugaggaaucuaaagacaaguguaggccuucucccuugcacuacuugcugcauuguagucauaugcacuuuuauuggcugggugauaaaauaaguuacccuuguuaauauuuuguugcugcuguuguuguugcuguuagaaagcaguacuaggcccagaaguaaugaugcacaccuuuaguccagcacucaaggaaucagaagcagguggaucuuugggcuugaugauagccaugucuacacagugaguacuuggcuagccagggcuacacaggauacagugccuuaaaaacaaauagauaaccaggcaucuuaagauguauugauaaaccaaguuaugcuagaagguaaaaguuuuaaccaguuugucaaaucacuauauuuuuaaaaugauaaccagaacaccuaggguacugaaggauuuaauaacuacauaaaaaucuuuuaaugauauaacacugaaaaaguaagucauuuuaauuaucuuaauggaaaaauauuuucauauauuggaguauuuaucaaauucuauuaaaggaaugguauaaaagcagaguuuuuuuuuuuaaagauuuauuuauuuauuauaaguaaguacacuguagcugucuucagacacaccagaagagggcaucagaucucauuacgaaugguugugagccaccaugugguugcugggauuugaacucaggaccuuuggaagagcagucagugcucucaaccgcugagccaucucgccagauccagaguuauuuauauguagaugaguuuguuucaggacagaguuccucuguguaauccuggcugucccagaauucacucuguagaccagagguagagcuccuacuucugccucuugagugcuggcacuaaaggcacugccgccaccucucagcuguucucauguuuucaauauucaucuuacauauaagauugggaaccaaacagaauuucuaagguuauuuuuuuucuuuaaagaauuuaaauggccuauaaaauucuuuccuuuuccuacugcuuuguuuuauuuuguuauuugcuuguuuguuuagauuuuacuaugcaaccauggcuggccuugagcucacuaagauccaucugccucugccuaccaauuaccagcuacauguuuuucuuaauuucugcaaauuuuuaugagaaaucuuaauuuuaguucucaauguuguccuuugaguuaguuaguuaguuaccaugacugucucggaacuuucuguuuuuaaauuuguuuuuuaaucaugucacagccaagaaguagaaggaaccaguuaccaugaaucguuguauaaugcucugcagugucuaagaaacagagaauucuccacauuuuaugaaagucuccgauaugccagguauuauaaaaagacaaauuguuuuuauauuuaaugcuguggcugcuauccucaaaaugaguaguuuuaauguaagcauuugcaucgaugaagggaugaaggcuugguggcuguguucagauauuugucauccuuugcucucaagaaauacuuucuucaggaccuaugucagcucuucagucugagcccucagggaaagugugauaguguucucuuuucguucagguauccuaaaagaguugacuuuugucuuuucuaguuucauagccuucacucucuuacugucauagcucuacuuucuaaaauagguuucuuugaggcauacaugaaaugauauaugauguagcaauuaucugcaacaaguuaaagaaacauuaauuuuuuuaaaagauuuauuuauuuuuuauaugcagugauguuuuugccuacauauaugucugugucagauccuuaggaacuggaguuacggacaguucuaagccaccauguaggugcuaggaauugaacccugguccucuuggaagagcagccagugugcuuaaccacugagccaucuaucuagcccccaaacaugaauauuuuaaacacuagccacugacaucacaaauccuauacauauuguuugguuuuagaccccagaacaggggacugcagugcauauuuuacacaccaaagcagaccuggccuccauguucucccagcaucccucaguuccugccuggaaugcccugccccgaauccugaacuuuucagccuaggggcugggcugcccuuucuccauaggauccucccuauauaauccaggcauuuugguuucuuuuuuucuucuccucuucucugucugugagcuugucccuuucucucugucucucccuccccuaccccuucccaguggugacuuucccagccuuggaccuuggggcuagugaacucggccaccagagagcugcuucccaauaagccugccuuuaauauaaucuaaucuggccugaauuggcucauucaccagugauggagaaauaaccuaugacagauggcagaaauaauauuucuacuuuuaacgugauuguauucuagaccuuuugucaggcucuuucuauacauacucuuuaacucuaaagguggaaaacaauagcuguggcaagauuugguagcagguucaaagccagacagacauggcagaacugggcuuuacacuuagaacuguauaaucccaaggcuggucacacugcuguuucaccacuguguuuguguguguguguguguguguguguguguguguguguguguguguguguguagucuuuacugcuguuucaccagagucucucucucucucucuguguguguguguguguagucuuuucaggucagcaacaaguguaugacaaguauugcucagccauagaauugaaccucuaucucccugaggacgugucaguuucagaugaucugcucucuuaccccuagggugaaagaaguugaagaguugaguaagggcagccuugagucuguauauucgcuguaucccacacuuaguagauugcaggcaauuggagaacuggaaaacaguggcgagcuuuucucaagguagguggcuugcggguuuugcuaauccugaagcguguugcuuguuguguguugugugucagcaauggaaacaugugaugggcaugauugauuauuauuugcuuuguuaagaaagguuuaugugggcucauggcuuccaaagguuucagccugugauuagcggcuucuguguuggccugaaugagagguuguauugauggcacacagcaggagggaaggggagaucuguuauaaaauaaacuggauaaauuuauuaauguguguguaguaaacacauucuagacauuuaccaacugagaaauguaaugccaguagguauaaccuaagaauugaaaucgaagcucuucagaaccuuaauuuuaagaguauauagagaugccuuugucuaaaauacuguagaucuguuguucuggggucguuugugacagaaguagaagcuugguuuugaugaacaugcacaagcaacugaaaugauuucucaucuuuacuucauuauucucuuagucucacuggaucuuuuuuuucucccucucaacacaaguccugaaagaugggauaguguaacauauuuuaggcaugugaaaggcaaaguauucauacaaaugaguuguuuucuguuuaauaauguuagcagaugaaauguuuucaagugcccguuguuuguucaaugaacugauuuuuuugacagcuauguauagugucauuuguagguaauuaaugaaaauuaauugauuuccuuguagauaugucugcuuucaccacaaugaggacuagcagaguagacgugucuuuaugauaggucugaaugcagcauucucguuucugaacaaaaucuguuuaaaggcuaccuuuuaaaguacccauuaucuguaacuacauguaacuuugcacuguccuaaguauuuuucauuugcucaacuaaguuaugugacuugacuuucaggucagucacagacagagagcgcucugaagcauacuggaaguggcagaagcacucccagcuucugaaagacagcgacuucagcuuucaggagccucucauggcucugcgcacagucauucuggagacccugguacagaaggaaauggagcgcucucaaggagcaugcucuaaggacauucucaccaaacaccucguugaauucucuguucuggcucgaaccuucaagaacacacagguaaaaagcuuauauuuauguuaccucacuucuugggcuuuuuuuauuacucagauaccagaagguauaaugaugugaagaagaaauaucacugaaaauuggaaaucguuguauauaaaguuauugaagauuuuagguugacuggggcuuguacuuaacuuacaauccuagucacuugagagguugagguaagaggaucacaaguucagagccuacuugcgaaagacaaugaguucaugguccccuugaaaaaccuagugggaccugucuucaauguauaaaaggguugggacuauggauguaugauagcacgcuucuuugcauagcuaauacaacaaggcucugggaucaaaccccaguaucgagugagaaaacaaaacaaagcuuucauacuggaauuagacaaaaacuugaguuuaaacauuggcaaggcaauaauuaucauuucucgcccccaauuuccugguuauaaaauaagauucccaaacuacuauaauguaaugguaacaauucagugaucucucucucucucucucucucucucucucccucucucucucucucucucacacacacacacacacacacacacacacacacacacacuugucagacuuuguggucugcagguugguaaguaagcaggaaacuaauuaagauagucucugaaaaaugagguucucaguggauaucuuaccaguaaauguauuuauuuccauaugcauuuucacuguagcucccugaaagagcaauauucaaaauuaagcaauauaauucagcuauuuguggaauuucugaguggcauuuggaagaagcacaaguauucugggcaaaaaaggagcagagucuugcucugaguauucucaagcagaugaucaagaaguuggacuccagcuuuaaagauaaagagguauguaugugcuuugugugcacgucggugggguggcugcauccgugauugaauguugucagaaagcauuucugcuucagaauaugucuguaaugacuacauuaagguuuugaaauuacggguccauaaauaaaauaauaugaaaagagacuuugaagauuaaugucagaaaugagacuugaaaacuuucuuauuuaaaacaaaucuaucagucugucuuguaguauauucauucaguuuuuccagaagucaaaaauaauauguaggaaauaaauggaaauacauguuauaacuuugaaguagcaaggacaaaaauagaauuagaaaugucugagagaagaaaaguaggaaacaaguuacaacaauuugucauucuuaaaguguuuuuuuuuuuaagguuuauuuauuuauuuauuuauuuuuuaagaugaugauaauuuuuuuaaagauuuauuuauuuauuuauuauauguaaguacacuguagcuaucuucagacacuccagaagagggcgucagaucuuguuacagaugguugugagccaccaugugguugcugggauuugaacuccggaccuucggaagagcagucgggugcucuuacccacugagccauuucaccagcccccagguuuauuuauuuuauuuauaugaguacacugucgcugucuucagacacaccagaagagggcaucgaaucccauuacagaugguugugagccaccgugugguugcugggaauugaacuuagaggaccucuggaagagcagucagugcucuuaaccccugagccaucucuccagcccauaauuugucauucuuagugcucugaaaauaucacauccaguggacaggacacugcagggucaugaaauauuaauuauaacaaagcauuaggugccaguagaauuugcuuaaauaucuccuaaaucguauagucccuaacauaugugguaguuuuauaccucauuuuuugcauggacaaauagguaauaaugauauaucuaauuuauaguauuccugugaaaauuaugcauuaauauauauaaagcuauuggaaaauuccuggcauuuuaaaauaauaauuaauaguauuaauaguaauagcaaauuguuaguaauaauaauaacaacaacaacaauaacuagacaguucacagugguuguuucaugaacuggcauacuuagaauuauuuauacgguaaaaguaugaggaaaauauuuuuaauuguuuuuuuuucuaucuacauggaagauacuuuuguaaucuugaaaaggaauuacauuuuaaguuuuuugcuucuugauacagaaugaugcaggucucaaagucauauacgcagagugucugaggguuuguggcagcuggcuggcagaaacuugcuuagaaaacccugcagucaucaugcagaccuaucuagaaaagguagguuguuggcacagcucugaacauuauuguuuaguauaacuauacuugauccuuuuaugaagaccauguguaucuuaaaagcaaacgcaagugugguuucaauccuucagcuccugcuggggcucuguaauccguuagagcagaaagaagcaaaaugccacagagggaggaacagcuuugaaugcaugaaugucuuccguccacucuuuauacccaccccuagcguucaagaagucauuucugauuacucugcuuuuauucuacaaaauguccuauuaaacauagaagccaucauugcuauuuguccaacuacuuacgguaaggguuaggacuucacuucuauaauccccauuggccuuccuguuucuccuucuuuguccuuuagucucacuaauuugggaaauaggaaguucaguaugaaaaguaagauauaaaugucgggcuggagagauggcuuagccauuauuauaucauaaacauaagauauaaaugucuuugauacuaaagaguucuuuuuugcacaguucauugcagcuguuaccugauaagguuccaugccauuaaguuucacauuuacauagauuugagugggcuaccuuggucugagagucuuuagcuauaucuaugcauguaaauaugaucuuaauggauuguguguuguugaaggcggugaagguugcuggaaguuacgauggcaacagcagagagcucagaaauggacagaugaaggccuuucucucguuggcaagguucucugauacucaguaccagagaauugaaaacuacaugaagucaucagaauuugaaaacaagcaaacucucuuaaaaagagccaaagaggaagugggccuucuaagggaacauaaaauucagaccaacagguaacuuuuagcugacgguuuauguucggcugaggggcugcugacgugaaaacugcccugaccuugucaucugaauuauaguuuugaaaacuuagcuuuuuaauaggcuuucucaguccucuaguggcuaaucacaacuucagucaguuaauacacugacauguucuucuaugaauaauuaaugucuugguuuagcucuuggcagaguacguggauguuaguuugguuuuacuagaagcugacauuaaguauagcagacuugccuacuuugauauugucacaguacuucuaagucugcauuggguuuuuguauguuuggaguaagcagaggauuaacuuagaguccacccuguccuuggguguguggaagaccuauuaauugcaggugugacaaguccuuuuauuauauuuagaauuuuuuuuggagugaacaccuuguauuucauugauguugucuuaucauguaugauuuuauaguuauguaaagguuugugacuguuauguuugaauuuaucaagauacacaguaaagguucagcgagaacuggagcuggacgaaugugcucuccgugcacugagagaggaucgcaagcgcuuccuguguaaagcaguggagaacuacaucaacugcuuacuaagcggggaagaacaugaucuguggguguuccggcuuugcucccucuggcuugaaaauucuggaguuucugaagucaauggcaugaugaaggcaagucuuacccaacccagcauuugagcauacacuuuaaaaacugaggccuaagccccugcagugugggauuuugcacaucccuguguaccccuccuaauggguuuggugcuccauaaauaaguacuuuauaaacucucagugauacaaguguguguggaggcgagagaauuucuguagguguuuuaccucugcagauaacacagaggaguccauaggggggaaugcuagacuggagaauaggaaacauaaaaauaaugugaugcuaagcaagaauuuuccuuuguuuuauuugugcuuuugagggauuuuuuuuccuaauacaguccuuuuacaaauaaaaaaaauucauaacauguacaggaguacuugaaaguuuucauugaaaaaauaucuuaagauguggucauaaaauaaauauauaaacuaaguauauauuuaguuuaaagguuaaagauaaaauguuucuccagaaugaaaagaaugguaagacucaaaaucaacaaaaccagucuuuucuacuguauguguuaaaccucauuacuucuggcauguagggaaaagaacuugauuuuguuaccccccccccaccccaucccccgacuucuugggaguugagaccacaguagacucagauucguaucuauccuccuuggagucacuggacuggaugugggguuagcauaccagcucuggaugcagugugacuuagggcuaaggauuuuuguuaucacugaaucacuagguaaauuuuauuaucaccgaggcgucgaauuagaaagacuuucagauaggccaagagguaagggaaauugccuaguuaguaaaguuuugacagccacuaggguguacuaguggaggaucauuauuuuagguaccauagauauaagauuauauuacaaacauguuucuauauuuuguauuuuuuuuaauggcagaaagauggaaugaagauuucauccuauaaguuuuugccucucauguaucaauuggcugcucgaauggggaccaaaaugacgggaggccuaggauuucacgaaguccucaauaauguaaguauacuugaagucaaaauguaauaacuaccuuuuauguuaguaaacaugugaaaucaaaauauuaaacuuucucuuucauugcagauaagcuugucucuuauuucugacauuccucuauagcucucucucacagauauacacacccacuacuuacuauacaaugaugacauuaacuugaacuugauguaaaguaaaauuaaaaauguauauuuaagguuuuuuucuauuugcacgaaacuaauaguuacuacuuuucugauagcuaaucucuaggauuucacuggaucacccccaucauacuuuguucauuauacuggccuuagcaaaugcgaacaaagaugaauuuuugagcaaaccagagacaacaagaaggagucgaauaaccaaaaguacaucuaaagaaaacucucaccuugaugagguauuuggguaaaugcaaguacccuuuuguguugugauggucauucuuccccagaauauuccuuuuuuaauucucagagacuuuaagaauguauguuucugguaguauucuauauccuuuauuaugaugaugccacccagaauugguuaacaauuucuaagcugguauuuuaaaauaccaguuugauuuuguuuucuggcagcaaugggcaaagaaaaagcagaucuuuaaaaugauuuauuuguaacauucaugagugguucucugcaccauauguacaucuggccccuacagaagccaggagaggguuuuggaugucccuggaccugggguugccauguagguucugagaaccaaaccaugguccucccaaagagcagcaagugcucuuaaccacugaaccaucucucuaggcccagaaaaacagauuuuugaaaaguacccaagucauuaaccuugaauuuuuuuauguguguauuucauucccugaguggguguuuuguuugcaucugaggaauuauaguccuuucguugucuagaucugugcauggauucucuuuguauagcuccaagaaacuuaaauguuuagugggucuuguucuuuguuguugaugguaggaucgaacagaggcugcaaccagaaucauccacuccaucagaaguaagcgauguaagauggugaaggacauggaggcgcucugcgaugccuacaucaucuuggcaaacauggacgccucucaguggagggcucagagaaguaugugugaaaguaccacugccgcuguccagcuugaccugcagugauaguccuccguuuacagcugucacuaaaaucuauuuauuuuuaacguagaaggcaucaauauuccagccaaccagccaaucacuaaacugaagaauuuagaagauguuguuguucccacuauggaaauuaagguaauuuacuauuaacucuugauuuuuuuuuaaagauuuauuuauuuaucauaucuaaguacacuguagcugucuucagacacuccagaagacgguuaacucuugauuuuuaauaagacuaaauuacgggcuggugagauggcucaguggguaagagcacccgacugcucuuccgaagguccggaguucaaaucccagcaaccacaugguggcucacaaccaucuguaacaagaucugacucccucuucuggccugucugcagacaacuacaguguacuuacauauaauaaauaaauaaaucuuuaaaaaaaaauaagacuaaauuacacauuaguagauuaaauuauuuguagauuuuuuuucaguccaaauggcuaauuauuguaguuucauaucuuucuaccuauagguuguccauuagauuuuuuucuuucuuuuuuucucccuucccccaccucucucucucucccuuccucccuuccucccucccucccucccucccucccuucuuuucuuuccuguuaucucuuauuguuauuuuaacucuagggacugaaccuauuaugcacuggggaagccuuuuuuauacguuuaaggcagggucucacuuuguugacuaugaaccugcucuguaauugaagcaagacuagaacuugaccauccuccucucugucuuuugaguaccugggacuacagaccugugucccguucacuguuuuucucuguauuauucuuucucaguguguggguguguuucaugcccauggugauggaacacucuaccucugguuugcgggugggcaacaccacuccaucauuuuuguugucgccguuuugguuuuuagucauucaguaugcacugggauguauuggcugugauguaacuauauuauuuaguaaaacaguagguguuaugguaccucuaaguugcuguguauacguacuaaacaccuauucauagugaucuuuuauuccuagaaguaccaugugggcaggauguguguaacacuaaagguuaccauuuuagaagcugaugcguuagguccaugguacagcucucuuucuccuuccaauguguacacuaagauuaguguucuuguuacugaguuugacccauuauugcaucaugcagguuaacagauacaggcuaugugguuuagcugaauauuuccucuuuuaaaauuuuacaugauacucuugugaauuaaauaauuccuuagauuuuuuucaacauauguaaauaacaacuaaguucuaguuuucaguaguuuuucagcaguacuauuuaauugacuuaaaaugcugaagauuuaugaaaagauguuuaagaaaguaaacuguguuauauguaauuuuaaaaaucugggcagcaaguaaagacacuugcugccaaucauuuaaaccagagcucugccuggguaccagcauggugacacauauguguggucacccaaauacacacacauacacaccaaguaaauaagcaaacguaauaaaaaucuaucagugucauuaauucuaacuugaauuaaacaaauuagaaauuagaaacccagcuguuaauuagcagaguuaucauuugugguuguuuacuguuuaucauuaguuauucuccuguuuuguuugucugaccuauaauaauuauuuaucaucauuuauuagguugaucccacaggagaguaugaaaaucuggugacuauaaaaucauuuaaaacagaauuucgcuuagcuggaggcuuaaauuuacccaaaauaauagauuguguggguucugauggcaaggaaaggagacagcuugugaagguaagacuuccuguuucugguauagucuucagaggauuaaugccaucaacaucaacagcaggauauuuaauucuuaccucauuugguugucuggaucuagcuuuauccugaauaaugacagguagaaaacauuuuugaaguagaaauacagugugauagaaucaaacugcuuuuuagaauugugugucuucucugaaagacuguaauuuuuguuuuuguguccugcuauuauggauuagaaccagggccucgcucaugcucaucugcuucugaguuacaucccagcucuccuuuagguuuuauuugacacagggucuugcuaagcucccugggcggggcuugaauuuaagacccucuuaccugagccucuggagaagcugagacuguaagucggcaguacugggcuuagcaggcucuugcacaguugauucaagagaaagaauugcacacgcuaugagcuuacuuguaaaaaaggcuuaugguggggauuagaacaauuuaaggccuguacucaauaucccgggccugacacagugccacuugcuccugagaaguagcagcacucccugcuuugcauugcugcuuaggugcuuuuggagucuugcugaaaauagaagagaaaugaaagauuacuuuauuuggguguuuuguauugugccuucaguugaaggaguuaguuuaguuauuagagaagcagcuaagaggaacuuggccuuuguaucaaucugcuucccaguuucauagguuuuguuuuuuuuuuuuuuucuaagugaaaaaugacaguagguauuaauuauucaagacauucugaagaugaguguagaaacucagauugacuaguucugccuuuucuuagaugacucugugcuuauaauaaaguaaacucugccuguucaugucugguuguucugaagggccgugaugaccugaggcaagaugcugucaugcagcaggucuuccagaugugcaauacacuacugcagagaaacacugagacuagaaagaggaaacugacuaucugcacauacaagguaacuugugguccugcaagguagcuuguguucugcagcuugcccaaggaaggugcacuguuuggaccaagaaugagcauauguuuucuguaaaagaacaacuaguaaauauuuuagacuuugaggaccauucaggucuuuuguauauuguuuaauuuuuacuuaugacuuuuuaaaaucucugucaucuuuugcucacaagcuguacagaaauagacugauacugguuuugcuucagaggcuauggauugccacucucagguuggacaacacaacuuuaauuuucauuuuaguauuauuuaauguuggcugccauuagacauuuucuacagucaacagcaauagucucccuuuauugugguaaguaaugugcuguagggauuaugcugcugcuuaucugugcaugguucauuuugguuauuucugggcuuguguuacugcacacggugauacucugcacugaacagaugaagugagcaugcaugcuucguucauuucacauucuggucaaucuauuggaaagauuuucagaaauuggauugcuaagugagaggacacugcaaccuucauuugguagauuuuacuguaggacagucaauggaguuagacccauuuccauuuucuccacaguucacuugagaaauccucggguccuguuauucuaucauuagcugaucuuuuuuccuaagaggugaagguuuguccuuuuccggcuuuguucccacauucucuuccccaucuccauccucugucacugcugucucagggcuucuugcugcuuaucuuuccccaggaagauaggaacaaacugaaaagcauuuaauucacgucuaguugagaaccagcucuuuuuagaacagucucaguggcuguuucuuuauuuucagaaggguaaacucugcaacuauuuucucuagacacucaaauauuuuacuagaagauaaacacuaguaaaauauuuuaaagugcauuggaaaaguguucccuucacaacaguuaaagaguauguaucaucauguucacugcagcagcacagauucuaaaauuggaccaguacaaagaaaauuaucguggucccuauauaagaagagggaaaagguaguauguauuauggaguguugggaccccacuugagguuuagaaauaaagaagcugagauaucuguauaguugaaggcucuuggcuuuuuugcuggggcagucucucagcuagcuucuaacuuaaccugacugccauccuguccagccauguggcgagcucucucuuucucucaucucucucuuuacaucccugcuucauuuuuguccaugauucugucuuucugccaagacguucugcuuucuucugccccgucuccagccaccagcucuuuauuuagcaaaagucacauuucuuucuccuaucaaaagcugcuagcacagugggagaggucccacagcuuccccccgcugagcagagcagcaggacuacaccacguucauagggugguguccuuuuggccagauugaaggcggugucaccuuccauggccuccuccauggcagcuugcuuuuuaucaugacagucuuagggaauccucuuuggugcaggugaggaagugacaaacauuuacuuacagaaaucagguaaugcaccauagaaaugacaauaccaaauauccugccagcacuuggcacugcuggcacagcaauugacaauugaaaauacaagggccacauuuacaacaccauuugauacaguauguguaggugcagaccaucccuauguaacaugaauaaacugccuaggagugguguugacaaguacaggaguggauuuuaaaaauuaggaaaauagaacauguaaacacaaacuuugauuugucuuaaaugggauagcauugaaaaauaucugcuuauuugaaaauaaugugugauaguaaaauuucaauaaaaauuuuuaaaauaaguauugaaugcuugccuaucagguauaaggcccagaguucaauaucccacacugaggugcgguguggaugggacuggaggaagucagaauacagaauaagccuuaaaacauuuucugguauacauuucuaaaaacccaguguauaugccaccgacugaguuacaucccuaacccaagacauccucagucagugcuaaaaacaaaaguuaaaagucgguaaaagccguuuuguuguuauuguuguuuaagauaagauuuauuuuauguguaugaguguuucccucacauacuuuguacuggcugaugaucaauggucaccgacaguucuuuaaugucuuucuaaucagagauauuugacuucaucucaggugguuccccuuucucagcgaagcgguguucucgaguggugcacaggaaccguuccuauuggugaauaucuuguuaacagcgaagacggugcacauagaagauacaggccaaaugauuucagugccaaucagugccaaaagaaaaugauggugagucggaagguucuucagucuuucacauugccaccugauguuauaaaauauaagauacauaaccucaugaggugauuguugacgauaauaaguaaaaacaagauguaaacuuaacaagaugagugcaugugugaauagaacagggcuguuuuuaaacaguaugaagagaggaggcaugugucguuacagaccacauaagcuugggcuuaaggagggauaggugaggcuggaguuguaaucgacccaaaaagcauagguuugcuguaaaauguuuacaagcauguauccuguaggugaagagagaccccugugaagaaucagggugucagauuuacuuuuuagggggagggcagcauugagccagagucucucuaauacuggcuguccuggagcucaggauguagaccaggcuggcuuggaacucagagauccaccugccucugacucuugagugcuaggauuaaaagcauggaucaucaugccuggcuucagauuuacauuuuaggaagauaauucugacaguaacguauguugugguuuugagaaaacagauuagggguauuauuugaauuaagacuaauuaauguuaugaaugaagaauuguggguaaauaagaaauacguuaaagaggcaagacugauagaauuugauugauuagaagugauaauauacucguagagaaagaugugaggaaaauacaagguccuucugaauagagcuugagucacucagaaaugaagucagcagucaacaaacaggaucaugugaaaugaaaaggcaucuuuacagcaaaggaaugagguaaucaaauguaaaggcggcuuccagaaugggggaaagucuuugccagcucuguauccaacagaaguuuaauagcuagauaagcaaagaacuuauaaaaaaaauaagaaaacacaugaccaaaucaauaaauaggcuaaaaaaugaacaguuagaaaggcaaagucugaaccaaccugugaauacgaguguucuacuucacuagacauugagaugcucuccuacccaagucagauugacaaagaaggagccugaagggauggcucaguggguaaaaagguuccugcugcuaagccugaccaccugaguucaaaucccaggagccaggugguggaagucaagcgccaaccgcacaggcucugcucugacugacacaugugcacugcgguacgugcauccccagcacccacacacacacaguaaagaaaauaacugggcgggagagauggcuucgagguugagcguacuugauacucuugcagaggaccuggguucaauucucagugcaugcaugguggcucacaaccaucuucaaccccauuccaggggcuccgacggggucccgaaugcugcacacacaugcaugcaggcagagcaucccuacacuuaguaaacuaaacuaaaccuaaagugaguaaugaacgcaacaaaugcuagcacagaugcccuuauauccugcugcugcugcuguaaaccaguccagccaccguggacguuaauguggagguuucuugaaaaccuaaaaacacaucuuccauaucacccagcuguacuguuccuguaccugaagguuucccagguagucaugguaucuaaauucuagaggcagucuaggugucaggcaauaggaaucaauaaggaaaauggaaauuuuuuaaagguuuaaaaagaaugaaguuacauuguuugcagaaaaauagaugcagcuggaaauaauaauacuaaguuaauuaaacaggcauuauguauaauuuuucaaauuuguaguuccuagauuuuaaaaacaauauguauauauagaaugaaagagagcagaacuguaauuuuuucaggauucaaagcgggggaggguaacaagugagaaaaaaagagaggaagcaggcuggggaguauacucgguacacaucuauaccuggaugaaguucuaugaaguagacaagaacaguguccggaagguguguucuucccagguuucuggaccacgaggcuagcugcgguguuuggauuuggaugcugagugggaaaugaggugggacuucaucacucagguuaacggaggugucugggccaggucaacacaccauccucagauggauggacaccgagcccacugaaguugguaaacucggcuucaggaacguaauccauggaggggcucuagaggacagaagucugaugccuccaucccgucacaguucuuaccccugcccugagauuacugggagauuauugggagcgcuucuggcauuucccaugccauuucuccaaaugauaagaaccuucaaauuagaauuuaguuaaaaagcguuccaacagagaggguccucagucgauuaucacuuggauuaaugguuuuccugaccagauugcuaauuucuugugaguagagugucuuucucaccuuuuauugccccuauaaucuauuagcuguuucguguacauguaaaagcauuguggaugcuagcugaaugaugugagcauacuacugaaaaaaauguuauaaauguucuguuuaaaggaagugcagaagaagucuuuugaagagaaauaugauaccuucaugacgauuugccaaaacuuugaaccaguuuuccguuacuucugcauggaaaaauucuuggacccagcuguuugguuugagaaacgauuggcauauacacgcaguguggccacaucuucuaucgguaauccuguagaaaauacauauugaucacauuacugcuucugucucacaaggagaugguaguggcaaugguaguuguuacucaaacuguccucacaaggagaccauguguuugcucaugcuaauuguuagcuugcaaccauuguuucagaggagaacucuacucugagguagagaaauagaaccaguuuggguuuaguuuuuaguauagugaaugugauuuauuuucucuccccucaauauacauuuuuugagauuuucuuuggaaaauuaaaccuuugguauugccauuugacuucuuagucuucuguacaaaaccacugauuuguucugcuuacuagaaucucagaacagaaauugugauauguguuuagauacuugauauacaacauauguuuugccuuuuuaacuuugugugagauuggaauaaaguuaguauaaagccauuaacaagaugcuggaacgugagaacugacagaaacguggagacuauccuguuaauucauagcuaaagcaguuccuucugccacugcuaugcuguauguagagcagcagggcaggcuuaggcgaggccucagugcuugugggagccucuucuuccaugaaaaucaucauuuggauuaaaggggcuuggguuuauagacaagaaagcaggcucagcuaacaaugaggccagucagacaugguggcauccuuacucccuaccccaugguuuuucuguaacacugcaugcuuucucuuaccagguuaaagguacuucaaggcaugccauuaucugucuuaaaaaauagaagugcaguucugccugcacaggcaccuggugaaauaaaguagcgaucaguuuccagucagcuuaguuuaucaggcagaggaaagucucacuguugaaugaugaaguuaccaaucccugcaucucuugguuuguaaggauacuuaauaaaaaucuugaguguacugcacugacccagguaaauuagggucuccagccuuaaccacacuaacuucagagaaaaucuaugcuuuuuuuuuuuuuuguaaagagaaaauauuuuuagcagcacaucuauuuguaaaauguaaugugccuuaaagaaccuggcuagauuugacuuaaacccuacacacuauucacuguauauaguuuccuuuaaguagcuuuaaagucuaaacuacguaaacauugcauagagucagugauacuaguugagauuguaguuggcuguguauuagagauuucacaugguugguuuuggguuuuuuucucuagucgguuacauccuuggacuuggcgacaggcacguacagaauaucuugauaaacgagcagucggcagagcuugugcacauagaccugggugaguaaugaaagaugcggaucuuucauuaauauuuugucaucagacaguucggaugucagcguguuacaaauaugaggaggucagacacaucagcaggaaaauacaacaagauuuuucuguaagugucagcaccagaggugagggaguggcugcaucuaccugugacagugaguaaaugucacuguaagauuggauggcaguugagucaaguucucaagacaagaaggaagggugacugagaagguggagaucuagaaaaugaggagggcugacuagcagccuugcuagaggagccuugccaguaauuaaguagcuugaggcagagcgcaguaguagacugaagagaugggcuacaggguuuucacuuuuaaucuguuggauggugggaagugaaaaauauuuaaccagcagacagugguguuuggauuuuagguaauuuucugagcgauuuggaccaggaaguugagagagaaaaugagaguguggacaugaaaugacgguugggacuagcguugggacaaggagcuuggauuugaggccguuuuuguaguaagcccaugccauugaagucaguggcacagagugggaggaggauuccagacauccaaagcaucuaacaaaggaauacagcagaucucauagacaacuaaaagacaaugaguuuugcacauuucaaaacauuagagagcuuuccggauagcagcagcagcucaauacacaagagagagauuggaugucauggccagcccagcucaucaguaguacaggcggcugcagccacugggcuggggcagacucugaucucacacugacacguuagcaaugcuaggacugaaaaacuaaaccagugugggcuuuguagcucaugacuauaaucccagcacuuaaaagacugaggcaggaggauugcugagaguucaaagacagcuuaggcuauauagggaguuucagaucagucugggcuacgaaaugagacacacacacacauacacacacuguuacuuucugggcuuuacaauguccauauucugacugugcuacuguacaaugguuuuccacugcagugggggaaauggguagaaaguauguagggugaucuuugugcaugaaaaucaguauaugagucuguaucucagaacuuuuuuuuauuaauuaaaaauguuuuaaaauguugguacauaagucuucuacauuuuaaccauaccaguuauccaguuuuaaaaucauccuuuaaugugccucccuucgccaaguagcuguuacuuuugcguuugguguggcucucaucgaugaugaagcugagauacgcagggaaagcaacaacaggauuauguauuuuuucaaucauccaggacuaauagagcaugaguaccagaugguuggcugccuuuccagaguuagcauggacuuacagagacagcgugucagcccgucagacucgcuugccucacgucucuuuuauuuuaggaguggcuuuugaacaggggaagauccuucccacuccagaaacaguuccuuuuagacucagcagagauauuguggacgggaugggcaucaccgguguggaaggugucuucagaagguaagggagggaaagcaugcaguguuugcuaucagaacuauucagcuaguagauuuaaagagaugaugcacagagacccuuggcacgggccaccuugguguuaauucagcaugacaucguguggucauaccugaccuccucuggaagaggcccacuuuuaugcuguuacucagucuuagcugacucacucuggucuuuugcugucuuauugaugcucaugguuggggguauuaaaaagguggugguuauuuugucugaaaaaaaacauguuucuauaucauguuuggcuggguauaacuuccaguccuuguaguucccccaguaaagguccacaaucucagcucggcaaaguaaauuaauacucgccucaguaaucaagacaaugaguauuucauaggaguacugucuuccuuguaagugcugagcuuaggagacacacacacacacacacacacacacacacacacacacacacacgugcaucuguauauauuuauaucaauuucuggagcaucucuuaaaugucuuagcgguccugcucuuugaaauacaauauggggaauugcuagcaagaauccucuaaguauguauuccuaagugcauauaggcaaagaagggcugaaauaccagcgucuacagaauccauaccuguaauguuuccccucgcaggugcugugaaaaaacgauggaaguuaugcggaguucucaggaaacccugcugaccauuguagagguaaagcgugcacagggcaucugcauuccuuugccaucggccugcucauagagagucacucaucugaagagcauugcuguauuucauguagagugggucucgggcagcagcagaaaggggaacagugagcaccuucauacaucagagucugggguuggaaauggcucuaguccccucauguuucuuggaaauaucauacauuguuaaguaaucuccaaucuuuacgaaauuaaugagcacuuuggcaucuuagacaucccacgugggccugaagaugacucagcuggcaaagugcuugccccaccagcaugaggaccugaguuuggauccccagaacccaugucaaaaccuggccuaguggugcaugcuuauagucccagcacuggggacgcagagcuggggcaaccucugggacucuuggccagcaaggcuagccaaaucagugaguuuccauucaaugauagacacugucucaaaaaauaaagaagaaaggugguugaagaaagcaccuggcauuaaccucugguuuacacacgcacgcacgugugcacgcgauuaugugcguacacauauagauaugucuguaugccucuuggauaguuugagauugguuuccgugaagaaaaaucaguaauaaguaucacuuucccuacaaaucucagagcuaguuuagauagaaaucagaguaucagucuuguuaguggcaagcguaacugaagagggagauuugcugcugaggcuccugccgggccuaguugcuuugggacaacucaccugaauggagcuguggcuguguacagguuuaaauccaguucgucauuucagcuugacccaagacagagagggaagaaagucugcaacgcuugcaacauuaauucuucccaagaauuaaugaauuguguggugcuggcagucaucugcaaccugguaagggugugugaaauaagagcucagcuguuuccugcacagggaaauacaugcaggaaguagagugcaggccugacuggcugcgcacagugucgucugcacuguuucuaaagaguagguguuaacuguguucagaccagauuccuagggaugcagcaggacccuguguuuuguagaugacucuuccugugcaggcacgguuaagagccauucauaucucacuggcacuauuaaguccgugauaacaagagccgagcugugucuuuuagaugacucaauaaacagucugccgcaguggucugagugaggggacugcaacugagaaauuauuucugucuccaccuacgaugccuguaucacuuuagaaccauccccacccccaccccaccgaccagccacacacacacagaauucuguauugccuucgguaaaucaguccaaauuucugacagccaguuguuuuuccuucaaacaguuaccuguucacuguugguugugacuaguauuacuucaugaugugguuacuauuguuuuuaacuacauaauuaaaaggcacgcuguuuuguuuuuucuauuuagguucuuuuguacgauccacucuuugauuggacuaugaauccuuuaaaagcucuguaucuacagcagagaccagaagaugaguccgaccuccauuccacccccaaugcagaugaucaagaaugcaaacaaagucuuaggugggauauuucaggaaggaccuguuguuacuuagauuuucuuguucccaggcccuccaugguugcaccucauuguaaucuuuguguucuuuuaucauuagugauacugaccagaguuucaacaaaguagcugagcgugucuugaugagacugcaagagaaacugaaaggcguggaggaaggcacugugcucaguguggguggacaggugaacuugcuuauccagcaggccauggaucccaaaaaucucagccgacucuucccaggauggaaagcuugggugugaccuucacccuuaaacucgaacuucagaaaugacaucucacccaccauauuuggacaggaauuacuuaagugaauaacugcuuuugauccaauuuucuacuugacugaucaccaccuaaauauuaguauuucuacucucuucuguuagagguaauggucacucaagauccauucguaggauacgugcugacucuuaggucaugcuugugcuacugcagcaagaccgccgcauacacacugaacugcaaauggugggggcagcagagugagcuuuacugcugguguacaugaagacaaguucguaacuucugcucuaaaacaaccuuuaauuaaagcauguuuuccagacugugugugugugugugugugugugugugugugugagagagcaugucacacacauuaaguaaugaagugcuuaauaauacuuuucaaaagggacucuuuaaaauuguaacuaucacuauaucaugggaaucccucauuagaaugaauguagguagggcuggaguguggcucagugggagaacaugugccuaaccuguaggaggccccauauucagaccagaauugcagauucaagagaaaaaaaaaaaaauagagcauguugaaagcaagcaguauaaguugagccuucuuaauucuuaaguccaaaacaugagacauuuucauguugaaaacuuucugacauauugggcucauuuuagacuugcacauuauauuaggcacacagcuagucuuagcucgcugucugcaugaaugcuucccaaccuggaaacgucuaaaacugaaagcaacucucagcacacauacacacacucacaacaauaaaguaaacaacuuuuuuacaaagggaaaaguagauugcauaguuucagcuaugugcccuggaacuaacagauccaccuccuggggccucccaaggugcggaaggaaggucgguguuaaaggugugccacaccauauuccacuuuauuaauguuccaaguccuggucugucacuaaccaucuuuaaacaccgcauugggaucgucuuguuaaggcaagggcugggugggcgguugguuguauuguugauucuugucucgggggcugauuggucauuuugucauuuugaaaggugugcucacucauacacacaagcacacaccgugugugggaauccagaguggcuugguuaagagggguucuuccagauaguuugcuucuguuucacccucagggauuuuacugacauuucuuggcuccggagcuuuagaucucaggaguaguguagauucccgagagcagcagagucuuucaggccgcaguagaccuguucucucuaaucuguaugcuaaugggcauaauguugaauugaugccccuuaaaaugaaagcucgaccugugucucacugugguggcaggguaaagggagauggcauuuaaugcuucucuugugcuguuugcaagccuaauaccacacgugugugugugugugugugugugugugugugugugugugugugugugugugugugugugugauuuguauuguauauacaaagccaaacuacucuuuugguuucuguaaacugcuaugaaacuguucugcauuucagcuuucuuguguauuuuguaagaauuguuaaauggauauuuggcaucugcuugacugcaguaaaucaggcggauguaaugaacuuagaaugucuguaagcaaguguugaugucuucauggauggaggaagaaaauuagcuaaugaugucuagcuaaaugaauuuguaauuuguuuuuguaguuaauccacugaagagguuggaauaguugauccauucuucacccuugaauaauauucuguuaacagaauauauucagauuucuucaguggcuuugauaaaucuaugucaaaauuuuucagauaaacccagaagcugcuacuugaaaggugaaaaagacugaguuagaaaaucuuucugacagguuugagugagacgggcuguuaccaggagcccaugagugauaguuagauuuauagguuacuaagaaucagguauuuucuuuaugcugaguaccugacaugucuaucagcagcaccucugauucuuacaacaaaacuuuguaauauuccugacggugccacagauuaucuggagaaaaauuacuugccugaggacagaagacauugcacauguguuccucacagaagcugcuagaaaagaaggaggcagcaugucugucugucugcaguaaaggaggcagcacuccucuuccagcccuaugcugcuguaccccucaaaugguccccagucagguccuaaggcuaaggucaucauagcguucaauuaaaacagggaaaaaagggugugucccuagaaauccaucucaacuuuagaugugauaaaaggaauaaacgcaaaaaggaacuuagagcaccuuaagguuuauaauaacugucuuucuuuuuaaguagaaggucaguaugaaauagaaaaugugccauaucaaauguuuuaguugcaccuuaguaaaauuauguauguuauguagauuuguuuagugcuaguaaauguuuuucaguuaugcuguuuccugaauuaucaguuuguuuuaaauaaagaacuguggaaguauaugcugacuaua

SEQ ID NO: 12439 - RNA, 161763 nt, Mus musculus
gccccccucgcucuaccgugaggagcccgagucggcggcggguggcggcgccuggaaccuggagagaccgagccaccccccggcucucggccggaauguacugauucuccucugcucuccuccccgccccgcugcaggagggaggcgcccggagucuuucccccugggcgcgcgagggggccgcgcgggccgggccgggccgggcuggagccgagcccugcggcgcagagaccggcugaggcgcgcugagggaagggcgcgagcgcuccgcggcgcuaucgccgccgccgccgccgccacucgugggguagagauggcggcggagcgcgaagccgggcgacuccucugcaccuccuccucccggcgcugcuguccgccaccgccgcugcugcuguugcugccgcugcugcugcugcucggacgcccggcguccggcgccgcggccacgaagagcggcuccccgccgcaguccgcagguaagucgggccgggcccgggacgccgugggggcuggggcgcggcaccggcucccguggccgcugcgguggguuuuuguuguuguuuaggauccagaggggaacgugcgggaacuuuuccuccucggcucccguugcuggagagaaaagggucucgcgugguggaaagcggagcaggcaggagggguuccuaccgggggaggggcgccuccgggauccgggccggagcucugggguccaguucugcgcuuuguaccgggaggcagguucaccccucgccucuuuccccucccccaggcucaucccacuuguaagagugggacauucuugugcucacacaagcaccaguagaggccacuacacaccucauuagauaaacaaucguacagccaauucauuaauuuucaggaagggauggaggagggggcuugaauucauucucuucacccuccaucccccucggccauggguugcccagcuucugaaguccagggaagcgcugucggaucucgagggacucuucgcucagugauuggagccugggucuucaggagagggggugcuaaggggcauacuagccccuucaugaucagaucagugguguugacuuagccuuguggacgccuuggagagcggcuccaagugauucugugaaguagugccucuuuacuagggauuuaacuauauuucuauguaacccacucucaacuucugaaaaauuucagacaucggauuuuuaaggauuugucuaauugucucuaugugacuauauauguauauguguguguauacacacacacacacacacauacacauauauacacauauauguguauauauauucagcaucuuuuuuuuuucuguguguuucaugcauuccuggagucaccagcauucuuacauauuuaagggugccaauugacacaucgccaagccucugauaguugagcaggguucacucggcucuugaagagcaaauugacaugugcuuugcuaaccucguuuaccuaagguggugugccauauaacuugaagaaacuuucacucacuuuguggagauuuagauuuuuaauacgaaggucaccugaucagacacaauggcaacuuguaauugcuaaaccaaaaacguguuucccucugauuguuaugaaaucauuaaaaucacuucgaaaugugauuugcugauaaaguuuguuauuuugcauuuuguguguauguguauagagcucacaacuugccaguguuaacaguuuuaaacccacacuaguauauauuauuuaagcugcuaaacaggaguguuaauguuaaguuaggaucacugaugugauaggcauuugcacauuuaucuuguacaaaguuuggggcacaguuuucagaccuucaguguaaguaccugaauaguuucuuuucaugggaaugggaaagagaaauguauaaauuuuggaaaacaaguuccucuuuuuuuuuuaaauuucuuaugaaaauuuauauacagcugauuguauguguauuugaggucauagcuggaguuuguguuuaaaguuuuggcagagacuuuuuaaaguuaacaaaagcuuaaacaaugcuagaauuuagaaauuuguuuuacauuuuauuauucugucugucugucugucugucaugcguguguguuugugccugugccauggcaugcugugugcuagucagaggacaucuucggaggagucacuacucuuuccagcaugcagguccuggggagugaacucagcuccucaggcuuggaggcccauuaaagcagucacuuagaaagggaucuuaacgucugcuuuagcaugaauucaaucagugagguuuuauuuugcaaugaugagaugggagacauuugcucucugccuuuauggaguuggcaguccagcauguagguagggaccauagcugcucagcuagaauuacauaguuaagugauugugauaagcacugcaaaauagaguagguuuugaggaagugugagcuggcgugauuuaccuagucagugccagaguucucgaucugagauggugauggguggagguuaguuagaaggcucacaguuaauuaguaguggauagagucuagagcacaggucugauucucccucauaggccuuuuuauuuucauuccaaaauauuuucuguugaccccucugucucauuacaaaaaugauaaaaaaaaaaaaaaaaaucacugcagugagcaggggcugaucuguuccguccugagcugugggaagagaucaggagauggagagcugagucagcagucuugggucaggcugucuguaaaucagauaucauuuguuaguauugcuuauuuugaagacgauaaauuugacuuuuuuuuuugguaggagagagaugauauucaguaguaagagaaaaauagaugugugggaacagaacaaaugaguguucuacccucuuaggauggacauuuggacacguggaagaagaggaaaaagcaaaugagauuaugguagaaggugguuagcaguggggaggaugggaagugaguaagcacacagucaggcuaaacagcuuuguagugauccuugggggagacagauugacugagcacccugugaauugcaagugcucucaguugacauucuucauagaggaccccacacauucugacaggcauuuacuugacuugacacauuaccucauaagguggucuguuucuguuuuuaauaaugucuguuagaaaaccuugcuucacauugagagugauauucagucucccacucuugaguuuuagcucuucccucgccuuuaucaguaucagcaugcauagcuugacuuaguguuugcuuuccccaugguuucugcuuuuguuuuucacauuuucuuuuacucacuuaaauacugauuccuaauguugucuccuucuuuccugucuuuugacucuccugguucucuccccucucccucucucuauuugguagccucauugaugcagguccaaaggcagacucacauuugcuccucuuuccucuucuuccuccaucccucuuucucagugucagugaaccagucccuggccaggucucugacaugguuagagugguuagaaugauugcauggauuugacuuguaacaccugcuguaaccaucacuguccaagugcucuccugaauuaagaucuagaaaaccuuauucugguugaucuuugccuccuagggauuccuucugucuguaccuuuucaucuuuauccacaccugaacuagcaauagcaacacuguaauaaaucucuuugccucaacaguuauccuguaggugugucuuccuaucggagagauccuucugagcaacguuucuaaggguggaacucccacugaaaaugucuuacuaauaaguauuccauaguuccuuguucuaaaaauccuugggauggagauugugagauccugugcguucguuaacacucuccaccaaucccaguuuaaauuagucuccucucaucacuccuauguguacccuuuguucucccacuccagauuaauugcagagcuuucugccuucaggcuuuugcacaugcuguccuuuuuuuuuuuuuucccuguuaaagcuacaucguacuucuuuagcuccuaucuuaucggggaaacuuuuuuuuuuuuucuauuggcuucucccccagagaguuuaaugguugcuguucucccuguuccuguagcuuuuaaaauacuuuucauuuucuauuacuuauuuucuugucaccuuugauugucuuaaccucuggaggauuggcacuugacuuacuugucacuugacuuacuugucuuaauauccguguucuaucugacgcauccaugaggcuaguugugcuggcugguuaguuguuaacgugacaucagcuagagucaucuggaaagacaaaaaccucaguugagaaaaaugcuuccauuagauuggccuguaggcaacugugugugugugugugugugugugugucuugaauuuucucauauaagaaagcugucugagcaagccaugaggagcaagccaguaagcagcaugccuccauaggcuucaguuccugacucuaggcuccugcuuugaguucaugcccugacuucccuaacugauagauuaugaccuggaaauuguaagaugaaauuaauccuuuucuuccaaguuguuuuuguucauggugcuuaucacaguaauagaaacaacuaggaugcuagauaaccaguaaauguuuguugaguuauguuuggcuguuuuugaacugcugggccauagaacaugauuccuuuauauguuugcggacagauucauguguagggugugcaugugugacaguuguuccguucucuccccaucccucuucagccacucuuaacagauuuucugacccuuuaugaacuugaucauucucuuaaguacccugccauuuuaauauuugucaguuuugucauuuguagaaggauaauugacuuuuccugaguuguauagaaaagaagucauauauuuuugggguggugaaugcacauaagagauaagaaaugugcuccuuagcaaauugucugaaaauuaguauaucaugugagaugaagaaagaacuuucaugugaaagcaaggaauggguguaugacucaugguucuacagcuauaaguauauccauaaauuggggccacaggcaggcaagaacaguaccuuuccuaccuaaauggauugccaggaaaaugagaugugaaguugcuuauaaacuccauuauauuuguguagaauagacuuaauaguucuuguuuagcuuuagaaaugaaagugugauuuaguuuuuacuuuguaagauuuuauuuguguauguauuugugagggggaacggggagaaggggaagggagggcgaguguguguagaggacagaagacuacauuggaucgcucaauguaggugcugggaaucgaguuggguccuacaugagagcaguacuugcucuuaauugcagagccaucuuucuaguccuucccccucccccaaguuuuucuuuugucucaauugauuauuguuaguuuugccuuuuauauuuucucuauaucaagaaacauauuggggguuacaucaacacaucucuuuuaugaaggcucuguguaauagucuuuucccccagauacuuugauaagugauuuccauuuggugaguauggauacaauacuacagugcacccauaccaggagaacaguaggggcacugccuagagguguuguauccgucagagagcuggugagcugaguuugauuuaauugggaacacugucaagugaaauaugauuguaaaauggaggccaaauuuuggauuaauuuacaagaaagaguauuuugaucaaaaacauuuaugagacguugcuuuguaguugcugucuacuauaugacucauucuuuuacaucaugacugugagcuauguauaacuuuaaauguuuucccuaaauuuaauguguuucuuuuuuuuuugccacauuaucuuuaaaccauuuuauuuuuaagacuuauuuuaaaaauacauguuaguuugcaguuaacuguauagaauuguaaguuuaauuaaucucauuuuuaacaauuuuaaguauuuguagcaauuuuaaguauuuucuuuccuguauauguauauaguuuucuuuuuuagacauaagcagaauuauacaauuaauuauuuucagcauguauuuuuuuagucuuacuauuggagaucuuuccuaucagugcacauagauuuuuuuuucauaacuguuauuugagauagcuguguauuuuggaaaaugaguauaauacuuacaguggucaauaaaaguguuacuuauagaacagucaaaguguuugaggcuguguaccagucucuucuaucuguauuuuuguauugaauguaagaguaauguuauuguacaccaugcaaagacuguccuuguaucauucaaaugcugguuucucugccucugcugacuucuguguccaguuacaaucaaacauggcauuguaaugcuuuuauucuaagagucuccauguuguguaaauauugcuccccauuuauucccugauuugucaauaaaagcugauuagccaaugacugagcagggggagaauagggcugggcuuccuaucccagucagccaagggggagggaagggagagagaggaagaggaauaggaggagaagaaggagaaagaggagaaagaggaggaagagagauuugccaugaggaaagaguuggagaggcaccaugagaacacaucugaagcagagagagcaagaccacuacuaaaauacaaguauuaucuuggggauuuuggcugggagguagccagauuagcucagaggaauagaauagauuaauaacuuugauuucccauauauggguucauugcuaagaagauguuucuguguaucugcagggucaggguuuaugauuguuagcguuaauguggauggcaccauuccucgacugggauccuggucuguaguagaaaagggaacugagcgccauccugcauucucucuuccuuauuaugaauguuagguggucagcagcaccaaaaucuuaccacuugaauucucugccaugauggacugcaccuuugaacugugagccaaaauaaauccuuucuccaauaaguuguuuuaucaggguaucuuucucauagaacugggagaagaaguuaagucacaguuccauucacuguaguccacuacugguagguuaugcacuugaacaucccacugcugggauguagcugaaggccccuacuacaccacauacaaacaaaacaacaaaaccuauugaccaaaacauuuacaacuugucuaacauguuuuuaccuuuaauugugcauauuucauacuaaauuuuuaaaauuuuaguugcagauacuguagucuuuguuuugucuguuaguugguuaggaugcuagguuaguugguuaggauggaguggguuaauagauagucuaaagcguccuucuacuauguccuucuacucuuugucugcaguauauaacggagcaauggcuucaucucagcuaaaugacuuucauguaguuuuuguauuugaaaacuggugguuucugguuugaugugaaaauuaaccuuuugucauucucuaagacguaauuauauaucuuuuccuggucuaaaguaaggugugauugggaaaaucuuuucauugcuuauaaaugauuauaugugauuucauuuuauauguguaaaaauuagcuucaggguuggguucaugaaacacaagcucaguguuaaguagugaaacauuuaaguuauaguauuucuagaaauaauauuacuugaaugagcagguuuugcugccuuuucuaacgauguaguuuuauauuuuaauuuuugagacagggucucuuuauuuagccuagacuggccuuaagcuugucaucuccugcccugggcucccgagugcugcuggaauuauggacauauaugaacaaccaugucuaguuuauagauauuguugugauaaaaucaguguuugaauaauuuguuauaaggaguuagcaucuggguagucuucauauaagguuguaaguuuuaacauuuaaagguuagaaguaaccuuuaaaugauuuuauggcugagcuggagcucacucugugugccacucuggccuagaacuuaagagauccaccugccucccaagugcugggauuaaacuaccaccaucuaggucagcaagaauuuuuaguuuuucagucagacaguucuuccagagcuaaagauuuaaauacuuuuuacucauugcaaacacauaucuuugagccauacacucuggagauagauagguaagaugaaauggauguguucucuguguuuaggaagccuugggucuaauggcugagaugagacagguaauagguaacuugauuuggagcaaacacuauuuuugcuacagguggaaagcguucuggaaucacugugucagcgcugaucaagcgacagugcugcugcuuucagaacucuggaucuggaucuuuaguccuaguuuaggaagccagugaacagcagcucuccaguguaaauuacuuacucucucucucuuucuuucuuucuuucuuucuuuuuuuuuuuuuucaagacaggguuucucuguguaguccuggcuguccuggagcucacucuguagaccaggcuggccucgaacucagaaauccgccugccucugccucccaagugcugggauuaaaggcaugcgccaccacgcccggcuacuuuuuguuucuugagagugauuccugaaaugugugcauauaugaggaucucauaaaaaagucaccuggaguucaacuacuacagugucuuuuggauuauguaccacuguaugugugcaugugcaugugcgugugugugcaugugugcuguuaauacugagaguuagacuuguggcuuugcagguuggaugcagccugaaccuuucuucuauaaaucuggagacagauuguucuguuuguuuguuuguuuguuuuguuguuguuuuguuuuuccaugacugauuauuaguugacaauacuugguaaaaucuuacugaggguuccugagcagaauuuuaaaaauaauacuucauagaaauugaauagagacuguuuuucuguugcagaaugauauauaaaguauaguuaacaaaaugucauuacaguuaacaauucaggaauagaauaauaaauuguaaauuucauauaauuuuuaacauaacuaaauguaauaacuaaaauuugaacaucuuguuggcuaauucuugaaaacuugaaauuugagugugguaguuuuagauuuguguauuguguucaaggcacugugcacagacaugcuuugacaguggccuccuuuauaaauagcaccagaacuacauugaacucaaccuuuaugaucuucauguaacugaagaacaggacuaagggagguuuugaaguccaugcaucaugcaaguuucucagucccagaguucucccuuuugaucuuaccuuuauuauaagcacuuuuaacagucaggacaaucuaguuccaaaugcauagcugaccagaaguggggaggauugucuugggauguucuugaccacaggagagguggugagguccuguuuuuuuuucucuucugguuuuuauuucucuggccauggcauuuaucuuuauggacaacauugcuaaacccuauuguuaauuggaauuuuaauuuuuguguaaaguuaacuguugauuugacucuaauuuuuaaaaaaaauuauaaaaauuugaauaaauguauaaaauaaaaugugaaaucauacuccaggccuguccucagagguaauaacuuuuaauaaugcagauuuuacauuauauguguauaauuaaauacuuaagcaauacaucuauaacaaauggcaaguuggauuaugauguacguguuauuuaucgacuuguuuuaggaccucuuuuuuagaugagugcauuguaucauaguuguuugauagccauauggcauucuguuaauauagucuauuuuguuaauauagucuaaucgguuaaguuguuuucugaugcccccaaauuucugauuguuaacaaaugauauaaugagccuacguuuuauaaauguauauguuuauaucaaauaaguguggaaguauaagauagaacauuuauauuaaaaaucaucuuugauuauauauguguuucuauguauuaauuuuugguaguuauuugcaaaucauuuguuuaaaaguugauucuuagcaacaaaugagagagucuguuucucuacacccuugccuauaaaugauucauguccagacuucauaauuuuugccagcuugacagaugaaaacagaagugucucuauguaucuguuuauuuuguaugauguuugugaaugcugccccacauaugcugugguacucguguggaugccagagaacagccuuagguguuggucuuacuuuucuggcuugccuggugcaggauccuuuaguuguuugcagcugugcaugccaggcaggauggccugcaagccuuuuagguucuguuucuuguuuuccaucuugccuuaggagcacugggauuguagauguucauuacugcaccuccuggcuuucuguuuguuuugaggauuuaaagucagaauggcauucuugcacagugagagcuuuacccaucagcuaucuccccaacccuugguuuugcauuuacuaauagaauuagcaccuucucagguuuuaauugaugauuuauauugcuucugagaauuaucuauuuuuuguuuauuuuuguuuguuuuuuguuuucauauuuuccucccccucuucagaguuuaaugauagagcuguauguacguuuuuguuacaagggaaaauggaguuuccucuuuuggguccuuaguguugucacccaccaugaugugauguaguaaagggauuuuugcuagagucagcacugauuguuagcgaaauaaacuucuuuauaagccacccagcuucagguauuucauuaucaugaaacuaaaugaacuaaugcagagggcagggcauaauuucuauuuuggacacuuugaaccuaaaauuuaggucaguacaauguguuuguaacuauugcagaaccggagaucuggugagagguaugggauggcauuuauuuauuuauuuaagauuuacuuauuauauguaaguacacgcuguagcuaucuucagacacaccagaagagggcaucagaccucauuacagaugauugugagccaccaugugguuacugggaauugaacucaggaccucuggaagaacagucagugcucuuaacgucugagccaucucgccagcccugguccaggucuuauuagauaaagaugaucauaguuuaugucaugagaauagaucugcuuagaaagggggaaaacaacaucagcaacaaaauccaaccuggaguaaauacuuaggaaagcaucaguaguuggguuuacaaagaaaggaaaacaugcuauguuugcagcgauuaguaccaaagcagggugagugccuagaauagggacagggucacacauagagcuuuacuucaccuacagagagguucuuauuuuguuuuguuuuugagaaauaucuguauaaauaaguggacuagugcuaaaauaauguuaguucuuuuucuaaacucuguagucacauucuuggccucagaguuugagugcuaggcaagaagagugaagguuacaaggacuauacugguaaauucuuuacauuaaaugacaguuauaacaacuuaccacccacccuguugugcugagguaaacaaugaguugauauauaugguguuuaggacagagccugguuaucuuaaucgcccauuaaacauaaacuguuguuccuguuguuuuguucuauacuagauugagagguuaucgaaaaagacaugaaaguuagauaacacugauguagccugguuuauguuuuuaucugauggcuuugugcaauuagacuguuaagugaguguguuugugauggggaggauaagcauuuguuuauucuuggguggucagcuggcucucaggaucggagcugagagugagauggaggguaacggcaaaaagagcaaaauacuacugagcagcaaauuaaucucccucccucccucccucccucccucccucccuccuuuccucccucccucccucccuuucuuuuuuauuuuuugagacagaguuucaaucaggccugggauucacauuguagcccaaacaaggcuugaaccuggcguuccuucugccucgguguucccugugcuggguuuacagacaugagacaccaccacacaggcauacccacccuggggccuucuugugaccuaggauaacaguagauucaaaacaaaaauuguaaauuuucuuuaacauuagauuuuuguuguugauuuuuguuguuuuuguugucauauuaguguuucugaagugugaguuuuacagaugacaguguccuguugcaaagccaaaaguugacacaugccuauaaucauuuuugaaaaguuuauuuuuauuauaaaaguguaucauuuguuacguaauggauagguaguuauucagugaaaccauagcaguaaccuuuaaagauugaccuguuauguauguaggaaaagaaauuggagauagugcugguagcuguuuuuaaaaccuggaguuuuagccuuaucuguguccugcugaauaauagggaaaacagcuuguucacuuggcacucucccuccucucccccccccaugguuaaauuauuauuucuacuuaaaguagauguaugguauggcuucucuguauuuaguguauuuuucuuuugcauuugugaaccuauuuuaagguaggagaaguuuucuucuuucauugcuuguacuuuaauuucuuucuugaguuccaaagguaaaguguacccccccgcccccguucucuaugguacuuuauguagccuuuuauugugucaguuuuuuauuuuuauuuuuggagauuuuauuacuaacugcauacaaauuuguaauugucucuagugaguaaauacaucauuaggaaguuauucaucuacuuuugucaaguguuuuuuuuuuuaaauaagauuuacuuuuauuuuauguauaugaguguuuuaucuacacguguguaaguguacuguaugcaugccuaaugccuacagagaccagaagagggugcugaauucuaucuagcugaaguuacaggugguugugagucaguaugcagaugcugagaaaggaacccaugccuucugcaagagcagcaagugcucuuacuugcugagccagccaucuuuccagcuccucuagcucuguuuuaguguuaaauaauuauauuuaucgucaaauuugguauaggcuugguuuugcuguauaaguaguauguaguuaaauguuuuuauuuuuuauuuaauguaauauuuuaguuuuuauuuaauguaauaguugauauuuuagccuuuagucuuucauuucauuauuuaauaaacccccugcucauuguauauucuuucuggaucuucuuccuuuuauaaaauuuacuuguguguauaccuguguacgugugagugugagugaguguguguguguggggggguguggggugugguguguuuugaugugucuuugcauguacacguaugugaugcauauguggacauuaccagauaacuuuuguagcucucucguuauacuuucauguuuacuuugagggucaaauucagguugccaggguuacacugcaaacucuuuacuaggcuaagccauuucuccagccuccuccucuucuuccuccuccuccuccucccuuucucuuccuccucuuucucuucuuccucuuccucuucaccuccucuuccuccuugguccuuuuuaguuacuuuucucucuuguaacugccaacuguuacucuuuuacuguuuauuucaaugguuccaaaaacaucuucaacucguacugaacauaauuucuuagacagugaaaacucuauaauaauuugcacuucccuuuuaauuuuuguuauuuuuguauauuuuauuucuuauauugcauuuaauaagacaucacuauuauuaaauaaaucauuuauuuagauuuacucauaugcuuuucucuuucucucucucuuuuuuuuuuuuacuugucugggcuucuaucugggauuauuuccuggagaauauccuguaguauuuaguuaggucugcuggagauggagucucuuagcuucugucugucuuaaaauacuuguaauuauuucuuuauguuguuagagauuggaugguaguguuuucuuuuucuuuccuuuuuuuuccuuccaucauuaaaguaugccauuuuguuguuuguuuguuguugacuuuagcucucuguugagaagucagguauguguaguuuuuccuccuggauaauaugcuuauucucccucuaucagccucucuuaaaauuugccccuuaauaugacugccagaaauuugacccugagauuucugguugugguguucuuugcauuuauguguugcuggacuucuggaagcugugagaugaccacuuuuaucagcuguggaaaguuucuggcagaucucuucaaauacugucucauuggaauuaguucuguucuguucuguucuguucuuuucuuuucuuuccuuccuuccuuccuuccuuccuuccuuucuuucuuuuuuuuuuuuuuguacugucaucucugacaaguucagaacagcucuaguuuuguauuguauaguuguuagguuaagaacaacaguuucuuaagacucaguguucuuaucagagacagcacuuccauuuguugaguuuuuaaauuuauuuuuuguguuuucauuucuagaauucuauuaugucuuauaguuuccaaauuucugcuuguaguuuuauuacuuuaguccuuucucuuauaugucucugcaggugagugguggggcgugcuuuuauaauuugugguuuuugaguuaguuuugucuauucauguuugaucgaauggcagguauugaauaaaaaaaaauuaucgagguuaucugaauggcauugucaccucuagaaaggucucccuuugguaaacgcugaugcuagaggagcuaacaacuucagaucauuucaauuuguucagggacugagauaguuuagcauugggcuuuguccuaugaacugaaguacauuagguuugccuuugcuucauagucacagugcuuugagguucuaagccucaguuuaagggguuuacccuucuuucuagcaggucuucucccuggagagauggcucacaggguaagagcuuguuguucaaacucaaggaccugaguuuggauucauagaauucacauuaaguaagaaaaagugggugcauauaaccucaccaauaugggagaauggaggcaggaggaucauuagaucuugauggccaccagccuagcuccagguuuagugagagacucagagauaaucagggaaauuaggcagagauugauagaacaggacaguugacauccuccuuuggcauccacacacccaggacaagcucacauguguguguguguguguguguguguguguauaccauauacacucauuaauuuagcucacuuaaaccucuuuaagcaguagucuuuaaaugugcuaauuaugcaucagcaguaacuacuguugauugacuugaauuuuguagacuaaugauagaaaauagcaagugaaggaugccccuuccuauaauauuguuuaauucaccaugucaacaaaucucucccugcagccuacuaagccuuuucuuuaauuaaguaucugauuuacacugcagauuuuauucauucgaggauucaguucuuguuuaaacagauaagguuagcagcucagguuuguuuaaaauacauuguaaauacaaccagaguuuuaccuggggcaguucacuuuuagacugcguuguguuuagaaggcaagcacuuuuguaaccaguuucuagcauaggcugguuaucuaguuuguucaucuuaagauuaugaaauccucuuguuucucacuccauuuagaucuacuccccuggccaguuuagguuacucuaaacucuuacauaagauaaggagaagaaaagcaacagauagagauaaauuagugaguaaugugaagugcuucuauuuauuucuuuuuucuaacauugaguuucugugcucccauggacugucaaagauaaccaugauguaauauuaaguacaauaaaaugaguucuugauguucgaagauacccucaucuuauuuagauuauggagccaguuaauaguuugggcaaauguagagacugccauagccagggauccaccccauaaucaacauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaauaguuugggcaaauagaacuuuauugucaugucugaguuaguguggucacaugguacccacagcucucucaacauaacucaccuucuuucuucuacuugucacugcccauaucacuuugcaaacauuugaaauacagcugaugugacugggguaagaagccagaugagaaauuaguuauacacgccauucuaaguagcagccauagcuuuuuuuuuuuuuuuaaucuuuguuagucucauugucuaccacauugacugacauguguucagaaacauuuuguuuuacaaagacauuuuuuuuccagugcuggacauugaacccagagucuuguguuugcuuggcaggccucuaacucugagcuacauuucuauccuagccuucagcauuuuguuuuuaaaugaaagacuaccucaaaauuacagucauaggagaagcauuugacucaucuuccugucuuuauagaacagucagguuuauguccaagaccagcaauuuaaguuccuaugaauugcuuggcuuaauuauucuuuagauaauacaaagagguggguaaguauaauauacaauaaacccagcaaacagcuuccuagcaaacagcugucauuggggaaauggcaaggaauauaugguaguauguguuuuuguuuuacauuuggugucuauguuugcugaguggugugcuguagcauauauugaaucauauaagacauaauuuuguucuuaaggaauuuggaacagagacuaaaggaauaaucauccagagacugcccuaccuggggauccaucccauauacagucaccaaacccagacacuauggcagaugccaacaaguguuugccgacaggaaccugauauagcugucuacugagaggcucugccagugccugacaaauacagaaguggauucucacagccauccauuggaccgagcacaggguccccaaugaaggagcuagagaaaggacccaaggagcugaagggguuugcagcccccuaggaggaacaacaauaugaacuaaccaguaucccagaguucccagggacuaaaccaccaaccaaagaauacacauggugggacucauggcucuagcugcauauguagcaaaggauauccuagucggucaucagugggaggagaggcccuugguccuaugaaggcucaaugccccaguguaggggaaugccagggccaagaagcaggaguggguggguuggugagcagggagaggugggaggggauagggggguuucggaggggaaagcaggaaaggggucaacauuugaaauguaaauaaagaaaauauuuaauaaaaaaaagacucagaaauaaaucuauacucaaaaaaaaaaaaaaaagaauuacuaucaguacauugcaugauaagaugccaaauaaggugcauacuuuuccaagcaccagcuuuguaaaauuaaaacagucaauacucagggcccagcguuagaaagguaugcaguuuucaguucuucaggauguaugugcagacugaguuggggaaacuguccagaauacauacugaugauuucuuucccuuugacugagcagaaugugagcuucuccguguaaacugcaugaacauugagccuguugauuucuuuuauaucagacugugucaugucaucagcuaagaaguuuuccaaguaaauuuuauguacugguacuggccuguuguggaaauauuuagugugucugcgcgcgcuuuuuguuuuuaauuauugagggauaucuguuuaucccuuccuugggaucuuaaagauugcaaaggauaaguccuuugguuguuucuuguguauauuucuaacuucuguuaaguuccagagcaguccuuuucuguugauaacuggggaacccuuuccaggaaggccggucucacacuuacuuugccgugagugaggcugacacuuucuccucucuuacagcuuuucugggauucagaggggccaugcuguguuuuacagggaacuguguuuuauuagcucguuguucccucuucagaucauguuguaagauggaauagcaucugggaaagaacucagcuaucagaagugcagaaacgauuuuuguaaggauuaagaaagaggaaaacuugggaggguccaugacagcuagucucuuacaucagcagagaaguguagagucacauuuucagucuguuauaacuucauuuuaauuggcugcauuaaaaacacacacacacagacacacacacacacacacacacacacacacacacacacacacacacaaauuaaacuagcaguuaugcucuuucuuuauuucuccucaauguuggcaguauaaagcuuuguucagagaacaugaacaagcagguacaaggacacuuaugugaaugaagcucugccuagcugagugacuugccuugauuuaaaauauggcccuuggcaacuucaaauaguuuguuuucucagagggaaaaguucagauuauuuauccauguuuaguaaaaacuauuaugauucucuaguagggaauacucuccgauucauuuauugauuaaauaaacauuuaucgaauaguuacuguguguaaggcacugcuaggugaugagagaaauaagagcuaauuuaauaaaguauguaccauguguaaaaacaauaaaaaugcuguguagaaagugauggguguuguaaaagaauauagagugcuuugggaauuaaaaguagacauuucuucuugacaggguaagucaaaguaaacuuuccgggaugguaggauugagcaaguccuggaggccaugauaagaaaugguucuuaaaagguuuagguacaguagauuccugugcaauggcaugggcaacuacugacuguauuuauccuguguugcuuugcauuaagguacaguugguuauaauuuccucauuucauuuugcaaaucucaucuuuuuuuuuuuuuuuuucaacuugcuaguaguacuagaaguccuaaguuagaagagggaagaucuuaggcuaguugguuaaccucucuguguuuucuuucucauguguaaagcacuaugugccagggacuuaugaagaguguuaacauagccagccagggugguaguuuacauugguaauccaagcacuugagaagcagcgacagaacaauugccacaagucugaggcccgccugguguguacauagugaguucuaggccacucagggcuauggaagacauuauccuuuuuuuuuuuuuuuuaauuuuuuuaaaguguguguuauauguaauaagucauuuauuugugguuauauucccaguaaguuacuagcaagaauuugaaaacaggccagaauuauaaaguacuaaacuguguaguauuuuccuuccuagaguuccuuugaucuccaaagugcaguagcucuuguccuaucuguguacuuaaagcugcuuccccuauucuaaggagaaaggaaaacagaagugcuaugguagagugcccuaacugacuugguuuuaagcuauuauugcuacuggucauuuagcgugcuacccuuugcuccaaagaacagagguuuuacagugaagagcuggcaugcauuguaagcuguuaugucauacaguagaccuauguuggucaacuuagaaguaaauauuagggcucccccacccccaccccaagagauccuggaguuaaauucuacaggauaauuucuauacaugcuuuucuccugaaaaauaauaccaauauaguucuuguuaaugaguaaaaugguccaaguuuacucauaaaucuuuuagggcuuuucaaugagauauugaaauguaggcauaguagagguguagauuuuaacaaauauaucaaugguuuuauuuauuaauuuauuauuuauuauuuauuuuacauuuuacuaguuagagaaaaauguguaguuuaaaugucucccuuuguuuuguguucuguacauuuguuguagaaaucaugugguuuugauuugguauugacgugugugugugugugugugugugguucaugugguuugggcuggccucuagcuuucuguguaguagaggauggucuuaaaugccugcuccuucaccccaucauccugagaucaugggugugcaucaccacacccguuuauaugguacugggcuuaaaccuagugcuacccacuuguuaggcaagcacaguaugaacucagcuacaggccuaguuucucauguguauuuuuaauuuguauuuuucguucauaugugaaauuaaacaacuguuaguggagauaaucuuuucuaugaacuuuguugauguuaaauaguuucccuucagaagucaacuguuaguguuggagcuacaaagagugaauaaauuuccugagaggaaacgauaauaaaauauucaggaagucguuaggaagcaagaacuuuuguucuuguucauucagauaagcaguugagacuuuuuaguauaucaauauaguuuguacuaguggaaggaaugaaagauuuggcagcuucuaguacuguuggggaccuugaacuguguagaauaauggaauauagaaugcauaaauguuaacaauuucuuguagcuguuugaauuauuuccuaccucaaccccuuuugaguaucuuuaucagagaaaaaugugagaacuaucugaaaucaauaugugacuaacucaggagggacccuggucuuggggagaccugcaggaguugauugccuuucaccucuggcgugugaagcaagccaguaguaugacugaguuuucuucccaugccuugcuuucuggucacuucuugguuguuugucuuagucauuaauuucccacuuugcuauagaaucuuuggucacugugacuagccuguguuuuuccuuuuugaauggaauuauuacacguguuuuuaacaagcugaguuuaguuugcauuuucuucuguuuaugucagaagcagcuuuacccuugagugauaagcucuggaucccgucacguggaugagccucuucuagaaccugugagaggucccaacauugcauuugguaguuagauauugcaccuguaaauugugcuaaauugaggauuugauucccccuucugaauuauguauggggucaaaccuuucaaaacccaaaccaguuuggacgaugguagagguuuaguguccauuucuaaaugaagcugaggaaaguuuagugaagaauacugugaaggaagcgcuaaugaggaagccgagcaguugacuauagagcagcagcucugaucucuuggcugugacuccuuuggggggguugaacaguccuuucagagaggucuccuaaggccaucagaaacacagauauuugcauuacuauucauaacaguagcaaaauuauaguuaugaagugccagugaaaauaauuuuaugguuggggguugccacaacaugaggaacuguauuaggaggguugagaaccacugcuauagaguguggaguggccagggaugcuuucucuggcaucagggccaagguagugaguacguuaaggugcugucuuuggauuuaaagauacauuuucaaguagugguuucaguagcauuuugaauuaaauaaggaaucccaagauaguauauuuuacucagaaauuuaguaauauaauuucagaaucguuuuauugaaaaaauugagucauuguguuaauuaacagaucgcuuaagaguuaggaguuuuaucagugagccuuucucugaacacagaguaaagauauaagucucgguuucucugucacagcguguuagcuuggaagaugauucuucucucuacuucauuuucucauccucuggcucuuucugucccuucuuuuucaucccuuguucucuucacuuuuggauucaaaacucucuuguacuucugaggauuuugaaugaccacugaagauaaccacauuuuaaaauuguauuugcucuguucuccuuaaacaugacuggguguucugcaugucuggagacucuuauuuacaguuaaaggagagugcaguauuuuuagagccaguucuauccagccugcgguuggcuaaccagcuaaguuucaaauacgcuuacaauuacuuagcuuuuccuaaaauuccuuucugauuggccugauaacauuucuagaaaguuguauguaucugccaccugguggugaaaugguauagcaaauguuaacuuuuagaacuguaauacuauuuaagcucuacuuaagcucucuggauauguagcauuuucuuacccuccuuuuuuugguugagaagauauuacuuuaauacacuacuacaggaacauuuugacuaauuuguuuuacggugacuucuuagauuauaggugacuucuuagauuaugaaauuuguauauucaucaguugcauaacuucugacuucuuugaaagcauguuucuauuuaguuuggagagaugggagcuuuuaagaguauuguugauuguaguauuucuaaaaugaauagucaucaacucaagaaaaaguaaaguugauagaacuaaagcauuuugugggggggcaauaauaacauauuuaaaaaacuuauccucacugauccucagguuuauuaauacagcuaagcugugcuaggauuaaagaccggaauagugacuaauagaaacauucuuguuuucucaguguuuauagucuaauuagagaaacauuguuacuacagggguuacauauauauauauaagagagaagucucauccaggcuguuagcaggggaaguuucucuaaggaaauggcauuucagcuugggugugacagacauagacucagucuaauguggaaagcaaguuggcaguugggaggaguuaauagggaaguugggguucuagugagagagagggacugugguaugaauuaaaacaauaaauuaauucaggaccaugcaggguguaucacauguggaugucagagaaucgacuguccuuccaccagguggguccuggggguugaacucaggugagccauaucaccagccucagucacuagucaaaggaaucuuaggugugcagcacauacauaacaugagucauuuuguuuguuuuaacuugugguacuuaucuuauccuguaagucauuagauguaugaccauagaaaaguuaguaauuuuuauuucgugaccuauaaaaaugaggaaaauaaaauuauaggguuauuaagaggauuaagagguaauuuucguaaugucuuuuuuauuauguucuuuuccuucugcccaacaugguguuuuaaggauauggccauauugcuacgaauacaucuaguaaguuuccucuaauuacugcucagugcuucauagugugagccuucuuaccuaggguaugaauaccuagguucguucuaacucccacuaccucaaauacacuggcagugggaauucuucgucauggauccuuugcaaauccuggaaugguauuuuuuuccauuaauuaauuuauguauucacucgacaucucgauugcagccuucucccccuccucccaguuuuccccuuacauagcuuccccccccccccccggggauugggggugggagguccugccucuuucccacucccauacuaaccuacccaggcacuucaaaucacugcuggacuaaauauaucuucucccacugaggcaagacaagacagcucacauguggagcaagauccacaugaaggcaacaaaaucaggguaagcccccguucugguuguugggggacccacaugaagaccaaacuguauaucugcuacauaggggggggcuagguacagcucuuguaugcuuuuugguuggugguucagucucuugggaucccccaaguguccaaguuaguugacucuguuggucuucucauaggguauaaauuuaauaaauuuugccaaauauggccugguuaagaguguuuguacuaguuuguugguauaucagaguuaucaucucaugucuuugcgaagagcugacaggacuuaacuucuuaaugcugacaucugacaauuggucuaaagaguuauuucaguguugguugaauuugcauuucugauugcuaaugaaucuuacagugauugcacuuuucuguaauuccauguugcuauccugucuucauuuuugugucaaauuucuagucuaauuaauuuguaacucuucguucuuguugguagacaugguaaaucauuuuucuuugucauguuuuuguuuguuuuuguuuuuuacuuuaccuauagucuccuuugaacaaaaagcuuuaacuuucuuguuugaacccauugauuuuucuccuuuuaaaauuaauuuuaauuaguaaagcauuugcacuuacuauguauuuaacaugauuucaaauacauauucauuagggaauguguaaauuaagcuaacauacucauuacuucacauauuucuuuguaguugauuccccacucuguuauuguuuugggaauauuauacauaguaauuaacuaguccucuuacugaguaaagguuuacuuagacuuagguuuucucucagggaacuuuugcagccuuugaccaguggcacccaacccccuuuaauucuugguaaccacuuuuuuguuuuuaguuuuuuggguuuuuuuuuuuuuuuugguuugauuuuuguuuuuuucugaugcaacaugcaagagguuuauugauccagcacacuggggucauccugcaauaggggcagagacgaccccaaaucuucuaagcauacacuuuuuauaguuuaaggguagaccuugguaauaaggugaguugguuuaagcccaugguuggcccaugcugaccuuuucuucccccccuauagaaaugguaauuagccucucccuuccagaguggcaaguguuucuugaccuucccuuugcuucccccugcuuuuaucaacuuuacauuuucacuccauuuuuuuucauuauuuuuuuaauuagguauuuucuucauuuacauuuccaaugcuaccccaaaagucccccaaacccucccccuccccucucccgcaacucccacuucuuggcccugguguuccccuguacugaggcauauaaaguuugcaagaccagugggccucucuuuccacugauggccgacuuggucaucuucacuccauuguuaagugagauuaugcaguauuugucuuucugcucuugucuuauuuuacauaacauguuuugucucaaauacaaggagaaacaacuucucuuccccugccuccuccacuuccuugcugaccucaaacucaggauacuucugagucagccuucaguguugggauuacaggucuguuccaaccaugcagugcuuuuuuuuuuuuucuuuuucuuuuuaaagauuaagugcuuaccuaguaugcaaaggcucuaggaucaggauucuucaacacacauuaacauuuauaucccaucuguggugugucugaacacuguuuucuuaccaguucaucuguugauagacacuugaggugauucuguguugucuauggagaaggauuccuuacaaggacuccaguugugcuuuggcacauugauuucauuuucuucuuugcauaccuggugggauugcugaguuuguuuuguuuuucauuuuggguuuuugagacaagguuuugaacucacuuuguauaccagucuggccuucugagugccggaaucugugccguaagaucuccccacgguuuucuguagcaacuucacaauccaguauuuauacuuuaccuuacuucuuguuuuuucuugaauuuagcgguucuagaucucaccuuugcauaauaaauaugccgaguaucugcuguauuuuaggcaugggauguagaacuugugaaucagauacacagacuuuagcacagccauuggaugaaccaugcugauguagaaaauauggaugaugaagaaguucaaacuugcacuugcccuuauccaucgccaaauuaagaaaaaaguccacaacagaacuagaaacaguaaacuuuuacccucuuuccuaacucaugucugugaccggcauuuaguuuucccccauuccuaauauuuaccuuuucuuauucucuuuucucccuguuauaccuuuuuuguacauuuguuuauacaugcguaugagggaaaacauguuguuuuuuccccuccccuuucuggcauugcaugaccuggcuuaacauagauucuaaaucuauccauuuuuuuuggcagauuuuaugauuacauuuuuauuuaaaguugaauaguauucaucuuacauuuccacuauccauuuaucuggugaugaacaacuaucuugguuucaauuccuuguuauagugaauaaagcagcuauaaaugucaggcugcagauagcucuauggaagcauaaggaguuuuauagacaugcucauaagugaaaguaccauaguuuuauuuauuuauuuauuuauuuauuuuugcuucuuauuugcagguuuuuacaauaaacuuuauaaaaaguuuagagugggacuuggguggaguaaagaugauuaauuuaguauaaaauuuuauuaguauauuauaaaauaacuguacuuuauguagauucucuuaaccuucaccacaaucagaaaacagauuacucccucaaauuaaccugugcuuguuaguuucuuuuuuugagacaggguuucacauugcaggucuggcuggucuggacuugcuacguagcuauggcuggccucuagagauccacuugcuucugccucuauggaagcaaggccuugagccauccugauguacauuugucguggaacuugcccuccacuaauccuugcaaccacugauauacucucccaggaguuuuacauuugagugccauacaaguugaaucaacagguucuagucuuuggaagcucuucuuugaauaagcauaaugccuaugaaauguguuguguauaaauaaauuguuuauuucauugcuaaguaguauugcauccuuaacgaaggaaagcugauuuguauuuugugggaacauuuguauauaggguuaguuuuauguuuguuguuguuguuguuguuguuguuaacauguuuuaacuuuucagcagcaaaaauuucaaagugagaauauuggauugaugguaaauguuuaacuuuauaagaaacuguuaaacuguucccucaaaugggcuguaccuuuuagaauuuuaaccuacaguauuggagaguucuaguuguuuggcggccucacagagaguugauauucucaguuuuguucuagucauuauaauagauccauagccgggucuuacugcaguuuuaguuuccauuucagaaacaacucaugauauucaauauauuuuaauuaaccuuuuaaauuuuucucugugagugggguggugguguuccuugucuuuaaucccagaacuugggaggcagaggcaggcagaguucaggcccagccuggucuacagaaugaguuacagggcaaguagggcuacacagagaaacccugucuugaaaaaccaaaauaaauaaguaaagauaaaauuuuuguuuucuguguacuauguacaugaauguguguagcgugugcacaagugugugugucuguguagcagaugaguucaccucuaugauuguguguggagguugauguugggauguuuuuuucaauaccuuuuuccaccuuuuaaaaucuuuuaaaauuaaaauauaauuaaaucacuucccuuuucccuccaccucuucccaugcccuccccucauucucucucucucccucccccccucuccccucccucccuuucaugucugugcagucagcugaggauguuugauauuguuucuguguaugauuucagggaugaccacuuuguauuggauagcuaauuaagggguucauucugagagagacaaauucuacuuuucucagcauucguuaguugccuguaguuuguugucuagaagugugaccugugauauuuucuccuuuggcuuuagcaugucuauugguguuguuauaguucaggcuuugcuuaagcagcuauguuguugaaguaucauggauguaucuucccugucauuuaugugagacagucucaaacagcaaacguuuugguccucuggugcuuacagucuuuccucuccccucucugugagauucccugagccuuaggugaagaaauuuugugguaucuguugggacuaggcucccuaugaucaguugaauauuuauuuaccuaucuagcuaauagauauaguccucucucuuccucuuucucuguguguuuauguauauauguguuuaucuguauauguauuuaccuguguguguauauguguuuuuauuuguguguaugcauguauguguguauguauuugugugucuguguuugaguguauuugguauguguauauguuuauguauauguauauauaugugagugcauguguguaugaguguguguguguguggcgucuuaaaugaaguuaugcuacuuggacuggcagugcucccugcaaaagccauaaacucuguauuaagacacaccagaagagggcaucagaucccauuaaagaugguugugagccaccaugagguugcugggaauugaacucaggaccucuggaagagcacucaguccucuuaaucucugagccauuucuccagccuccuccauaaacucuauaacaaaagcccuaguauuagguaugagaaaccucuguucaagauguugguuagaguaguccagguaaaucucaaaacaaaauaggcuauugcuguuucccuugauugccuuuuaaagauuggugguaaguuccuaugguugaagacaccacacacuuuggacaaaggaguugggagauucgagcuauaacuaacuugaaaaccucuuuugugcagucuaauuucauaguaccaggagguacuauguaaguugccaagggaggggaguccuguuuagguaugaugcuuaugaaucacaacaauagucagcaugguaggauauccuuaaagauguagcagucgcacucauaucugugugguaaacaacagcuaucuaauuggauuauggcccaguuaacaugaaggaaaucaugccugcuauuagaaacguagucagcugcccugggauagccaagucauggguauuggagaaccuccuacuacuacuuuacuagaucaacauuauuuuuaacugcauucuaagauuucuuuauaccuaaagguaaguguauuauuugcucuauguacaagaagccucuuguugcagcaaauggacaccauuacagaaauccaccuuaucucacgaaacccaacgauuacagacacuugccugccuuugccuccugagugcugcauuuaaaagcaugggccacuacaccuggccaguuucauuauacauucucucuaugcuuuucuuugacuauugauuuaaaaguguauucuuucaguuucuuguuuacucuuuuauaguccguauauuuuucagagcaaagguuguagauaucgucaggcaguuuauuaguuuuuacaaaaugaacauauuuuaguguaucucuguauaaucuagggcuuuuaaaccgguuuaguuucacauuuggcauuuagcguaguaugaguuuugagguaauuauuauuuauauaagucaggugguuuuuuuuuuuguuuguuuguuuugcucagagauaucuaguuuuuuaguccuauuuauugaaaguacuauucuuucucuauugaauugcauuagcuccuaugucaaaaaucaacuuaccauaaucaugugaguuuauuucugggcuuuuuacuugauuccauugauuggucuccuucgcuaaucccacauuguuuugguuuucauaucaagguaagauuuauaaucaaguaguuugaauauccaacuuuguuuuuauuuaaaaaauucucuagcuuuucuuuuucauguaucuuuccaucugaacauugguuaucuugucuuuguaacaauucuaguaaagauugucacuugauuuguauuaaagccagagagcaauuuggagaccuguugaguccuugcauuauaaauauaauacuucuuuaggcuuguuaacguaccuuugcugucuucuuaguagcauuugaucguuuucaguuaucugauauuucaugguuuuagagcuauuucgugauuuuguuuaaauuuaauguuuaguugacucacaauauagacaucaauuuuuguauguugauuuuucuuaaauuauugguuacagaagcuauuuuguagauuccuugugauuuucaaauucaguaaucauugucuugcaaaugaggacaguuuuauuucuucuuuuguuauauauaugcuuauaaucaaauuuuuuguuuuauuauaauggguaggauuuccaguauacugcuagauaacaguugugaaugaaaaacacccuugaccguuccugcucuuaagggaaaugcacucaaaauauuuugccauuagguaacaccaggcuuuagguuuuaaaucuccuuuaacaaguuaaagaagguccuuuucauuaccaguauucugagguuuuuuuuuuuuuuuuaaaucaugaaugagaguuaaaaccugucaaauauuuuuuaauugacuauaagcucauucaguuuuccccaguagcuuguuauuucuaugguaguuuucauugauuuccaaauauugauuaaucuugaagaaauaacucccaacuuggcuuugacuuugcauguuuuucuuuuucuuuuuuuaaauucaguguuucccucuuugcccagccugauccugaauucacuauguaguucagguuggccucaaacucacagcaguccucauggcgcaagcugccucagugcugugacuauagugugagccaccauuccuggcuuuguuuuuauguauuacugaacuggaucugccaguaucauguugaagacuuuucucuacuucgugaggaauaucggucuauauuugucuuguuugguuuacugucaagguaacaauaaacucauaaaaugaguuuugacaccuuuucugccuucuggaauaaaucauguagaaugcuauuucuuaaauguuugauagaauucagugcugcaacuaaaaacauuguuauaaagauaaaaauuaacuuuucacaaccagaauaguaauaauauuauagaaaacauugcuuaaaacuuagaaaccauagaaucauaaggacuuaguaucucucaagucacaauugagagcauuuuuaacauuuagaaguuuuucuuucuuuuguguacauacuuugugugugugugugugugugguuuguuuuuuugagacagaguuucucuauguaacagauauggcuuuccuggaucuugcuuuguagaccaggcugucuuugaacucagaaauccaccugccucugccucccaaguacggggauuaaguugcacacaagcguguauugauguaaauauuaaaaacuugggaaucauguaaugaaugccauuuugcuuaugggcucaguauaguugcuugauugcauugugugcauaucccauaauuuuccauaaacauuuuauauuguugaacauuuaauuauguuaauagcuuuucuguauuuuuuuccugaaagcuauuuuauagacauuuaaagaguuguauagucaagaaucuucauuauucauugcaaauuguuuuuaaaaaggauauaaguuuuuuaucccagaugugaauuuuuaauguguauuuucacaucuagaaguauauaaugcauuguaaacauugcagcaugccgguguuuguacaugauguauuuuagaaugcuaaagaguggagaauacuguuuaaaaauccucaucaaaugaauauauuucuggcauagguaugcacaucugugacaguguuaguauacaaguugaagcuuuaaaguuagaaauguacaaaaaugcuaguaagaaguuaacugggucuuaauaauaugaucugugguccacagauuuuauuauuuuccagauuuuauuauuuuuuauuauuuuuauuauuuuccagauucugggaaaguggcccuagggaccguuccccgauugggucugggguagcagagaugaaguauggauuuagcaaauauuaauucaagaacacaggaagggagugugugcuggcuguggggagguuuagaagugcucagccauugagcuagucaaggcauaucaaaauuagcugacauguguaucuuuuauucgugaauccagagagcucuuggaccagagcaacgcaugcacaaccugcugagagcaucaagcaauuuaacuguucacagcuacacaugugacagaggaaaagugaaaaagagaaauggaauuguuaagaagucuaauuuauagaaaagggacugcguuuucaguuagauuggaaguagggucacauuaagagaauguggagcuggcaaaaagaggcaaaggguuuugugugccugcuauaaggaguauaaagccagagucaggcaaagaugacuaagacaguggucucaacacccagcagugaccagggcuaaagaaaggcaugaacauggagaggauaagcucaugugaagagugcuauaggauuaauuuugauuaauugguccagaggcugaguagaugaagcagaaggaaauaaaauccaaaaaccagcagagugaaguauuaaaaacagagaaagcuuucugaaaagauuggaaaucuagguuucacucucuugagcgugaguuaucauaaaggaacuauuucagauuugugguuauuauuauggucaguaguuguagucccgauguugaguaaauucuuugaaaauguauagaccaaagaucauugcauuuuuguuacucaggaguguuugguguuuauaauaauauaaaguuggaugugacuuaaauacuagccauuagcuuacagcccuuuuaugcagggugauggaucugucauugaguuugcuucagguggacccaguguauauuuguguugucagcauaauuacugaguauuuuuuuaaacuaaaaagugucuugguuuuagauuuaagauguguuugcugcaauggaauggaauacuguauagcugcuaagaauuagguaaaacuauauauacuggcagauacauauucaguauauuauugcuuaaggaauacagguugaaaaacaauguuauaugcugaaaacaacaacaacaacagcaaaacaaacaaacaaacaaacaaccccaccaaagacaggagaucccucccugcggcaagauggcuagcuauaauggccaaauuagagagcucugguuucaaaggagagacccugucucuauaaguaagguggagagcuaguugaagaugacauccaacaucaacuucugauugccacauauacacauauguacauguacacauacacuuccccaaacugugcccacgugaacaugcaaacacauaugcacuuucuaaguacucauucaaauauuaauauaaaaagggggcuaaugauuuucacuaggugcuguaaauuuaaucagaaaccguugacuaauaaaaaauuuauuaauaagcuauaauuuuaguaucagauuauauauaguugguugguccuacauaaauggcauuauauuaaaauaauauacaauagaaauuaaaauuagcacuaccacaccaccauuguuaaguuuguaacauuuaccuuuuacuuuccuauuccuaguucuuaccuaauuaauaucaaaauacagaauaaagagucauauuuuuaaauaauuuuaaauuauauucuaugguguuuccccuuauaguagauaguauuuuggaaaaugugccagguuuagguauuguguuaaauguuguauuucaugauuuaaguuucccaacugcuuaauucaaggcaguaacuauuacucuguuuuacaaaugacuauauugacaauauguaaucuauucaaggucauacaacuagcaaguagcaugacucagcuuugagguugggcagcuugacuuggaacccauguucuuacuaacucucuuauagauugaauauugaaauggccucacaggcucaggaguuaaaaauuacaggguagggccuaccugcaaaaagugugucacuggagguaugcuuuugaagauuguaccuagucccuggcuccuccuuucugucuuugcauucuauacaccacauucuggcuauccaagagcauggugucaagcagccauggaagaaacucuuugaaagcuugaaacugaacuaaauaaaauaaagccuuuucccccuaaaguauuuuagugaugguaccauaauuuacauaacuaucuuaccaguuaaagaucuaguuuauaggccuuaaaaucuaaaaccuggacauuuuuauuuaacaaauuugugccuaguauaugcaggaucuuuauuuugggcacugugggcuuugguguacauagauuuaguuuuuauaauccaguauuguuuaaccauacauauuuaacauuucugaaagguuggauguuagguggagauuucuuuauacaguuggagauuuuuccuuuggauaucacuacuuuagugacgcauuccuuuaaaaaguacuaucauugcuauuauuuugaauuuugcauacucacuugucaguguguguguaugcaugcacauacagcuguguguggaaguuggagaacaacucucagguauaguuucugugguuauuuuuuucccuguuuccauugaguaaucucgcacucugcugaucuauuaaaacauggcacuagauuggacauuuacuuggugacaguuuuguuugaacugagcauuauuuuaccguucuugaguguauuugcuguuuggauugcauauugucacuucuguaucugguuuucucaguguuuguauuguguuuaugguuugagucauauuuucacacaaaauucaauuucuauaauauaaaauacccuauuaguucuuacauuuaaaaaucuuacaagugucaucauuuccauuuauuuuucagcuucaccuauuuuauauuacaauggcacaauugcuaaaaucaguaaaccuguaucaguauauaguuuuuggcuagagucuauacuuccuucauauuucuuguuuuuacuuauuguucuuucuguguuaaauuuuacccagcaucucauacuauaucuaguuguugcauuuucuuuagggcuuuugaaugaggcuauauguuuccuguauuuugaugacccugucaguuuuaagaagcuggucagguauuuuauuguuucccacuuacuggcuuugucugaugauuuuuuuucaugauuaagcuagaguuauuauuugugaggaaaaacacagagauaaaguaacaacaagcaucacauaguuccacugugcuuuaucaguaugggaagugaaucuggucgguuucagggacuuacugaaggcuguuuugaaguguuuaccuuuugccuuaaggaccuucccuggagauagaauguuucaaucuuagcagaaacugcuaaacaucaguacuucauuguauucauaguugaauaguauuguaacauaauacuguggaaauaacauauguuauuuauugaucuauuaguggauguugguuuauuuccauguuuauacacuugggcuaguuuaaguaaugcugauaauguacauucuauuuaguuguuuuugcaaagaaugcauuuuguuagauuuggaauuugcacaauuguuuguuuuauuacucugacuuuauuuucuauaauuuauuuacugaagaaacuuugcgauuuacugugaauaauuucuuuucaguuguuauauugcugacaacauccucaucucaucucuuacuauauuucucuacuuuuaguuuauuuauauucuuaauugauaguuggaucuagagguaugaucucuuccaagguuuuguuuuguagggugcuacaugugauggcagcagauucauuuaagaauuguauugugucugaguaagauuuucuguuuuaucagccaccaagcucagcaaaucaugcccucguuagcaauucuggucuuuacaaccuuuucauuccugugagguaauguugaucuuuauaguuuuuccccuccccuccccuccccuccccuccccuccccuccccuccccuccccuccccuccccuccccuccccuucccuccuuucuauauuccucccucuggaugucuuuuaccaugugggaucuagggauggaaguuaggucaucaggcuuggugguaagugucuuuacucacuggcuccaauuuuuauaguuuaaauaaauuaaaaauguaaauaagagaguauaucacagaaacuguaaguagcuugcaaaauauaaugcauucucuaucugguucuuaugggagacaaucugcugacuuauaaaccauucaucuuuuauuacuuuguaccucuaauucauuacaguugcauuauagugacagucuuaucaaucuuugacuuaggaggaacacuugaauauacagaagcuuacuuucagccauguguaguuaccauagagauugauuaagaaagaugaggagggcuggagagauggcacagugguuaagagcacugacuguucuuccagaggucccgaguucaauucccagcaaccauaugguggcucacaaucaucuguaaugggaucaaaugcccucuucuggugugugucugaagacagcuaaagugcacucaugcauucaauaaauaauucuuaaaaaaagaaagaaggaaagaaagaaggaaggaaagaaagaaagagaggaagauagaugaggauuuccuuuccucuuucuugccacugucaagugaucgauucuauagcauucauuacacuuucuuuaaauuuuacaaucauuauaaagcaguagaggucaccauauuuguuucaaaauacugaaguauaauuauugagguucaaagguuuuguguuugacaagaaagggacugcuuugagacuacuuaagugauagucauuacuuuuagguuguuuuaaauuuuuuuucauuuaucuuauguguauggguguuuugugugcauguaugcuuguucaucaugugugugugugccuggugaucucaggcuacaagagggugucagauuuccuauaacuagaguuauaaguuguaagcugcuguguaggugcugguaauggaacccaggucuucugaaagagcagccauuggaccaucucuuuagucccaagauuugucuacucacaaaccuggaauuagcuacuuuauaauggaucuuuugaaugaaaauggugguuagauagcaaagccuggcuagagaaaauguucauuguuaauggguuaguuauuaccacugggauguuucagugaggaaagcuaagaaauguauauuguucuaaaaaauauaauucauauugguacuuaaaauugaagguuagagcucuguuuagucucacugauuuuauugauuuccuuccacaauauaauuaaaauagcuuauuuguuuuaucucucaucacauuuuuagaguaacaauacuaauaguaacugcaauuaaaguuaaaucuuuguagguuugucccuaagauauagacuacuucuaguuugguuuuuuuguuucaaaauucucuuggacuaguucuuucugauguggcuauaaugauguuuggacaguuguuuucuaucugcuuucaguuuuuagauauuuuaaauuuugcuuuuuuuuuuaauuuuguuuuuuacuuaguaaaauguuuauaugguucagugacaaacuggugaucaaggucuauucagagacauuugccuucaaucuuugucuuuuucgcauauuuuuucuuauguauguauagccuaccuaucucgguguuuaaauauauucacuuucucugauuuacuuuuuacacauuuuuuauagagauaacugugguagaauauaguuauucugcagucuuauuuauaucugcauaguacuaguaccucaguguauuaguguauccuaguugaguuuacaugucauauaucagaaugaguccucacguucagucugaauagguucacaaugaauacuuuguaccuguuuacgacguuauccaguguaccuuugauaucacuucagagaugcgcgguuguuggguuggaggaugauaaauacauauauauguauaugccagaugcagucagugaauacgccauucuguauuucaucagccuguuuccuuacaguuagucuaucuaggcuuggaguuuugauagugugauaagugagaaauuucaauguaguuuuaauuugcauuuuucuuacuaugaaauugaaaucauaguuucagaugauugugagccauuuacauuucauuuuaguaacguguucuagggcuauguguuauccuuuugauacugugaacaucuuuugggagguuuagaguuuucucccucucuuuucuuuuauucuaauuuuuuuuuggggagguauauuguggacaugauaugaagauauuuuuuaaaaucaauaagugaaugaaauuugucugugauuuaacauggcaguuuuaauagugcagaauuggguuaacaagcuuuagaauucuguuuauuuucaucaguaaauuuguuacagaauaaaagaauucuagaacccaauuuugcagaccuuguuagaaacaagauuuuuuuuuucuugaaacauuuuauuuuggguugagagcuugauuguacacauuacuuguagaaaauagcuuguuauuaccacuuuucacuuuguucucucuuuuaaccuguuagauugcccauaggauuucauaagcauuauuugacagugaaagcuuucaucgaauuauuuaugggaugcaguugucuauauucuaggauuaauaucuuuacucaaauuuuuuuaguucaacuuggugacagcuuguguacauauggugauauaccuuaauaaaauauauaaugcuuguuuaucacaaugaaagcuauuaauacugaaagaauaucaacugacuuauauuaacuccuuagaagguagccaguuacagaagaauuauagaaaaauaguuuuuaaaaaugugaaggucacucuauuuucaaauugcugcucuuagaaucugugccacugcaugcuaucgcuuucugauucucuugcucacuauugucgguguacuugcuauuuggugaauauuuuaaaagauguucauguaagacauugaaucuuacugucuucuguuucaaaccuaagauaauucugagcagcaugcgugguacugacugaccucuucaugguaggcuuucgauuccuugcugucuucaucuccagugacuucgucauuacaguauagaaaucagcuugugcaucugugucccaccuugccauuccucagcagugcuguaguauuagaauaauuucagucucuccaucguagucaggacucccagauugcucccacuacaccugcaucauuuuuauccaaccuaauuuacucgaauuuccuuuucuaacugugaugguucuacagauggccguuugcugaucccuuuaacuuucuuaacuucacugucaugacaccaucuuguuugccuugaaguuuuaaaugauugcuuuccuuuuaaaaaucacauuaaucauauuugagucuuuucagcuaugguaaauacuuugccaggagucucacuguucguggggaucaguuuuccuguuguagugcucuccccauucuugcugccuuauuucacauauuuuacugaaaccauuuuuacuuugaccgucaguacaugaucuuaguguauaaccucgguguauauguaaugaauggggucaaggcagcucauccucuuuuaguccuuuggcuucuucugugcucugcuccuuugucuuuugacuuuuauggcauuuuguuuugagacagggucuucuguauaccaagauggccucaaaauugcuauguagcuaaggauaaccuugaauuugaucuuucugcuuguaccuuucaagugcugggauuucagguacucaugaccauagauauuuauaugguucuggggacuagaacucagccagugaaugucagacaaguccucuaccagcugaguuacacgucuagcuccucuguauaucacuuaaauucuuuucuguaacguuuugcuuccagccaguuuagaguuuuucuugcugugacagauaccuaagaaaagcaguguaaaggagaaagauuuauuuauuuuggcucacaauucuggaaguuucaguucuugaucacuggcucuauguuuuuaaaccuggguugaggucguuguacaucaugauggaaggauguuagcagaacagagcuucuuaacucaagucaaccagggaguaggaagaaggauaggaagggaccgggacaagggcauccccccaguagcuuauguuuuucuuccgcuucucgugaaguuuagcuccuccuaaagcauaaagaaauacuuuguaaaugauuucugcuccagaaaccuuuccucagcaagcugaaacaucaaaaugaauacauuuuuuauugaaacuugaaaaaauuucuaaaaaguuuguuucuaaggaaacauuucugaauagguguuaagagaucacugcugauagcugcuaaaguccuaauuuucauugucaauuauuuaauuugauaucuaagagagaauuuaguuuugauccuuccuauuaacugccauaauuccauucacccuuugaaaaaauaaugugaauuugguuguuuuuaguguugaugaaggaaaacauaguuggcugcuggccuuucucaguagaaauaauaacacaagccaaaaccauaaaaauuucugacugccauacuaaaaagguaaaauagaaaucauuuuauuaauauuuaguaaauauuuccaaaagacauguaaaucagcauacauuauuagauacuuugcauucuuguguguuuguacaauccauguuuucuaaaucaauugugugguuuuuacuauuuuacauguaucucaauuaagacuagcuguaguucaaguucucaguguauaucacuuacccauauuagauagugcacauguaaugauuaugaucuugguucagauagcuuaauuauuuuggagcaauuuuuuauucauuuuguagcaaaagguuuuaaaucaaagaugauaauucuuaccauuagugaacuggacugagggaauucucauaaagccuggauugugucuaaugcauagugaacacucaggaagcuuucauuauuauuuuuauacccuuacaccuuguccauaauucccauucaaucuuagaaguacaacaaccaaaauccagacuagaucuuggauuucuuuauuucuguuuugucucuuuuguuucuucuauuuuugccuucaguuccuugcucuacaaacuuaugauuaagaugaacauauuuuccgaggggggcguucuuugugguuagaagaugcaaaggaugaugucuuuaaggucaguucagucuuuggaagaauuaauuagcuuugcagaaagaguaagcuguggagcugaaauugcuaaaauguuauguaguaaaaugguagaaaaaacuugucacuuucuaaauaucuguguaaaauugguaauauaaauauauuaaguugugucuuugaauguuaagucacuuuaacuuuccaauuuuggcggggggauuuuuaauuaaaaaacugagaacuuaagacugagcuguauagcaucacggaacauaaaaggauaaagugaaaugucacauugggaagugguuugggaugcacuugguguuaggagauaauacugcgguguaaggaaauaggaagucacuugagaguagaaucuuaguuuaugaugagauaauuuucuuauagugaagaaaauuacacagacugcuuucauuuguagguuuauaaagaggcuugcucugaauuucuacuauugaacuuuguacuucuuccugaaaaagagcaggguuuuuauuucugcuggcauuaaaaugccauguguugauaucuugcuuuagguacuauaaaauuuacagcuaguaugaagcauacaguuagauuuguugguauuguagggauggugcuuauaacugaaaguaguucccugugaauguauucuuuccuagaaugggauucugucaaaaggugugaaguagucuaucagaaagugaggaagaaucuaucaaaaagugagaacuauucuauuaagaagugagaaauuuguagagacuuggaaaugaaggagauaccagacaggcuccauuacgauuauuucaucguauuuuguccagugacucuggccuuaguaaacuaauaguaugcagacuaaaguagauguccuaugaggacuguugagacauccaggccagcuuuuguauagacagcugagcucucugcagugcccaaaggaaaacuguuaaaugauagauuucucugcucucugcacaugguuguugaacaguaaaugauucauugugaagcuguuuaauaugucuuuagauuuuuacuccuuuaucuucuuaucuuuuuccuucacaguaaccaggaguaagaaacugaugcacacuuccuaccuuuuucagggccuauguacucacauauucauugagcuauaauuuacauucauugguauuagucauuuuccacagaacucuaggccaauuaaacacauggcucagguuuuacuggauaauacucugaggcagguggggacuguuguacuauaugaguggauccagaccauccugccacguauugugaugguuuuaucucacccauuuuucugcugaguaguuugaacuuuuuaauuuuuucuuguauacaaaaaucaucuuucucuauuguuuuccugcuuuguuucugugcuuugcaaaaguguaauuaauguguuugucaaauucaagaaaguaaaguuuaucuuuuucuguuucuaugagguuucaucuuuuuacuuaaaaggcugucuaagcuccaagguuauacuuguuuucuccuaaaauuucuaauaugauuuuuauugcauacuuucuauauguuuggaaugaauuuucauagcuguguguguacagugauacguuguagcacuugagaucuuagacccacguucuguucuuaccugugugaccuuuggcaaguuacuuaauguuucugugcugcuuucuucaaugagauggaggugauacuagggccgcuucucauaaaugagugaugcagaugugcaaaauguuuagaacaguguuaguaccauuuuauacguuccauacgucuagaagguuaaugcaguaaacauuuuaauaggaacagauagaauaacuucugguuacuuuucaaaaauugcuaaguuccuuuccagagguuuuaagacuuuucacauacauuucuuaggccucaucauguggaaucgagaccuuuuuuucuaauacaaaauacuguuuuggauuuaucuagauuuuuaaguguugggaagcucuucaaagauuugaaagguuucuguuuauuuuuuccuucugccauucuguuuuauauuuauuuagaaccaaucacugauuuauaauacaggauuaguguaucuugaagucacaauuuacauaauuuagaaauaacagucuuaacgucguuguuugaguuagacuuugcugaagaugaagcuugauuacagcuugaguucuuuaccaauuggacaauagcuucccucuccucccuuccucuuucccucccucccucccucccucccucccucccucccucccucccucccuucuuuuccuuucuucuuucuuaaguaaagggugaagcuuuaucugccuaagaugcaaaguuuauagcaguuuucuuuguaauuuuuuucuucauauguucacggugccagccaaaggcuuagaaagauugaacugaguucuccugugcucuuuacaucacaaugaguucuugaugaaaaguaaauguaaaaaaaugaaauaaaaauggaacagaagagaauaaaguuaaugaaaaauuugauaggagcuggggagauggcuuagugguuaaggacccaggauaguucccagcaccaacguggugguucccagugaucuauauaacuccuuccaggguaucuucucccucuuuugacccugugggcagaacaugugcauggugcacauacauugagcaaaacaugcauauacauaaaaucaaccuaaaaaguauuuuaaaaauuuaauauucuugggcuggagagguggcucagcaguuaagagcacuggcugcuugcucuuucagagguccugaguucaaaucccagcaaccacaugguggcucccaaccaucuguaaugggaucugaugccaucuucuggugugucugaagacagcuacaguguauucauauaaaugacauaaauaaaucuuuuaaaaaaauaaauauucuuaagaaaacuuaccuaagaauaucauuaauuucuuguaguuuaaaacauugcuuacuuuaaaaaauuguguuuacacgcgugcauacacaagaugaugugcauaucccugcaugaacuuguggagaacagaggucaacacuggcugucuccucuaucacugucugucuuaguuuuaaggacagguguucucauggagccuagagcuuccuguuuuggcuugacugguuggccagcaaguuucugggaauuaccaggcaucauguuguauugccagcuuuuauguagaugguagggagcuaaacuuagauccuuguauuugugcagcaaguaagcaauuuacucacugagcuaucuucucaggcuagaaaauauuuuuauaaaaaauuauaaagucaaauagaagggaauauugggaagugugaucauuaucaccaaugguugccuguaagucaagaggaugaauacacuacuaggaaaaugugcaaaauauguauugaguuuauuaaaaguacaaauaacuaauguaaaggauauuuuauuuacaaugaauaauuucaguuuucuaccuucuuuauguucuuuggaaaacuugacuuugaauaaaagaacuuuaaauccauuauggaguuuccaauuagacuuuuauuagcuauucauauuaucuaauagggcuuaucacaaguuuuuuuuuaauaagcuauucuaaaugagucauuugguuuuuuuaguaguaaacuuuauuuagacaucaauggcauaucauucagcaauaaucugaaauuaauguuugaauauguuguauauucuuauagaaauaacagaagaaauuuuuauuuagcuuguccuuuuuuuguuuuuguaggagccaguguucgaacauucacuccguuuuauuuucugguggagccaguagacacccucucaguuagaggcucuucuguuauauuaaauugcucggcauauucugagcccucuccaaacauugaauggaagaaagaugggacuuuuuuaaacuuagaaucagaugaucgacgccagcuacucccagauggaucuuuauucaucagcaacguggugcauuccaaacacaauaagccugacgaagguuucuaucaguguguagccacuguggauaaucuuggaaccauugucagcagaacagccaagcucacaguagcagguaaguccuguuaagugauuuacuuggauuuucaguuuuuauaagaucuaaauaaaccagugugcuacacuuuucacuuaaaugguaauaagucguuuaggaugccaguuguguauuugcucuuguuuaugagacuacacucauuugcuuaggguuaugcugaagaaacuggugcuugugugugugugugugugugugcgcgcgcgcgcgcgcgcgcgcgcgugcgucuugccugucugaaaguucaaaguugcuaucuuuuuuguuuuuaacuuggaaguagagguaguucuguuggaaaauuaaugucuuuaaaaccuacucauaauaaccaguguaccuuaauaaaacuuuaguaaacccuggugguaggguuuaggggacagcaaagagaaaagagauaugauaagaggccguaaaagagauuguuacagcauaugugauaagcagaagccuggugugaaugguauuauagaggaagucaguacauuaaacuuuaacuaagaaauagacaguauuuauauagaaaaagauggugcucuuaacauaucauuauacgaggcagacuaaaagcaggaaguuguaaaaagaggaauauuaacuccuuuucaaaggaucucuguuaaaugguggcaaauguaagagagauuaaggaucuagagagauaagauguguuuauuaaagauguaugcucuaguaggguuucuugagugugagaugaagucaucuugugaagggccauguuguuuuacucgccguggccugcugcagguguguguggguuggccugacagugauagucaucuccuacuucuucccacucucgcuugggcuuagucacuuagagcugcaguucuuaacucuuucacaggguuuaccuaagaccaucagaaaacacagauauuuacauuacaguucauaacaggaacaaaauuacaguuauaaaguaacaacaaaaauaacuuuaugguugaaugucaccauaauaugaggaauuguauuaacaguucuuagcauuaggaagggugagaaccacugacuuagggucaaauacucaauauuuaauuuggguaugacuuaauacugcaguaaucauccacaucacagauugaaggugcaaaaauaaaaauggggggauacaaucuaaugccacggaauuuucuuuucuccccuccuccauacuuucuacaguauguauaaguaaauugguggacugacauccucuguaaugucauuuaggccagguucuguucauaacugaguuguguacuucaagugggaaacuucaugguuuauaaguuauuuauuaaaauuuguuuucaaaaaucauuuuuaaaagguagccaaauuagccauuuuaaaagacuacagauauauuuggcugcaagcagcacuaguuuuagucauggccagaaaacagagaaguuuucaaagaauauuaaaguaguucauagauuuuaaauaugagggugcucuucucugggcugucuuauuucuacaccagugacacuugcuuugucuggagaguaguguggcuguauguguuucgugcucaaagguuauggaaugccguggucuaaacacagacaucguugauccauucaugccaauuccaugucucacucccacucuuucucucucacuucugcacaggaagcaggagcaccggaagcugaggcggccuuugccuugauacgcacgccacuuccuaguucuuauaucugcucucccuggucagaacucugugaacuuucuugucuuacaaaucccacaggcuuaugcuuuugaaaauuaguuauuuucacaagaccucuaaagggaguauuuuuuuguuguuaaaaaccuagaagacaguucuuccuuugauuuguuaaguucccucugccucgcuuuauucgauucuguguuuaucuuuguuaguuaccuuuucccugauuuuuguucuuucuuuaccgaagagauaauugaacuauuuuauauuuagugcuuuccuuuaaaaaucuccuugauaugaaaucaaggaaaauacauagcaggacuagaaaacuuagguguuauuuauuauuuggacuaauucaccaucauaaaaucagccuagaauaauuguccauaaucuauuuccucuucuuuacagaaacauuuuguuguauucugagcacauuagaauuacuuguaagguacuguuauuaauagaugguacuucaguguauauaugccaggcagugugccauaugaaucacuuagauuaauuucuuuaaucacacugaggucugcuaguuuucauuuaacugaugaagaaacugaagcuuagacucaguaacuuaaccaccuuuauauaaccauaaaagguggaguucauuuaaguucaagauuggacaccaguggcuaacuaaugcuuuuagccauuauguucuauagcaucuguggaauauuuagaacuucagcaauuucaaacuuagaggguagauacaaagauagaaucaagaaaucucaugugcuuuuuuuuaagucuucacaugucuuccugaucuccugguuaacauuuuucaacaucuacuuuaucauucccuaucuuaguuugguuucuauugcuguggcaaaacauggacuaaaagcaguuuggggaggaaaggguuauuucagcguauaccucucaggucacauuccauaaagggaaccaggguaggggaacauggcugccauugcuuucuuauagcacccaagaucaccuguccaggcuagcaccacccacugugagaugggcccugccacaucaaucauuaaucaagacacaccucacagacuugccaauggggcaguuucauggaggaauuuccucaacugugguuccucuuuuuuaauaacuaccuugugucagguugacauaaaacuaucuagcauauuacccaaauacacauuuuccccugaaccauuaagaguagaagguagcagacauguugcuguuguaucugccugaacguguaagugcgaauuuccuggaaacaaggacauucucuuaaaugaccauagacuuucaucaaaauuaaaaaauugauguaacacugccauuuaauguagauuucacagaucuuggggggggggguagaaaucaaccuuucuagucuaagaucacaugugucaucuuauaauuauucuuauucuccuuugauaaauaguaggaccucagguuuuccuugucuaauuuugaguuugauuuccugugaagagauugagcuuuuucauuuuggggaggaauaccauggaaguaguauaguguccuuaguuuggcacaccaaaguauauaauauuuuauugcuaaugaugcuugcuuuauuacauaagaucuguguaguauuucuccacuucaaaauaagguguguuuuuaauuaaugauuacuauuuggagaagaaauguuuugguauuuuauaaauacacucucucucaucaauuuucgcuaauaguuauaacauccauuguaagauuguugcgugaaucaguuguuaugauaguaguugcugaaugccuauuguuccucauucugucaucucuguugaguagaucuuuuccuucuccauguguuuauuacuauuaacaugagucaacagauucuuguuugugcuuucauaauguguuagcaucaucauucuacaaacuuuucagucuugauuucuguguuaaguaguucuuccccuauauuuuaagguuaaaacuugaacuaaugacaucaggugaggaagugucuuucuuuaucuuuuacuuuccuaguuucacucuuagaaucagccucuaauccaggaacacugguucuuugcaguaagaaugauacuuagaaaucaagauaaagucaccauuuggacucacuguuaaagaagugacauugauucagggagggagagagagagagagagagagagagagagagagagagagagagagagagagagaacuugaauauuaaugcauguucauuaguuacauacaaaaugcauauuuacccacaccuuuauagcuccauaguucuauaucuauaguuagauaauccuuaagucuacacugagugcuuugaucauagacuauaccauagcauuuacucuauccuuaccuuuuccacauugcaccuugcuuuuccagcuaugaggaaucugauguagguuauacuuauugcaguuauuuauuagcuguuugcuuuguaucuauguaucuagucagauuacaccauauguuguggcuacaugagcugucuuggugcuagccuguaugacuguauuuuagaguaauauuuaaugacuuuuuauuuuucuuuaauuguccaggucuuccaagauuuaccagccaaccagaaccuucuucagucuauguuggaaacagugcaauucugaauugugaaguuaaugcagauuuggucccauuuguuaggugggaacagaaucgacagccccuucuucuagaugacaggauugucaaacuuccaaguggaacacugguuaucagcaaugcuacugaaggagaugggggacucuaccgcugcauuguugaaaguggugggccaccaaaguuuagugacgaagcugaauugaaaguucuucaagguauuaauccauugacaggacugauggguuuguguuuaauacauaaaacugaucugcuauaauuuuuuaaauaaacaccauuaaaaugcaagaacuauuacuauuaauauaguauguucaguuuuuuaaagagauaaaaaggggaggggccauaaaaauucacuguucaaagccagguguaguggugcacaccuuuaauucuaauacuugggcaucagaggcagccaggucuuugugaguucaaggccagccugaucuacauagagaguuucaggacagccagagcuucauagugagacacugucuugaaaaaaagaaaaaaaaagcccauuguuugguuaacguauuauuaaaaauuuauccaaggcuaggaauggugggacacaccuuuaaucccagaacucaggaggcagaagcaggcugaucucugaguucuaggccagccaagauuauuuagaggggcccugucuuuaaacaacaaaaauuaaccaaauaaaauaaaagugaaauuuaucaggauagcugugcaugguggcauaggccuagaaccccagcgcuugagcggcugaggcaggaugaccuguaguuggccucccgccaacccugcaagagcugggaguguagguugugugccacugugccuagcuaacuuguaucuuuuggcaguccucuauucucugccuucuccacaauaggauaccuuuuaauaguuaggguuuuuuuuuuuuuuuuaauuuuguuuuguuuuguuuugucuuacugaaaagaaucuuguuuaagguauuaagauucuugguaauucagauucaaauuauaaauauaauuuggcugucccugacuuguuuaggauuccuguucauagaaauguaugacuaauuuguagacuuauuuauaacacgugaacuggcuuguaguguaagaccacuguuacgagcuugauaucacuugugaggguguugcugauggaccuugaacugauuuucuuuuaaauguagcuucuuuuuguuguugccgucccugcccuuuuaauuccuauccuaguguauucucaguaaucaguuuucuaaauagacaaucuuugcuccgucucagcuagguuucuauugcuaugauaaaacacuaugaccaaaagaacuuaggaaagaaguuugucuuaaaauucacaggucacauucugucacuaagggaagucaggguaggaaccaaaguccagccacagaggaacacugcuuacuggcacgcucacauguggcuugcucaaccugcuuucuuuugcagcucaggaccacuugcccagggguggcauugcccacagcgaguuggacccuccaccaaucacuaaucagggaaaugucccacaggcuuguauacaggcuaacacgguggaggcacuuucucaguugaguuuuucucuucucaaaugaccauagcuugugucagauugacauaaaaucuagacagcacacuuccugauggucucuuuaugucauucacagugaaagguuuuggccuuuaaucuuaauaccuuuuccccccuuuaccuuucuuuuuccuucuccucuucaccccucaguugugaccagugugugcuucucuaacaguuccaaauguuuuacuuuagagcuuuucuaugugauagucucucugcguagaaucuuguguguguggaucacucucuuccuucagugcucaaaugucacuuugauauuugaaugauauuugagucccuuagauacucuguuucagacaacuauuuuuucaccucuaaugcuuuuuccuuuuuccuccauaaaauauaucaacauaauugucauauacaguaucuaauacaucugauacauauacagugucuaauuugucuuuuuuuuuuccauuauuaguauguaagcucaaugagaguaaugaaaaucuuggggcacauagaaaccaauaaauauuuguaaaaaauuugcuuaauuaauucuguuaaauuugauuaaauguaucuacauuuauagauauaaauuuauaaguauuccuaaguaauugcaaguguaauuaaagaagcuguuacuacauaauaaugugcucuaccugacuugcuuggucguauuuccuuuccacaccugagguaguauucaagcagauccuuagagucuaauccaggaaaaaaagcuuagugguuuuaaaugauggaaccacaacuuaguacuugaaauaagaacagaauucuggauauuugcuuauuuaaguacgaagagagcuuuucuugacagucacuuggagaacagccaccuucugcacuccuacagaguuuugaggucauguugguuaaaagagagaggucuuauuucaaucacaagccgguuuccguguuggcugcacagguggacacagguaaguaucagccuuagaagcaacaacucagcuguugguuggcugacuuuuaaaggcagggcuugucacugauuggcuucuagaaguauauucacugaaaugaauuguuauucaucuauuagguaguauuuacuuguuaccauggcuacaaaacuauuauuaauugacuagauaggcuuaaagaccauuuuggugguuguaaccuggcuggggauaggaauuaaaucucuaccugagagugaucucagauuucaauauuaauaaaguaaaaugcuuaacuuuuaucaauaggaguguggccaugucauaugucugcaagaggacaacuauaaauauagcauguauaaugaauucauauacaugcuauaugaauauaguggcaucuggauaguugcuacauuacaaaaucaaagaauugauagauuuuguuuuuguuuuugauuuucuuuuuuuaaaacaagucuccuagccgacguggaacucccuauguagaccaggcuggcuuaacucacagagauccuccuaucucugcuuccugagauuaaugacaugaacuacucugacaggcuugguagacuaauuuaaagagaugaaaacucagaaagacuuucagacauaauaggcacaagaaaagaaaggagagggagucaguaggaagggacacacagguauugaguuuguuuagucucggcuguuuguacccucgugugguauuguauagauucauguuguguguuccucaugugaccagaaagcaccauguaagcaggaacugucaccuacauaucucuaagacuccuaaauaaccuacacaguacuucacguguagaaaaaaacgugggaaacguuugcuguucaaacaauuuucuuggguuaguuuugcuuauuuugucacauaaagccacacagccugaguaggaauuagcuguucuucauggcuaaaguugugaggugcuuugucuuuuacuuaauuauucuuucauuuaaauuccuagauccugaggaaauuguagacuugguauuucugaugcgaccaucuucuaugaugaaagucacuggucagagugcaguguugccauguguugucucagggcuuccugcuccaguuguuagauggaugaaaaacgaagaagugcuugacacagaaagguaaauacugccugcuuagucuaaugccauuuggaguaucaguacauaaaaaucgacugcuuuguuuaagcacaugggguuuucauaugucauccuugaaaggcauuuuuauguugugucuaugguguuuaaagaaaaagcaugcuuuccagucaguagagggguugauguugcugcugcugcuguuaaccuucauuauagcuagcuugcaaggucugauugcccuaaaguguugcaugagcugccaggucugaccagguugagucauuuucagucuuacaugcacuguggaaguuucuuccuuugcuuaguuaaguaaauaaugccuuccguuuucccaagugcuggcauuacaggcaguuaucacagcugccuuuguuuugcuuucuaaaguccuaaaacgccauaagcuauguucacaaguuauauaucuuguauaagagccuucucuguuacuacucaucgucugcaucccuugucucuuccuuaugaaauggguaauuuccucaguuguauuuucucaaaaaauuccuggagugguaguaaugguucaauaguuagguaugcuuuguuuucaaaacacagcugcuucaagcauuguaaauuuacuggcaucccugucuucuaccuacagugcccuuucaaguuaugaugacccuagaauacaucuagauauugucaaaugucccuugaggaacaaaaccauuccugguugagaauggcucuuucagaacaguauauaaaaugcaaugcaugccucagauauaaacuaguuuucugauagccaugcuaaagcaauauuuauguaugcagcacaauuacaguaauacuuuaugugaggucccacuuagaaugaaacguaguucaucacaccacagcaccaugaagguauaacuaagguacagaaugauuuuuauuuaaugaauagaagggagaauuucugugacugcugcaagacuucaacaaauaguauugaaugauauuugagguacauuccuaggucuucagaaccaaguagcaaagagaguuuuugcuuuuagaguagaagaaugagagaguaguagacauacaaugugucagguuauaauaaguacucugaagaaacucaagauacaguauuccagggauuagagagaggcagaacgggguuaauauuguauauggaguauuagacaauuguucucauagaaagguaguucucaggguagagucuaagugaccaauauaaacaaaucaugguaggaaagucacguuuccccaguuuuauuugaagauuuuuuuuuuugacagcaaaugguuuuuaauccaacgugaauauauuauggugaauaauauuucuaugaacucuguggcuaaaccaggagacuuugaagaacaaguacaugguuguucugccucuaguucucuaggcacuuaaauacuuaugaguaugucgaggaaaaucugagaaaugcugcuuucuugugucacugccucagagaacgucaagacuuaaggagauugcgaugucagcacucuccauccuggccucucuaucuggggaggccaaauguucagcaguguguuuuuggcugaauuacugaguguuacaugaggaaacagaaauagguaauaaaacagagaaguccuucagguuggauguagguaguuauccauaaugucuuuguuuuugccagcaccugagaagugugggcggauuaugccuaauuuauuacuuagauuucagauuucaauauuaaaggggaaaaugucuagaaaucucaauagugcugggcuauguagaaaaacaagguaucguaagcauuaggcauccuuauuacaucuuugaaaacaaacacacaagaucacuauaggguuuuuuuuuuuaaacaaaugucuuagaauugauaacauuuaaauuuguucguauauguuaauauaaaaaagcagauagaaugagggauguggaaaugguuuuguagaggaacccaaagaaugagugcuaaagcaggaggugagcagcaacaaaguauaugucagugauuggauaauaccuucucuuagaagaccguaguucugagugcagggacaaagaaagggcuugcuuaccauacuacagcucuugguggugugauggcucacgcuugguggugugauggcuggugugauggcuggugugauggcuggugugauggcuggugugauggcuggcucacgcuuccaggaccaucaaguacaggaguggauucuucagaguuucacuuuucaagacuucauuucuaguuagcaccagccuggaaacaauagugaaauaaauagugggugggggagggggggggggcuuuugggauagcauuggaaauguaaaugaaauaaauaccuaauuaaaaaaauaaugaaauaaauaaaaaaaagcuuuaaguggcugcuuuaauugcauaccuguagauuuauauuccuugcuuuguucagauaucuuugucuauugaucuaguucauaauucuccagaugaacuaaacuuuuuaacuuuagaaaaauuugagaauauugauuuucaauuauuucuguuauaggauuguuguuuuuuauguaaauaggcuucuaucaccguagauuuaugaaaguauucaucaucuuuauuguaaauggagugauggauguuggcugauuugcgcccaguacacacccugggaguuacucaguggcaucuguccuucccuuuuccuuccugucuuuuuuuuuuuuuuuuaaauacaaacccaucccuauccccaccuccuauuuccuagccaggucaccauaggaaacuuucaguugguggcaccaccucaugacucgucaccucgugacucgucgccucgugacucgucaccucaugacucgucaccucgugacucgucgccucgugacuugcugcuugaguuaacauuuugcccucuguauuuuucuuccuguuaguaaucucaucauggcgcagcuguggugaaguuggucuuagauugguugcaaacuuuaaaauacauaauuuccauuaagcgaccagaauagggagacagcgauacacuggaggaaguugaauuggucauaaaaguaauaacucuuugggaauagcuagaagugccagagauugugaaaauuuauuuguacacgguggcauuuaugcauauaaaauaagagcaaaacaaacaaauuaaauucugaugauuuuuuuguuaaucuuagucagcuuguagccaucacuauaacaguguuugugugcuauuaugggaaaagccucauaggaauucuuuuccucaugcugaaauguaucguuuuguuuguguguuuaauccagcucuggcagguuggucuugcuagcaggagguugcuuggagaucagugaugucacugaggaugaugcugggacuuauuuuugcauagcugauaauggaaauaagacaguugaagcucaggcggagcuuacugugcaagguauguaaauauuuacugugaaauuaaaaauguuguuuacuguccaggucuacugauuaacaguaauaugagaaaggcaguacaucauaaucguuaaaaugcaaacgucuagaccguaucacuugaauucaaauucugagucugcauuucacaaauacagcaauagaaauuuuucuuuucauauauguguaugcaguauguguguaugcauguucacauguguuugaggagcacauguuggggagugcaugucuaguccugagacugauagcagagucucuuagucaaaucuagagcuugcuggugagguuacucuugcuacccagcuuucuguggggauucugugucucugccuuccaaggcuggaauuacagaugagcugccacgugcaccugacguuuguguagguucugggaucuaaacucauccucuucacuucagcaguuaaagcacuuucugaaaugaguuuguuagagaaaacuguagagaaguuucacauaauuaaaauuuaccaucuugcagaccaacauguuauugacacaagaauaggaaauaaaaaagaaugaaguccaacuauuaauugcaguacugugaccacaguugucaggaucagagccugacccuagcagcaccaacaagcgaggauuagccaccugucuucaacaggccaauuaaagagaaaaauaacagugaaaagcagagaaagaagauuuacucaguggccauaaugcaaagaacaaauaaagaagucuagugaccuccaccucucaaguccugaauuauguaugcccccaaacccggaaauuguuguuaggagcaucaaauuaaauacaucucucauacuuguuagcuucugguuuuacuucacuauuucucuucgugggaacuuuucuucauauggguauggacaaaacuuuaggguuuuguggugugcaugacucagcaguccugguuaaggugggauccugccauucacuacugaccuucauuaucugggcuccauucuuuucugccagauagucuggcauacacuaagaacugugcgaaauuucuacuugggcggaagcuuccucuucagagccgaggaagguaccaagcuucacaaugagcuuucuggaggaguucugugucuuggcuauuuuuuuuuuacuaguuugacagucaaagagaauauguuuuuacagacaaauaucugucuucagaauauuuuuguucugcuggaaugguuacaauuauacaauuuaaaauauaaauacaggaauucacuuucaaggaggaaaagauaggcccgugcgugcacacacacccacauauauaacaauauauaauauauuauuaaguguuaaacuauuaaaagaauaguagacuuucaacuggaagaaaaugaaguugggucuaaaugugaaaacacaaagaauaaauggaguuauguuuaauauuaucuuggguagaagaguguaucuuaagaaaagcagggacaagaaagcugguucagguaguaaagauggauagcuugucuuccagaaaaugccaggggaccugaguucauuuccuaguaccacauugagcaucacauaacccucuuauuugggggcuaggguuuaugucucuuguucuuuaauucagguagguuuugaguuauuugaauuaaugagaguauaauacaaaugaugcgugacuucuaagguuuauauuuuaaagccauguauauugccuuuucugauugccaauaauaacgaagaggguagucuuuaauaaauuguaacaagacuaaaauuggagccuucucuuauaucauauaugaaagucaucccaaaguagauuaaagacuuaagauugacuuuguaaagcugcugagagaaaugagagaaagcaugagguuucuggaaagguuaaaagguguuuuaguugguuucuuuucuaugugacuuauaaauagcacaggcaaaaaaaaaaaaaaaaaaaaccaacaacaacaacaaauaggcuuucauggaauuagaaaguugcacaagaaaggaugaaggaaucuuggagcgacuacuacgaaaugagagcaaauauuuccaaacuauacaucugaugagagguuaauaucuagaguagauaaggaauucaguucaguguaagaaaagaacccagugcuuaaauauguucaaaggaccugaaaagacauuuccugaagacagagaaguggcccauggguauaugaagccaaaacuaugaauaaucauuagauugugugaguaaucauuagagaaauucaaauuaaauccucaauaggauaccaccucacacacaguagaacuacuguaugauccaauaguucuuuuuauggcuguauguucagaugaaaugaaaucauugugucaaaaaacuaaguuuacucaaccaugcugguuacagcgcauaaguagcuagacuuagaaucaauuuaguaauucaucauggaugaaugaacagcaaaaguguuacaguggaagcacagcuuuauagaacgaagucuugccauuugcaauaacaugaacgaaccuugaugauauuauacuaagagaaauaagcauagaaagacaaauucugcaugaccugauuauaaguggaaucaagcauagugaaacucauagaaucaaaaagaagaaugguuacaguguauucucuacuuaaaaauuguugugagaauagauuuuaaguguucucaccauaaaaaacuaaguauauauaagguaauagauaucuuaguuuaauuuauccauucugugcuaauagacaucaaaacaauauauuuuacauaaauauauacaaguauugucaauugaaauuuuaacugaaaaaaaaaaauaaguguuuugaucuuguuuuagauaggcucucuguaguccaggcuaagccgagacuugugcugauucaccugcuucaggccucccaagggcuuaacuacaagggugaggcauuaugcucuguccuaaaaauauguuuuaaauuagcuacccuaucaggaaaauuuuaaaaaguuaaaaauguauauaauuuauaauguaauauuaaaauauacaaacuauaaauuggcaagacuauaaacaggcagaacuaaucauagcaaucacauguuaguaacuauuagguuauauaaauuaaaaauaaguacaaacaaaaaaaauacuuaaaauacaacuaaacaggacagguaauaauuugaccuaguugacauuuguauggguggaguuauagcucagucauaaacuguuugccuaguguucaaaaguccugggcuaaauuguaaaaaauaaaaacuacagacauuaucaugaugauguacagcaacuaaauaguacuguuucauugugugaggguauauugcuuuaugugaauaaucuuucaguucaugaguuagaaagggaauuaauaacaaaauuuagaaaauaguauaaacuaauauagauagaaacuagcaaaaguugagggaaguuuguagucuguguguguggggggggagagagagagagagagacagagggagagagagacagagagagagaaaggcgcagcagcaauuauaacauuaaccucaaaacugcuaaaaguagcaaauuuaaaccaaagaaaauagaaaacaaggaaguguuaaguaaaaguuaguggagggguugggggaaaggcauuaaaacagacugucagcaaaaccaaacuucagacaaggcucccaacaaauuugguaaauuugucuauuuacacaggugcuaagucaaaaggcuuacacuaucugguguuagguugaggauaacuagagacuuuaauaaacuauugauagguauauacacugauaacauuuuaaaauacucuuuaaagaacuagagauuacauuugucuuugauucccaguuuacaaaaacaagaaaccuguuuggcagaauuuauuaaaacugaacauaaagcuaauacugugguacagggaagaaugcuuauaacacgugaacagacacuggcacuaaaagucaugcccgacaguguuccugccguauuuauucuaggaacucaaacugguaaugaugcagaugcccaccagaauccagcauggcauugugucaggaguggaaacaggcacgccaccuuuauauugaaaagcguuuuuaaaaaaucucagaagcacuuuuaaaagaaacuaggcacaaagaauauaauuuuauuuuauaauauuugaaacaggcaaauucuauaauuuuuuuuuuuaaguaccaagcuucugcugugcuaaggccuuguuucuacucuggagaguggaguucaagcugugcuuuucauggguaucaugugaggucauuucuccgucauuguguacaacaaaaaccauuuggaaaauuuuguuuugagccucaucccauaacugaaaguauuuuauuuccuugauggggaaaauagcuuaugagaaauaauuggggauauaugcaccugugucucuauauguauauauaaauucagucacauuuguaugacuuguuauuuuuuaaaaaguuauagcuguaggaaaugacagugguuguuaaugcaguaaagguuauaaguucauuuuucaucuguuaaauauuucacauuuacuaucuuaccauuaacgcuugggauuucgacucaugcuaugacgugaauuagcugguuguguauuuccugccaucucagauuguugauaacagaugauaagggucaugaguugcauuuguaauagugugugaucaacuccacguacucccaaaagaaaauuuuccauuucugguuucugggaacaaauugacaauuucugaauuagccauuuucauggcaauauuaauauugugacugaucuacugcuaauguuucaaucaucuuuuuuauuauuauuuuaaauuuuagaaauggauaugaguguuaugucucuguguacuaugugugaggccagaagagcagcagauacccuggacuguacaugggugauucugagaaucaaacccaguccucagaaagagcagccaaugcuuuuagucacugagcuguaucuccaguccguccaccaucuuccuucaagccacagccucauaccgcccuccuauuacucaucuuguuuuguuuuuuguuuuuuaaaccucuagccacauuaagaaacugaccuucucuuuucuucccaucuccuucaugacgaucagccaauauuucguugucagucauugacuuucuuagaugcugcauaaaacacagauuuuauaagguaguguauagagcccaucaagggacuuacuagucaaugcuaguccuccuuagaauagggaacaaaauacccauggaaggaguuaaaguuuggagcuaagaugaaaggauggaccauccagagacuaccccacccggggauccaucccauaaucagccaccaaacacagacacuauugcauaugccagcaagauuuugcugaaaggacccugauguagcugucuugugugaggcuaggccugugcaaauacagaaguggaugcucacagucagcuauuggauggaucacagggcccccaaaugagaagcuagagaaaguaaccaaggagcugaaggggucugcaacccuauagguggaacaacaauaugaacuaaucaguacccccagaguucaugucucuagcugcauauguagcaggagauggccuaguaggccaucauugggaagagaggccccuuggucuugcaaacuuuauaugccucaguacaggggaacgccagggccaagaagugggagugaguggguaggggagcagggcgaggggaggguauaggggacuuuugggauagcauuugaaauguaaaugaagaaaauaucuaauaaaaaauugaaaaaaaaagaaauuuuuauaauaaauuuuauaauaaaauguuuaaauaacuuuauagcuaucuuuaauuauaauugcuuuaucaauuaaccaucauucuacccaucaaugucauuucugauaaauuuuuaaaguuguucagagaacccagcauucauaucauuaucuacaauuuuaauauucuaagagaauuuuuuuagauuuauuuauuuuauuuuaugucuaugaguauuuuaccugcaugucugucugggcaacauaugugugccuggugucuggaggcauccuauccucgggagcuggagcuguggauggcuaugagccaccaugugggugcugggaaucaaaucuggguccuucaaaagcaacaaguacucuuacuuccugcgccguguccuuuuuguuuguuugggcuuuuguuguuguuuugauacaggguuucucaguguagcccuggguauccuggaacucacucuguagaccaggcuggccucaaacucaaggauccaccugccucugccuccugaaugcugguaguaaaggcgugcgccaccaccucccggcaagucauguguuuuggucccaagaauuuaauauuuugucuguaguuuucucuucuuuugaauacauaaauauuaaguuugcuguucaugagcuccaucaguugcaccuucuuguacaaccgagauaucuauaaggacagaaguauuaccaucauaguggaaauuucugcaugccacuucucaucccuuacugcgcucaaagcaucuacucuugugagcuuuccaguauaaauuaguuugcuucccauaaaagcauuuguaucaucugcugcuguuguagaagacuuauuucacaaagcauaacauauuugggauucauccaugcuguauuuauuaacagcugauuuuuuaaauugguacuuauucuauaccagacuucucaaaguaauaggaccaguuuacauucugccaacaguguauauucugguggcuguauauccuagccagcaguuaguuuuccagccuuuauaauuucauucauuguacuugaguauacacacaauucuguaugguuucaauuuauguuucuguggugauuaguggugcugaguaccuuucugucuguuaacaguaaagguagucuaauaucuuucuuugugagauauuuucuaaaaugaugccuuccuguguacauaauauguaaaauagccauaucaaggagaauucuuaaaauccuguauuagggaguuuucuguugauaaccaaaagaaauagacaauagaaauaaaaacuaguggggggcagcuggagagauggcucagcaguuaagagcacugacuguucuuccaaagguccugaguucaaauuuuagcaaccacauggugguucacaaccauccguaaugagaucuggcgcccucuucuggagugucugaagacagcuacaguguacuuacauauaauaaauaaaaaccuaacaucaaauauugauagaauuucaagguuuauguauuuagaaguagauaaauuuuagcuuuuaucauuuccauuuuuuuugcuuaugauuugacauuuuucucacuguagcccauuuaaauucucuuaaauaucugaaauaucuaauuuauaaauaaauuuuugucuauuugaaguauuuaauaacuggaccuauaguaaauuaucuaaauagaauauuaagguuucccagagaaacaaccaguagguaauacaaauguagguaaagagggaaaagacuugcugaaaaauacuggcucauaaaacuggaggccaagugaggagucccaugaucgaucugcgguggugagagacuuaggagagccauagcagugugauuggucugauuagugcaugcuguguuaauaugaauaaaagucuagaauccaggaagugcuaagggcaagaagugcugagagucucugcacaaacagguagaaggcaaguucaaccuuacuuugcuuuuugguuuugguggauuggaugauacgcaugcauuggugagagcuuucuuuucuccauacaauacagacaucccccucuggaacaucuucacagacacagaaagauaacauuaacuagguaccugagcacccuguugcccagucauguugacacucagaauuuacagucguagugguagucaucuuuuuaugagucuuuaaauuacagagucaaauuccugcguugucaaaucauccauaaagaauuuuacuucccacauggcccugcuugagguccaagucaauagaacuauagaguuucucaggcauuaccccaguauauucaagugagaaaguaaaauacacgcagguuauauagguccaaggcauaacuauccucaguacuucuuagccugcagugauugguaccaugcgaguauaagagaacugugcuucauuuguucauguuuuauuuuuaauguuguaaaaagaugaaguaaagugcauguuuaaguaccuaauuuacagcuuauauugaacaaaauaauuuucuuuuuaaaacaccguagagaaacaugguuguugagcugaugauugaccaagcuucugaaagccaccagguuauauuagcuccuuaaacuuuuucauugugaugcugaauauugcugcauuugaaaacauuggaauggguagaauauuggaacuaugagccauuuugauuugccaagaacuuuaauuauaguagaaguaacaccaagcaauuuucuuuccauaguguaauccauauuuguuauggauuauauauaauuacaugaauaugccugaaaauuaucuaaauuaucuuuccuaucagcaagaauacauuuucacauaugcuugacauccuucuaaggcagagugauucuccccaagaucauauaccuaaaagcauacuagaaauucuaauguaaaaucccagaacuucugauuccuggugauaacuuuaggagucuuuguucuuugaucuuucucagugacuuuuaagcuacuccaaauaggaauuuuaugcugugauccaauacacagaaagcacauuugucuuuacaaagcagugccuaccguaccaccagagaugcacuauuuucuguccuauacuucuggaauuuuauuuucuggacgcaucaaugagucaucuugacaaaggaguaggaauugucugcucuaguuggaaagacuauuuaucacuggucuuguuugggauugcuaguaaaugcuaaccacuaaaguaaauuaaucuaaagaggguuuauuuaacaaucuaagauucuugaaugucucccuuccuuuagugucugccagaauuggcaaugcucacuggacugaacuuauuguugaagucaaaacauuuugaaaaaugaauguucugcuuuguauucaacuauugaagcuuaucuugaacagaaaauucaaugauagaagcaauuccuaagagcuaaaaugcuaauuuuucagucacuauguguaauuaaaaaaaaaaaaagacuuaaauuugcauauggaaaacuaguaaaguauuuuuuguauaguauaccuauuuggggaauuuucauugauggcgaagaguuaaaaaaaaaaugccaguaucagauugauagagaagauguuaagaacacagguucuucuuuggagaugagaacuugaguaguucauuggauguguuuugggaauuacauauauucaguguuuucuaaugcaguuacgaaaucauuucucuagguuauaaacugauacuacaaaagaauaauuacuuuuuucagauuauaagaauaacacugaaaaguacuaguaaaaaaagccaccuuucauuucaccaaccagaaauacugccuuugcucuuacaguuuacauauuuuaaaguauuuauaaacaaguucguguuuuucuuaaagugaaaucauacuauucaucuuuuugcauuuuuuccuguugucuaucauguuucuuucuacagcaacauacaauuuuacauagugacauaaauuuucaucauaucuaauaaccuucuagcagacuaacaauuaguaaaaauguuacucuuaauggcccugcuacagcuguugaaacuacucagcucugcuauuacagcaaaauagcagucauugacugcuuaacugauuagugguagcuacuucugaauuaugauuuuauuuauaaaacuggacugcuuaguugguaaaaauagcagucuagacugcucauuugcuuauucaggcuucauaguuaaugguuccuagagccucucuaaguaacaugguuuuuaaugucuuuguauaugcccaguuauauuaccuauuuguuacccuuuugugauguuuuuccccccuccaaagacugcuugguuuuucaaaagaaacagaacuaguaauuauguauuaguaugaauuaauauuacauauaugaagggaguuuauuagagaggcuuauaggcuauggucugaauggcugucuccugaggcuaaggguguggaaggcguucaguccaugagauuggaugucucaagcaguccuaaucuggugcugaaauccccaagaaaguccuagcaagguucuaauuuuuggucuaauguuggaauccugaagaaauagauuucuaguaccaaugaagggaugucuugagaacaguauagaugaacuugcuauccagagugaagccaagcaggcaaaacaaacuuucccuuuccauguccuuuugagugggcugccaccaaaaaaagguguggugguauagaaauuuuuaauucagacccaggguuucuaccccgcuuuugaccauucaguuuccggauaaaagacacacacaaccuuuauauuuacaaugagccuuaaacagcacaagagcuggguagagaucuacccucuaugcuauuagaagcuacuuuccuaugaauaacccugaguuauuacuuacuagguuucaucugggcuucucuuaacucuaauuggucagcccccagagccuguuuucuugaacucaccuagcccaugguggauucuguccauugaccuuuucuccccucaugguucuucucagaucccaagcccaagaauccuaaaaccuacaugugucucuucugcccagcuacuggcuguucaagucuuuacuuaucagucaaguauuuaccagucaccuugagguuaaggucacccuaucacuuggguuuaugugcagauucucuucucucugggacaaccacguuuugggggcucaaaauuagcauuagaauacaaguagcugcuggguggagccucucugaggacagcacgcuccugucugcaagcuuaacagaguaucauuaauccuguaagggauugguccuuacccauggggugagucucaaguugggcugauuauugguuuguuauucccucagucucugcuguauuccccaugccugcauuucuuguagacaggauaaauuuuggguugcaaguuuuguggguagguugguaucucuaucacuccacugggguuccugccuggcuauaggaguugccucuucaguuuccauauccccaauguugugaggcacagcuaagugaccccuauugauucuuggaugccuccacguuuccaucuuauccuggagauacccccaccuccucacuucugucaguugcagauuuccauucauuuucauggccaucuagucaucuuuccuguccugagccuccuccauuucccuccccauuacuccucccucccaguuccuuuccuccaucugccucuuacgacuauuuuauuuccccuucuaagugagagucaagcuuccucacuugggccucccuucuuguuuagcuucuuugggucuugggaguguagcaugguaccuguauuuuauggcuaauaucuacuuacaaaugaguagauaccaugaauguauuuuucggucuggguuaccucacucaggauaauauucucaaguuccaacaauaugccugcaaaauucaugaugucuuugguuuuuuuaauagcugaauaguauuccaugggguagauauaccacauuuucuuuuuccauucuucaauugagagacaucuagguuguuuccagugcagacaggagcauguuguccucugaaaggcaccacaaagcagcugacucagacagagacauccacagucaaaugguggauggagcuuggggacucuuauagaaaaauagaaggaaggauuucggucccaaaggggacgggaacuccacaggaagaccaacagagucaacuagccuggauuugagagucugagucugaaccaccaaccaaagagcauacacaggcuggaccuaggacuccccacucauguagcagaugugcagcuuggucuucaugugggucccaaacaacaggaaucagggguuauccaaaaagcuguugccuauauguggguuauguuuuuuuaggugggcugcuuugucuggccucagugggagacucacagaaacuugaagugccggggguggggguggggggauaacccagggaugcccccaccugcucagagaagaaggagaggaggagaugggagaaggauuguucggggguaagagagaaagggggcagugagcgggauguaaaguaaguaaguaaauaaauaaaaauaaauuuaaaaaaaaauagaagcagcaucagaccaacccacuacauuguagcccagauuuaggaugaaucuuccaccucaaauaauucaaggagaacccucuagagguuugcccagaugcuuggguuuuaguuaauagcagaugucaaguugacaaccaagauuaaccaucacaacuggcauuacuaaaguaaaagguauuuauguuaagcauugcuacaucuuuccaaaacacccuucagguaaaugggauuacuucuccuacccaccaguaaugagguuauauucuguacaauugaaacaaaaauaauacauauguaagguauaaauuuaauguuuaauauguauauacccaugaaaauaucacaacagucaggauaauuagcaguuaucacucccaaguuuucuaacgccucuugcuaaucucucccaugugucuuucauacuuucaucuuugaauaacuguugaaauacuuuagucgauauagauggcuugaauauucuagcauuuuaugugugguccccacuaccaucucguuuugaucuaguuuuuuuuuaaauaucagacuuagccacguuguuggaauuaucagcaguuucuuaccauuuuauuaagaaacauauuauguaaauauaucaugguuguuucucugucuuuugaaagacauuuagguuguuuccaaauuuuggcacccagaaauaaagaaccauuaacuucaguguuuuaauucugagguauauauuaccauuaaaaaaaaaaaaacuuuuauuccuaguauaugacuguaauuuggauggugaaggccaggagugcccaagacaccagggucaucauaacaagucaaaggcccaccuggguagaagagaccuuaucucuuaacaaacaggcaaaccaaccagaagucauuauuaccacuaccaccaccaacuucaucauaauauauagucagauaugacacuuuauucuuucuguaauuaaauuuugcuuugguuacccccuucauguuaaugaaguuaucuucuguuuucuucugauaauuuauacuuuaccuuuuggucuuuaaugugccuugguuuugauuuugcaugugguaauggguaaaaaucugacuuuauuuuuuuccaaauggauuaucuguugcuccaauaguauuauugucucuauuuauuuggaugucaccuguguacuacagcucucuauagcuuauuuccaaaugcuguuuuacuuaaaggaggcuuucauuauauuaaccccagucucagugacugacauuuuaugaggaaguucccuuucuaucgcucucucaaagcuuucuguccccauauauuuccuuccaucugacuucugaauucaguuugucaaguuuuguuaaaauucucuugacaguuugaaugacaguuuauugaauuuguugauuaguuugaaaaaugacaacucuuucagagaguguuuuaacaaggaguauauuuauaucccuaguuuuauuauuuuuaauuaaacauuuuuauuauuuuuuaaagacuuaauuauuugugaguacauugucacucuccagacacaccagaagagggcaucagaucucauuauggauguuugugagccaccaugugguuucugggauuugaacucaggaccucuagaagagcagucagugcucuuaacugcugagccaucucuccagccccuuacuuaaacauuuuaauaggcaauauaugcagagaaaauucaaggauauguaaugaaagaucaccuuugucccagacucccuccauggaaacgccauugcuguuggcuucucuucuauucuucuaaaaguagucuaugccuguucaaguaaacaggcauacgcagcaagagcaugaacgguuagcaggcagccuuaagagaugguugucaucagggacagauccaaguuugcugggauauagacugaaagcuauuuugaaaacuuugccuaagaaaaugaauaccagaaguaccaaaaugaguaguuguuuaaaugagaaaaugauaacagauuaggguuuguuuguuuguuuguuuguuuguuuagaugauacauacuacaaacauuacaaaagucuaggaaaauaauacuuuuuaaaaacugacuuauguaaugcuugucuuggcucuguuuuguuuccuugggucagugaucuugcaagucauccuuuuguuaaaguagaaagccagcuugguuuuuaacucacucuuuaagauuuguucaagugaauguaagccuauacguuggcaucucucuguugaguccaguuaauagagugggcugagggaaugucccuggaagcuguucuuacgacagcuuaaguauagacaacagucuuggcacaccguguagaugcuucuuucucagugaccccacuaaauguguagcucaguuucccuugucuuugugugaucucagcaauuccggaaaucagccaguucaccaccuacuaucauaaggagcuauuagggcccaagcauaagcauucuuaguggauuguacauagaugucgcagcuugucuugguggcaggcacauuccuaucauuuuguacucagggaaacagauuaaggccuauuuagaccauacaacaagauccuuucucaaaacaacaacaacaaaaagccauacacaaaaauaauacaguaguuuacuauuuggugguccccagccuguuagcauuucaaacauaguucagagacuauuaucaucuauuuauguaauagugucaguauaucuguuguauugaucuugugggguaaaauuacuggaucaaagaauauaugcaauuuugguuuugcauagcaguuaaguaaauuacccagcauagauugucucuguuuuaucauuccaaugagcguguuuguuucuccuaccuuuguuagccuaacauguucugguacuauuuagagaugacaucagauccuacaggcuggggacucaauucuccaugacuuuucucuccaguucagagaaguccgucacaagucuagaccuccugaacuucugacuaaccaacuuuaaguuaagguucccaugacuaccucuuuggguuacauuagcuuguuacaguggcucaagaacucaaggaaacauucaacuuauacuuacucauuuauuaugaaugaaauaccaaguauauuuuuaaaaugaaaaaggcauugagcuaaguacauggguagggaccccagagucaugugccuucucuaagcacaacacccuucaggaacacauugagcugccuagaagaucuccagaacuuuguuuuuugagggguuuuaauggauguuucauuacauagaaaugauugauuauaucaaucuccauugguaagaauucagccuucaucuccuuucagguuagggccugguacuaaaaguucugucuaauuuugguugguuccuauggcaacuagcucccuuccugaggcagucuuagagugcuacaagaguugacucauuaaaacaaaagaaaccaucaucuaaggaacuuggggauuuauuugugucaggaaagugaauaccuaaugcauauuuaacaauauucaaaguugaacauacuuaauguuuuuugucucugauguaguaucauacuuaggccuuucuucaaagacacuuaaaucaugcuuucuaaucuugcugccuuaggucugugucuguguaaucauuaaauauuuuauacauauauaauuuauuugguguaaggaauauauuaagauagggacacaaauuacagaaaugcauccaucuaucugguuaaaaaaaggaugaugucuguuaaaauuauaggaaaaagacuuaugaaaaacuagcauaaaaacauugaauccuugacacacauuuugggggaagaagcuuaccaucuaauucucugauaguucugauuaguagagcuuuagauaauaauugauuacuuucugcagcauaauuuaggcuacuuuguuuucagugguagaugaggcagugaggggugggugcuagagaagaugugccuauggagacaaugcuucuuuaaggaaaugcuuuaaauugggaucuguaggaugucuacuugucagcuaaauugggaagaaugggcuagggaaauggagugagaauggaauuguaaauaugggccugagaaaagggcaggauauuaaagucuaguggcaauuucaugguaagguuccugcagaauggaugucgcagucuuucuuggaauacaggagaccuauuuaccuuuggugcauugggaagcuuucucuggaaauggugugugugugugugucugugugugugugugugugugugugugugugugugcgcgcgcgcgcacgcgcgugcgcgugcgcacaugcaugcauggaugcauacuuuuagcagauuuacaaauacacugucaagugaaaucucuaaaaggauuucagacuuaagcgcuugggcgaggucuuggucuauuuugucaacuguuuuuuaaagauuugggugaugucaauuugugaauuguagaaaaagcuuaagaacaucaaguauacaguuuaacuaacauaaguggacacaaauuauuuuguuuuucuaguuaaagugauguaugagaauuuuaguacuaaacugaaagcaccagcauuggagagcuaauguacaugaaaaccauuaacucccaaauuacagcaaaaugaaguaaccaugaaacuuuguuguuggccaacacaauauaauuuucuguuugaauugggugccaaguuccagcaucauucaacagugguggaauuaagcuaguuuguuuguuuguuagcaaaugaauuuuggaaguauaauguuuguuuucauauuaacauuuuauguguguauuuagcaaucaaaauuacccguguaaugauggugguaauagaagggauagagaacuguuauagagaauuugaagcuuaauuaucucuuugguaacaaaauacauaaucuuccacuguaauacuuauuuucuuaugguaauugauucauuuguucucugguuaucugcuuaacuuccuaaccacaaacaucugcucucacauuaucucuaauugguaugaguacuauauaaagaguaguuaaaauccagagaagguuuuuuuguuuuguuuuuuaaaauaauucaugaaagggaaaaguaaaugguagacacuguuuaugauuuucuuacugaaaauguauauuaaaaugauuaauuuaauuuuuaaaauccauuuugcuguguuuuguagaauuacuuacucuacucuaggggaggguucccaaauacuagauaugagcucaaggaauaugucaguuccuuagaaaugguaccaucuaaguuaugaguacacgcuuggaaaguagagaaaaauuaguauuuauugaggaggagaggugaggcaaguugcuuuuauaucuaaggaaaauggaaggauaaaccauaacuuuuuuuaagauuguuacuuacggaggggacuauguagacaggauagaagcccaacuuaauugggugcauauuguuuguguagauuucaguuuuugccacaugacuucugagaguggaaaauauacaaaugauucaaaguacauaucaguacauaucgagacgacagaguaaagccacacagguacagcuuaggccgaaaguuauucagaucauaugaaaugguaguuggacuguguaguccuaauggaguguauucuaaagacaaguagcugcaaauauuguugguaaaaauguuauucugagagugaggagcuauaaaauauaagacagaugcauaauuauguuaguguuaauugguagcagaaauuuuuaguagaaagaacaaauguuagaguuaaaaagauucauuuaagacuuguugaccugaauuuaguugguaacuuuaauagaaaaucaagauacauaauugcugguuuuguaaugaucagaaaauacugaaagaccaccaguaaguaaagucaugacaggaaggaccauugugcauccaacaagcccaggcuuccucuauugauaaagaaaagauaguuucaaaucauagaacuguaaccucagugagaugaaacaaaccaaaugcaucuuaaagcuaggacucacucuaaugcuuuuaaaaggaucucaaacuuauaagagauuuccccuacccaagaccucuuuguuaggagaaaacauagcagcuucccaaaggcagagcuguuagccaaagcuagcccaauugaaauugccugcaaggaugcuauagauacugucuugcaaaaauauaccugucugauacuaaacaaacaaacaaaaaaaucuguugauaggaaaucuguugagcuguguucuagauccugccuauuggggugcugugggcuagaggugguauauagaaagccacauuuggaguaaacuagaggaacuuuuggggagaauuaucauuauaucuuacagaagccaugauauagacagggaagaaaguguauacuccaagagauaagaaaauuguaaacacaauuauugaaaaauggccaagugccuauauagauuaaucacaaaagauuuuuuuuaagauuuuaugggugcugcauccuuguuauaucuagacacacacuaaauaagaucuauagugauacuacuagucgacaagagaauguggaugguaaaauuuucacagggccacgucuuuuuccauaauuuauuuuuguucaguuuacaucuuuaucacaguccccccccccaguaccaccucuacaaggcucuccccccacuuccccaucuaaggagaagaggaagcccaucuuggguaccacccuacucugagacaucuagucucagcagggcacauccucucccauugaggcccaaccaggcagucuagguaagggaaagagcuccagugccaggcaacagagucagagauagcuccugcuauaauuguuaggggacccauaugaggaccaaacugcacaucugcuacaaauguguaaggggucuagguccagucccugcaugcucuuugguuugugguucaaucucugugagcucccaugggcccagguuaguugauucuguuggucuucuugugguguccuugaccccucuggcucagucuauucuauucuccauucuuccauaagacccccucuagcucuuccugauguuuaucugugggucucugcaaucugccuucauccgcugcugaaugaagcuugucaggagauuuuaugcuagguucugucuguaagcauagcugaguaucauuaauagugucagguguuggcucucucacauaagaugggucucaaauugagccagcuauugguuggucauuccuucagucuccgcuccaucuuuaucccugaacaucuuguaagcaggacaaauuuuggguugaagguuuuguggguggguugaugucaucuuccuuccacuggaaauccuaccuggcuccauaaauuccccuuggcucccccugucccaggucuccagcuagucccagugaugccccucacugauuuccacugucacuucuagcccucucccacccuucucccccuauacuugauccacaaggccacuuacugaaaagccacaggcaucaguggcugcugagagguggggaauuaguuuucuucaaggacaagcgucuugauagucuauccaaucccaaguggucagcccugcacacaugcauauaagcaacacuaaauagguucaguaauauguauauguauaugaauauacacaaaacacuucauucagaagaagagaugagugagugugugcuuugguuauaaacacaagaguuagaaggagaggugaacaccucaggaaaaaaaauuaaauuuagguuaaaguuugcauauuugggaggauggucacuuuuccuaacuuuauucuguugucaggcuuuaguuuucuugaacuuaaucucauggcagauguagggcugucaauuugccugugaauuuaaaaaaauacuuuucuuuacagcugaaugauauuccaucaggcaguuaauuuuuaaaacuacugugcuaaaauuuaaaauauauaguuauaugauuuuauaaaaauaugcaaauaacugaauucuacgaucuaaaaguuuguugauaugugaauagcuuccuauuuucauuuucauugguaucuuuucuuuauauuuuaaagugccaccuggauuccugaaacaaccugcuaacauauaugcucacgaauccauggacauuguauuugaaugugaagucacugggaagccaacuccaacugugaagugggucaagaauggggaugugguuauccccagugauuacuuuaaaauuguaguaaguauuuuuuucaaagaaauacauuuuauuuuugaaaccuucaaguguuuuuaaauguaauaaucaaaagauauaauagacauaccaguuuaaauuacuguaaaugaagaaaaaaauauagaauguaauuuacuuuuaaccuguagagaaagcuuugcucagaaguauuuugguagcuuauauguaacaugagauuacauagcaaaucaguggcuggucuaggcuuagaacccaccagcaaucugguagugagaauguagcugucagcauugcacaaggaaugcagugugugcaugcagguguauucucauugucuucacagcuauauucaaggagcagaucucucucguccucucucucccugucuccucccuuuucuuccuucuguuccuuucucccuuuuuccucccugcucccggggucucacuguguagcucuggcuguccuggaacucacuauguaagcauggcugcucuagaacuuacagaaauccaccugccuuugccucuugaguacggggguuaaaggcaugugucaccauauccagcucuggcuuggagaauggaaagauagucauuuugaaaagcuucuaagauaugacaaacccuacuaaacuuuauaaacuuauaaaaacauuaucauacuucaaaauaagaaugaccuuaugcuaacauuacuaacaacaaaaauccuuuuagaaagugaguacgucaucacauagugcccuucauauaauuugcauguauuaguugaaggaacuuucaaaguagauacaggcaagccauggugauauuagccuguaaucccagcccucaggaaaugaaggcagggggauaauguaggggcuugaggccaggcaggcuagguuaucagugagaugguaacaaaacggcaagugcagaucguguuaaaugucaagcuauauugauaucucagucuguaaaguacuuuccacguaagcaugaaggccuaaggucagucuccaggagaaacccagguaaggccuugaguugaagagccacacuauggagauggagacagguggaucccagaggcucacugccagcuagccuaaccuaaccagcgacucucccagaucccagugcaagaaagaaaauguggggcuggagagauggcuuagcauuuaagagcacugacugcucuuccagagguucugaguucaauucccagcaaccacaugguggcucacaaccaucuguaauguacucuucuggugugucugaagacagugacaguguacucauauacauaaaauaaauaaaucuuaagaaaaaaaagaaagaaaaaguguuaaauguauaagaauuccuugucaaaauugcauuuuaauucuauauauguuagguauauaguagauauuauugccuacuaauauuaucauuuuuuaauaucaaacaaacaggauuauuuagguuuuaguaauaaguaugaauggcauaccuuaagaucuuuacucaaaacuuauuaaaaagcucagaaguaauuauaguguuuuaaagacaguuucauuuugaaaauuugucaugcaaguaauucauuuuugugggaguguuucuaaaaugcauaaucucauguuaacaaaaaguaguucuaaguacuuaacauuaaaaccaaucuguugugauuaaauuagcauuuuuauuuuaucauuguuuauauguuguuuuuuaaauuuuaaagcaacauuuaugcuaauaacaguauuucuuccuucucuuugagaacauauccuugagguuuuaaagucauguuuauuaauuaagacauaacauuuuauauguuuuucuuccuuagaaggaacauaaucuucaaguuuugggucuggugaaaucagaugaaggguucuaucaaugcauugcugagaaugauguuggaaaugcacaagcuggagcccagcugauaauccuugagcaugguaagaggggagcagcagugagcugaaggagcuugcacuggaagcaccauuacuccagggugccuugggauugcuagcuugcuugguaaaacgagccugugacacaacuacaagcgaaagagcagcagucuaaaucauuccugucacuuacaguuacuuagcgggacuuagcaguuaagagcacuuucucuuucaggggaccacaugacagcucacaacugucuguaacuccaguuccaggagaucugaugcccuccucugaucuccuuugguaucacauguguuguacauauauccauucagacaaaacauucauaccuauuucaaaagucuaaagaagggugcuggagagauggcucagugguuaagaccacugauugcucuuccagaggaccuggguucaauucccagcauccacauggcagcucacaucugucuguaacucuaguuccagggcuucuggcacucucacauagaaauacacacagacaggacaccaaucaacauaaaaacaauaaaaauaaaaguaacuuuuaaaaaguccaaagaaaaggaaaaaaauaaaauuaccuagagauacauuuucagauaacguuaaaaagaaguugauauuaagagaaaaacugaaaaaaugcuauacaaguguuuaucagaacccauuugugucaaucucacaaauuuguuucugugucauaagaaagacuucuuaauguuuacuuugcacuaguuguuuuuccaaacuaaaauuaguguaccuuuucuuauuauaaaaauaccuguuaguaaaauaaauucaaucaacauugaagaaaagaaaauuaagaguuaagucagggaagccacuguaaucugagaaaaggaagcuuaauauuguacaguuauuauuucuagagaguaacaguuauuuagcuaguaagaaaacaccuauuguaaauagcauuggcuuauauaacaagcaacaguagccucuggguaaagauggugucugcagagaaagaccuucacauaagcugaagucuggacacugcuggagagaauguggcucugguuuucuagaugacagagaaguugauacagugcuuuguuguugaaacuucagauuuacuuuuuagggucugaggagaguugaucauaaguugguaucucaccagaggcauuuucugcaaaagcacccaagagguccuguguuggggaaagcgacuggcucucagaaucugcacaugagagcuaagaaggaaguccucuccuuacauaauugguaucuccaguguuugugcugauguguguaacauuugugccagcugagaaaaggaaaaacuauacuaaaagcgccuggcuucauuuuaguugagcaggaaguaaaaccugaauguggaacugggaaguuaauuggaugacauacucuaaauucuaggaaugcugcauaggcgcacacagauauguguacugucuccuagcauguuuucuugcaacauaucccauguacaccuuuccaugcuagcaguuuacaacaguguucguuguugaauagaauacauauauauauacgcacacacacacacacacauacuuuuaaguuauucucugauuacacuuaaguuguccuuuuugucauuuuuuuguuuauugcuauuaugaguaguguuacacugaacuuuuuuaugauuauauuuucauacuaaauuacuguuguauaacaguauaugguaaggguuaucacuuagcaacuaaagcucucucccuuuuuuuuuuuuccucuuuucauuuuauuuugagcauuucuugugaaggcaugacaaagguggcauuuuggauauccauuucugagucagauacaguaagauauaguguaguuccagggccuucucggagaacuauagccugaccagagaaacuguauggcaaagcuggcaccuauacugucauuuuacuaaaacagcauauaggauuuauagaugcuauuuuuuaaaaauauacuugggaaaaaaugaaauaaagauagugucguaaaaggugaaguaucuggacagcucucauccugcgcucuacugugauuaugccuucucucaccuuagcaaccuucacgcucguaaaaugcaauuuacugaagugcguacuagcugagugagugaagcagacagcuuuguuuguuuguuguacaaugcaaugauuuucuuaguaaacuuuacagauauuuagugaauucacguccaccuaagcacuggggcuucaguguguguuugugauuacuucuguaacuauuaccaguguaaauggaugucuguguuaggagcauccuaauggagcuuuuaucugaauguguuuggugguauaaucauuuuacuacuaguauauguuuuucucugauuuugagaauauuuaagggcuuugggaauuuuuuuuaugaucauacugacaauacauuggcaagucauaggguauuagaagaauauaagucccaucuuuauuaaauuuguguccuauuuuuacauuuuauuuuuuauguacuuaaaaauaauuuacuuguaugugugugugcaagcuugucaguguguguaccauuugcccuuggagacuaggcuucaaauuccuuggaauuggacuuaggugauugugagaugcuugguguggguguggggacuugcaagagcaaguccuuaaccccugagcuguauaucuucagcccuguuuacuuauuuuugggaugggggaaggugcugugugccucaccauauugcccagguauccaauuccuuggcuuaaggugguccuuuucuaucucaagauuagaacuguaagaaacauuugcaaccauacguggcuuuuaauguuuuaauugucuaaaaauuaauuuuuuuaucauuagguuauguguauguaucucuauguggauaugcacauacgaguauccagaggcauuggaucuuuugagcuagacuugggaguaauugugagccacccaacgugggcgcugggaaccaaacucagguccucugcaagagcuguaaaugcuuucugcugcugagccaucuuuccagccucuuaguguuuugauuuuuaagauagauauuuauguaggaaagccaaaauuuaaggaccuuuggggaaaagcagcccaaauuuauacccaauaaaauuauuccuccaaaaugaaggugauaugaagaccuuuucagaacagaaacugagaaaaauuauaguaggaaaagauacaguaauaaaauuuaaugaaugguuuuucugcuuuuaacaaauuuacuuuaugaugauuggauagaauguaaauggauuuguagcuuucccucacucuuaaagaaauuguaaaucauuacauuguuugauaaaagcauauugguaguuacaucuuuaaaauuacuaauuuaacccauuaauuuuuuaggagugcuuccuuaaaagucagaaauuuagaaaaagacuguaaauauuagcacuagugauuuaaaaagguagagaaauagggauagagggaaagacuaagaagugacuuaauauuggccaguagaauaaaaaaauaauuguagaacaacuuuaugguagaaaaguuacuugaacacuuuuuaaugacaugagaaaagucuuaggaaagaauuucaaguagaagagauguaaaaccaaauagaugaaaucugaauuuaaaaugcacuuaggcauucucuuuccccaaauguuuacauuaauuaagugcuuugauaaaugauacuguuuucagauugcuguaugaacuuuugcauaaucugucagguuuuuuuuuuaaguacuaaacucagcuuuucaaucauuauugaaagguagaaaagccaccagacacaucauacugaugaccuucugcuaauaacaacaucaguggaaggucagcauucacagcuagucccuuuuagagugauguugcaugaagcagagaagauucuagcaggccccacugauauccuuugauuugacaggauguagagggaggcuuaaacagcaugaaguggaaggaugaaaacaagccuacuuugagccuuucuuuaccuuugcacucauuagaauuuugacucccaggauauacugugacuauauaacaauucccaaaaccucucccccuguauccuuguuuauguggaagcuuugcuucuuuguuuuuaacagacucacuaauacuuuacaaggaaauguuuaagaauggacuagaucaaaguugacagaguguaccucaggcuggauccaucccacuucuuguauuuuucauuggaacaugaacauacacguuuggucacagauuaucuguaucuuaucuguggcuauuucauacuguaaugacaaaagucaauaguuuagagagagacuaaauggccgguaaaaccuaaaauauuuucuugccuuuuauacaaaauguuuugccaacuacuggauuacaucacagacauuaauaguuugugauacuaaguuauuucucguuggugaaaaucuacuucacauacgacuuuuuaaagggaaaauuggaguagaggaacggagaaaacagaagagaaguaaaccgaugaaagcacaggauaggagcagcagauccaggggaagugcgcugugagccaugaaggagaagugggggcugcagacagugucuagagcauccuucuggauagggggagcagcauagugugggcagccugcgaggugaucuuuauguuuauauccuuggcuucaaaauauugaagguauuugagcaucucuaacauagucuuauuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccugguguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugccccaggagagguauugcuggauccuccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucauagucuuauuuuuaugugagaaauuuucugcuucccacaugaaaugugugacuguauauaccagcuguuggccuucuggaacaauaagugaaauuuuauaauuauaacuaaaauauuagacauuuuaugucaucaucagaaaauacaauuccuuacugaauuaauaggucaaauuugagaagcauuguuucaacauuuucuuaaucaaaacauuuaaaauguaagacagagcuggcaugaccacuaagugggcaaagguaucugccacuaagccugauaacugaguucaguucccagaauccauaugauggaaggagaaaaacuuaacucccucaaguuguccucugaugcucauauguaucuugugccuguccacacuacacauguacauauacacacaauugaauaagcaaauugucauaauuauaagaaaacaguaaaauauuuaagauauuaauaucuaacacuaugcauuuucaguacgggcaguacuuucuuuguuguuacuuguuuugacguugcuauuggcaguuuguuuuguuuugagaucucuuccugugcaugucagauugguggugagcucaccuucuaagugcuggguuccauugcacaccaacaugucuggcaacagcaucucuuaguuuuagagacucuuaaaauauuuaauugaacauaaaauggaauuacuucugaauuacgacauuucaaauuaauacuugucuuuaauaauugucuguugaaugauuuuuuuuaaauugucaguaaaaauaguacaacuuaguuggaugguguuggggcuagaguucuguaacccuagcacuuagaagucagagauaggaagauuuugaguuccaagccagucugagacuucacagggagagucuaucucaguuagauagauagauggguggauggacggacggaugcagauauauuaaaagcagcaaagccugagggaaaauauccuuaacuucuucauugucuuuucuuccugcuuauuuacauuuagaaauugccuuuaauuuuucuuguaaaacugaaauguaauaaacuuagaaauacacuuuuuaaaugcacauccugucaacgggucuaauaauuagcaguauuuuuuuguugcagaagggaggaaggggugaugaaaggaaguaacgugaacuuguuuacaguaaaggaaauucacacuuuaccaacacauuaaauggcuucuaggauaucauggccaugguagauaagaauacauauugaguauuaugagugauuguuuuuuucaaauuuuugacugaaauacuugucaaaaauuccauauaguucugagguuauugaaugauagaugcucuggaaaaagugacuagagcuuggcaugauuaaaaguuggcuaaguagcaagaaauuauuagucaguaguggaauauuuuaaaucuaaagcgcuacuugcaaagguuaguuaguauugaucaaaggguuaauucuuauuuauuccuuugcuuuuguacuaguaaguauaauuuuagaaaaaguuuuacucuagauaacugguauaauuggucucuuaauugugcuuucuguaucuaggcacuuucuuguuuuuguuuuuaagacuccugcuuuauaacccagacaggccuguaauugacuccauagccuaggccggccucagauucacagaacuccuucugcaucacuucccugagugcuaggauuagucagguaccaccacacccaccucaagucuaggaacuaagauuauagauguuguaaugccagugucuccucugcaccugacuuacuuucugagucgaguaucaaaauucugugcuuuuuguuuucuguaaaaugaaggaauuaaauuaggugauuacuggauuguuguuuuguuuugguuugguuuuuuaaaaucacuucauauaucccaugaaauguaaucauuuuaggaguauauuaauaucagaugugauuuuguuuuuuauuuaauuuuauguuuuuuacuuuaauuuuaugagucuuuuugucuguuuuuaccacuaaucccucuucgggcccacaaaugaaaaugaaguuaaagauuaacauuaugaggcaaacauugagguuauucuuuaaguagaguuuuuuaaaaucuacuuaauauauuuacgucauuuaaauuugcaaaauaaaauaaucuuuuaugaccagauugaaaggcaccugaaauagcuggauaaaacuaccuaucacuguuuuaaaacagaccuaacacauguucauuguaacaaauaagagcauguaauugacugauaaaaaaggaaauguacuguuccucuucccucaucucacuuucuagagcuagcccuuguuaacaaacuuggcuuauguaguuagucaguaaauuuguaugguaaaaucccauauaccuuacagaaguauggguuugugccaagugguaagguuggaauagucaggaauuggaucuuuggcccucauagaacauuuaucuguuagaauagaaaaauauuaaacaacuaaaauauaaacaaaauaauuaaaacguuugugucugcuuaaaggaaauuaaauaaugcuuuaugcuguggauugaauuuagaaucauucccccacaggcacguauguuuaaacacuuggucucaaccuaggguuacucuuucaggaaguugugggacuuuuggacauggggcaggguggaugauacagggauguggcagccuuccuagaguuguagucagccuaagaugagagggaaccaucuuaagaaccccaccaccuaagcaccacacuagucccagcugcuaugccugccuauucugccauuaagcugugagcuaaaacaaaucuucccuucucuaaauuauuuucucuguauauuaauauuuagucccugugacaagaaaaauagccaauacacugauaaagaaggauggaacacaggccccccaauggaggagccagagaaaguacccaaggagcugaaggggucugcaaacauauagguggaacaacaauaugaacuaaucaguacccccagagcuccugucucuagcugcauauguaucagaagauggccuagccggcuaucauugggaagagaggccccuugguauugcaaacuuuauaugccccaguacaggggaacgccagggccaagaagugggagugaguggguaggggagcagggcggggggaggauauaggggacuuuugggauagcauuugaauuguaaaugaagaaaauaucuuuuaaaaaauauuuuaaaugaaaaaaaaaaagaauuauuggugaaguuaacuuuauuauuuggugguuguuugugggauggauccccagauggggcagucucugaauggucauucuuucagucucugcuccgaacuuugucucuguaacuccuuccauggguauuuuguucccccuucuaagaaggaucaaaguauccacacuuuggucuuccuucuucuugaguuucauguguuuuacaaacuguaucuuggguauucugagcuucugggcuaauauccacuuaucagugagugcauaucauguguguucuuuugugauuagguuaccucccucaaaaugauagccuccagacccuuccauuugucuaagaauuucauaaauucauuguuuuuaauagcuguguaguacuccauuguguaaauauauccuauaagacaaugagacauguuuuuguuuucuucuuaacagcauacuuuuuuaaaaaaaaaaagugcaguugaauaauaauuuaccauuuaccugaguguaauaguacuaucuuucaauuacagcauuuaggagacaaaggcaauaugauugcaaauucaaggccagccugagacacauaggcucucguauaagaaaaaaagaaagaguuuagcauacauuucaacaaacagugaauagucauuuaucuugaagcuguaguuacaagguauguaaagguugauauuacuuaaacuagcauaaauuugaaaauaaccaaauuaauacaaccaauaagagagagugcuuuaaaacauuaaaaaauuaugggaaccuauguauugaaaauaucuuaguuacgguuacuauugcugugaaacauuguuaccaaagcaacuugggaaggaaaggguugauuucacucaguuuaacucuguauauauuacuucauauaacaguuuaccaucgaaaguagugagggcaggaacucgcacagugcaggaaccuggaggcaggagcugauacagaggccauugaagagugcagcuuacuguuugcuucccaugucuugcuuucuuauagaacccaggacgaccaaccuagggguggcccuaucaacacugggcugugcuuuccccuauaaauaacuaauuaagaaaaugaccaacagguuuuccuauaguccagucuuaauugacacauguucuuaguugaggcucccuccucucugaugacucuagcuuuuauaaggugagauaaaagcuaaacaguacauauccaaguuacacuauugacauaacaaacugagcuggacgugguugugaaugccuguaauccaagcauuggaggcagccaaguuaaacuacuagaaauuauacauggaauauauuaauuuacauauaaugguuucuacuuaagaaaauuuuaguuuuuauuucuugaagcaauguuaugagagauaaaacuguagguugcauauuugacaacugucucuaaauguuggacauuguagcuuauuuuuuucaugaauaaugaaucauacaaaugguaagguaaaguauaauuuauuaaaauauuaaaaguaaauuugauccaggccugagaacucauacauguaaucugagaauuuggaggcuagaguaggaugauugauguaagcuccaggccagcuuggcugcauagugaggugaaguccagccugggauaaauuguaaaacccugucucaaaaacaaacuuguaaaccaaaagucuuuuuuuuuuuuaacugaguacaugaauagagaucccuagcuaucugaucccuacuaugcagacugguaugggaggugacauugaaaaaaaaauuagagucuagcuagaauaaaucuuaguuuuauuuaaguguuuaguuuuacagacuuggagauucagcuaagugaccuguuuaaaacaaauuauuuagcaugaaagaacuggaaccuagauucucagcuucaaguuuaugauacagaagcagguuuuaauguuucuaagacagaagcucaugugggguuuuuugccccuuucacuuuaauuucaaaaaucagacuuuuaagucaguauugugcuuauacuuagugacaaggcuggucagacaucauuuuggaaacauggcugagcaccaaauaguuuugagauaacggugguuuacuucacucauaauuaccaaaaguaccugcuguaacucaggagugucagaguauguauaguauuaauguguggucacccucugucaaaccugaacaguucucgaagugccagcauagaggcuuuauucuaagaaucugaauaauuguagcgucggcucugcugaaugccaaagugcuacucaguuucuaaacaaaaagaaaucauuucuguaugguuucuaagacauacaaggcuuuuuugacugaacuuuuuaaacauuaacugaacccagaaggguaucugggauuuuguugauuaggguucauggagaugaaaaaaagggaauuuaguuaaaguguagaaagauugaacaugcauugaaagaauagcaggcagcucagcuuuagaauucagagacgagugaauauagaagugaauaucucaaggaggugugugugugugugugugugugugugugugugugugugaguguguaccagauucuuuaauagcuaguuauagauagcauuuggaagacugcagcagauuuuagguaugugucucugauaauaacucuguaccaauuaugugcgguguuuaaagcucucaaccauguaguagcaagaacauuucuuugugucccuuaaaauuuuuugccuggcaauaauuuguuaaauguuaaguagcuauuccuacaaagaagguagaaccagaucuaugauuuauugaguuuguguaagggagaagggcuauauaaaucuaagauuauauccuuauucuuucuggguuaggaaaguuugucaucauuaugcuugagcuauaauauaaugcauguuaguuuuagauaacuuugguaagguugacauauaauuauaguuuguuuaacuugaacaugaauuuuaucuuuuccaaacucacagaauuuaagacuagaguuuaugagacuaagguagcaacuuacagccucagugauauuuuugguauuuaguaguuaaauugaaaaggcccugcaaaugaccuuuccagucucaaagaugugcuaagaaauuuucagaaagcaaacuuaaauuugaauuugaugcuauuauuuuguuauaaaaagggaauauguuaugcagagcuaagaucccagaaggauaguguauaugaauaucauuucuuuggaagcuauauuuaaaugaugcuaaauuauacaguaauguuauaauuggcagaauaucauuugggucagaaagacaucgcugacaaccuggaugcuugcagauuugaucucacacaguaucaaucucgaauuguugugguuuucaucuaaaguguuggcauugagacugucucccaauugauacaugcuuaugaaaucaccagaaauaaguauaauaaaauuugaaaugcaguugagaaaguuuuuuuuaauauuauugcauucagugcuucuguugccucacaagaacuguuguccuaaugcuuuagauguguaaagcaagugcuuuggccuagcauugaugucugagucucuaugcauguguaccugagcuacacucuaaguaguaaaguagcugugagggcuuuuuaucuggauucuggcuuggggguggguuuuuccuaaacuuugguuucucuuuagcucauacucaaaaauuuuaguucauuaaaguagucuuuuaagagaucuuauuaggguucuuugacuucuuuagcuuuuuauacauaagagauuuuuacaaaauuuggcuucugaagcugaaucuuaaaagcauuaauguucuuucagauguagcauuauggaaauuugucaugauuggaguuaacaaaucauuaagcucauugaaacaaaaaucaaaaaaauuuuuggucaaaauaguagaaaaugaguagaaauaacugcacauuuuguuuuaugucuucugggguauugagagcuuaucugggaaacagcaguuugauuuagaguggaaagaaagagcugucuuuuucuggggcucacugcugagguaggugcgucauuaacaucugacacaccuuuuaaaaugaauauuuuuaacgucaggaaaaagucagaugacuuccucaauacugaaacaccccuccugcacauagaaugggaggaguauuuuauuuuauaacuuccuucaauuguuuauauaaguauuuuuuuaaaguagcaguccacugcaaguaugcacacaauaguaaugaugaccagagugugccccugggucauaaaauuacuuuucaaccagugaggaguuaauucuucagagaaagagcuguaagucggugaguugguccuuaggauucugcaccaaaagcaguacucagaauacacagcuuugucaguguuggugaguuaauucauggucacauuguauuucuucccuaccaggcuccuggcuauuuggcaguuguacuaaagagcauuguguguauuuagcuaauuuugaauuccuucauuuugggaguguguuacucucuuguaaccauugaaacuggguaccaaauucacaaauaacaacuuaguugagccucagacuacuagagaauccugaaagcuuuuaaugaugcguuccuucaugagucucaaaccuucaugcuucucuguaaacaguuuccuuaauucaagaaacagccucgcaucuuccaacucaccagaauuugaaaucuuuucauaaucuagcacauacucaguuuuuaauaacagcucuauguauguuaucuaaauauaauaguuuaugaauauuagaccaaacuuauugguuacauuuucaaauucuauagaacuuuauccaauuuuuguccaccugcucugccuuaagaacuuucuagugaaacauaagcacggguguguuagguuccugagcugcagcugcuguguguuucccaggcugcguugucagcgaaggauaugugacuuaccgcccugguggacgacucuuucauaaacugcagggcacuguaguauucuaagaugcagccuuucagguaucaaaauaugagaaaguaggucucacaaccaagaaaauacagauuguuuuucaucagcaggaaacacuuguuuucucuuggucagucauuuugccuucaauucuacuuagaucaguaucaguuuucucuuaauuacauuguuggccauguauuguaccauuaucaaacuuugucauuuucuuugaugauugucacuucagauagcuuuuuauuuacuuauuucugcuaucucaauuuguuucuuuaagcuuuaucauucagcuauucuuaaaauugcgacauauuuagacaauuuuuuucuaccuucaacacacuuaggguuaaucugauuuuuccucuuaccaaauaauaagucuguuaauuuucacugucuucuuacucacauugugccuuucugcagaccacauucgcuaagccauuuuacuuucuuaaacuugucugaagguuuuacacuuauaacuggcuugauuaaauuuuauauaaauaccucuugagugugcaagaaguuuuaagccagugggcauuuuaacaaaccacucggcauuagcuccauucaucccaucauuuuagguugccccuccgucucugggaacuguaggguuuugaccugucuuuccauugugauuucauggugugcuguguguaccuuuuccucgugugcaggugacauguuccugccauccaacagcaguuuuaaauacaaagguuugcauuucuuuagguccuaaaauauuuuaugauguucuagcuuguuaccauugcuuuuguugcuuauucuguuaucuucucuuagcccucuacuguauaaacuacccguuauugguuaauauuuuagaaaaauauuuagaacuaccuucuaaugcauuuguuuaaaauauuuuuaauuuuuauuuuaggacuuuauucagguuuuucuuacugaaauggguuuauacgauuuauucugauuaauaguuccguuucaccagcucuucccagauccucuccgccuccucaccuacucaaaucuacacccuuucuccaccccuccccccaucagaaaacaaacaggcaucuagaaaaauuauaauaaaguaagauuuaaaacaagccagaauaagacaaaacaaacacagucaggacaaaguaaacagauucacaacuggacggugugcagagauugagagaccuuagaccacuaagucaagugucuccaucaaacgucuuccccaaggcucaugaagcucugggacgaggaggcagaaagauuguaagagccaguaggcaugaagacaccaagaaaaccaagccuuccagacacagcaggacugaugcacauaugaacucccacacacugcagcagcaugcacagggccugcacaggucuagccuggauggggucccaguguugagaggggagcaaacacaagcccuucucuguaauacagagcuaucucuaaucaauaacugcuugcacagaaaaaauugguuuuccugaccgagucucguuagauauuuaaaccauacuuaagggaagcuucguguccagcaguaaacgguuaacacaaacgaguucaguguuauuuuaggaggguuuuuuguucucauaaugguuugucugguuuguuuguuuguuuuuauuguuuuuaucuuaacaggucuuuugcuuauauagugugguuuucaguuuucuuuuucuaaugggauuucucucuguguguauauguuccuugugcuuuuucuuuagcucuuuuuuucugaagucuacuuuuccuaaaauuagcauagcuaaucaguauaguaacuguguagacuuuuuuuuaaaaacaucacuuuugucuauggugcuggggacccaaccucacauguugaguguguuagcuaagcacuguggugcuggucuccauuuuuuuguccagugcuaguuuuguuuugauuaaugcuaacaugauacaccacuuguccauuuuuguaucauuuugugccugguagguccucccaauacauuuuuacuauuaauguuuuaaagagauaauuacgguuuuauaucagcaugccuguaaucccagcgcuugagacagccuuggcuguauaagagaucugucucgaaaaccaaagauggguuuggagggaaggagagaacaaggaagggggcuugagguuuggguugauguguaacuggugcagcuugucacuccugaggcaaaaggaggaugcguucaaggauaccauuccauuuaaucgcucaguguuuccuugcguucuuuauggaaugccuccuguuuuucucuuuucugcucauuugaaaaguaaaacuaucagguuuggauauagauuuccauucucuccuucucccucucgccagcaaugcucaacagguaucauuucagaacaacagucggugagcgcuguuguucaguguaauuucugcccuuacuuuguaaauagacucucuuaaauuaguuucuucaucagaguuguuggcuuguuauuaauuguauggauuuuaucuaaauaugauaaaggaucuugagcauacaugucuuaauacugccuuggggaauaacacuuaugaauauugaagacauggcaaauaguuuuaaaauuagauacaccuuccuuauuacacuagcaccaauaagguuauuugaacaagcaugaccauuuuaaggauauucaggauacuugggaaucguuuacacuuuagaccuuuucucuuucuagaagugaaauaaugcugauaguaauagggaaaugauucccaggcugaaaguagaugucaggucuaucauugcuucugucauacaaaccuugaaaaaaaauaacauaucuuucaaguuuuaaaacucauguuagauuuucacaagacaauuugauguuucuuucaaauaauacauaacaaaaaagugcauguuguuucaaguaagcccuauucuuuuuuuaaucuuuuuuuaaaagauuuauuuauuuuauguauaugauaucuacauguauaccugcaugccagaagagggcaucagaucccauugcagaugguugugagccaccaugugauuacugcgaauugaacucaggaccucuggaagagcagccaguguucuugaccacugagccaucucuccagccuccccuccucccuuuuuaaauuuuaugugcauuaguguuugucuuacaugugucugugugagggcgucagaucuuggaguuacagacagcuaugagcuggguacugggaauugaacccagguccuuuggaagaacagucagugaucuuaaccacugagccaucucuccagcccaaguaagcccuauucuaagcauaggguucuugaaaaauuauuagacuuuuuucuaccugaaaaucagaauguuagaauuaauaaaauuuccucaugugagcuuuguuggaaaaaauuauucuuguccugacagauguucguaaauuagauugugacaguguacaaagagguuucucagucauaaccacacagcauuauuccuuugcucuauuuuuugucucauuaucauauuuauaacuugagaauaaugaugaauuuuauuauaggaaaucuaugucaucucuuaugcaucucccuaccaagcugugaaacuugucucguacacugagagacaccagugggagcgcugcauacaacuugaagucauaacuaccuuauaccuuacagugccuccuuuaugugacaaaugacucaggaguaaaugauauguggcucuuauucuacuacuguuuuuauuuuuaauaaaguacugugacugguagccuaauacgguuguuucccugacugaaugugaaugcuuuuacugaaccucuuucauauauuggaguaguuguuuuguuggauucuaguuguuggucugugcaucucaaaagcuuguuuguuuucuaauugcuucuuuucagcuguuggcuauagggaaaaugaacugugcuuucagaauuguggaauaggacccagaagagaaguucucaggaugaguacugagcugugugaacuuugauauacacagguuuugucaauuuuagaauggcaucucuaacaguuugauugguuuuucaacggcacuuauaaaaacagcuuaucucuacccugcuggucuugggaagacauugccugauagaaaccaugugaaaugauggggugucuuuucaguuuuguuagaauaugguaccauauuuaccagugugacagcccuacuggcuuuacucuuaaaaugaugauacucuuuagggaaacuguuccuacauucauugugaagaagcuggcugugauuaaaaauguuuccuguaaccauagaaaguagccuggauugccuaacaagacccugacauucuuuuggcaaugcauucaucucucuacuuccagacuggaauauaauguaaucauucugcugccacaguuauccacuauaauguacuaugaguccaaauaaacccuuucuucuuuaguggcuuuugacagguauuuuucucacagcaacaagaaaggcccucaaaauacuaggcaggugcucuacaauuuacaguugaucuucauccucaauuuaggugacuuuauuuguuguacuuugaagcagggucuccuuguauagguuuccagucuaguacggaauccauguucucauguucuuccugucucaccucccggguguugacagguauguggaaauaaaauaaaacauugacaucuagaaaugaauagcaugucauuuaucaagcaaacuguuggauaauuggaguuagccuugaauauagucucuuaucuuaaaagauacaaacugagccaggcaugguggugcacgccuuuaaucccagcacuugggaggcagaggcagguggauuucugaguuugaggccagccuggucuacaaagugaguuccaggacagccagggcuauacagagaaacccugucuggaaaaaccaaaaaaaaaaaaaaaaaaaaaaaaaaaaaaaaaaaaaaaaaaagauacaaacuaucuuugaagccuauacuuccugaguuuguuguucauaauuauuuauuaugguuaguaccaugauccagaaucuuuuauuacuguacuacuucuuugagagaaauuacuaauaacuuuugcagcauuucaaagcacauauaacuauaagagaauauugaacuaauuucugcaguaaacaaccagacaauaaccaaacuagacaaagaauauaaaagaaauauuuuaaacauuuugcaagcaugugaggaucaugaccacuaagauuagugaaauuagccccaucuuccugccuggaauacuuacuuccugcugcccaggguggguaagggcacccuuagucagagcuagauggaagaguuagguugagaaagguaguuggaauuuauagagcaggcuacuugagagaaagguacaggaaagaaacucggagaguuguaggaauucauucuccuccagucuuuuggauaccauguugcauuuauguucuaucugucucuuucaauuugacauuucuguagacuucugaucuauccuaucuucaacacuuccaaaguuuuggucaaaguauauguucucucauuaucuuaugguuaugcggaugagauuuuucuuuccuuaaguacaaaugguaagugacccuguagugcuucugcaucagauguuugucaggaugccuugcuguuuggucauguuaaccuugauggcgugugugacuuaggugguauccuccguucuaucuccuuucugaucuccucugauuacuugaguauaaauguugcagaggauuuugaagucucagagcuccuucaucuuauacaugucaucccugcuuccaaauguacugacaguugaucaauugauuuuugucuuuucagucugccccuuuguaguaccuaggaugccagaauuucuucuauuaaauuuacuuuaucuuaucugccuuauuucuuaguacacuuugauuuacuuaaaaugcuuuuuuguuuaauacaaaauggaauuuaugauguccugguuauuauuggaauacuucucaagucagguaugguggugcauguuuuuaauccuagcacucaggaggcagaggcaggaagauuucugugaguucaagaccagcuugaucuacagagagaguucuggaacagccagggauacacagagaaacccugacuagaaagaccaaaagcaaacaaacuaacuaaaaucaaacaaacaaacaaacaaacaaagaaaccaucugugcaaggaauaauaaaagugacucuaugcuugggaauauucaaauucguuuuuauacagauguaguagccucuucaagccauauguuguacaaaaguuugugaagcaacauguuuggcaucauuccauuucuuucuuuacguguguaaauauaaagacaucugugugagucagcucucuauugcugugauagaguaucuggggaaacugccuagaggaagaaagcuugucuuugcucaugcuuauggagguuuuguccaugguuguguagcucuguugcuuugggcuuacuguagugagguauuucauaaggagaguguuagcggagcuuguucacuucaugacuccugagaaguugaggagagggagacagagaaaggguuuaggagagagaagaaaggagaucccaagaaauauuucagaagauaaagauaccaauuacauucuacuauacauacuuggauauaauggaaagugaggggucucugcagaugucagacagagaagcaaaccacaugaaaagauaagaaugaaaaccagauugacuuuaucagccuggaucagacuucugagagucuaaugccaggugguuccuugucagcguauuuaaaacauaguacaauaugggaaaagguuuccaggcaacaaucaguccaauuccagaugcacaauaaagcuuaagauguuggcuacauagaaacuccuuuucaaaguacauguaacuaugaggugguuuccauagauaaaaggccuagaaucuaguguggucucugaccaauagcauagaggucagcagaccauaagggaucucccccaagguaauggucuagagggggaagaaucugggauaaacauucugugccaucucccuaaggaugaguugagggauggaagagucuggggaaagcauucuggcacauuugggugaggacugccuccacaguuagcagcccccacucucagcuuucuggauggaaugcaggugugugauuucucuccuccacugaggagaaaucacaccccuucaugauuaacauuccugguucccauaaugcuucucuggaguacccucguacccuccacaggaaaggaagacguuaguucuucuacuuacacacuugugcuuguuguaaguuguuuuuauaauuuacugugucuuuacaauaaaaagcaugaaauuaccuccacaugguugaacagccuagcagcuuccaggcacaggagcucuuuucaguaggcucucugcaguacaugaucuuggcugguauuuaaucuagggugucuagcaaggacuacugucugggagaaaaagauugcaggauuaagauuuagaaguguugcaugcaaacaacauaggauucuccuguagaauugucagauuagcacuaggcucccauguaucucuuugucucugugucucccucugucucucuaauacacacacacucccuuuuucccuccccacccccuccuuucugguauacuuguuaacuuauacaugugaugguguauggagcuguaccuucguugacacucaugcauuguguagaucucacccaauucuaggcaacgucaccaugaacaucccuggaacuuaacaauauaguagaguucuuuacaugaggaaauaaagggcuaccgagaaugaaccuuucccaagacacucuugcaguuugaaggaauuuagaaacuacacacacacacauuuuguauuucaaaaugaaauuuuaaaugugccuacucacagcucgcuucacugacuuaaguaggugucaaauuagaauaauuggauccucuuaaccaagggcaacauguccagcacagaacuuaaugguuuccaccuucagaaacagcuucagguguguguaauguguuagucaagugaagguauuggucccagacuggccugugucuguugcuauaaacauggacagugugaacaaagaagcagaaaggcucguucuuuugcagagagccagaaagauccagaguacagcacgaacaguauguccccugcacaacagucucucuaggcuggggaacuagauugggaucaaccaguagaagacugugagcccugugcugagauuuucaggcuuauacuaugggaaguuuuggagcagagugagugaucagaucuuugaacucucaggaguaaauucuaaugucaggaggacaacaaaacagcauaauuuuucaaagauuguaauugcauauacuuggccucaagaucugugguuucacuuaggcucugagcugcgaugacugauuucuaaaagucuuggaguaguuuccagauguuuuaauuuuguggaagacuuagauagguuguuuuaaaaucaaguguuugguauaacagaaaugcccuagaacgcugugagcacugcuauuuuauaucagacuaugugucucaguauauuugugcuuauagcugaagaaaacuuuauaauguuacauuuuaauagacuaacucuuccaaggauuagacauaaaaagagaacagaaaagaauaagugauuccuagugacacagccacacuggaagugaaguuuccauuuccugcuggcuacauucagggucuuuacacuacaagucagaauuugguuauuagucuaccacuugcuaugacccagguuguaucuccuuuaaauaucauccucuguaagacugagacaauauggcaguacagauuacagaauuguuguaaugauuuacugguccacauaaaugaggcagaguuccuuguggaaagugcucagauaccucuaggagacuguuugccuuauugcccuaccacuuaauucaaaacuguguacaagguaagagugcuuaucuaggcuaguagaagcccugugcuccaucuccacaaacggcagguauaggagaaaugaagucuacaaauuauuuucuucucugacuguuuccuaccaauuuucccaggaaguuuguaguaauuucucuuuuucuagcaugaggcccucucugagggguggggugguaugugugugagcgagauuaaguuugaacuuuugucucuaaaagggagauuuagguugaguacaaggaauaaaauuucuaaaaucagaacuaucucauagauaggccaccucaggaagagcagguuggcuacagcugcuuagugcuagcauuacuucaucucucgcacccaguacugcauucuggagcuguuaacaugguggugaagauccuggcagaggauccuaaguuaccuauauuguuuuuguggucuuggaauuuuggguucgguuuuuuauagugauaaaacuaaauggauugacauaaggacaauugaaguguaauuuaucaagaugaggaaaguugucacuucccuggguauugccgauguggauaacaggcuaagcauuaaaguuggaaguguagcuuucuaaucuguaaagcugaaaaaauaaaugaagucauauaccccuaccacagacuuuccccuggggcccuuuguagaguguaaugaggaguaucuauacuauaaucauuauagauagguuuuuccauguuuugguaaaguagaaaauacugagaguuauaugcagaguuugacacauauugcaugcugcuuucaauauuaagaagauugccugggcacugcugugucgucauuuaagauguguuauucucagcugucuuuucccuguuccuuauccacaacccuuaucagaucagaaaaucuguuccacagugaugugucuugaauauccccauuaguuugcaguaguuaccccagccugcauguuagccuucaguuuaauggccuuuuuuauguucauucauuuuauuuuauuucccaucgugguuuuguuuauuucuuuuuuguuuuuuguuuuucuguucucuuuaaaaaccgucgugguuugcccuucauauuccccaauguuugcacaugacaagauguugccaucccaacauuaccucccacuucacugaccagugccacuacugaccaucuagcaccagccacaacgggaccauuaccuucagcuccucgagacgucguggccucccuggucucuacucgcuucauuaaauugacauggcguacaccugcaucagacccucauggagacaaucucaccuacucuguguucuacaccaaggaagggguugcuagguaagugcugcauguuucgagccagugggcugcaucuucuuacacccugccuggucaugcucacccuguuuuauugugcaggguguuuuguuuugguuugguuuuuuaccacuuuucaguccagaaaacaagauuguugaaauaugucuuccccauuauuaggggaaguguuauuuaggucauuauauaaacuccaagcacauugaaguccuagcaguuuuuccugccuuucugaaaaaauuggagaaaguagauagagcuguuuagguggaagcauucagguauagccuggacugugccugguguguuuuguucacugauuguagugcaggaacucaagccaaaucaaaucaauauguaugcuaaauaaacauugccacugaaacacaucucuaacaguagaacuauauaccuuucucauaagauuaauucagcacaaaguguaaagauuaaagucaguauaacuuauuagucaaaugaauuuaauuuuguaccuauagggugcuuugaugucaaaagaguauuuaggaguaauggcccuagaaugccgcuguugguaaauccucugguaccuccacccaccucggggcuuauguuguuuacaagaggauguuuagaaucuccagaccucuuuaucgcacaaccuggcuugauuuauguguauacucucagucuccuuucuucccaguuaaacucauuuucuagggaagccagucuacuucucaguggugccucuguucccagucucucuggguucuuucuccuuuccucuuuccagcuaaagcuacaugucuuauuccuucuguaccaguuuaagucccaugaagcccucucagggcagucucuaccuuggcacauuacuauuacucuccauaugaacugaaacuacugauauugacaauuaacuauaauaauaagauaauuugagguuguuugguuguuucauguguauuuacauuguuuuccccaccaaauuaugaacucugugaaagacccaugucaccugcuguuguagauuauuucuuuguucauuguucucagcuuagggucuuaacauaaguacaguuuauuuuucugcuagguuaccuguaguuauuuuauucucucucucucucucucucucucucucucucucucucucucucuguguguguguguuuauggccagacuaccaagcucaucagguguaggacccugugauuuuugccuuaucacaaauugcaauaauauaccuuuaucuugauagaguggacuacuugucaaauaaugcuuacugaaaacagguuguuugagauuuuacaaagauaaggaaauaaaguccuauacauaaaaugaugguacaguacuagucuacugaacaugaaagacauuaaauaaaaggaaguuuagagagugauaagugcugagaacaagaaaaccaaaaacuaaaacaagaaagaaagagagagagagagagagagaggaaggaaggaaggaaggaaggaaggaaggaaggaaggaaggaaggaaggaaggaacaaaaccuccuagaucccaaacucacacccacaguguuaucaucuuaaaacaaggauaauaagaaugaagccgcagcccaugaacccuaguggguuucaguaucaauaucagaauaaccuacgggugauguuaacggccuaauugcaaaugucauguaaauucacagggaagaaggcaucuaguuauuccuacacaaaaggcacacuaucucuacagcaggaccuuugccuucauuaauacuuauuccauaaauaaaucucccaaacaaauaacuaugcuuuguuucuugucaugcucagauaacaccccccagcccuccccuaagugcccacauacaaguuucuauucacuuuuauacuguauuagacacagcuuauccuagcaccuuuuguuaaaucuuuagaauuuacaaaucugaugaugucauuugggagcuagaagugggcugagaauuuuacagugacaauuacaagaacacaagaguucaguuuccaugucugguguaaggauggugacaccuuaucggucaccuuccugacccagaacuuuugguagaaaucaguaugagguuaaaaauaaagcacacguuuggaaccauguguuggaaugccaguaagaauuugggcauaauaaaaugggaauggaugauuuucgucuuuugagcaauugugcccccuguuuguagccagcaguauuuugagagcacuuuuaaaguuuuuaauaggagaaggaaaaaaaaaaauccagagacauagcagguauguugaucuagaugcaguaguugacagccugggugaagguaacagcagugacuuaaaauggguaggacauguggaaaauauuaaagaagaugcuucaagaggcuaagcuuuguuaauguauuaagcuucauuuuuuuaguacaagcgaugaagggauaaaagaagucuaaaaugaagucuaaaaccuguauugugauuauuuuguuuuauaauauaaacaguuuauuuagccuucuugggcuuauauuuaucaucuuaaaaacaagaauaauaaauuauuuuaugcaguguaauaagaauacaguguaaaauguagaccuuacaggcaaacuucucuacuucugcauuuaaaaauucaaccaccagguggcacugugugccuuggucauaaguaguaauucuguugggcacuuaaguugugugguccagaggguccuuuguuugccuuucauuauaccuguguaauauuaguccucuucaccauuuaaacaccucuauauuaaacgccaguuauuuucugauaguggcuauuaaaugaagaguugagaguuacuccaaauaauaauaguauuuucaagauggauaaagcguuagaacuguuagucuaauucuagggcugcauauuaugguuaccaggccaaaucagaaccaucauuuuuaugauucaggagcuaauaauuguuucuguguuuuaaaacagugauuuuuuuuuaaguuuuauauaagcaaguguuuugccuguaagcuuuacugucuggcacuuuuaagaaaaaaguuaccccaaaacacccauggaaggaguuacagagacaaaguuuggagcugagacaaaaggauggaccaucuagagacugccauauccagggauccaucccauaaucagcuuccaaacgcugacaccauugcauacacuagcaagauuuugcugaaaggacccagauauggcugucucuugugagacuacgcuggggccuagcaaacacauaaguggaugcucacagucagcuauuagauggaucacagggcccccaauggaggagcuagagaaaauacccaaggagcuaaagggaucugcaacccuauagguggaacaacaauaugaacuaaccaguaccccggagcucuugucucuagcugcauguguaucaaaagauggccuaauuggccaucacugcaaagagaggcccauuggacuggcaaacuuuauaugccccaguacaggggaaccccagggccaaaaagugggagugagggagugggggggggguaugggggacuuuugggauagcauuggaaauguaaaugaggaaaauaccuaauaaaaaaauaaauuuaaaaaaagaaagaaaaagaaaaaguuacccaaccugucucauucuuucauuaaauaccuaaagaaaguaaaguucagaaagagcuaguggcuugauuauagucucuugauaggcuaacggcccuaccauaaccagaauuagauuuccuagcuucuuguucaacacugucuuaauauaaaacacacuuuuuucguucucauuugauucaauuccauuguaacuacacagauauucuggaaauagcccuuucugaugaucucugguuccugucugacacugccuuuucucucuccugaagagaaacuugguucauauggaccgagccaucuuagauggggcuuuccucucugggagucaugcuuaugacugacucccaucuuauaauaaugauucuauggaaaucuguuucagguuuugauaaugucacugguuucucccauuuccccaccuuucagagaggaacaaacaagauacauacaguuucagcaauguaauacuuaggaucagaaggcagauuuuaaauucuguaugugugugagucuccuuaugugagcauucugccuacggcuuguguaguguguaagcaugaugggacagucuuauacuucaguuucaaguaaaauagcauccccaguuguuuuacuaggaaauauguuguuuaaaaauguauauacaggugagucauagccugugcucuauaguucaguccuucccauuaaacaaaacagucauuggucaucaaaacaagguuuagccaccucaaaguauaagaaaugaguugauaugcuuccucuaaaucugguaacuuagaaguuuacacaaagacaaaauaguacuguggauaucuuagguauugcuaaacaauaauuuuuaauacuauaguauucuuuuuaggugaccuagccaacuauagcguaacaaccucuuuaaauauucugugacuacuuuguugggguuuuuuuuucucuaccaauucggguguuuuuaauuuuauagauaaaaauauaauuacacugguuucccuuuuucccuuuccugucucuaacucuucucauugucccccuuccaauucuuggccucuucuuuguuauguuucucucucucucucucucucucucucucucucucucucucacacacacacacacacacacacacacagacacacacacacacacauccugcugaguuguauauauguauuugguuauaaucagugguaucaguaauguuugaggaagaucacccacaguuugccaaguguuuacaacucacuuucauacacuguucugccugguaacacucaguuucacuuuugagaguaaaugugacuuagugauuagauuuucacaggagcuagagagugaaacuauccagagcucugcuguauugaucaguuucuuuucuaacccucuuuauccaaagggagcguguugagaauaccagccagccaggagagaugcaggugacuauucaaaacuugaugccagcaacuguguacaucuucaaaguuauggcucaaaauaagcauggcucuggagaaaguucagcuccucuucgaguagagacacagccugaggguaagucuuucaccuaccuguuugccacacccugagagggagggacuauuuggaguccugucagcuuuuugucuugcauaagggcuuuaagccccuucuagauaggaacaugaacuuuuacugaacauagcaaguaaagggacagccuguguauuucugcuuucuuucauauuccuauuauaccgaucuuuuaaggauuagcucauaagucuuauagaagcucucucugauccuauguauguguaugauccuaagagacaucauuucaucccucaauugcuuuuacuaauauaucuugcuuauuuuauggacaauuccuacaaugucuauguguauaauguuuauaauguagugcuuugcacagugguggguauuuaacauggcugccagcuggagugucagauugauuuauacuuuaaaugaccuguaugcuuuaacuuuuguuuauaaaaacuacaagccugaguuuauaagaaauaucauguuuuuccuucuugaaaauuuuuaauuguuacuuuuugccauaagccaaauuuuucucaaaauggucucuaguuaacuuuuacgguaccuacacuagcuuuucuguguucaugagccuaaauaaaagacugacuuaguagggagcaugugcgauacauuuguaucucccuaucugggagcucagaagaaugaguuuagcaauuacagaacagaaagaauucacgaacuuugccucguggguggaauaagggcaaggagucaagaaccuucaacuuuuuaauauuauagcaaauuacuuguccaguguuugugugccuccuaugccagguacuaugcagaauacuagaaacacagagauggugaacaaguaauguuuguucuucagcauaagcaguaguaacuguaauaaggaggccuucagucaugguagugaugaugcugaagccaugagucagcucuaggcaagaacacugggccaugaagaguguccagaauugauuuaaggcgaaugcauucucauuacagagguaggggugcuaaauuucauaguugacuguguucagauuaagugugggaauuauccauuagauuucaggcuccacccccuuccuuugguuuuaagggaggcaccauaauugagagauucuagacaaagauucagagcaaggaagaguuuauauaaaaauauagaaagaaucccagaaagauggagccugugguugaccuuaaagcauuugacauagcacaagcauucuuggggaaggaaacuggaugacccaaaucacagaaauaggaucaaacaguucacaugcaaaguaagucaugaugaaagugaaggaagggccacuggauugaucuggugcagaagucuguccuggggcugugaaccuucugaaaaugaaaauaccugugucuauauauaucugcauuccccuuggaaaaugacuauagcuuucaugagcguuucagacuuuguguccagauuguuaaaccguugaacuaaaagagucauugucaaauuuagaauugaaagagaagacauaagaaguggccuuauuguguaccuacugugugccuuucacuguguugggcaguucagacauaaagauuauuaaggcaaaccuacuacgagagacagacauuuaaauacacaauagugugagggccuacuaucacauggaaagagacuaaaauaauuaguuggagagcuuugguuaagaaagaguuguugaaugagguuauaggcaggaagaauaacccguucugaugcaagccuuuggaauuuguaacgugacaauagagaugcuggcagugaagagggacuuguaccuccugaagguguggggcauauagagagguaugagugcugaauuggccuuuggagaguauuuugcaauuuacauuuucuauuuguuucuaucuguaccauucauuguacagcugauuugaaagaguuaccggugccuuuuaaaaggaugguauuugccuaagcuuauccaaugagucuacugaaggugauguuaagaaaauuguuuuucuauuuuuuucuccuauuuuguuuuucucucccuuuaguuaaguuggaagaaaguuuccacagcaaaagaagugugacaaacccuaccugucaggcuacacagacugugcaguugacauugaacaaauggcaugauucaugacuaaauaaagcaaacaacuauuaaagugacuacauucagaucuuucuacaucuauagcaaaacagaucuuauggcauaaagcuguuguuggagaaaaacaauuuucuuaaacacuuuuuuccuuggccuuaaaucuaauggugucuaucacagugacauuaaugcuaagaaaacuuauuuuuaaugcaggaauuucucccaaaguauagaccugaucagcuagcuaggauuuauauacuaucagaugaaaagaauauucugaaaggguugauguaugagccauuguagaaguuagauccaggguccacagaggaccagcuaccccacugaagauacuguccucaucuccuuacugagcucagggaaguuguguuuuaaaaugaccaguuucuggcuccaacauuauaaauucccaugacuuggaaaaguucuuaacauacccugcaucucauuuggucagugcuaagacuaaauuagaacagaaaagggaagaaggauguagcgugcuaacuuacaguaaaugauggcuguuucuggccuugacgcccucucucuaaccgguuuauugcuuugcugcuuuuccccugugcuuguguccacacauccuuucuaaacauggaucugacugucaugcuccuguucacugccugucagaaaaucaaaaccccauagcagaucaaacauuccucccugucuggcuguugcuuucgacauuauuucucccacauccauucugugguacaaccauacaagucguauaacauugucuuuccacuuaccccuccccccccccccgauugccccaaugacaaauaaucuucuccuagaugucugagaaaacuauuuauuuguaauaccaagaaaucuucaccagcucuucucuucccuucccuaaggaacccuucacacagcagaauccuguacucucuacuaucucauuacagccaccauaugaaucugucagcauuuauuaauguaccugauucuaugccaaaccgagaguucuuugugaagggggcuucugcccaucccugcguucccagggccugcuuaguguucaacagcagaaaggucucuuccaguggagguugcuucugugugcugccuugucccucuacuaaccuacaauuuggggcugaaaaagagggcucaguaauucaaagauuuauuguacaagucuaagaauuugaguucagauccccagcaugcgcauaaaccuaggcgcaccccugccgcuccagcuaaggacuggggaagggagcagggggaucccaggagcuugggucaugcugccaggcugaagcaggugagcgucagguucacuggaagacccugucaaggagcauggcaguagagugugauagaagacgauaucugacacugaccucugugucacacacagagaucacacaguucugugugguaagaggguguauauaagcacauguacuccugaguuuguaaaucacaagauuucuuuuguguauuuuucuuauuuuuaauaaauugaagauacugaguuauauaaaggaaaauguacauagccuaaaaauacuucaaucaagucaauugucuuuuauuguuucuaaaacauggccuuugugacaguauugcugagaauggcuauugugaacugcaguaaaucuaacuuacaucuugaucucuuggaauucucuuuuuccaguucagcucccuggcccagcaccuaauauccgugcuuaugcaacgucaccuacuucuaucacugucaccugggaaacaccguuaucuggcaauggggaaauucaaaauuacaaauuguacuacauggaaaaaggaacugauaaagaacagguaugaagugcugauaugauuuuugggagaaacacuagauucuaacucuaaaggguuagagauacagcucagcaguagaacauuaccuagcguacaagaugugcguguacuguagccuccaccccaaaccuuacaaagcucucugguucauugaagaaaucaaaggugaaggagauguauaggaaauuaagugaugaugguaucuguuuuguuguaccaagauuuauucugugguuuuuaccagcaagggcuaguaagcaucaaauaauaucucuaaauaaauugcuauugauuauauuuaaucugcuuuuacuauaaauaauauucuguaagaggguuaaaacuguuaugcagaguuuguucauuuuguauuucuuuuagcuugagcucuguguguguguguguguaugugugugcacacacacgcgcacauguauguacagauauguauucuauuucuuucaaggauauugauguuucaagucacuccuacaccauuaauggacugaagaaauacacagaauacaguuuccgagugguggccuacaauaaacaugguccuggaguuucuacacaagauguugcuguucgaacauuaucagauggugagcuuuuuccuuuguaacagaauaccguucuuagugcuccucaucaguaaaaucgugugcuuugaugugaagaaacuuuuauucaugcgcccguuguaccuccuggcgagccacucacuuuuuugaguauuuuuuucuuacauguaaacuucaggaaacaccaacuucaucagcauugcugugaaacuucacuggaaagcacagacagagcacguggaaccuaauauuaaauggguucuccgugguuuuaguacagucuucugaggggaucaauuccguggcuuguucacagcacagaccauuuuauggcugugggaugaucagccuuacuggauguaccagucauauuuaaauauuuaaaagcuacaguuugacucccuuaagcagaugaucaaacauuuacaucaguaauaaagaagcaggcauaugugccugguuuguaguccaugaagaaauauacagcuuuggcccccguuuucccacccaaaauacuuaacuucaguccaaaucaugaugucacaucaacaagcagacacgucaaauugagagaaguucagcagcuguuuuuuuuuuuuuaauuuagauggccuuuagaauuaaagauggccucaaauucuuaaaauauauuauuaaucuuauagaaaaaucaucuaaauuaaaggagaguaagacauaggcuauaaaauaugugggaucuuugguuccuagauaccugaaacaaaaauaucuauguaggacacugccagcacacuuacuagaucuuucugguauuaagaaauauugguaaauauugaacauguuauauauauauauuugauaccauuuacuaaucaaaauuacagcuuccaaaugugauucuuauguuuuaguuugguuagcgccugcuguuauucucaggagauauugaacuauugaauucugauauucagauauugaaauagaugugaucuauuucagaguaaucugucacagugacuugcagcaucucucagauauaugguagauaaaccuaugccguucucauuauguacuauaaugggaagaauauaguaaacuuugcagaauguuaguaauugguaaaacuagaaggggagagugguguucauuauacuauucuuuguucuuuucuuuggacaugauuuuuuuuuuucagauaaaaagggaaaacaaaagauaaauuauaguucaucaauccaacugcauauccaguuggucaugauuugagagagggggaaaaaggcuuuuacagccuuuuaaaucuauauguaagccaaauuuuaacugcacuaaaauagguuggccuacugaccacaguaccacgggaacugaguggagugacguuuauuaacauggaaguuucuuaacauggggauuuaaaggcaacacuuuggaguaaggaaaauccuagaucuuaggccuacuaaaagggauggcuugaucaaguaaaccacauagaagcucaucuguaaacaacacguacaugaaaugguacaacaguaaacuccugugggagcuguaaggacugaguaccugccagaguagcuuguaacaaacccaaguucugaggguggggauuacacagucacaguuacguugaaugucuccaucgcuaaguuacuuccuaacagggacauguuuucagaauagcuggacccuacuucagaccuuacagcugaaucucagacuugaagccccuuaucuuuucccuaggaacaggucaggacagugagcaaagcacuucaguucagaaggucuuuauuucuguaucugcucaccagaugauagggaguugaaaaguccugaugaguagaugagguaagaagggcuagaauuagcaucuggugguagagagcaaacuaguuagcucugcuugaguuuucuuugcugucugucaucacaugaaaggagaguauaugagccaucaguuguuagaugcucuguuguuaagcuccaguacauuaggaacuuugguuauguaacuguuucaccaacagacccaaacucuucacaccuaaaugcauguugucugacaccuuggugcguugggaguucacugauugcagcuuuccuuguugaaauguuuuuagagucuagggcaguguucucaaccuuccuaaugcuuugacccguuaguacaguuccucauguuguagugacccacaaccacaaaauuauuucaaauuuugcugcuguuacaaauugugauguaaauaucugaugugacccugugaaugggugguucgacccccaaagaaguugcgaccugcagguugagaacugcuggucuaaggguucaaagcuacuuacauuccuaaacuaaguaucugauuuccagaauuauaaccugauuuuaguaaggguggaugcucauaugaacgaagcauggccacacuucauccauuguuagcuggguugagaccuucuagucacauuaguauuaauuaacauggugggugauauauggaugguugaauuguuuccuuuuuccuuuaaccugucuaguucccagugcugcuccucagaaucuguccuuagaagugagaaauucaaagguaagacuucgauucuguucacuuuacuggcacccugagccucagagggaacguagagagucagaaaugccuugggcaaacaucagaacagugaaugccaguguuguaggaauucauuugcuuugaaaaauacuaacgugaaauuaggauguaacugaaaacaccuaaaaucaaacaggaaaauaagacagcauggguauaaaaaagcugggcuaagaacucacuuacuuuacuguuucuuuccuuucucugguacuaaaaccucuuuagcuuccuauuaaaaguuuuuucuauguuuacauaaauaugacauuuuagaucuuaacuauacaaaaucauucaaagaaaguagguugcuuaugaugacaugaugccaguauaaaccaaagacagauggguguagauuuggguaucuguucauagcauccccccugguucaaguucguguauaucaacuaugugugcuuuucagaucccucugggcaacauauauaaagaagucuuaucaaaagguacuaugggaugcugcaucaggaaacauacuucuguucauuucagggcuuguuuguuuguuuuuguuuuguuuuuggacagggucuuacucuagguaaauauacauauaccuacuggcuuggaauuuuuguauagcccaggcuagccucaaacuuguaaaccagcaguuucgguuuucuauccaccacuccuguccacagaaauuacuuaauuacaccuaauuugcauucaagaaaggaaauaauucuuauaccaaacaauaguuuauuuccuaaucaguaugcuucuaaccuuauauuuuccuucuaaaaccucuuuugggauuucugauguuuucauucagacagaauacuuccuuaggagauaagucuagacucaagcagguauguccaggcugugucuauaggcugcaugcacacuagaaucgauauuaugcagccuaacccaagaauuauagacuuaaaauagggcuuuuuaguaguuucucuuguaacauggcucucaagcaugaguuuuuguagaugacaacaucauguuacaugccuaguagagcauacugcuuuaauaaucuccucuuagagagauuugaggguuuuuuuaauuaaaguuuuguuuuuuuguugugcuaguguuuuguuuuguuuuuuguuuugagucagggucucccuguguaguucuagcuggccauaaacuuacuauauagaucaggcuggcccuaaacucacuauguagaucaggguggccucaaagucauagauaccuaccugccucugucucccaagugcugagauuaauaauguacaucaccacacccaguuaguuagaauuauucuugacuauuaaauaaguaacuuggcgaggcuccaaguaccaaggguucuauaugaccauucuccucuuccugcagugaaauuggguuuuauagcauguacagucaggaacagcccuuugacauuucagucuuuuccuugcacuuccuuuccucagaguauagugauccacuggcagcccccuuccucaaccacacaaaaugggcagauaacuggcuacaagauucgauaucgaaaggccucccgaaaaagugaugucacugagaccuugguaacugggacacagcugucucagcugauugaagguaagcugcuuugcauauagucaguggcuaaaaggugguucuuucguagacuugaaauuauguuagucuaaaacugcucuaagcaguuguuuuauauaaacaaauuaaaaaugguuuacaaaaaauuguaauagcuuuugauacaaauuaauggaaaauacucugguggauuccuccaucgcugaggaguugaauuguguuugauuuuuaguuccuuuuuaucgucuccacauuuuuggaguuuauaacacuguaaucuaaaaauguaagguaaauuauacucaaccaaauugguaacaaaacuuaacacaugccaaacucaggugaaugcaaaauauuugaauagcugcaauauuauaguuacauuugcugcuaugggcaauguaaaguuuuagaaaacucuauccgaaauggcucuuuuguauaguuuucuuuuucuguauaacaaaaaaggauauaucuuaccagguggacacaaauauauaucuaauaaaaauauagaucacuaagaauucuuccuuauacgacuaugaagacuggcuaagcaaggccaggauuccuuuacaggauaucuugagaagcagcagauguaaaugaggguagagucuaggcauugcuaacuaauaaaagcaaaagcaggauccauugugcucagaccacagcuaaguacccgcugaauuaagcauuauccaaaaccucuauagaugaaaggauagcuauugucuagaagcauguuccaguauccagagaaugaaaagcuguaaucugcaugaaccaacauugaauaugcaaugugaacaaaaacagauuccuggaggcuugaagcauuaacuugaagcuuguuaaugaaacaugcaauauagauuaauaggagucugugucagacaucgaauuacacgguaaucuauagcuggacaaaauaguuguuguagcacuuaacacacauuacuguaucuuuaugucugcuaugugccuuaguuuugcuuuuuuggggggggggguguguuuggguuuuuuugagucaggguuucucuguauagcccuggcuguccuggaacucacucuguagacuaggcugaccuugaacucagaaaucugccugccuuugccucccaagugcuggaauuaaaggcaugugccaccacugccugcuuaguuuugcuuuuuaaacugucaaauuauuuagaggggagaggaacucggccuuuuuauauuuaccucucuuuugccugaucuuucauauauucuuagccuucuagaggguauggaaugauaacuaaauaauuggagaucguuauugagccauguuuguuuuuauuuaagguuuuguccauuuacaauuacaaauacaugcaguauucucuuguacuuucugacaagauaguauuaguaauggaccuagagagaugugucagugacuaacacaggcuguucuucuagaggaccugguuagagucucaacucccacauggagucuaaguacagucucagggaacccaacauccuccuuggccucugagggcaccaggcauguacauggugcacauacauacagacaaagcacccauacauauaagauaauaaauaaaaguaaauuuuuaauggggguggggguaaauugacaugcauccaguacuuguuccucucucuguccuugcuauuugugggcaaacagauuuaggauggcaccuacagggcagagccuucugucucuucuuacuauaugccaggauugguuaccuuagcgacagcauaccuugcaucccagccuaguuacuuauauuuucaauaucucugucuuuauugggguuucuguacuauacuacuguccaaagaucccaguuauuuggauauagagaaguaggaugauuucccuaacccuaauggucaguaucuuguauuuaagugcucuaaaaauguacaugugaauggaugcauaacuagucauauuaacuguuauccugcuuuguagaaagacuuuuauuugugaaucuuuguugcuuuuacuucgguaaaucauacacuuuacuaaagcuggguaguaaauaaagaguuacauaauagaaaaguuuggguuuucuucuuuuacuauaaauacacuuguucaacugguuauugaaaaauagauuucuaggccauauuugauguugaaauuauuucagcugugguuauagcaggucucaaagaacagagguaaccugauaggaguuacaucuuuacauucuuuucuggguuuuggugucuucugaacccagcugauuuuguuccuuuguaacaacucuuucauuaucuuuggucaugguuuccuuuuugacaaaguugacgggauugcauuaaguaaucccaaaggugccuccgugcucuuaaacagagaagcucuuaacuuccugggaggauuggucuuugcuguuuauccuaggguggugugggcacugagaauuacccagggguauauuuugcuuguucuuucugaacuuacacuuaacuaagcuguggacugaguugguuaugugagauguuuccuuuuauaggagauuacuaacuuuguuuuccaaagcucuuguuucagcuucuuucuuacguuugauucucaggucuugaucgggggacagaauauaacuuccgagucgcugcucucacagucaaugguacagguccagcaacugauuggcugucugcugaaacuuuugaaagcgaccuagaugguaagauucaacagcgagcaggaauggcucauaauagauaguaacuaucaccagugaggcaaauggaaagcuuuugaguuuugcuugucugugaacauuggaauguugugcugcuauuguuucugugaagcaguagaguuccuaaaggggucauuguuucccagacauugugaagaaggaaacaaaggaucagguucagaacaauaaaaauguacagggauuugaaguugaguuuuuuuccugaggccaguaaguaaagagauaauugaaguguuagccugagccacaucagugugugccuauguuucauuugcagcuuccuuuuuccugagucauggagaucuugugcuuucucucaccuuuuuguucaauaaguaguuucaggugguuauguguaguuaguuccuuuaacaaugauggugccagauuuggggagaccaaagaccuauucugaguuucaacuaagguagcaauuuaugucuugagaaauauacaugaaagauguauuaaacuguuaccuuuaaaaucuguuagucaucuaacagcuggcuuuggugccaguuuuucuggauuguuaauuaucuagggaaauaaauaauugguaucauuguuguaauauaauguuugauuaacuuguuccaaacagguuucuaguuuguugauuuaucuuucucauuaaacauguagaguuuagggaauggaaugagcaacuggguuuuauuuucuuagaaaaaaaaacaaaaaaacaaaaucauagaccguauucuacuguaguuauagauucucuuuuaguucuuggccuaaauauuguuaaagcccaaauauuuugacaggagcuaaacaacauucaccaaggauaaggaaacauccuacagagaauacaucucauuuuuuucugcuuuccuucucagaaacucguguuccugaagugcccagcucucuucauguccguccgcucgucacuagcauuguagugagcuggacuccuccagagaaccagaacauugugguccgagguuaugccaucgguuacggcauuggcagcccucaugcccagaccaucaaaguggacuauaaacaacguuauuacaccaucgaaaacuuggguaugcuugcuagguggaagggauaaccaugcaugucauuucuuccauucuaaauuuuauuacaguauaauuuuauuuuuacagaaagauuguaacacuuggugaaggaauuuugccauauucuucuccguccucacccagauugugcaggauuaacucuuccacauuuccuuuacccuuuucuguuuuuuccccugagacauacaaaggucaguugcagacaugguaacucucacuagucccuaacaugaacaugaaauucuacuaaaguuguucuaaauagccugcuuauugaaauaaagacauuaaaauugagauaggauuuucauauuuggcauuuuucuuaccguuguccuuuaugacaaaaaaaaaaaugcuguuuucugguucaggaucaguguugaguaucguuaucaugucucauuagccuuugauuuagagccaauucugugguuuguuuggguuuuuuccuuccugaucuugaugaaugacauuugaaaauacauacacaggccguuuauguuccucaaauuagguauguccagcauuuccauauuacgucuggguuugcauacuuugugaggaaugccauaguguuggguuuugucagugccucauauuagacacacagaacgauauccagugccuuugacauguuccuuuguaauaauauguauuucguuaagaagauacuuugauuuuuguaaauacuggguuucccaucaaccucaccugcuaguuuuaggacacauauaguagguuguuaccugucaaacuuuaggaagaguccacuaggcucuuguauuacacaaauugaaaaacuaauucuauaauuuauuuuuaaaaagcaaauaacaaaauaacuaucuuugaaaacgaaaaaauuggaaaaugcauacuacuuaacuugguagcuuacuuuuaaaauccuggagucucaguggugcuggugcguacauggagguugugcauucaugggauggucaguacuuaacauagucaguugaucuuuuaacaaaagugaugaagucauucaguacagaaaggauaucuuuguaacuaaggacaugggaauaaccaaaaaaaaaaaaaaaagaaugucuauauggaaggggaaaaaagaacaaaaugccacaaaugaccacaaaccguaaaauugacaaagaggagucagugagaagacucaguggguaaaguaccuacugacaaacugaguucaaucccccagccacaggcaagguagaacuaacuucugugauucauccucuguguguguguguguguguguguguguguguguguguguguguguguguguguguguuaauuuauaccugcucaccaccuaugugcaguguccauugaucagaaaaaggcauuggguccccugaaaggaaaguuagaggaaguuaaaggcaguuguaagcugucauguggcuguuuaaucuuacccgaguccucuagaagaguagccaguguuuuuaacuucugauccaucucuuuacccacuccuucaucaaaaacuuaaucuucugcucuugaaaacacaucaauaaaaauaaaaaggcaagcugcagauaagaagaaaauaucagcuauccaaaugucugacaguuugauccuaggauauguaagaauucuuacaacuuaguaaaaagaaaacccaaucaaaaugagcauaagauuuggauggacuacacuaaagaagaccuaugagcagacaguaaggguguaugguaguauaugaagauuuacgaauggaaaaugagcauguuaaaagaugcuuaguacuguuaauugucgagagaauugcaaguguaaaaccucaaugaaauaccacuguauguccucuagaauucucacauuugcuguuaaaaaugcugauaguacagcuuuguaaaguggggguuuauguauaaaguuaggcauacaacuuagcaaucccacucagaugcuuaaccaagagaaaugaaaacauguacccacuuaaaggcuuaaaaaaagauacuuuauuuauuauagccucaggagggaaauauuauaaauuuauaucaauuaguuaauaguaaauuguacuauaucuuugucauagaaacuacugaguaauuaaaauugauaggauuggcuaucaguauauacagcagaagaaaugagucuaagaaaugugcugagcaaaaagcuaaacacaaaauaauguauaguuauuuuuaaaauauuaaaaaauaugcaaaacagcuacaaugacaaauuuauaaucuaugguugcauccucaguauuagaaauugauguuuaagagcauagcuacuuggaaauguccuaauuucucuauuuagggauuaauuacaugaauauauuaauuugucaaaacuuacuaucccuuuaaauacauuuauuuuaugcuaauuuuaucucauaguuaauuuuaaaagcaaaauuuucuuuaauaaugaauuauggaccaucaagauaacugucuuagugguuugguuuuuuuuugguuuuuuuuuguuuuuuuuuuuuuuuugcugugacaaaacaccauuaccaaaagcaaguuggggaggaaaggguuuauuuagcuuacacuuccauauugcuguucaccacugaagaaagucuggacaggaacucacacaggugaggauccuggaggcgagagcugauacagaggccacgaaagggugcugcuugcugcuuacuggcuugcuucccauagcuugcucagccugcuuauagaacucaggaccacuaguccaggguuggagcuauccauaaugggcugggcccuccccaucaauaacuaagaaaaugccuuacauccagaucuuauggaggcauuuucucaauuaagguuucuuccuuucagauaacucuaguuugugugucaaauugauguaagaguccccagcacugagcgaguaagaugcuuuccaccauuccuaggaaccaugggacaucauacaugugugugacuacucauguaugcacauaaacaaacauaaauaaauguaacuuuuaaaguuaaaauaauaauauaaugaauugauuucuguggcuauaacuaccuuuccaaauuggauuuucauuguuaauauuuuucugaaagacuuuucucuuaauucauaaucuucucugaugaauuuuuuauucaaaccauugcuuuguagacaucuuuccuaagaacagcuuuaagugccuaacaaaugaguucccagaucuuuuauggaagaaaauaaacaauaguuuuuaaauguagucaaaaacaaaauauacuuucuguuuuuccuuccaaagagagacagaucagcugaacccaggcggcuucuccacaugaguagucuuauaagcaauuguuggaucgcaaaaccaaagcuuuucgguggauaaaaaugucucugugaugaccagccucccacuguuucccuuaggaaacuucugaaauaaaaguccuuuacauuucagucaggacucugucguugaccuccuggaacuuucagucuaggggacaaccaaaguaaaacacaagaaacaagugaguuaaagugaaguuguucagagagaaaaagcugaacagggcacacagaacagcccacuagaaauagagcguggcuugaaagauguagccagaacagugugaggcagaguggugagaaggaccagucugcucaaagaguaagcagugcacucuuaggaaagacucggguguucguccugagcauuaagaguggcagggccauggagggaucuaagguugggagaugagauggagggugaggaaagauuugagauaucccagagcaagugcugaacuacuagaaaagcaguguuuguugagaaaucgugaaaacaaaauuuguucaacauaaaguaaaauguguuuauuagccugacuuaauguaagauucauggaauauaaagugaaagaagcaagucaaaguugaagauguuuauguaggaauuaucuauucaucagacuuaaacucuccugagcuugaaggauccaccagagcagugguucucaaccuuccuaaugcugcagcucuuuaauacaguuccucaugugguaaccaccaaucauaaaauuauuuuuguugcaacuaaauaacuguaauuuugcuacuguuaugaauuauaauaucaauaucuucugauauguaacccuguggagguugaggaugacuucccuagagagauuguucucuuagucuccuugcagaauuaccuauaggccaucaaauccuggauuaugccuugucuaaccaagaaguugacugcucuguguuaggacguucucuggaauauuuuugacacuucacucucaguuuaucuccugcuucucuaccuuagcugugaggucagggauggaaggggcuugauuuucaagcugcaccugaaggcauauaucauacagugagcaccuuaaccauuaguagccuccaggagaggaagacuaguccaccucacucugaagacuaacccaagaaguugauggaaccaauuuuuuguaguaaauguacuucuaucuuuauaucuuuucauaucccaaagcaagcagcccaauuaauaauuuuucuuuaauuagauagacacuuuuguaucuuuuuuaauccuguagagagcauuaaaaucuuguuuucucucccucagauccaagcucucauuacgugauuaccuugaaagcauuuaacaauguuggcgaaggcaucccccuuuaugagagugcugugaccagaccucacacagguaggacaucugucugucuuggucaccugcacuuuucccaacugcuuauguagaguaugacucaggggucucccugauggguguucaugagcaaaacucaugacaacuuggagaacagacuuagaaugagugauaagccagcuuuguaaaagcuaccacagaagcauuuuguauagauguauacacuuuuuaauauguuagaaucuaggaugcagaguuuugagagaauuauucaucaugcaggaaauauacacaugaagacuauuacacuaguguagcaguuauucauaaacaaggacugucaauuuagauuuuuaguuauauauaaaacgaguuacuaucacuuuaugaggaaacagcauuuaaucugaacuuguaaaauaaugaguauguguauuuagaaaaccuagccaggagcuggaaaaacccagaggucuuucugaacugcauuccagcugugguccucagugauuuuuuuuuucuuucuuuuuucuuuacucacccuggccuuugcuuugcaguagagcgugugucugucacauagaacacagcacaugcguacauucuucaucaaauaaguacugugaucucuaaaauucgucagugcuaugccauuugaaucuguaacgaucauggcauuuacuguaccucauggagacuuguucacuaccuuauucugacuccuagagaaaguacagcacacacugcgacauggugucaguucaccucuuaaggaagaggaaucuuuggauauauucagcuaugagccauuucucuacugccucugcacuuaagauaucagcaagucugaauuggcuuagccaucacacguccaaugaugggcaguaguaguaacucaugucccaaaauccagccauauuuacuaaaaaaaaaaaacagacuaugaguuuuauguugcuuguucagaaauuauacucuggauuuuaagagcaguuuugguuuuuuuguaaucuuuuuucugacagcgggucacauuuucaaggaauucgaaaaaaugcaagcauguguauuaacaugaucacucaauuaccaucuuucagugucuuuagaguauuguugacaauaugguuaaguacuauuuuguuuaacauuuuccuacaauuuuuccuuuaaaaaaaaaaacacauuagaagugcucuucugaaugaaugagggcuaucuauuaacucuggauuuucuuucuuuuuuuccauuuuucauuuuucauuccauuauacuccccugcauucccuuuuauuuuuguuuauguuaaaaugccacuucccuuucuuaauuacuuuuuacccagacacuucugaaguugauuuauuuguuauuaaugcuccauacacuccagugccagaucccacucccaugaugccaccagugggaguucaggcuuccauucugagucacgacaccauaaggauuaccugggcagacaacucccugcccaaacaccagaagauuacagacucccgcuacuacacaguccgguggaagaccaacaucccagcaaacacgaaguacaagguacugaacauuugccuugagagcaaaaagcuaaucagugggauuuucuuguuuuaaaguucuuugauucaugcuuuuccagaaugcaaaugcaacgacguuaagcuauuugguuacugguuuaaagccaaauacgcucuaugaguucucugugauggugaccaaaggcagaaggucaagcacguggaguaugacagcucauggcgcuaccuuugaauuagguaaguauaaugcaaucccaugucacaugacacuucuucucuuugugaaauacgaaagccuguagaauucacacuguuauuguggcacauccuaucaccugcguccacuggacaugggcagugcacauacugcucucgcuacagaacccggugggcagccgcauuucaguuguguuugccauuucaacuacugugaauuuuugggucacuuugcuaaaacaguaguaaacagcagaauagugcagugcaagacagacuagguuuuagaaauugcaagaauucaaucucuggucagccaucugccaauuguuucaugagcaugccaacuaauccuacugaaucucaguuuccuccaucuuguuuggggugauagcccccccauuucuacuuuaguagguuauuauaaggcaaaaugaggaacagauggaaaagcauguggguggguagauacaagauauuauuguauuaauccugcuuacugguaaauugaaauugaaaacaaugaagugaccugcccuugacccagcaguugcccagcuguguugccuagucugaacaguuugcuggguaauccagggcuuucuuggaaagcagcucuguaagauccuucgcuggacuggccuuugcuguuuguuaguacacgugagggagaaagcauaacuaaguagaugaaggaaagaguaggcggccaaccuugagacccuguuuccccugcacuuugcugggguaaggauaugagcagccuugagaaucuauguauucugaccuauuucugugccuggugaaaaccaaacuuccacauucugugcaaaccaguuuugcccuucugcacaguugcuuagaauuucuccaggaaaggggauuggacuggagaguuaggaauacaguauagaaaggggcaaauaauuauuaguuugcuuucuuuucuguuuauuuuguuguuuguuuguuuggcuucguguugacacggggucucacuguguagcccucgcuggccuaacacucacuguauagacgaacaugacauccaaguccgucccgccugccucuggaguguugggauugaaggcaugugccaccacacucaguguuuccauuuaagaauaucuuuuugcuuuacuuucagcuuacugaccaauaagagaaaauuuuacuuucccuuaggaguucauuucacuaggcucuuccauuuuauauuaaaacucgaauguuuuaggaagcagcgauuugaaggaaugcuugauuugaucauuuuccuacuuagcuauuacauuagacauucucaccuguaacauagaaagccauuuucuuuugucaucuuuuguuuguuuguuuguuuuugguuuugguuuuguuauuuucgagacaggguuucucuguauagcccuggcuguccuggaacucacucuguagaccaggcuggccuggaacucagaaauccgccugccucugccucccaagugcugggauuaaaggcaugugccaccaccgcccggcuucuuuugucaucuuuucugcuacaugaacagcuuuuauuuauaucauuaacaucagcaguugguaguaugcuuucagugugagcuuaaaaugaaaaauaccaaguaguaaauuucuucuuagagggaauugagcuuuuaaaagccauauuugacuuuaagagucaacucugagcaagagagaaaacuuuaacacuuuaaaauguccuaccaaauaagccaaaucaauugagaggaaguagucugggacaguuauguaacugcucucaguuuuggugccuugaccucccaacaagggacaauggcacuugcccgucuagguugucauagccuuaagaaaaugcaaacuauaaaauaccagaugguagugugugcuuggaaccaccucccaguccacaggcccauucucuauccucaugguuuuaguuuuucuuugauacuuuguauagucuucuuuuuauuagaaaugauugguuauacauagacuugcauuauuaaagcugggggcuuugucuuuuuucuaugcauuugcuguuccuuaucagugaaaagaauuggaaaauugaauucuauuaaaauggauaguguuuguuauuuuguaguuccuacuucuccaccuaaggaugugacaguugugaguaaggaaggaaaaccuagaaccaucauagugaauuggcagccucccucugaagcuaacggcaagauuacagguaagacgccuuagacugggcaaguucugugucaucaauaaaguggggaugugaaccuggcuggguccuuguauggaguguagugagucauguugguccuugaaauugaagcaaggguagcauggaauugugugucuagccaguaguguuacuuaacaauauauggugggacaaccuauuuuucuacugcagcuugauggguacguuuauuuuccaaaaugcuguccacuccccagaugacuugcuuugaacuuguguguccaguuuuacuggaaauuaucuagucuguauagacugugcuuuucuacuuacaagccccaccaaaucccauuaggcuuuaaaccaccacuacagcccaaggccugucacuucacaauucugugcucuuacuaguagaguuagaagcuugaauuacccuaggccuaccaaagaucucaggaucccacccccaccccucggcccccccuuuggacuucagagagaaauuccccauaguagaauacuggcagaugcuuggaaccugugccccauucauuagaaguuugcuaaagaaccaguugccuucugaaauacaaggaagauggccuaaugacucagaaaguguauuuugucccuguaacuuuuuuuuugucuguuuugguuugguuuuuuugagacauacauacauauauauauguguguguguguguguguguguguguguguguguguguguguguguuuuauuuauaguccuagcuguccuggaacucucuguguagaucaggcuggccucuaauucagagaccaaucuaccucuucccgccuagugcugggcuuaaaagugugccaccauaccuaguauguuccuguaacguuuaaauaagauguccuuucccaauaaauccuagucauuuucuuagguuccuauuuugcuucuucuauaaaagaaacaaauauagcuuaacucagauuacauuuugcuuugucuuuuaaaaccuuaaaucacaauuuuguaguguagaucaagaaggcuuauguuuguaaggcauccugccucauuugugggaauugagugcccccugguggaaauaucuggugacagccucugugaccuaacccacccuuagaacuuugucagguuuuccaaucugccgagcauuuuccuccugggaaaugauuuuuaucauaauugagcauggcauaccauugcagagucccagaacuacgugauucuaagucagagcccucaugauacuucauucagauacuauauuguagacauuuauugacuuucagauugcaaaaagaaaagcagaaaugggaucucuuuuuucuauuaauugcucuggacagguuacaucaucuauuacagcacggaugugaaugcagagauacaugacuggguuauugaaccaguugugggaaacagacugacucaccagauucaagaguuaacacuugauacgccauacuacuucaaaauccaggcccggaacucaaagggcauggggcccaugucugaagcuguacaguucagaacaccuaaagguaacucuccccgagccaaggguuuuacuguguugucuauaaugggacugcagcauguggagagcacugguaauggacuugccagccucacuguaaagacuuccaaagaauuccucuccuacccacuggccaccaaauugguacucucccaguccacccagagggaaacguuggcugucuguaucugggcagaagaauuacagugaucucuuaguuuuuaucagagaaaucagaugugauucuuuagguuucuacagaguuauacugcacaauauucugacagauguuuucuuucagcacacacagucucuuaacauaaaaaguuuaggggcuggugagauggcucaguggguaagagcacccgacuauucuucugaagguccgaaguucaaaucccagcaaccacaugguggcucacaaccaccugagauccugaugcccucuucuggugcaucugaagacagcuacaguguacuuacauuaaauaaauaaauaaauaaauaaauaaauaaauaaaaguuuaaaugucaacuuuuguggaggaugagguuagaaggagccauuuauguaaagcucacgaaaaaagaauauaaaauaguaagccaggcaagcuuaggccaauuaaauggaguuggguacugagacuguggagaggugaaaaccugaauuucuuuucuauuaucaauuuacuuggaaguuugugggaauuguauuuuuccuuuaagacgucugucuguccaucuucaaagcuggugauccuugcucuuguuuccucuuccccugugcuugaccugucagcggacuccucugauaaaaugccuaaugaccaagguaaaugaggagauggccucucauuuuuucucuuuugcaaccuaucauuagcuuuuuguuucauuuuuccgccugaaaaucaguaucauguguuuaaaaccacacauacuuauuggccagaguaguguugaguccauguuuauagcccuugggauaucugaaaagcugagggagucacuuagaagcuaacuuaccugguggaagaaaauugaguugaauaaacucuagauuggcauuaagugaagaucagguuauccuuagaaguuaagaugcuaaaguuauaaacagugauaagcauuugaggcaaaugugagcaguauagcaaucuuucauauuuaguauuuuauuuaagugaaaagucaguaucaaaaucaguaaacacuguauuucacuucugacauacguauauaaucuuguuacauacgugcuuaucugugaccaaggauguuaauuuauagcucuuuuuauauuucuuccuuaaacauuaaguaagacuguuuuuauaaaaggauaaaaagcauguggcaagacacuuaggaaggacgagucuuaaugucaccugucuugaaauccuugacuggcagguuuuucauugugauugcucugguggcauguuagcugcccuuugugauuucugucucuaagaaacaagcuaaagguagcuuuccauauagagauagaacacuagaaauaaaguugauaauuguucucaugguuuaacaguaauaaucagaaauucagcuuuuuggaucuugguuaauguaagaaucagaacagaguauugaguuucauggcuuuggacaugugcuuguguucaacaagucuuuuuuuacaugggagggaacugugggcauaguguuuugaguguagaagcaugagauuucauaaagcguuacgcugaauaugcagagaauguaaauaugccuugcugaauacgcugaauaugcagagaauguaaauacgccuugcucuuucauuugauaacuguuaagcagcacuuugcuguucuaguauucaaaauuuuucaccuguugguauuuaggguacauccuuugaauuucuugguuauucuuuaaaugcuaaauaaaauauugggaaaugcaggaauauaaaccaacuaaaucuuggcaaacaaggugaguucaguggcagcuuuuuguuuguuugguugguugguugauuuguuuguuuguuuaugugauguguucuggaaaguuuaaauguagcuuacgugauaaucaugaaaauuuaaauauaaagaacuuaaaaugcugaguaucucugccaguuagauuuugccugaugugauagcauaugaagaacaacaggaaucuugaggcuuacauagugugugucacuugggagaugauagccucagaaguaagaggauggaguaguuaguaggaacaauggaaaaggggucagagacuaaauuaaauccuagacuaugcccuagaaguucugaaacuauacuguaggauccaagaacaacuguucuuuucuuguauagauuuuuuacuucugagaacauaucaaacauuauaguuagccucuagauuuauucuauuaaaugaaguacuuauacaacuuuauauucgggcucccuuuguuucuuuuaaaauaugauucuuuauaagaggaaagaggaauuaacauuaacucuguuuugcagaaauaaauguauuuauacauuucuagucaagcuuuauuugugaaaauaucucuuauaaguguuuacuagagcuccguguacucugccuccauaaagaggaagaggacaucccugaauuuaugauguuuguaauaguuaacauuuauugaucauuuacuacacacagagcaguauucagugucucauggucuuaaauuuccauuugguguuguaaacagauguccaagugacuaauuacaugacuugccccacagcaaagcacugccauguaguggagcugguguucacgggcagucuuguaagcacugcgugccauuaacggucaggagcagcuuuuacuuuuuaugcuugcuggccucuucucaagagcuugccacugcuuucuggcuaguaacuuggaauugaggaauaucuuuauggaggaagaaagagagaaacugaaaacuaagaauaaggauuauaaaacagaaauaaaauaaagccugggguuucugccucuuugaggucugcugcuggggagaccucacucauuugaaccugugacuauaggagcucagaugacaguguaagcaaccagaaggaaggcuuguguuuuguuuguuucuguugcucaauucauaagugacagaaaaggaagugagaaucugauuugaaucucugcuuaucuuccugcucuugcuuaaguuaacuuuauacuugaaaggacaacuucauaaucugggggggugggagggggagccagaacaauacugauacuagccaugccagaucagcaucaccagguccuuuggagaauauacuuguuugguacaagcaucagccucacuuacucccucagucccuuuuguuauaaaauaaucuacuaccacauguccucucugaccaucacuuccugggcuagagaaaugggagggggucccccacuuccugaacagcagauugguaguuaggucauggccuugaaacagaggcaccagucuucuagguaccuccuuacacugcaagcugugucuguguaccuuggcacacaaucuguaguuucccauuauuuguguuguuucauuuucuuacggaguagacugaaguguuuuguuuuuagaagacacuuaacuagcuguggaauggacugucacaucuacauguuggguuuuuacugacgugauuucuucugcuucagccuuagggucagcaggaaaaggaagccgacuaccagaccugggaucugacuacaaaccuccaaugagugguaaaacccccucuaagacuuuuucagcuuucuguggacauuaugcaguucugcuuaaaacuuuuaaguaugguuuauggcuucaauguuggcuuauggcauguuaaugugguucauuuuaauuaucggaccuaccuuuggccauuuuguggcaaguacugcugaauuacuagaagccuauuuucaucauagaauccugucucucugcauagcuagcuggaaacaagacugauuccuaaacaaaugaucugucuccuacuaccucgagagaaaagaguuagacuuugaaacacuagcccucugguaggauccccgucacccagcaaagcccgagaaccgcuucagaaucucagcaucuccccuacuauguuuuuuuaagucugggacuucuaggggaaaauacucuacuuuucuaccauucugcaaguuauuacccucaauuuuauaacacuucauucuuggugauggagcauaguuaagagcacaagcuguucuugcagagaaccuggguacaacaggacccacacaguggcuugccacugucuguaacucuagcccaaggcaucugccauccucuucuggccuccuuggguuuugcaugaugugaucuacagacauauaugggcaaaacauucauacucacuaaauaaaagucaguaauuuuuaauuuuauuaaaaaggcacuuuucuuaccauuucugaguuuacucucacacuugaacucaccacugauccucaacucugggauguagggagaacagauugaaguauucccaauuaauacgguaaaaaaaaaaaaugaguggagaagugucaucuuugacuccacucuuauucugucauaaaaccagaauucagaccucugugcuccgguugugcauuuugucacugucgagugcagucugaagugcaggggauucuguaccagguguaagaguccaggugcaaaaugucuaaaaggcaguuauuaaaauugauuuuuuccccacugucuuaucaccucuaccuagcaggcauacgagaauaccuucuuacucuccagcuaucugucuaaugcccauacuuaagggaaacccacugauuuuuagaagagaaacuugaaugcuucaagauguuuuauacuacacuugucuagcuauuucuccuucaagcaucucuuguauauugggcuaucaacaguaaaguaucaagauugugagaaaguaguuauuccuuuaucuucuuacauuuauguauccaguuguacauuguauuuugaagguucagacucuauagcaaacuauaggaggaagagaaguaaaaaaaguaccugauaggaaaaauaggcacacuuuauaaaagaggucuuaucuacccccuauccuaaaggguauaugaaauccuaaaggcuguagaaaacugggagcagaagcagugcucagcagguaagagcacacuuuccauucauguagcaaaucgaaugcaguucccaucacucaccaugaguagcucacauccaccuuuaacucugguuccagggauccauugcccuccucugucccccacagguacucacacacaugcaacagacacucauacacauacacacagacaaaaauaaucuuuagaggggaaaauuuacuaaaugucaagaugggcaucagacauucuaggaagcucuaagagcacaugcaaaggcauagcagcaccggcucacuguagagcucuacugccugcagguggaauagaaguguacaggagguuagagcuggcuugacaaaagcccacauacuuagauugcuaagaaaccugggcuuuauaaccuauauauguaaaaugucugacacuacuaauauaccaagacuuccauuuuuucaguaucugcuauuauuagucugagaacagugaagaauugauugacagcuaagaaggugugaagucagaaggauaaagaaagaagcugucccaguaguccagucaaacauaaagagaugcauguaauaugaucucagacaagaauauugacagccccuuugguggccccuucuuaacucuguucuagaaaaaaagcuuuuguccaguucauacguagaaguuaaauccagaugaaugcugaaacuuaauuuguguugaaugcagaacaauacuuucucuucugcuuguucucguaccccugcucccccagccuucaguuugccaugugggucccaccuuguaagaaucuagcccaguaguccagcauuucucuuaagagcaauguuggauuaacaguaugguuaauuuuauuggcucuaguaacuguagucuuuccuaaauaucaaaauguuaucucauugaaggucaguguauacaguuuuaaguugucugcuuagcuuuuucuuagaaaugaauaaaaaugauugaaccaaauauaaaagaauaagcucuuaagccauucuaaaucaaccucagauuuagcagucuacuuagaugucuguaaaaaucauagaaucaaaguugggaggucagauaauccaguguuguuggaaggauugccauacagagaaagguuugguuuaggaaccuagcacucuguuuuuuagcucuacuguuuggcuggcacgcccugggaccugccugucucugugccaccagguuauaauggacuccaccaugccugguuuguguguggaugcagggcuucagacucagguuauaauggacuccaccacgccugguuuguguguggaugccgggcuucagacucagguuauaauggacuccaccacgccugguuuguguguggaugcagggcuucagacucagguuauaauggacuccaccacgccugguuuguguguggaugcagggcuucagacucagguuauaauggacuccaccacgccugguuuguguguggaugccgggcuucagacucagguuauaauggacuccaccacgccugguuuguguguggaugccgggcuucagacucagguuauaauggacuccaccacgccugguuuguguguggaugccagggcuucagacucagguuauaauggacuccaccacgccugguuuguguguggaugcagggcuucagacucagguuauaauggacuccaccaugccugguuuguguguggaugcagggcuucagacucagguuauaauggacuccaccacgccugguuuguguguggaugccgggcuucagacucagguuauaauggacuccaccaugccugguuuguguguggaugccgggcuucagacucagguuauaauggacuccaccacgccugguuuguguguggaugccagggcuucagacucagguuauaauggacuccaccacgccugguuuguguguggaugcagggcuucagacucagguuauaauggacuccaccaugccugguuuguguguggaugccgggcuucagacucaggucacagcacugagcagucugcccagcuguuugaugccuuucuuucuugauaacaguuccuuccacaguaucucacuucuuaaauacguuguuucugguugacugguugguuguuuuugagacagaaucucaaucuauaauccaggugugggccugaaacucacugugugacucaauuuucugcagucuuacugcuuuggucuucaaagugucaguauuacagcaugugccaucauacagucuaaaaaaauccuagugccaggcaagaaacacucccuuguguaguguucccugagccuuuguggucuggggcucacuaacgugaggaacuguauaaagggucacaggacuaagaagguugaaaaccacucugcuagaguguccuccaucaggccuuuuugugaugagaucuugucuaauucuaaacucaaaagccauuucgaggagaaguuucuuuuuuuaaaacuuuguuugauacaguuaaacacaugaaaacaaguugaauuuagaguccagauggacuacaagcuguuuucugcauggcuuaccuucucaguuacugucucgggauauauagugcaggcucaggccuugcuucuccagcauuguggaaagagaccuuauacuugagacagagccacacuggauucagaaaagcuuuucaccuacuuaucuaagucagccacacagucacucugcauuguacccccgcuuuuuuuuucuuuuucuuuucuuuuuucauagcauucuuagcuaguaguuucuuaccuguuuguuuuguguggcaagucccacccccagcauucacuguugcaucuugaauacauacaauaauauaugacacauaauaaccacucaguaaauaauugucaaaauaggacauauguacagaacuacuucuugcugaaguugaauaagaaaauggacucuaucaucuguauacuuaugaggaaagauuuuuuucaaacaguaauuuuguaaucucagacaccuacguguuaaggaaaaauuuuugcuuuauauauggcuauacauuuuaauaugauuuuugaaagccaaaaaaaaaucccaaaggauuuagaaauggugauuguagaugguuguggguauguauguucagacgccaaguucuguccgccuuuuaagacauggucucugacuuugcagcucacaaaguaggcuuugcugucugaccucugagcucuaaugcucugucuaccagggcugcaccugccuugcuucuccagcacugggauuauaaacuuauauaaccaugcaaagcuuuucuuuaauggguucuggggaugggaccuggguccuuaugcuugcaagacaaaaacaucuuaccuaucaagcugucuccucaguacaacgugggacuuuuaaaaaugaauuuguacaucuuauaagacaccagaaaaacagaacacuaccugagccuuugugcuuagacaguucuagaauaucaguacacuugaagguuucuuuguauguuauucuuugaguaaacuucuaugccaaucccugcauguagggcagacugucauagccucaggaauuuauaaucuagaaauaguuuccuugaguagcacucuaugcaguacugugauaacugguaugaagaaaauucaccugaaauaccuugaaaagguuugauggagcugauugaauuuuuuuuuuuaaaucaccuaacuaacuaacuaacauuuguaccauuuuaccugcacaggcagcaacagcccucacgggagccccaccuccccucuggacagcaacaugcugcuggucaucauugucucuguuggcgucaucacuaucguggugguuguggucauugcugucuuuuguacccggcgcaccaccucucaccagaagaaguaaggaucucuaacaugcaacccugguuuuguuuguuucuucuuauauguugcuucuguuuuuagagugaugcaaagaguugaaaaaaacaugaaguacaggaaaagccacuuuaaaugcagucauacccccuuccuaccguggggacugucuuggggaucuuguauauuaugacaagucccauaagauucuaauggagcugaaauauuccugccaucuacugaacacaaguugaagaugcaagagaaaaagaaaccaugggagaaggaggaaaaugaaucccuaagaaauuuaacacuggcuuuucugggccucaaccuuaaaauguuugaaacugagggggcuaggaagguggcucagcaguuaagaacauguacagcuuuuguaguggacacaguucuguucccagaaccuacuuuggauggcuuauagcuaccuguaacuacagcuucaggggaaucugauaccuucuucugaucucugcagaaguguacacagaauuaaaaauaaaaaucaaucuuuaaaaaauaaaaaguuugaaaacaucuuccccugucucaggccaaaaaguuugcaucuacaagcaggaaucuucauagacauuucugaguagggagaccugguuaggaagugggacaaauccucagaagagauucuagaagaaggcacugucagucauaggagaccacacaguaacauguguauuauugccgcaaagacuuucuaauaaaacaagaauagaaaaaaaaugaaaaagaaaaacagugacauuggagaucugacucuagggcaaucugggcuagcuuuauguuuguguccuaguuuuugauggugguggugguggugguggugguggugguggugguggugguggugguggugauggugaugguggugaugaugaugauguaggcagguauaugcacaugauuguagcugcccacagaggccagaggcaucgauucccucugaaacuagaguuaauauguguuugugagccaagccacagggguacugggaaguaaauucagguccucugaaaaagccaucuucccucugugccaucucucuagccauguaucuuuaguuuuuuaacaauaacaacaacaaaaaaaauguuuuaggaacuaagaaguaaaggcuagagacaugguucaaugaauaaagugcuuauaaugcaaacaugaggaccugaauucccaguaccuacuuuaaaaaaaaaaaacaaacucagcagugugccauagaagugacagaucccucaagcuugccuuaccagucagaaaguucagggcuuagugauagaaccuguuucaaaagacacaguguagaguaauagaggcagacagcagaugucaaucacugaacccccauacacacuugcauacaugucuggauaagcccccacacgcaugcaugcaugaaaaaaaugagaaguaaaacauugagcugauaaaaauagaacaguuaguggaaugaagaaaaaaauucugcuuaugcaguuuaccacaaaaggcagaaaguacaucuguauauguacacagagagcgaaacggcuucugaacccuuaccacaggcuauuucacaacagccugcgugccagugaaggugggagaaagcuauuaaccuaauauaaguauuuuauaugugugugcacgugugugcgugcauauguguguguaugagugaggcucucacuauguagucuugacuggccuggaaccugcuauuccaggcuggcuucaaacucauagagauccacuugucucugccucuggugcugggauuaaagaaagacaugugccaccauguccagcuaauguauuuguuuucaaagggcaagugauaagcuacccuguaacugcuauuugaauaacuuuaugacagauaagucaugugauguuuuaacucucuguucucaaguagcuuucuauaguuuagguugcaucucuuuucuaagagaagaggggcucucuucugguuuugauuauggaaaacuguuuccuuaagagccugaaagucagcucuuuuagaacauuucuccaaguuucuguguuuggugcuucauuuauuuaucuguuaguacuugcucauacagcuauuauuaguaugcuugggaucuuuaaaaguuucuaaaaaaaacaaagugaauauauacacacacaaaggacaaagaguuccacagugcuuuagauggaguuaaaauucaaaguaaauaaaacugguaucauaggagugugccacuguggccaaugguucucacguuuucagauuaggaauaaucaacauacagggauaacacguguguaacagaggcccugaaagaucauaucaccaaauggcagcacagccauuuuaguuuugaaaauauccccauauuaaucauauguggcuaccaaguaauugcuauacaaaugauuuuuauacuguauugcuucaggaauaaugacaaggagaaguugacauauucaguaaaauuuaaaaacaguauauuuucagucuaaaguugauugaagcugaaacuaugaaacgcagauaugaggguccacuguacuuguuuacacuagcuugaagucuuuuuuuccuucauugcauguucaagcucuagucuuuucuaauguacuuucugucccaacuauuuuaccacaguugcuuucauugaaucacacauuccucagggcucgagucuccauucucuuccgugugguuucauguagcucugugguuucauuuacucugugcuucccagaaacucuguuucuauuuccagccaggccucuuuguucugcguaucaggcaugcgugcccuucccguccugucgcauuucucuuuacucgacauacagcuuagauaugaagcaugcccgcuuguguaggcuccugcaugugaacccuugguccacaguuaguggucuguuggaggaaguucccuggggugggguuagccuuuagguguauggcccagucccucuuccugugugauucuacuuccugacuacagguucagugcgaccagcaaccuccuacuuccaugccuucuggccaugguggaaugcauucccucaaacuguaagccaaaguaaacccuuucuuaaauugcuucagucagauagcaaagagaaaaguaacuaauacacacauguccaaaucaauccauaauauuuucaguaaaacuuuguaguccacucuucucacugugaauaaguggccugggccagaagccuuggccucaccauuucuuucuuuuuuuuuuuucuuugcucccacacagucuaugcucauucccucccuaagcccuauauuucugucuccugaauaugcauuucaaauuugccuccuccauuccacugucaugggccagcuuugaugaacucccuccaguccucugccucacaaauccauuuuuacaagaggguagggauaaaguuuuaacucagaucaaccuuguuucucccuugcuuaaaaccauuaaaugauuucccaucucugagaguaggaaguucccacucucggcugcugugaaagcccuuccuggccugguucuugccugccuucccggccguugcccagccuccccucauggcucaugcucucauccuccaguauacgaggcugcugcggcuccacugcagggcguugacacagcugauuuuaccaccuggaauacacgugcuguccccauugugucucagcauaaagucaguucugcgcauuucuccucucuaucuaagcuccagcuauuaagauuaacacuuggcauuuugguaaguucagagcauuuaaaaauaguuuagugucauuuucgucacuugaccaaaagugcugagggcacagcaguguagcagaggcucugacaggagcaaggugccuaguguauaugguuguugaaugggaaagugaguggaugagugccagcagaaaugacaguacagugacacugcugccacugcacauacccgauagucccggaggcuuaccuagagcauggcucuguccuuucccugucagccacagauuuuuaccuguucuuguuguuguauuuuuacuucuugucguccuuucuuuaucuaguggaaacuuguaaaggaaccuucugcuuuugaaguuucauuuuuaauugcuaucucaaucuuuuaauauaaaaaaggcaauauucacauauacucuggcauauaguaucuacacgaacaaagcaaaaacacguugacuuuuuccagagauaggccuuuugucccugaucuguuguucugcugcugcugcucgcugguuugaauuucugccuuuguuuaaagcuucucuccgaagggcaggguuucuuucucuuuuacuuuggguuggaguaguuuuauuuuaauugaggcuuauauuuaggcccucacaacaugcuagacagacacugcuacucagcuacgggccguuuuugacuuuuuauuuuaagaguaaaucuugcuaaguugcauaggcuggccuugaacuaacucuguagcauaggcagaucuugacuauuucaucuuucugcuucugccucccaaguaguugggauuauaggcuagugccaccacacccagcagaaaaucaauuuuaaucacaguguuuuaacaaauauauucaaagggaguacauuuuuaaaacuacucuuaauucugugccuaggaaacgagcugcgugcaaaucagugaauggcucccauaaguacaagggcaauugcaaagaugugaagccuccagaccuauggauccaucacgagagacuagaguugaagccuauugacaagucuccagauccuaacccugucaugacugauacuccaaucccucgaaacucucaagauaucacaccaguggacaauuccauggauagcaauauccaucaaaggcggaauucauacagagguaccauuuucacuuuguaagguugccugaauuuguuaauuuaguuuaguuuuaaagaaauguauaucuuguuuuuuuuuucagcauuugaugaacaauagcuagcuguuacagaaggggagagguuauggaucauuuaggaacagccuucuagauuuuuuuaagucucagugggcuucagucaagcauuugugccaccuaacucaugcuugugcauuggguuguguccuuuuuguuggacuccagcuaucacuauggcauucagaaccuuuaugauagcagaagcuucuacacugaaguacaguauauaccaucauaccauccucuuugaaucucagcaggaauucccaugauacuguaaauggaaaugccuugcccuagugcauuguuagagaaucccaaacccuccaguggaaauguauuacugugaaggcugcucggaggucuagggcauaugcuugcugcuaaccuccauacuuuauauccagggcaugagucagaggacagcaugucuacacuggcuggaaggaggggaaugagaccaaaaaugaugaugcccuuugacucucagccaccucagcguaaguagaaacuucccuuuccucaagugcuaccagucuucugugucaugguggaaaauaucuaugaguguaucuuuaacuucucuugauuccaagucaaagaccaacugccacacuuuacagaaaaaaauaccaaaccauuauuuuuuuucauaauaaauguuauucuugagcuagagagauugcucagugcuuaagaacacuggcuacucuuccagaagacugagguucaauuccuagugccaucaugguggcuuacaacuaucuguaacuccaguuucaggggacccagacacccucuucuggccuccaaagauaucagccauaugcauugugcacagacauacauugagcaaaacauccauacacaugagaauaaaaauuaaauauucuuguaacauguuuaaauuauaaauaaguagauucagaagcuaacuuaccagcuagcaagaugguucuagagauucuuaugugcaggcauaagaaccuaaaccgguucucugcuuucuccaugagguagugagggaaaaaccaacuccuaagauuguccucugacaccugcacaguggcaccugcacucuguggcacacaugauaauuaaaaaaaaaaaaaguaauuccuguacucuuccagaaguaggcacguaugugcucugagagacaggaagcaucucuuaaagacugcaauugagcuuuccaaacgucauacagaugcuuuaggcauccugcacauggucaggauuaacaagcaucuaugagauuguaacuuaguagacuuuuuuaaguuguuucauauuuguagcaugggguuuaaaacauuucaccauugacccaugcuccauuuugucaagcauauacguugcuagaccucuuuuuguaauaagcaaaauuaaaaauaaguuaaauguuacuguugagaaucaagagaggaguguggugaagagacaacucaguaguuagagcagaagacccaaguucaguucccaccacucauuucagggagcucacaggcaccuguaauuccaaccucaggggcaucuuucaccucuggccucuaugaacaucacacucauaugcacaaacauacauacaaacacacacauaacuuaaaauaguaaaauuaaucuuuucuuaaaaaucaaaaagugccacucauggugguaaaucccuauaaucccagcacuuaggaggcugagucaaaacucaguuccagggcagccugggcugucacucagacccugucuccaaagcggagaaaggcaaugagauaagucauuaucuucagacuacuguguccuuucucuugcuuuuguuucaagauaggccuuucagacuagcugccacugugggucuugcaguuaagagaaugcuuagcugcgucucugccaacaaaugaugagauaaaagagcucugggcauucuacacagaaacuggugccauggaauccucuccuuggaaaagcucuccuccacacuugcaguggaaccuccaggcaugcacaugcgucuuccucacucacacacgccucacagugcggucagggaagauaccagauuguaaagguagaucagcucugaaagaguaaggcucuguuucuuuaaaauuaauacuuuuuguacaaaguaacuuaagcuuaaugcccauaacagaaagaaaggcuuaaacuuggaagcauacaguggguggggacauauuuucucuacuuuaauagguucuuuaugugaauacccccaguuuaaaaaauacaaaaaagaacaaaauaaucuauuucacuuuugguuugguuugguuugguuugguuguuuuuacucacaagaagauaguaauuucuguguucuaagaucucaguuccuaccugaacugacuuacuuuuaugacuuagaaaauugaucacuuucuagauuuauuaaauaugucaaggaaagaagauauaauucuaguuaaaaucauuucucugcuguuugguuugguugguugguuggguugguugguugguugguugguuggguugguugguugguugguugguugguugguugguugguuugcuuugguuugguugguugcuuggcugggcugggcugggcugagcugggcugggcugggcuguggaaagaauauguaugaauacaagguauuauguaauucgugcccaaacaguuggguagguguuagaaucuuucuuucaaagcacugaaaccaggugccuggauacauucagggcuuugagagauccuuuuugaaaccugccuaguggcccuuuuguacagcuugaacuccuuagcucuguguccugcagugaaguuggagccaugcaccuggcauccacauaccuaggucugaaaaggcugggcaaagcuagaugggcugguaucagggugaggucagacccgaacccuacacagacccacaagaucagauccagcuaacuucacucuacaccaaaacauucacuuuuuacuuacuuauuuagaaacaguugaaauagcuuuuaaaagaaaaccaagcccauucugguuuucucucaccccagaaugcuuucaguuuucacuuccugggucaagcucaguuuaaccacuucaccccaacauaaacuuugggaaauacagauucugaagcaucucacuuugccccgggggagauggugaccccaggccaacugaugaccuugucagccaacuuuucuaguuguaauuucucccguggaccugcuagagcuugugguccguggaagcagcuggagaagaaaggcagccgucucacgucugaggcuucuucccaggggaaugcgauugccccacagacaucuaugcagagcucacacacaggagauaguuuaaugggcuccagagagcugauucagugugacuacuaaagcuuauggaaguguagcauagaaaagggaugggggaucccucuguuccuguuuguuugccuaguugggcagugugcagcuaguuaucuugaucauaaacaugguucuuccauauucuaaggaauaccuaugaaaauguuuuguuuucuguuuauaucucagguuaagcaagaagcuucauuaaagaggcuucauaggaaguuauaugugggauccacacagaaguuuauguucuuuauuuaaauugaauccuuagucaggaaagggaaaaggaaacuuuuaaaaugcuaguggguguggcugagcccccaggcugaacacaguaauaaauggugcuguaguacuguaauugauaguuuuauuacuagauuggaguaugagcguuaauuuuuuauuuauauuccuuucaagauauuaaaacugauuaagcagcuaucucuuuauuaauauccaucaacugagcauaugcucaaaggagucgaucuaaucuuccuuaguggggcauacuaauggcccuuuagcuggauagaaaaaauaauagaaacauuauuugcuuauagauuuauauuuuaugacauauucaugugauucguguuuuaauagaagaauucagaaaugcaguuaagccaaagaaaaagacucccuuaaucaugacugccauuccccaaaauuaccacuguugauggaauauauaccucagacuuucuuauuauguauagauguagaauaugccuagaaguguguccauuuguuaagucaaacauaaaauugauggcugauuauccagccaccugccaccaaaaagcuaaagguugggcuagugggaggugggcggggugacugguaugugucugugcaagcauguuaagcaucucucugucuuguguucauccacagcugugauuagugcccaucccauccauucccucgauaacccucaccaucauuuccacuccagcagccucgcuucuccagcccgcagucaucucuaccacccaagcagcccauggcccauuggcacauccaugucccuuucagacagggccaauuccacaggugagagaugaggcucaagcccagacggugaaagcauccccggaguuggcaaguggaauggggaaggacuugccuauuuacaagucuucaguguuucuuguuuauccugacauuucugugauggauucaaauuuguuuuuuuuuuaaccuacugcacuuuucucccugaguuuaaguauucagugcaaggugccauuuuaguaaaaagcagcaauaacuugaauugcauaagcuucuguucuuccuauaagccucacaccuuaacuuuguuaccuuuuuuaaacccccccccuuuuuuauuuuacaaauugaaagggaaguuuauucagaguggcuuaucgaaaccaguuguugccuuugucucagucacugaaguguuggacagucaugguaggugcagguuacugcccuguggaccagaguaaggacagcauccaaaaggcauccgagccaccuuaggggagcggagacagcucuaaaacauaggaaaguggcauagcgguauucagugugugguaaaugcuuugccagacaaacauguccucauuuggaaaucauggcuucaucauacaguuuuaaggagaaaagaaggaagaugagacagcagaaggaacagacugcugcugcccacugacuacaaguucauuuaaaucuccuaguuuuaagcugcaaguccuaguauuuauuacugguaaaaaccaaauguuggcaguucugagaaaugaggaaaauucuagugagcuccauuuuuuuuaaaaaagccuguaauuuuaauauuuagaaguuugaguccccacuacuagcaucucccuguccucaagcuuugaucagucauuaauaugcccagaauaccaaaugaaugugagagucuaaaagguugucugauaccucuuagcgcugcacacugccaauacuguuaccuggcuuggugaugcugcuugaacccacaccuaaauuucgccuucccacaauuuccucccaaauuuagguuucagaucuacauuuaggaagagaucauuauuccagccagauacaugggaaccaaaguuugcuguagacaugaacucauagaacagcaaguaccagaauacagcuuuucaguccagcccugcucuuaggaagauaguuuugugucccgccacacuuaccauguugaagacuaagggauccaucccacacaauccucacauaaggucgugugugaguguguggaaaguucuccuaguuggacuaucccuguccuccuuugcccugggcugggagaggcuugggaguuggagagaagacuagaaguucccacugagcauucagccagguagucuacuauuguugguaaaguucucuuuugugugugcugagacagaaagggagaaaggggagagguuacuuuacuaacaguucuugcuuugaugcccagagaggauagugugauagaugcacuagagaucuauuugaaaagcagagccaguaucuagaaguaauccaaguuccccugcuuuguauuuccccaagucuuuauaucguuagggcuuagacugcuauuuucauagccuuggguguggaggcugugcagaacuggagccuggccaaguagucucugcccuaggggcauuuaccauugcuugccaugagaagagcacuuucuguuugaccauucugaaguuuguauuuuaaacaacucugaaagguaagggauuaauccccucaccaaagcagacauuuuagucugagccuagucuuuuaguuagggauuaguguacaagguugaggaacaucuuccuuggagaaugcaguguucuggugcucucuggaguauacaaggcaaaccuagucuguggcaguggcuagggccgugacauaugcaagcaauagaguguuccuugcuuacuuuccugccaucucuuuguaaaacacaguugaggcaguuaggcuguuguacagaguugaucugccauauuagcuguuaucaggugauaugucaggacuuagaccuauuucuuucucauggccucuuauuucccuuccuagccagcuucuaccugggccuggaucgcagaugguucccggcagcuccccaggcacagugauggcuggcuugagcaagcugagaaguggcacccccagcauggccuuuagaggaugaaaggugucugaaccuggagagauuguucuagcccacguacauuuauccucauccgugggacccagcaccuuuuaaguuaaagugcggucuauucugucuacugagagcccaagggagcagauggauugcuuuuucacaaaggcagggaaguagguuagauuccugcagauaguuuagauaguuuauguguuucucuuaaggcugagaacucaaaacagucaaaauaagccuucaaacuaccuguuacagccuguugcccaagcugcuuuccgugucuccuuucugggugagaacaggucucuccuguucacacuguaugaaaaucuuucucagucucugacauugcugcuucugcuuugcagggggagacaagcaucaggugcagaaaggcaggaaaucuguggggcuucagaaccugagccugggaaucagugcagggauucaaacucggugccugucugugggcgacuugcuuauuuacccucccagugcuuccugaguuacucugagaaauaaauguaaaaugcuuagcauagaauaaguacccagugucuacaaagagaaccucucuguuguacagggacuauguucaagcucuucauucauauguguauguacauguauauauauacauauacauacacauucauauauauguauauauacauacauacauauauacuuuauacauaaugaauuaugugugucuccauguuuuauagaugaagaaauuaaaggcucagagaucuagugacuuugccagauucacucaucuaguauuaucaaaguaaaauauaggacuggcuaacuccagugugcuuuuccagccccacugugcugcccucagaagauguauuuucugaaacuugccuuguucuccaggcuaacccuucccugugccucuggauaaaaacagcauucauuugacacagucuucagcuguauacagaccccuagacuaugugaggcuuuauugucaugaggucaaagccauucacauuggugauggccaucuaguaccugagcauuggccucaccugcacaagccuugcugacagagccaauuucugguggguauuauccagccuguauuacuagacaugguugucugugaauggucaguuucuaagacuaccaaucagugagugaaauuugaaaaauuguauauacuagucuucagaaccuucauaaagacuccauaguaaguauuuuaaaucuaugaacuuacaacuaccuaaguauguaacuagagaaaaaaauugaaacugucgguugaaacaagauuguuuauagauucuuagauuagcccauccauucuuagccuuggcugucguccugauccgugugucucuggacuuagaacugaucugcuaaagugcuuauugaacaggcuuagggaaccccuggaaguagccacaacugcauauuuuaaugguaaagaaauacuaacauuuaagcuuuccugcuauagaaucuguucgaaauacccccagcacggacaccaugccagcguccucgucucagacgugcugcacugaccaucaggacccugagggugcuacuagcuccucuuacuuggccagcucccaagaggaagacucaggccagagucuucccacagcccauguccgcccuucccacccucugaagagcuucgcugugccagcaaucccacccccaggaccuccucucuaugauccugcacugccaagcacaccauuacugucccagcaaggugagugagaggagcagcaucgaccgaggggccgcuggcuucgacccagcuuugggauagaggucuuuaccacucacccuccgauaccacucucacaucccuuuuuucuuuccuuuuuucuuuucuucuuucuucuuccuccuucuuuccucuucuuuuuccuccuccugcuccuacuucucucucuuuuuuuaaacugaguuucucuguguagaccugucugucuuggaauuugcucuguagacuagucagccuccugagugcuaggauuaaaggugugugcuaccaccacuugccccuccccuuuacuuuuuaaagaaaaagcaauauccuccaaaguuuucauagcaacuuagagaagcucugugucauuguccccuuuguggggaaaacauacaagccauagcauaauguaguggugagcaggggcugaacuuuugaacugugauuucugugugggaucccugguauuaaaauccagugacauagguuuggacaacagagcugguccaucuaggccccuggaaucaccucacucuaaaagacucuucaggcuaaacaagggccagggaggccaggucugaaaaccaggagucucaagauagugagcacucauuugcuguacuucacagcucagcaagggacucuggccacugcuuauuaugguuuguuucagaauaagucugugguucucaaauuuuuucagucucucaaagccucuucagcaaucagugcuagucuaaagacacacggaucaggaccacugccaaggcugagaauggauggacuaaucuaaaaucccaaaacaaucuuguuucuguguauggaguaugucaguacuuaucauauuaguaauuaauacaagaaaguuuuuuaaauuuuaauuaauuuaaaagauaauuagcacauuauuuuuuuggugaacaguuaucacuaaguuucucuuaccuuguaagugucccacacucagucuacuguaauaaguuguuuugguuguuaaaacucugcccucacagauacauacuuggcaaauggcaguguacuuucauaaccuuuuagauauuuaggagcuuucguuuuuggaaaaagggggcuucuguacugcccacaccggucuagaguucuuaguccuuccgucucauuguugggauuuccgauacaugccaccgagccuagucuggguauucuuuuugauacaauggaaaaauucaacaaguuguagcuucuccaagacugauuuauagugcagcaucucugucugucugcggacucugcacagucugguccacuagguugcauuagauuuagcuugcgcuuuggauguguaacacuaaaacacacguuggacauuuggaagauauugguucaauaacuuuuaaaaauccuccaaauauucacacauucauuguaagaagcuuucacagucagauaacagaaacaagucuuucaaaaugguaauuuucacaaaaacuuugauuuuaauauuggcaguaucugucauauuuuccuuaaguucauagcucauucuuucuauuucuagaaaauaucuggggcuagagagauggcucagugguuaagagcacugacuguuccuccaaagguccugaguucaaaucccagcaaccacaugguggcucacaaccauuuguaaugagauccagugcccucuucuggugugucugaagacagcuacaguguacuuagacauaauaauaaauaaagcuaggaaggaaggaaggaaggaaggaaggaggaaaauaaaugucugaaugacccaugugucaaucaucuuugaauuaaaaguuuuguuguuacaugauaaaaccucaacuggcaagugagucuaucacgguccccuucuugaagaugguucugugugugguauauagcagaaacauuugcauuuuguuaaacacauguaauuuugagaguuaagauuuaauaaaacaauuucuuauugcuucauuaaggguaauauacuagcuuguuaaaauauaaaagcaugacccuaguuaaguucacagcuuauugcugcugucuucauugcuaaggcuccuaacagucuugcccauguugcuguguacccucaauacaaauaaaaccuaguaaaaaaaaggcauguguuccuuaagugucacaaugaaugagcuuuuacucccagguauuuaugaguagucuguggcucaccauacuuugagaaccauugggagaaaauacuaguuuucuaaaggcaguggaguguuucucuggccucgugguugcccucuugccuucuuccuuccaucuugcucugauaacuuuucagagcagaucccugucugagccuacaagcaucccucacauugaaacagcuuccaccccugguggacugcugaggucuaagggaucaaccuuagccacaaccuaacaaugcccuuugccccucagcucugaaccaucacauucacucagugaaaacagccuccaucgggacguuaggaaggagccggccuccuaugccagugguuguuccgagugccccugaaguacaggagaccaccaggaugcuggaagacuccgagaguguaaguuccuggggcccucggcuuggccaggauguccuagggaguugcuugcaugcuauuagcugauuguacauuuguguacacugaggucuuugccaccauagauauaaagcagauuuaaucacucaucaaacagguguccuuggagcauccccauauccugugggaauguacuauggguuugguuugauaucagaccuacucugauaagucuuacagugcuuuaucaucccaucaaaguuauauauauauauccuuccucucauuucuguuccuggaagagaaggugccuaagauuguuuucaaauuccaguauucaaugucugcauuuccagauacuggguucucuaaagagaaagcuuaagcccagagaugcuggguacacacauuauauugcucugacagagaucuagaagaggaagcaacagagccucucugccuugugaggucauugugagcugaggaguauguguaagucaggagaaaggcauuguguauugugaagaaaugcugucuuuauuaauggccuugaguauguccgcugcuucuguuuuuauggaguccaccugguuucuguaggccagcgucccagggcaguuuuggccaggcuacuuggagcucuggacagcucuucagaucauucccaguaaugguguucuuccuucuguagagcuaugaaccagaugagcugaccaaagagauggcccaccuggaaggacuaaugaaggaccuaaaugccaucacaacagccugaugaccuucgccuggacaugacuccaagccugagucuacaagucucggaacuuaaccuugaaaacaaggaauuguacagaguacgagaggacagcacuugagagcaggagccagcaaaccagccagugccuccaugugggguuggcuccaggcacagccaccugccuucuccuggucagccuggauuacacuuguguggaggcagcuucccuuugccugcugagagccugcaggacugggcacuaugggccaaaauuuuguguccagggaagaggcaagaaguacgaccugccuuuugcuuuguggucaguggcuugugucuuugugcugcaacugcaucacuuuuauggaguguagacauuggcauuuauguacaauuuuguguccuauuuuauuuuaccuuaaaacacuaucagaagccaagggagucugugauguucucucaagcaguugacacuugacugugguuccaguuacuuacggaaagucaucaacagugagguuguuugacaccacugacaggcauuggcuuguuguggguuucauuuuuauucuuaauucugagacauugcauccucugccagcuguuaauccaucacuuugaggggaggacauguugcauugcuguuuguaagcuuuuuuauuauuuuuuuauuauaauuauuaaaggccugacuuucuccucucaucacugugagauuacagaucuauuugaaugaaauguaacauugaaaagacuuguuuguugcuuucugugcagauucaguauuggggugggauuggggauugggaauaggaaauggaggggcugcugaggcccugugaauguuucugucaauguacuuuguuccagaagccugccgagaaugaaagcagcaucuuuaguguccuuuccuggcauuuccaucuucgugucacugcauagcaacuggaguuuuguuuggaucugguuauaaauucuuguacaguggaugacuuuggugauuuagcugcccugguaucuuggucauuuccucuuuggaguguccacacugaggucucuaucaauguauguuuaauugcuugagagaugccaaguagaaccagagccugacugugcucugagaagcuacaaagcacaggguggagacucccuuuguguugcuaguauugguucucucuggaagguuaaaaucuaaggcaggaucuugguuuccuauuccaaauaggaugccugcuucucugggcaccaguccucagccaggcagcucucguggcauugcagaggcucuccugaaaaacaucaaccagggugagagccaagaugggguggcacccaugacgcuuccccacauguuucuucaaggagcagaggacagagauaguggaaagagggucagcagaagcaggugccuucaucuaucccagcagcucagccaaaccccaguuagaaugaggcagcaggagauuccaggugugcugaggguucagccacacgcagaagacguugcagaguguuaaagagguaagcugagguguguauuugguuggcuuuguuguuguuguuaauguauaaugaaaaguauaagacuaacccucaggccucauguucuccaauagaucccuggaagacaguauagaaagucagucgggcuugggcuccuuagccagugagacuacucagaccaccaguggcuagccuagccuaccuguccuugaacaugggugauuuuaccccuuugaggucuuaacccuuuuuuuacuuucaacaagaugagcucuuuguaugauugcgggcgggggauaugaaaaugcaaugaucuaacuccuguugcucuucuagcuggucacaugacggcaccaggcaggguucugggacacccggugugcuuugacuguucuacaaaaagcugucagagcguucuggccuccuggaggcuagauuccucagaaacugucuagccuuugcccacagagcaugcuauguaauuagagcacuccuucccaugaaccccagcacuuguguuaccucagggccuugguaccuggauacugccacagaauuuccauggggcgggaagggauguauuuuuaaauaaaguaacuuaaaaguuggggaaauuuuuuaaauucagaaaaugcaaagcuauucuguauuacaccauuucacaauuuaauaugucuuauauuuuccugugacucuggaaacuaaaccauugugugucuugucguguccuaguugagcuggggccuagcagcuuccuuccaguggguguggagcaaacguguaugucgccucgcuaccugcuugagggguccgaagggcugcugggacugaguucuguacacacuuguuuggccuuuucuguaguugaugcuguaaaacucuauggcuuuuuaaaaacaauuucauguuuuuauuuuguauuggaaguccaauacacuuuuuuaauccaaucaaacuggucuggucaaaaaguucuuucccuuaaaaguucaggggcuccuacuuccagcuuccgaugacuucucuguggcucucacugcuauaaagcaggauuuagaauggcaaucugggcagagguaauaaaagaaaugucugacugccagccccaaa

SEQ ID NO: 12440 - RNA, 37461 nt, Mus musculus
uuguauaaaaaagauuuauugaaauuuaucaaugacaaacagacauaaaacucaaaguuuggcucuucucaagggcgggagaaaaaugaguggcaguuguucuguaccaaugagacgcaggguaggagggacacagcacgucacuucuaaagcgaucuggaagagggaugcagaaggcacacagcauucccuaggagaaaccugcggccauuucagagucccaccggguaagaaaauacgaguuugcauuccuuuccugugcuccaauguaugugagaaggaaaacaagcagaacaaaaccccagaggacucuuggagggagcuccagagcguagauuuguaaaaggguucuaagcuggagcgccugagaugcguccuccugucauuucugcaaaaccaguugcucuaauauuuuacagaaccaaauagaacaguuuuuuuuguuuguuuuuguuuuuaagaagcugaaacaugaagguucacuucuuucccauuuuacaaguaucuccuaacccugccguuuuuuguuuuuuucuuguuguuguuauuuugauuuuuucuuuuuggcucucgggaucauagccccagaguaauaagaguucucuuugcaaaaagcaaagcccacugccaucuguggagggagggaaaagggaugcgagauggggacuguccccaaaccagugccaaaauacgccuuuugguugcuauuuacaaaccggggugcugggugccucuggcagcgaccacacgaaccggaaccagaacaggaguuagugaagaugacaggggcugugagucaccuggcagaggccagccacggccucccgaucaacucuggggauguaggacauaccagaaaauguuagaccuccaagccauccucuccagagaguaagaacaaacacuugcuuggugugcacuaagcuauugcauuuauggggacaaaaccagacacaaggaaaaaggagggggggaaauaaaguguggcaguaaaaauaguauuuuauuccuccccucccccccacccccaccccccaucaacccccaguacacuuuuccccucuccuucccacagcaaugcuacaaucagaaaaaaauaaguuucggggggcaggaauaggagggggaggggauauggguaaaaacagucaaaucacaauaggaauuuccccaaacagguucauuccuuagucauccucuucgcccucaucguccgguucucguuuucgcuucugacucccuucuucuucuggaaaaauggagggaaagggagaguuaucaggcagccaucuucccggcagccccacccccacugggaaccagaacacauccaggaagcgugggugcccccucccaucgccuggcccuuaaagcccaagcagggcaaugcuagagucaaaggggucaggcugccacugggagagagaaggcugacauaccaccagcuucuucuucgucuuccucgucauccacuuccccgucauuguaaccuuccucauccuccuaggggcaaagaaagacagcaggguauuagcagugccccugcuggaucuggggaggcagcucccagucccacugauccaagcuccaccccagccccuagguaaaggcagggccuagcagcacacauuuguauuccagcaccuuggagacacagacagguggaacccuggagcucaccggcagccggcuuagccaaaccagugagcuccagguucaacaagagacccuggcucaaaauauaaggcggagaaauugagaaauaaaauugacacuaacuucuggccuacacacaugguacaugcacaaacaaacacaugugcacacacgcaagcacauacacuauacccgcacaccuacaugaguuagagaugucccugccuagaaaggccuuucaucccaucucagagcccacaauaaggccugcagcucagggugaacacacacaguagggcuuuuuacuguuuuguaucaaggaaccaccugagucagaugacuuucaauaugugggugaccuaagacauuucccacauuaaauaagauacugaggguuaccugggcugugggguaguuuuggacuaccccauguuagaaacacuggaugugaagccccuagaaaagaggcagcuugcuagcaugcaggcuuuuaggagaccaggcucccuaggcagguagaugcccugucauugaaaguaggccauccuuucuugcaucuguccucaauaugguuuuagcuucaaggaaagaccccaguuucagcaaguccagaaucaagugggcaagccuagcucuccuuucccgggcccuccccacagccaagccuaggcagcuaaaggguuuggguguggcggauagacucaaggguccuugagaaccucacuucaaccugcuugggauucagccagcccugugacuucauccucccauccuaggguccuuguucugggucauucccuggguuccaugcugguagcuucucuguaccugaaggccugguuucuaugguuucacagcggcuguuucuaagaacaguugaaguaaauucacuuuuacaucauuggauaguucucucccuggucuguuugcgaagacucuguguguguguguguguguguguguguguguuuguggguguguauuuaagagcucuuucauugguaacugagaaagggcagauggucaaugagauuacaaaaaaguagaacaaaguccacacguggggcucuuaugacagcaggcaggaaugguacaagggacaguccaccagccaguaugucccauuaccuuguccucaaggaaagagguucccuccugcaaguaucccuuaaagguggggcugucagccuaaacccagaagacagagaaaccgcagguacagaugggagccuggccuuucugcuggcauccacccuccugagcccugggguaggcaggccaggaacccggcucaggagcugugugggcauguguacuacaagcaaggaggcagaaaaccaggagaaggagagacuauggccuguguacugcgcaugugugcccgaaggcaucugguucaugagugugcacugcaaaucuuucuugguuaccauuuacuagugacaagaacagauucagcauucuaaacaacucauggaaaacuacccugcuuugagagacccugagccuccaaacucauagaaccccaacacauggagcaaggaggaagguguggguaccugagaccuguggcugcuguaccccucaccagacuccuucugucgaugugacuuuacucucaauaacccagugagagaggucccuacgucacagaugacaagaaacccagaaaaaaacaagaaaucuguccaaacgagcacagcucaggacagggcuagaaccagcuauugcaaugauaagcagaagcuggggagugguggcaaacaccuuuaaccccagcacucgguaaguggaggcaggaggaucucuacaaguuugaagccagccaggucuacagaguaaguucuaagauagccagagcuacacaaggaaacccagucucaaaacaaaaaagagaaagaaagaaagaaagaaagaaagaaagaaagaaagaaagaaagaaagaaagaaagaaagaaagaaagaaagaaagaaagaaagaaagaaaacaaaagguaggggcuggcaagccggcucagcgaguuaagggugcuugcugccaagccuggcaaccugaguccaauccccagaaaucacacagugaaaggacagaacugacucccaaaaguuguccucugaccuccucagcgacaggccccgcccaaagcacgcggagccucugcuuccgguauccccucccuuuccuuacucugacacaacuuccucagaacggcagcugaggucugugcagcaaagucugugccauagaaguuuuggaaaacggaccccuuuuccuuccccgccagcgggcaggagguagacaaccaaggcuccuuccuggguugccucgacugauaaugaggcaccugccaggucagaggugggacugcacaggugcccagccccgucuccuuaccuccuccucuccacucacauccucuuccuccccuucuuccuccucauccucuuccucuucaucuuccacuagcugggcauauucaucauacuccuccucuguggggguggccagcaagaagacaacucggauugagaugacugggggugggaggguccaugucugccccaccccccagcaaagcucagagcccgacugcucuaauaaugcacacaggugguguucacacaaaaaaugacucaugcuauaagccuuccuccaagucagauauguagaagaaccucuguguggguaaggccacagagacacggagguuugagcaagaagcuuaagucaacauaacuaaucccucuucagagaacugcccuguucaaggccacaaguggccuguguaguggagcaacuggccaggggcuuggaggacuggccccggggcuguacuacagacccaugccacauaucacaacaccauacugugugcaacaggggaacacguauaaucuaauccuugggcaaaggauauccaccgaugcugacagaauauaugaacauuucacagaagaacccagaccaacaaggacaaaagaauuuuaugucuacaucgacuggcacuaucugaguacuucuguuugagcuauaaagcccugcagaagagcugcagggugccaacugcagggggccuguggagauagggggaugggguagggaggagagacccuuagccuuuccuuccuucccaagggaucugacauugacuauagcccccaacuucccuagggccacggaagggcccaacacaggccagugguccugcaugcugcaaccaccagggggcgccacagccucuccagcagaagacccuggucucucagauggagaaaaggcccuggggaguccaccccuacaacuggucucuucucccacgucugggaucacacuauagagauauacauaguguucuucucuggggggacuugaggccaccagucccucuucccuuugaaaaccgguggcagauggcuugccagcuugucuagagugagcucugcaucccaggauccccaggacaccuaccauccucaucuuccucgucgucauccuccacguagcccucaacaucggagucgggggccuccuuguugucccugucauagccaucgagguacaugaccuggggcaggagcuugaacacguuuucucgguaggcauucagguuggucaccucacaguuaaacaggucuaggcucuugagauucucuaacuucuucugcaaguggagaaaggcagucaacggugagggugaccgugggaaaggggcgggaagggggaaacgcccuaucgaggccccaggaagugaggaggcccacagcuagcaagaaaugcagcugaaucuugaccucucaccucauucaggggaucucaccgagucccuguugccauggggaccaagucaaacuaggaagaguagaccccucagagucagucuugauucucuacuauuuuguauauaggcccagguaauucuuaguggaggggccaaaggccaagaggacaucugagcucuggucuguguuaagacagacuguauagacucagcuguauucacacucccaacacaagugagucagaacuucgaagagguuucucuuccuaacaaaaugaugacaucagggcuucccagcagaugaaagcagcucugccuucacuuaggucagugggagaccuggaaagaacuuccuguggucagugugcuuuauuagcaagacagacagacagucugagcuugaaaaagcaacgccugcuugcuguuaugaccaccuggccccaugagcucacuauguccagagacugaugagugcuuugugaacccggaacagucacuuuugccgcaucccuggcccuuccucaagucaagcuuugcaacuuuucuccauuuccaauggauucuuuuugucacaucuucgggcgguuuccuuaaaaaccaaaagaacgcugcaccugggacguugguaacaagaaacugccauucugacuaaaauuucccuaacuggaaaaugaguaaagcaagaaccagaagugucauccauccugucucugaggcccuggucaccaagacagacacucuucucuccauaugcaaaugaaggccugcacugggcuuucccacccacagccucagacuccaggaaugccacgucugugucagcacuaaacccuaacccuuggaagaaaugauagcugauguacauccagagucagcuuacaucuagguuugcuccucuccucaaaggguggcaagccagccaggcugugagcccagacauaccacaacccgggcugaagggcacacaccacaccaggcuccauucccugccccacacugggugcccauucugaccaggugaccuugguccaacugaauucuccgugaacuaagcagaaauaguacccauguuagcucacagcacaggacgagagucaaagaaaaacagugauaaauaaauaaaaccaugaaagucgggcuccccaccgcccccaaggaaaggagaggaccccaagggacucaccagcggcucuauugugcugagaucuuuuauuuuguugccacuuaaauuuagaugcuuaagguucggacauuucucugccaauacuuccagguccccugagauucuguuuucgcuuaauucaagcuguaugaggcaggaagggaaaguacacuuaacacccagcucggggcuacucuccccaggcagccagcgggaagggaacauccccagggacccugccagcaaguugaagcaagcaccuggccuaccccuuaauuaugcucucggagcacaaggcgcccccacccggagccucccagcucccagccuguuuaccuucuugaguuuguuuaacuuugguaaguuggaaauggaggugaggccuacguugauuguacuuaggaauuccaguucuucaaacucauccgugaggccuucgauuuugccuucaauugacuuacaguuauccaggaccagcucuuucaccuggaaaaggaagguuggugugagugaaggggucagagaggcgguccaacuccagcgucccaucaauugccuuauccagaucagcacugccucggagcaaagggugaccgggcuacccaucuuucuaccauuaagaaagacagacccagauggagaauguuggauaagcacaccucuagaacuggggagccaugggcuggcucagugguuaagugcacugacuacccuuccgaagguccugaguucaaaucucagcaaccacaugguggcucacaaccacccauaaugagauccgacacccucuucuggugcaucugaagucagcuacagugaacuuauguauaauaauagauaaaucuuugggccagagugagcagggacugagguagcgggauugacuggagugagcagagguccuaaaaauucaauucccgacaacuacaugaaagcacauaaccaucuguacagcuacaguguacucaaauacauaaaaucaauaaauaaauauuuagaacuggggaaccucugcagagaacauauccaguaggcuuugcugucaccaaggcuggugugugugugugugugugagugugugcacgugcucgcacaugugugaauaagccccugcuacacaucccaguauacaauaaaaaugacagucccuacugcccacaggcaucagccacaauggagguagccaugacaccugguaucccugccuacgaaugcccaggccagauacucccuggaggcaggcuacucauuucaguccacaccuugugguccccaucccuguccccaccaccaccaccucccccacacccccuugccaaaugcucguggcuugcacacaauacacucaugcuugcucucccuccucccucuggccucagccuguucacugaggccuggcccuuaucacuguaaucagguccccagccugcuccaccacaggggcagcauagcagagaacccucguccacauccucaugccuagacagcacuguccagcagauggucccaccagaaaggaaguguuuggugcuguccaagaauggagccacaagccucgugugguccugaacacuugguguuauuuuaaucuaagguauacagagauacaaggcacaguuacgggaccacauggcucuuggaugucuuccuuggucccugcuucauagaggaugagagagccuguacuccuaagacagcccguacuuaaaugugagggucccuacccacuuccucuccaaggacagggaggguggugcugggagguauuucucuguuucugacaaaaaguggcaagagacgguagaaguuacucgugaggauccaaaccacacccacugcaggggcaguugcuggcucggguaaacaccgcaaauggaugcuaggucagggggaaagccagugggucucagaaaaggcgcaaacagccaaaggaguccgcaggccaacgaagguaauccugggcaagccaggugcuuggggaacccagucucuuggugauaccaggaaccuuacagugguauagaagcgaggguugagccgaggugcucacauaugcaaggcaagcaagcaccugcucccuuuaguucacucccccccccucuuuuuacuuugacacagucuuucucugagucgccuaaacuggaucugaauuguccuugcacauagcuuuaaaaggccuucaauuuguaauccugacucgcuucugaaauaguugggauuagagaucuuagaguuggcuugaggcugaaaggacucuaaaaggagaagacugaccccucccgauggcacuugucccccaugcaccccugcaccccaggacuccgccucagaaucagcuucuacccugcagcuucugggaaacauggaaaauacugacuggacgugcugcacccuccauccaugggguucuccacaggcccacacaucucacagggucaccacuguccuccccaccaccacccugcauaaacagaucacgagccaguccccacccauggcugcacuucuccucuaagaggaccuugccuagagaguccucuggucuuccagagaccacuugucuucagccacucuguaaagguacaacaggguucacuccaggcuaauaagcagggcagggacuauggggcaccugggucccugcagagacagcgagugcuccaugcaggacagccccaucccuagcagggauucacaguucuaucugaaggaaagaaagccaggaacaccacaccaccuuccuccccgaaucaugagcuccaagccucugcccuggccaugcuccauccaucuucucaauggaucuaagaggccacggguccaggucaagccacucccgguuagaguguaagaaugaagcucuuggggcccuucaccccagggcaagacaguugcagagaaaggccuggcugugggcaucgagcaaauggaggaagagcggcugugggcaagggacacaagucugagguguugggcuccugugcacaggcuuucuccuuaacuggcuuuccagggaaucccugcuuccaagggcagaucccggugucuccucagagacugcagucaucugugguuuuccuagagugguucgacggccucuccccuuaaugccauuagcaagcauaagaggaccuggggugggaagguaaugcugggcagucaagggaaugucuagagaaguugccucuaugugugugugugugugugggggggagagacauggggacggggacacggcaccuccucaguuacuccccaacucucgcuaccaggacaggcugccuugcauuucuacaaacagcuggccaggacagucuucaccacccagaaccacacccaaacugggagccucuacucucagggacaauauguaagucaucacagcuacuguuuacacacacacacacacacacacacacacacacacacacacacacacacacacacacacucugaaugcccuccccauaacaggcacacacccuagcuacaccauggagggggagucccuccauuuacaaccacauucagaaacaccagugugggucggaagaccuggcucagucggcagugccuggaucggaucccuagcagcucacaaacugugcucaaaaucaccaauggcuacaaagccaaguuugaggccuaccuggauuauacaagaagucucaaaaaaaggaguaagaaaaagaaauacuuagccugaaaugcaggcccagcagguggcugccuaggcaaacaggucaaugcaggcuggccgcucaauguagcgcgguccccugaggcaucucugacauuccaagguauaggaacugugccugcccagagaucacccaacuccauagguccccauggcuguaauggcuuuccuucagcccuuuccuguuccaccagcuuggugggcaucacacccaccuccucagucaccaaggugcagagcucaaccuggccuccuccggcuggguguggggcccccaagaguuuccucucccuccggcaaagucucagguagccuuucccagucuccuuugcuuuucugcaccuccuccuuccugacagagaguaagggugcccggcacuguuuagggggugccagggcauagacccgaagaucgcaguauuguguagaaagcucaagccucgcaggccgagaaguggcucaaaccggacaaagcggaaaacccuagccaucgucugccugagucuucugccugcccucucucuacccccacccccuccucucucccaaggccugcgaccaaggggacucacccugcaacuguuaucauuucuaacccacuuccuccguccuuggcagccucuucucuagcccuuccaugugacagcaucccuuuuguauccaagaagugcugugcuuaaaaaaaaaaaaauagaauaaaggcccacuuccccugccaaguccugagugugagcgaacugcaaguuaaaauuaaacugaauauuuguacuuuggguuuagaugcccucccgguuccagcagcccuuaacacacaacagcaacugccacuagcccuuaaaacaacaacaacaacagcaccccagugcacucaguuaccucuguagccccagaggccagggcuauucugcuuacacaggaucguucagccccaggcaggaggcugacauucacauucugcuggcuguagggaggcaccacacauucacauaagaagccagccuggucuggcucucccguucguaaaccuuacccgagacccccaccccagacuugggucugccuucguuccuugccagugaaagcugaacuucauaauaaacacaaacacauucacgcaacacaacaacucguuuguuucaaaaccaccaagucugauccuuacgaaguucucagaugugaccuuucuucucucuaacgcugcagccuucgucacagcccuaguuacuucaggcguguuugucuugaaggucgugaccucagggaaggaugugguuaugagauagccugggcuacuguugaccaaccucacccuggaugcaagacccccugaucugggcugaaugauaucauguucucuggaguccaagauuccaccucuuuaggaaaaggacgguggcaucggcuuagccuauuauaaacugcaaacucuagccagcuucugaaacacucacggcugguuagugaccuacuagccggccgcuucccccucccccaagucaccuacccauugcacccaaaucuaauucaagacucccuccuaggaagccgucccuguagcuggcucuaagaacccaaggcugggcagcgaucucagaggcagcagcaugaaucauuuaaucguguauuaagcaucugacccuccuagaggucagagacuguccuuccccauaaucagccuagagggacgcaugggacagcacugcuuagcaaaugucccucuuacugggccaggcacaauauaauaaguacugggaauacagagagaggggggaggggcccaaacagcucauaagcauaaacagugcacuauagcaggugggaucaacgcucaugcuuucccgcaacagcuuugggcgcaacagcuuugggcgugugccuaugccaaucaagcaccagcccugacaggggaugggaucagccacuaaaauaccaaacugacgcagcacucagcacacuccagucaguucucccuacauaagacacuccugccgcauaguuggcugaagggucacagaauccauggugauccaagaugggggguagaggaggagucggacagagagagagagagagagagagagagagagagagagcugguggcaggcuggaaauccacagcuggcugguaaacagcccugaaaggccacgaggggagauaagagguacccggagaccgggaagagagaggcgcugucuugaucaggaauggcuauguaacuauagcccagugcaaaaugagauggugggccccuugcuggaaauuuaccugguagauagcauaugcuuuccuagccuguacuagucucuuguuugauuuuuccaauacuacauaaacuugguagaagauggaugacaaguucaauaccauccccaguuauacacugaguuugagaccagccugggcuaugugaaacucaucucaaaacaaaacacaaaacaaagccucacauagaauucuaagacagugacagccaacuauguguguaggucacauggcuguggcgcuggcucugauuagaauggacaucuugggucuacgacaggccuucuaaaaaaaauaaugacccagggggaaaggacacuuuaagagccgccccuuacuuuuucagaacuucuauggcaacucaggaugggcagaaggcggacucuagccaaacagaccuggcucuaguccaaguuccucucucuagcccagcuguuccuaaccuguaggucuccaccucucugggguuaaacaacucuuucacaggggucugccuaagaccagcagaaaacacagauauuuacauugugacuauagcaaaguuacaguuaugaaguagcaacaaaaaauuguaugguugcaaucaguuaagaagaguggggaaccacuggucucucgcccuucucaccucucugggcuuccaguuuccucucagaauucuagugccaacgacccagggccggauuacacaauaagaagucuagccuagaauuuugccagcuugaagaaaaaaaagcuacccaccauccccuuuaccacuggcucuacugaugguguccacacugaagaugguagcagggaaugaaggcuccuaaccaggcccaguccuccaugccuuccugccacaggcucugagcccaacaccccaagccucccacccugcucuggagccguggagagcauuuaaaacaaacccucuggguucaaccucuacaucuugcuuugccugguuuucuacccccaaccuccagacaugauuugcgcuuccuuuacugaacaagaauuggauaaauauaugugguuugguuucaaccuugucagucccugaccaauuuagguuccagguuccaggcuucgaacagaagacucaaaucagauugacccaguguuuuuuggugcuccuggauuuuaacuaggucagcuuuuaaaugggccacccccugcugcagaucccauuccuagcuagaaggccacgcugugugagucacugagguuugaggcagagcuaauaaacggacacuugcguuuguuuuaacgguaaaaucuacuuaccgaccugugugggaagggacacagcucuggggggaaaggcuggauguuuugaaaguuaccgagaucuuacugaacagaggucaguguuuucugaucauaacccacugaaagggauacauuuuaggagcuggagagauggcucagcaggcaagccacuugcagcucuugacugaguuugguacccagcaccagggucagaggcucacaauugccuguagcuccagcuggggaggggaguggauugauucugcacucucucuagucuccccaggcacaugcauacgcauuaauuacacagccacauuaauacaaauaaaacaaaaagcaagcaaacaaacaaaaccuacuuuacucagagcacacacaaacuguuugccuguaggcacacuuggugaaaauaaacacuacacauagaaucccaucuauagauuuaaaaaaaaaaaacuuaaaaguuucauuuaugugucucugugagagaaugccacuuguguaggggagccugcagagggcaaucucuuggaggaauuacagggggcugugaggggccggaucugaguccagagaacagaauccaaguccucugcacgugccccaagugcucuuaacugcugagccaucucuccagcccucuuauuacuucaauuuuuaaaauguggcccacaguauggggugaagugggccagagagauugauguucggcagaggacggggggggggggggggggcggaagaugggcggcugggcagagaacucuggcccgggugauuaauuuuaauuuuucuuuucugccacaacacgccuccuguccuaggucagaaucugccccccaccgccauccccaaaaguaagagaacccacggcccauccaccauccucccaaguuccugcagccuuguggcugccagggcuuggggguuucaacgccucucaggaucuuccguagucuuagccaggggcaagagccuucuucgcuuuaaaaacaaacaaaacccuccccgagaauugaaagccucuccgggccucggauuuuugcugcuacguacaaagcagcucugcaggcaggcggcgggggagcacguggcgcgggcaacggugaugccauccucauuacuuagaggcaggagggcgggccgaggaagaucaggcuggcucauagguccagcuggcagggcaggcugagacugcaccagcccgccagcccugcgacucgcucuugucccuggcuccuccccacucuuccccgcgcggucgggugauuucgccugugcuuuccuugcaggaguauucggugcuagggacgcuuccacucacuggaaaggcucggugcuggccaggcuugcucaaaaggauaccuagcuucugcccccagccuuugcguuccucuuaucuuuaauuuuuaaaaaagauuuaaaaaauguguuaugagugcuuugccugcaugccuuguacugugugcaugcucacaggggacaguuaucagauauuuugaaacugguguuacaaacgccagugagccacaaguagauucugggaaccaaaccggggucuucgacaagagcagcaagcaagcgcuguuaacugcugaggcgaacuccugccccaaguagcccuccauuuaaagccucguuccugccucccaucucaaccaagccuucccugguugccuggcccugcccuggucccgcucaacuuucaaguaacagaaaguuaccaaagaagcuggaaacagccuagagagcagcuguggggucugacuggcuguccaaggaggagaguacggugaugaaagagagauggagugcggagagagagcuugggaggccggaggugauggucaaacguagcaggcuccauucacuuaacaguucccuuccugucuuccgguaggggcuggcauauagucagccgcagagcacuaguccagauagccgaaaagggccgguuagucaaaaggcacccacacacugcaagaugcuuggcuucugucccugcuguaucucugaauuugcugugugcccugguagaaguugcuuccccacucugggcuucugccccauccucccuccagccuacacacugggcaguggggcuggaauaaagagaugagguccuaaaauuccaugucuaugaacauccccucagccaggacucccuaaaggaggcacagggaccuuagacguggaagagcucagguuucagcgugcaaaacuacaaaacuguucauuuuucuagguaauaacuaaaacggagaaacggaucagcuaggcucuuucugcacaccacgauuauaaaaguaguccccagcggcccagguugugagguuccaaaugugggagugucaucagucaucucagagagcaagcacccaauggcacccaagccccgacugugguagggggaacgggcagaaaccaccuccacuaacaagaccccacaccucaccucacucacccacaguguaauuccugauaaaaaccuacggugguugauauguucgcacuaaagagcugcagcacugucccugugcaauagaaaagcuggauucagaaggguugggccacagauccagugauguuacauuguggagcauuauuccuccccaaaacuuuuaauggccauggaggucaagugcaaauccaaagcaggauucccaggcccccaaccucacacgucuucccaaggcagcuagcggucuaugccucaccccacaugacauugcaggucacaggaaggcuaccuucccuccccuaccauucccaggagccuguuccuguccaccaaggcccucugagagccucugacaggucuaaagacucaguccaccuucccaggcucccugcacagaggggcuggcaucagucugugcuccuggucacaugggaacaaagccacucaggcuggaggugggcaaucguucuagagaaauuucuagauggccgacucccuuucuacucgaaccacgguugggcagagcagaugugccaacugagggaugccaguaaccagcugcugaaaucagacaggagauuuagaccuaagugaugcugugaccacuagugggcucaugguugccuguugugggaagcugggcacacucccugggguuucuaccuugagauguugacugaaagauacaagugagaucacuuccccagauucacuguucaaaggcccacagacuggcaacucaaggacugugaccaccccaaacccugaaggcaaaaagcauucagacucacaggccaggacacuggagucuccugguuuggagaucuaccccacuuccaauuggcuuugcaaaaaccaaaacaaacacacucacuuaggggauguugcuacagcuaaguugguagaauguuuauuuagcacacaugagacccuggguuugaucccaagcaccagauaagccacgccugaugaagugccaguagucccagcucucaggagguaguugcaggagaaucaagagguuaaagcuauccucagccacauaaugagcuggaagccaaccauuauauaugcaaagaucagaguuagucugugauggaaaccuugggcuguuccccguccucucagccuagggcucagcuauccagggggaacugcuugaagcaggagaaaacuggaacaaauaaaaggaacggagaggguagugcccagacuagagcuggaccuccucucaaccaggccuuacacucccccagaaggcauggaaauagacaagaagucuaauaaccucagagaagaaauuuugcccuuggcuuccuuccugccaccuugaccaggccugacaagcagccuccucaaucacacgagcugagcaauuccuggugcugaagucuggcacccaagcuccaauggggagcagaugauuugggcagcaaucacgcagaagagccucgccuauuagccacggucaugcauaagaagugaguuaaucagcccuuucccccuagccuaacaggaugcauucaacuugccuaaguggacaaaucaaauacuuaugcuaaaacuccugguggaaggagcaggggagggcagggagaaggggcaaaaggagaaggaagaggagggcaauaagggggaagaaagggaggggaaagggaggaggggaaggaaagggggaaggggaacgccuggcuuggcuuagcuccagagugccguuuuuucuccgccuggucuugcuaguggaaccugaccuauacuuaauuauuuuaaaaauagaaugcagauugaguuagcuguuguucacaggucuauagcugcuuuaauuuuguuucauuucuugucaagacagaauuucucuguguagcacuggcuguccuggaacuugcucuauagagcaggcuggccuugaacucacagagauuccacucaccugccucuaccucccaagugcugggauuaaaggcgugcgccaccaacugcccagcaacugcuuuaauuuuuguuuguuuguuuuuguuuuucaugacagaauuucucuguguagcccuggcuguccuggaacuuacuuuguagaccaggcuggccuugaacucagaaauccaccugccucugccucccaagugcugggauuaaaggccugaaccaccacuaccgggcuugcuuuaaucuuaaaaugcuaaagaacaaaauguuacaacuuuuaggacugugagagucagggaggggcuaguuggcuggaaauaggugacaaugcuggggagaccagucuccgagagagcacaccccaccuaccucagucacuggagcccacacagacaaagcuaagcucuucaggcuggguugagagaaaaaagagcaggcaugguggggguguggcucacugauagaaugcuugccuagcagguacuaacaagccuuauuauauucaagcucuccuaccaaggaugggaguggggggcacucgguggcugaagcugcuugucaccaagccuaaugaccugaguuugacuuuugaagcauacauguggaaagaaccagccagcuccugcaaguuguccucugaccuccacaugaugcuaugacaccgaugucugagcacacaacugcccagaaaacguaacaaaaacuuuaagacaaguggggaaaaacccaaaggcacuugauggcagcgucccaaaccccauuugcaccuccaagaccaaacuguaaauuccagaacuucaagggcagacugcgaggaagaagacaaccagggugggaaggcaucugagaaccggggugaugacaaggaacuagggaugcuuaggcagaaaggugggagacccacgcuaaucaaaacccuaagcaacuaucuguaagaagagcuuuguauacaaacugugcugagcacccgcuauauggaugaguaaugucuuaugaagcgcugcuaaguguguguugugggucacuucuaaaaaugcugcuuggguuuucuuuuuuuccucuggaggaaaguuaccugcuuagaccacaggcccaguaugccagacaucaagcuaggcgguaagaaauagcauggcagacaaccaaugccaaugcccuccgacgugcagggggagucagauccuaagucagugagugauaaauacacgauugaugcucaaaggaaaacagaaaaucaucagugacagagaacagcacuggaggguggccagcaacacuacccaaggcccgucuucugcgcauacuugacccuaagaguaucugaccagggagggcucuuacaauggaaggagcagcuauggcuaagacgcuaagugggaaccaggcuuggccacacgcugcagcuggguagucugugggagggcuggagagauggcuccgugggcuucugucacccugaugaacugaguucaaucccuggaccccacacagggaaggagagaagugacucagacaaacagaacucugaccuuuacaguggcuccacgacacgugagcaaaaggcugcaaauagccacauuuucugguggaaguggccucugccacacgauggggacacccuauggaaugcugcuuugauuauuagcacagggacacguugagauggagucagucugguuuggcgcuagacuuuucuacuaagaaucuagacauauuuuuguuugucguuuugagacagggucucauguaggccugguggucauaaagucucuguugcaauugaagaagaaacuucugauccucuugucucuucuauccaaguaccaggaagucaggggcguauccgguuucagcugagcuggagaugaacccaagacuuuggcaugcuacgcaaacucugcaaacugaguuacauacagccccagcccagaacuguggcuuuggucaagacuucgccaacucagagugaucaccacuagaaugggaagaagaucuauccccgcagaggaauccagggaacgaggcuagaugcuggguaggaaggcacuuggggagacugugcugugcuuggcauuacugcaauacauuucacaagcauguuccuuaccaagcaagaugcuguacccagagaacagagaugacguacuguccgccccaguccccuacuccuccuugugcuuagcaccuaggaaauucuguagaucagaaaggcaucaaaaauaaccugggaagacauccuaaggccugacuuccccacuauauaugcucccuguuggcccaguaacuacuccaccuaucuccaggguguguuuagaacucuggaaucuuauuuuucuugccuuuacccucaaacuaaccuauaacacugacuuuggggcugaggguguuuuggguggcuucugaucuuuaguguaauaaaggaaccauggaauacaauaagcuggcacaugucacuuuauauccccuggcuuagggacaaguacuuaaaucagaucccacccugauuguaaggucacaguccucaaaguccuacaaaucuaagggccucaucaccuuucccgauuagaagguuacucagccucaauuuaucccucaaugcuagaacucacucaauggagacuacaaccgggggggggggggaccacaguggaaacgguguccuugccuccugacccaagggugucuagucuggaaggggcaucacaacacaggaucgagguucaguuagccaaucugaccucucugggccugucuuccuuaucucaaaaacaaguggcccagccuauaccucgggaugugcuaauagauccaaaagguaauguuuaccaaguaucuaacaacaagcacuaccgcaaacucacccuaggcacuuaguaaaggucaaggaagccaccucuuaucccaggagagggcuuagcuuaacaggguagggaggugcucugcauacacgguugccacgccgagucacaggggugcuacucugcuccugcuaaagaggcugccuauccgaucccugcuccuguuugcggaggcaggcccuaggccccuaauuacaccuuagccuacuuuuauuggaaaacuaugcaucuuuuccuacuuucuagaccuaggucaaaaccucuggguauguuucucaucugugagcacaaaccugacuguauaaaguaugucagucaugaagggaaaggaccuucccuaagaaccuggcacauccugagagcaccaggagaacccaagcucauagugaggaaagaugaaggaaagugugugugugugggguggggugggggugucagacagacagacugacagacuggaggaccucucucuaggcuaucaccggaguggcuggaaggcgcagaucgaagcuaagguuccagguugcgugcacagcucugaaguuggccuggcugugcacccgggacagcuccucaguagccaugaccuggagcaagcuacccacucaaacuuuccagccccacccacucaccuguuccauaggaagaagaagaaucuuaacucuuccacaguaguucuguccuuuaaauagguacguggcacacaggcacguuacaguaacaagcagacaaaacacaacuuuaaaggacaugccuuucccccucacagcguagaaccaagucgcaagccuagaaaagcucagagcacagcagcacaguguuaggaaucagcgcgcgcagcaggaagcuucgcgggagccagaagcaccguucagauuuuucuggguaaaauccaguggcccaagauggcccacucuagcccuucagacaagcuggucagguucucuccccacaaaauaccagugccgagggcaacaggaauccugcaucaacacguugacuaacagcagcagcagagaauacuguccagcccaccucggagcaccuggaccuccaccccacccacacacacaggcacacgcacacacaauauauaaacaaacaaacaaacaaauaaacaaacaaacaaaccuagaaaaacauacuucaaaguucagauuauuuaaggucugagccuuaagagaguaacaagacauucuaccauggcaagguccugucuaaggcugcagugcacagaguacuggccagccccaacauaauuuugcauuucccacucuuguaccaguuuauucguguuuguccaucccaucccuuuucucuccucccuccuugaauuuuccugacucaaccucccuagugauggaacacaucaccaacccuggucuuggguagugcugcggcuugaacccaggguucuguugcggcuaggccagcacuccgccgcugagcuacagcccggcucucuguuuuacuucuuaauuaacacagaguaucacuaaguugcccagguuagccuggaacugccucuagucgauccccgucucagucuugccauguccucuuggccuugccucuggugucacaggcaugucaauccacauccuauucuccugggaucccuugaguguucuuaugcuguccauuagaaugucaccuccuccaggaagccuucccugagccacagguuuguuuucauggcacuuaguggggccuuugccaugaauggaggcugugugugcucaggacuggugaugugcucaucugcauaacugucauauacagacagccugcaaaaaacccagcagacagcagguguucaaucucugugcggaaagaaagaacagaaaccaccaaggccgggagucacggugggaagggauuccagaccugcacugcuguuugccagcugggaagcacuggacaagccgcauagaacugguuaaugucaaauaucgagcagccaagcguugcuuaccacugagacauccaugcccuaacuuccauggagcucaugcacucagaagauacaagucuauguucuggugcagugggcaccccucucccucagacagggucuacagccacuggucaacauguaaacauguccugugccacuccuaucgaugaccacacaggccacuagaguggacagaaaguuccugaaugcucccagagaacaaacauggucugaauucaauacccuuguggcuuaggacagacagccugcaauccaauugggcuccugccaccacaucccacucggcagcccagaguguugcuccagaaaccaccccagacuccuccuuggaagaacagauacaccaccggcauucaccccaagacguauacaagcaugucuguaauggagccgcaaacuagccgguguucagagaaguagcugcuugcgauggcugcaggccagccucugcagaagcuucuccagccucucagagcuggcgaggggaggcuggcuagcacacucacagcucgacguccucauggcaaggggggacaugcaacagaggaggaaggccagcucccacuccugcauguggauggauggggcugcuucucacaagcaguugggcagaagcugagaagcaccuuggucaccagggagccuuccugcuccagcugugggggagccacacuaaacucagcauaaccuuggaauguucccuggcaagugcgcaaagaaacacugaccaggugaaccggggagagcaaccagcacgugagacacgaugggaauccacuaggggacaaaccacgccuucacauccuguaugccaccuggauagacgcagagggucuccucccuccacugaguccaggaggagcucuuucugagcaugguguggaccaacaucagauguccuccucaauggcucuucaucaaauuuucuaaagcagggucucucacugaaacgagcucagugacugggcugagccggugcacucaggaauccucuuguuucugccaagccccuagaacugguauuauagauauacacuaccaugcaugggcaucuggguccugaugcucagagggcaggcacuucagcaacuaagccaucucaccaggccuauucuauuguuuuuuuauagauuuauuuauuauuauaaauaagugcacuguagcuaucuucagacacaccagaaaagggugucagaucucauacggaugguugugaaccaccaugcaguugcugggauuugaacucaagaccuuuggaagagcagucagugcuuuuaaccacugagccaucucuccagcccaaccaggcccauucuuggucauacucugguagcagcagccucauggaacacagguacauagauacaaguuugauaagcacaauguaggaauguuuaaagacugccuuuagcgggggugaggggugcgguggcgggggaggggaggugcaggggacagacacaggcggagaaaugggcccuugcagcccagcacauuaaaagccugaaccauucuuuaguuccacucucuuuugcuucccuuuagcuugcuucuacugugaagaucugaauccugcuucagugugccuuaguauccccccuagggcuuuaaaaacacaugcauugggguaccacgcagagacagauucagcaguuggggaagagccugggaagucccucagauguuccucggguaguucugaugccagaugaggcugcaaucugagucauuaaccacauucuuuccuccugucuaucacacaggcuccaccgcaagacaugggcaucaccgcccucggcaaucuaguccucccauaccucugccccacccaagccacagaaagagaaugcaauuaaguaagucagcugugcacauggcuuaggagaauaacucagccuucuuccaaggccaguacguugaacccaacugacggacagguaauaugacuguggggguccucugauuucccucagaggccacaccauguugguuuccuguaaagucaagggaagaugguggaccaguugcaaaaaggaggacugaaucccuuccccaaaugucugguccuucuaaauuuacuauaacagguccuggccuccaccuugccaguccccuuauccccaugguccucaugacuuuagcaggacacagaccaauggagaaauccaggccugggcccuauggcuggcugcagaguccuauguacacacacacacacacacacacacacacacacacacacacaccaucagacccucauccuucccucccaucgcugaucuuccagccugcugcagaaccuucccugguaacauucucagacauagaaaagcaagagaaaaaaaaaaaaaacuaccuagguaucauugguccugagccucugguauggggccucucacuaggcccacuccuggguucucaggcuaucuguggggagaacacagggcagauccccuggaagccucaagagcaucagagugggcuuugguggaucugcacacacagacuaaucagucaaucaagcugccaugcagcaguggccuuggaugagcuggguaccugagacaggcuggcuuagaaguggaggcugugacuauccucaacccugccuuccaugccaggggugggaaguucagcccguagacagcguuuggcaugguacaggcacuucuuuuacaccguggacuuuuacaaccaaauuaaaaauaaagcaagcaagccaggcgugauagcauagaccuguaauccgaacacuuagaggguaaaggcaggcagaucucugugaguucaaggucuacauagggaguucuaggccaauuggcacuacaaggaaagaccugucuugaggaagagagggagggagggagggagggagggagaaaaacaaaagaaggaaagaaggaaagaaagaaggaaaaggaaagaaggaaagaaggaaagaaggaaagaaagaaggaaaaggaaagaaggaaagaaggaaagaaggaaagaaggaaagaaagaaagaaagaaagaaagaaagaaagaaagaaagaaagaaagaaagaaagaaagaaagaaagaaaggaaggaaggaagaaagaagaaaggaagagagggaaggggaagggaagggaagggaagggaagggagggagggaggaaggaaggaaggaaggaaggaaggaaggaaggaaggaaggaaggaaggaaggaaggaaggaaggaaggaaaggaaaauauuuugaacacugacuuuuuaaccgaacuguuaaacugaacaggcuaauccacuaggcacagggaaggaauaauacuacuuugaauauuuuuaaaaugucuccucauuuauguucucugagauacuuaacacauacuuacacguaaacaauccauaguuaacagacagaacaaugguuggguugcaguggcacacaccuauggucacagcuacuugauuagacuggggcagaggcauaauaaauccaugaauccaaggccagccauggcaauauagcaaggugaucuugucacagaaaaaaagggggagggauaaggagcaugggaguacaaaucuauaaucccaucauuuccaaagcugaagcagaaggaccacaaauuaggaguguaucucaaaagaauaaaaauuuaaaauagugacuagguauggcaacgugucuauaaccucauugcuugggaagcugagaagggacaacugccuagagcucaggguuugcuugggcuauauagggauuaugagacuagcuaggucuaugugacaggaccucugacugcaucccagcauccauccuucagauggggccuggaaguaagauaaccaaauagcauucaucugaugguaauaaacaaaugggaggcagagacucuagcauuuggauucuaacuuuuuaacucuaagaaauuuaaaagaaaaucuggaaaaaacuggaagcccacuguuguacugagagugcuaagagauuccaccucaccuucccuggagcaccucacuccggaugguggguauaaagaagagaccagucaccagggcgugguggugcucaccuuuaaucccagcauuggggaggcagaggcaggcaucucugugaguuugaggccagccccaucuacaaaccgaguccaaaacagucagaacuguuaugcagagaaacccuguagugaacaauaacagaaagagaccagaccacgugcauacagguucuucacuccaaaaacacuagagaaugcuugugaauacagugccgagcccuggggauacccaggggugaaggaaacccaggucccuuuaaagcacacagcauacuggcuucccagggggaagagaugcuaauuaauagaaaugugcaauuacaaggaaaacuccuaugaaaguuucacaacaaaagaaucugacuuagacucucaggaaggaaggggaggagucaacugcgaagugggaugggagugguuugggaagggguugggggggggggcggggagaacagugccagagaggaaagaccaguuagaaggccagcaggggcugacuuacaguacuaaggauuuuuuaaggauuuuuagacuuuaucccgguggugaauuuuacacacaggauuuaaaaaaaaaaaaaaaaaaaaaaaaaaaaaaaaaagacacugucaaccgucaucugugcuuugauuggaucauaguuuuguuuuuuggcuaaaguuggaauccuggcuucaaagagaccagaacugugguauggggaaguuaucugggauggacugaacaguguuguaaauaggaccugugguagguagaaggggagggggugguugacaggguacagaggccauggguucccugaggacagggcgcugcugagauccagauacugugacugagagguaaacaccccagcccagacagcaugugguauucguacacauccacuaaggagaagcugucuuagggaagaaggauagaauaagggcaccugggucccacauccaacugaguuuaaaauauuagaagcuugagaaauagacagaccauaagaagcaugcccagaaagauggaauuuuuuuucaccaaagucuaggacuccaaauaccucaggacucaugaaagagcugacggauucccagagccauauccaaaaaucacagcuacuuagaggagacagggaggguaaacccaguuacaauaaucuaaaagacaggaggcagcggcuauggagggauccagcucaaucaagggggucuggucuuuuuguuuuguuugaggcaagguuccgauuguagagcccuggauaacuuugugauccuccugucucaguugccaaauugcuucccccguccaggaccaguucucuaaagccagagaagcauccucagcugaaaaagaaucuauauagaaagagaaccaguggggcaguggaguuggggagagaugccucaacagguaaaugaacucugccugcuaccaacucuguuugauuccccaaacucacauggugaaaggagagaacuaacucccccaaacugccuuugaccucuaggagcauggcacccaugcaaaugcacaggcaaacacacacacacacacacacacacacacacacacacacacacacacacacacacacacugcagggaaaggacuuccuaggaaaccaggagauaggcauuucuuacggaagcugccgcaggcugggagaaggugaaggaccaggaggcgaucugagagaaugccugaagcagcagaugugcagugaaaaaggagcuuccagagagagggcaguggauagaguggauaggcaucgaccucuacagaaacccuggugggaaggcagugcagagccaagggcugggcugcucugcacugcugcagcugaucccgaacagacaguggcaucuggaugccaucuccagauucaaaccuccuuuccuacagaaacaaguaccacuuuaaugucagccuuuguguguguguguguguguguauguauguauguauguguguguguguauacacacacgugcaacaacaggugcugguccuucaauuccuccuuuuuugagacaggcccuguugauuuucuguugcccgcagcaaccuuccggaguuugccuagccucuugucuggagccccggauuccagcugcccacgucgcaucuccacaccuccagcuuuuauguggguuuugaggaucugaacucaggucaaggccgcguggcaaguguuuuuaccacugagccaccucacaagccucacuuucucuuuuuaagcgccugccagcucgcacacucuagcacaucggcagugacgcaucuggugccugagacuguugguggugacagccucacuuuggagaccccaguccacacugugaggcaacucgccaggacugggagugagagacaggcacguaccaggcaccgcucucuaaaacgcucugacucaguaaaagaaagugugggugcucuucauagugcacagcaggaggggcuaggggacgcgguagcaaggagaacugguguagccaauaacugcaggcaccauggagaauacacacuuaagcuaauggcuacuuuuaccaugagguugucugggguagaccagagagcagcuggagaccagaggacccagcagugagcugccaugaaauugggaaauugggaaaagcccuguuguguugcugcacacacuacacaaggcucgggagggcaagcuccagccccacaccaaaaggcaaaaccguggaaggaagcuuaaucuccaaccuuuaauauuuuccaaacgguaauagagugaaaucaacuuaugagucugagcuaucauauuuuucaaugaaucaaaaguguucacguuuuaaaaaauaauaugcaugugcugagcaacggugugaauccuguuacuaguggguucaaaaaaucugaacaccacugggcuugaauucagcacccucggguuauuuauuuggacagggucacauguagcacaggcuaaccuugaacuugauauggagcagagaaugaccuucaacuucucccuccuccaccccccccccaggugcugggauugcaguaagugcuggcauuacaucugccuuacaaaguacaaaaaacagaaccuagggcucuguauguucuagauaagaacucuaguaauuguguuacuacaauuacuacaacuacaacagucacuacaaccccagcccgaccccccucccacuccauuuuagacgacaaggagagaagcugaacaccuuguccaacucaaguuaaugaccaagcugagaagugcguccaagucuuuaaugguucuucucaauaauuuccucacuaaaccagacucucaaaaugcaaauaccucugggagaaaggcagggacugcaauccacgcuggaguaaguaagugaucaaguaggcucaucguuuagaccuacugccuggagccaguuugguaaagaaaaugguagacugggcgugucaggggugaggggaguugcacagaacagaguaaaaacaagaucaguuugaagggaccucccggaaggugcuguggagcaccgcagaggacagggcgugaagaaagauaccggugucacugggacacgugguucuauacuaggaggcaguuuccaggucuggaauuggacguguugaggccauggguguuuugcucacauggcuucaaccaauucuaucacugaaauguucugaauaacuaccuccgguccagucaggagcccucucuuuaacucaguauuuguuguauaauuauaugccaauguaauauaagacucaagucaggggcuggagagauggcucagagguuaagagcacggacugcucuuccagagguccugaguucaauucccagcaaccacaugguggcucacaaccaucuguaaugggggucugaugcccucuucuggugugucugaagacagugacaguguacucauauacauaaaauaaaaauaaauauaucuaaaaaauuuuuaaaaaucaauauguuuaaaaaaaaaacucaagucugguucauguuuuucuucuuaccugucuaugggaagcaggugcugagcaccgauggagaguaggucccaagagacacagccuaaaaggggaugcuccaaggaaaacacccuuuuagacaccguagcaaugagcugcuucucucaggucagaauucaggccagaaugcuaggccaaguucauuccaucagacccccaccacagccacucagcaacaagcccugggcuccgacauagaagggagagaggagaggagagcagacagcuggcagacagcuccugccuggcucuucagaguggugaguuaguacugagucaggcaccucucccacagugcugcacggaugaugccuaacugcaccagucccaaguaagucaccuugagaggccgcuaauguggccccagcccagggaggggacagggucugacacugcugccgggaacuucacguuccacacacuucugcuuaguggcccaagcauuaagaggcaauuagacaaagguuuugaacccaaagccauuucugcuuugcuaugugcugucuuccccccccccccccagcagcaggccugggacggaggugccagggugaccuggggacuguggugauauguccugacccucacuagucacuagguauacagcaagcagcuuugcaaacuucaguagcccuggacuuaaauuuccuccucucuaccucugagacagagaggacugcuccauagggagccaggaaugagaacaacuucucaugaaggccugugaacgggagcccauuucuaugaggaucaaaaguuguuuaaucgcauauucagaaggucuuggaaaauucacagugcaccaucaaauguaggacuugccacauuccuaaaagaacaaagcacaggaccccagggaccuccccugccugcuaaacaaagagaacuaacuuuccagguaguaaacuucaagaagcaaaauugagaacauaacacaggugcuuuuauaacaaaaggauacacaucucccucuuaauucuuuuauugaucaaguucaaaauaaguacaauuuuuuuucucauuaauacaacuuuguuaacucgacgagcgagauuuguagggaggaggaucauucaaagguucgcucccagauucccaaaucucuuagugguuagacauacaaacuguuuucaacucagcagcauaaagagcgaaccauggugaccugguacuaagcccacacccaggggguggagcccagacauuugcauuuuaccgguucccuggaugaucugguaauauaggucauguaugggccuuggucaacuacagaaccugcauucucuccuguccacagacuaccuugggaggcugacucugaguccuaagugauccauccacagaacagagagguuggcuaucuuuaaggaacuucaggcaggguuaggugaguggcucuaggcaguauuacuagcauggcuacaucccaacacugagguccugucuauucuauccugagauuguuuuuucuuucuacagaaaggcuaaugaaaaaacuacuuauauaagacaccuaaauaaccacuaagaauggcuccugcuugucuucucauuaccggaaacaucuaacagugcauacugaauauuccaaaccagggucaggcucccccuuaaaaugccuacccacuccacuugucuguuucaccuaacgcuccaccaggaagcuaugcuuuguuucugugcccucaacaccaacaaacccaaacccacccucuugcuaauagguggccucacuccaaaacuggaggagaaaaaguccuuucccguggugcuucagggcaguacagaggcugagucuaacggaguuagaaucccaguucuguaccgaccggcggugaucuggagcucugacucaauuuccuugcauuuaguauaagaauaacaacaguacuuaacauagugcccuugugaggcuaaauuaacugaugucuguaauccacuuagcaacaugccagacacaguaaggaguuaugugagcaucugcuauuauugcuggaguuguuauuuuaaaccuccaaggggcccuaaauuauuccuccccacuccccaguaucugcgacuauaucaagcaccugcgaagggccaacucaagccaauagugacuuauugauaaaaacagaacuguccagucuuacaggacacauguacaaaacguuggauguagacuaagguaaucugucccagaccacagguuggcaggauccuaccuccuuguagcuggugaacucaagccagggucuguguggcuucagaagccagccucaccauggaaccuucagaucaaaaacaagccucagcagcugccagucacaagagucaacugaucaccccauaccaaggccacauucaguucucugcccccaauccccgcuuggcuugcauaaauuggagcaaaccgccaggccacucuccugaacccaauuaggcaguaagucaaccuggacggaaaaaaaaaaaugcaacgcauuccagaggucaaaguagacucccggcuccgauagcagccuuugcccgacacuuccauggaaguuagucucuacaugcagacaccagccuacagccugcgaugugccuagcacacgcuugagucccacaucggggccugcauuaggaacaaacugcccgagucugaaggcaauacaaaaggacaguuuacuuuuuuuuuuaaagaaaaauccuauuucucuuucgguuuaagguagcguuuacuauguaguuaccuaccuuccccgccaaaacaaaaauggggggcggggugggaggcgcggggugaggaacuggauaaagagcgagagagcucccucagccugcagagugcugcgacacccaccugaaacucgaccaaccuuucuagagagcccagccccggagggcguuuccccagcgcauccaacaacucgucccucccggguagaaggcugacgcccucggcauuacagagggccaccagauuaaagagccugagccccucccgcccucuaguuucacccccacccccauacaccacccaaucauuuccgcugaaggcgcaaacaccagcgcaaucguuucgccuucaaggccaccuuucacuacgugccgagcgcagcaggagccacggcggaaagccgaacgggggggggggggcagggaguuggggcgggggccgcuggauaagauagaccgucaccuuuucggggcuacuacagcuucgggauccuuggacccugggugggagccccuauaaggccgaaugcgaaaauggggugggggugucccaggggccagcuccuccagcagccaccucgcuagagggcggccgucggggcgauggcgcaagcuucucaccacccccaccccccaagcgcgacaacagccacggugacaaaauggcagcucggcgcccgacuggcgagccaccggcacacagccggggacugcugccccugcacccuaagaaugccagggcacccuggggauaggucucccaauggccuaguagugcaaauggcgagagcagacgggccuguagauccuaggaggucgaggguccccggcacgccgcgcccucuccagaccagauccucaggcccgcgccgagguucgacugugccugugugcucucaggcccccaccgcugggcgccacgguccccgcggagcccgguccgcggccgccgugggggaggggugggccuccggcgccccgggaaacauggcugcucguccuaguacggcggcgucgcggccaccaguccccgagaugcgacuugggagagagguugcagaaggugggugcgugggggggacucuggggagggagguuccccggaacgaucuguuuuccaaaaacguuuauuugaaaaaagcaaaaacccagcaaaacaacaacaaaaagccaguuccuccucccccaccccuuuugucccucuuucgagagcuuucugcccuccccucccccaugcgcagcaagugcccccucccccgccacccgcgcgccccaccccgccauaagcccggaggccggcgagugggcagcagacucacggcgagggggcgaagcgugagaaaucgcgcccagcccagagcgcccgccccucccccagcgcacacacucggggaaguuuaaagagccgguucgacccgcuuuccguuucgcuccgggucagcuaguacuguggaccgcucggucggguccggcgcugcugcgcaccuacucgccgggacccugaagccccccaacuacauauaggggucuuccgggaaaguacgcgggaagucgcguucggcccccuccccccagcaccacacccagucccuuccaccccccgggaucgggcacccuggcugggucgggacgccaccgggcgaaccaggcagcccccgcggcaaguccuggugcuaggggugcccccuccuuccgcccugcgcgccauaaggcuguagcacgucuccagugcacagcugcgugaggaugggcggucggcagaaaggagcuuguuuucaaaagucuuacucagguuuagaaggaggaauuaggagaaaagaggaaaugaggccugccuuugucaggauucgaggggucaaguggcuggaggggcgacaggucagcacaacgugcuacgcgagcccccaacucgcccgagccccagacccucaggcuagacccgagaucuuucccgcccgcgagcuccugcucccuacuaccgagccuagaggggaaguuggcuaggguuuccaccgcagacccuaaggucucucgaaugggucaacucgcagacaacacgagugcgugaaagcgagagggagacaaaaauaaacaguagcuuucgagucacccaccaacccucacuuccccuugcagugggcucgcgcccagccucccuguucccaccgguguaaguuuccuccugccauacucccgccgcugcccaauccauaacggcuacggccagacgaacugcccaucccagagcugcgugccugccgugcccgcaagaauguagacugggucgguccccacagcggcacuagcucugggcagcucggguucugauaaaguuucucgugcccauuuauuaaccaagcgccgaauggcugccagggagcccaccccaggagaagcaaggaccgggaagguggggugucugcugccgaugaggcgucagggugccaaggcuggcaucuggggagggagccgggggccagaacgggacgcagccuccgggcaacuuacauuagcgacgcucgugguuggggaggcgcgaggauuaucugagcauuugcacacuucacaaucccucccccuuaaccuaagguacccccccucccuuuccgcgaggaagaagggagaaaagacagcaucuggcccaaaggugggguggaaagagugagagagaaaggagaaggaaggcagacagagaaagggagggagggagagaaagggcgcguucacgaacacgacaaaguuacaaauauggcuccccaccucucgccucauccccgcagagaaacgaagacgcgcuuuaaacucgagccaucucccaacuccgcagcagucggguccccacgcgcucuccccgggguccucgggcuacauugaucagaaacuauaccggacucgcgaagcccaaaacuuauugugugcgagcgagcgaaagagacugcaaagggagggggcaggcgcgggagggggcggaaaggggguuacgcuucuaaaauauaacaaccccuuuuuguuguuuaauccaggaggcagcccaucuucuccuccccucgaucaucuuuuccauccagaugcaagucgugggagcugagagcucggacgagggugaaauugccgccuucccuccgacccgaacgcgugcgccccgccggccccccgcugggugcacacucgcacgcacacccucgcacccauacccgcacacgcgggagcacacgcacagguagucagucacacaccaagggcagcagcgacggcggacgaaacaugcuccgguggcauugcaaccccccccacccccgccauccaaccuugcaauucauuugcagucagaccccaaaccccacaccuuccccggagccccccuccauaaaaaagugccuuccccccaaaacacacacgcacacauaacacaaaguaggagaauggaccgacagagauauuuuuggcaaaugcucacaucagagggcguccuguuccgcagcucuaaauaaauccguuuguccaucuccaucucucgcgcucucucuuucugcagaggauccugcgccagcggaauucaaucaauaaaccccgaacccacggccgcgcguuuuaggacuuugaaggcucaaccagcuccgcucgguucucgagcccccagcacccgcggcgcacacuaaccugaucgccg

SEQ ID NO: 12441 - RNA, 94049 nt, Mus musculus
agagcggcuuccgggaggagaauuuuggaccucgcggggcuccgucgacgcuccgcccucuccaccggaggcggcuguggagaagcccggcgccggcggcggcuguuuugagagccgcucggugucaccaugggcgaccacgggcuggagcuggcguccaugauccccgcccugcgggaguuggccagguagggccgcgcgucgucgccagcuucgagucgccgggucuccucggcccgcgccgcggccuguggccgccguucccucccucacaguggcaguuggccggagcgccguggcgacccacgugccggggugaccguggcagccgcggcucggcucgcggggagccaguccacgcgagcugcuucccgcuuggccucgagaagggucucuucuggccaucuuaccacacucguuugcuucccgaaaacuucccccggguccugguccuuuggucguuguugacggaauccauuggcugagguuuuguuugggaaucacggccccgcuucugagggaagcgcggcgguuucuccuccgagagaggccgagcgucggccagcccgcuacucuagucggaaguccccgggacuggccacggguccacggaguccaacgugcacagcgucccccaaacuaaaacacgcguugguguucaucugcaguugccucuuugaggcucgccgccuucaaucccagaauuuggguggcagaggugccccuaggccagccaggacuaaauagugagaccuugccucuggaaagacaaagacaagagaaaaaaggggguggggggaagcaaaccccuuguuucugucaaccucgagagucaaaggagaaccggguuccaaucagaaauuagcgcuugccacgccccuucugcgcucuagguuuuccucugucaggacaccgcagccauugaguucucaagucgguucucucaggcuggaaaguuugcacguagaguuagugcugaccuuaagucugugagcuaucaguuuccuuuuaguuuugcaccgcagcgauguucauuuccuccuguuggccauaccaaaaaccgaaaaccuaaauuagaggauaaaugaaaagaccacuuuuguacugucugaaggguuuuuuuguuuguauguuuguuuuuuuacuuugcaugaauguggcaaauagacuuugugggagcaaaaaaaaaaaucauuaaaaauuugaauuuaguaauuucugucuaaaaguauaugagauaaagugauuuuggaaaacugauaauacaaauuuugucaucacugaaauucuggaaggcagggaccaacaccugagguuguucccuguccuuaacucauguaccguggcacaagaaccuauauucauauguacauacauacauauauaucucacaugcgcauacagacuuuuuaaaaugauuaaaauuuuaaguuuaacagcuauuaauauauuaaaaacuuacauaauucaacaauaaaaaaguuugaugaaaaaaaugaauaaggaaauugagauuuuucuccagagagaauauaaaauagcuaauaaguaaaggaaaacacagauguuugauaugauuaaaaguaagggagacaaauccaaaccacacaaggaaguuggugagaugacuugggaggccaagacaagaggcucacugaguuugaggacagcuugagcuaucaagguauuaaaaggggcucuauagugagaacuuaacccuccucaaaaacaaaacaaggagauuccauuucagaccauuacaauaacuauugauauguaaaagaaaugguaaggauauggggaaauuggacccugugguacauuguuaguauagaaguaaaauaguguaacuuaacgguugugaaguggaaugaaggugcuacuaaaggaggaggguaaauagaguaguuaccucauaacaugacaauucuuuauaauauauacccaaaagaauuuauaacagggauuugaacauauauguuuacacuuuugcucaucaaagcauugauauucacaauagcucagugguggaagcaaaugcucaacagaugaguaaauauaauccucccaaacguggcauaaacaugguauuauucaguaugaugaggaaagacauucuaauaugcuacaacaaagcuagugaguuucaaccuguagguaaaccccucuuuccaaaaauauauacauuaugauucauaacuagcaaaauuauaaugaugaaguaguaaugagaauaauuuuauaguugagucaccaagaauugaggaacugcauuaaaguucacauauuaggaagguugagaaccacugaauuaagaaauaagucacaggggcuggagagauggcucagcaguuaagagcacugauugcucuucagaaggucaugaguucaaaucccagcaaccacaugguggcucauaaccauccguaaugagaucuaaugcccucuucuggugugucugaagauggcuacaguguacuuagauauaauaauaaauaaaucuuaaaaaaaaagucacaaacagguaaauauaccauaaauagaagaaaccuuaaaauagucaagcucaugaagauaaaauaguggaaugaauauugccagggaauaaaagaggagaaaugguaaauuauugcuuauuagguguagaguugcugcuugggaagguuaaaaaguucuuuacaugagugguaguaaugugcugaacuuaauucuauagaaguauauacacuuuaaaauaaugaaauaguaaacauuauguaauuuauauuuuaucaaaauaaaaucaaaagauguuuucuaaaauugaucugauccuagccaguguuccuuuugugaaauuccaaccuuuguggcauuuagaauaaaccucaguuuuucugugucuccuuacggcucuucuagcuagccuagguaucucucuggucuuauuaaucacaauugcauuuauaucccaggcuuccauuaaucugagcugugugaucuccagugauuuaacuuccagagcauccucagauccaaauuaggcuuaguaucuuaccuuguuuuauaggguuuguguuagcucauuauauccaaauauuaucacacucauauguaacucauauaagacgauuaaugcaacauuaauucuuuuguccaaguaugaguaauccaauauguaucuuauauacaucuuaauuuggaauaaccuucuuuucaaguauuaaauagucauauguggcuaauggcugccauuuugagcugcacauuucuaaaauaugaagguuagcugucugcacuggcauuuaagacuuuccccgccccaaauuaguaauaucuuuagauuuucacuuuuaagaaguauaauacugucuauguuaacauuuaaaccaaucauauuuguuagguucaaguuuagagagcuuuuguacaaauugaaaaguagguccuuuuaaagaugaaaugcucuuugcuggauuaguuuguagagacagaaucucucuaaauagcuuaugcuggccuagaaucacuggccuucugccucagcuuccaauuauagguaugugccaccauaccucuaauaaaacauuuuuacauuaauuuauuuauugggagggagggucacacacaucacaguccauguggaggaugacucaugggaguuacuucuccccucccacuauauccauccggggauggaacuaaggccaggcuuggcagccugccuuuaccugcuaagccaucuugcuugcucccauagugccucuuuuaacaagcuuuacuuuguauuucagugcuacuccagaagaauauaacacuguuguacagaaaccaagacagauucucugccaguucauugacagaauacuuacagauguaaauguugguaagagggaauuauuucuuccaugaacuucaaugguuuuccguguaacauuguacuaccuguuuuuccucuaggcaguuuuagucagaguuaguuuuuguuauagauaguaauuuccagcaaauuguuacucaguauugcuuauuacuuaaaacauaauguaauuuaggcuuuaaaaucaaggguguguuucuauuauuccaugauuuuucuacuggcuuccuagaauucuuuaaugcauuaguuauaaaacauuugacuggguccaaucauaugggcuuuaucaacaacuugcaaaaaaaaaaaaaaaaaaaagugaaauuugguaccaacacauuuugugauuuauuauaaccacuuaaacuuuguucuuuucagucuacaaagucauagguugcuaaaaugagagcaaagggcuaugaacacuuguaagauaugguucccucugggucucccucuguucucaccacuugccuuuucccucagccauaggaacuccuucaugggaucuuuccagaauuguuucauuuuauccugaauuaccaagucaaacuacuauuuuuaauucuuugacuccuucaccagauuauuguuuuuguuuuguuuuaucuuaagcauggugccugucaucuuacaggccuauauaacaaauguuugcagaaugggcuauauuauagaugaauguauaugguuauuagacauugaaaauuaagugguaggcuggaaagaugacucagacauuaaucuugcugccuuuaaauucccaccacaaucuuaaaaagcagcugcagcaaugcacaccugugauugcugcaauucucacaguagaucuguggagcuuccugguccagccagucagcagggcaugguggcccacgccuuuaaucccagcacuugggaggcagaggcaggcagauuucugaguucgaggccagccuggucuacaaagugaguucuaggacagccagggcuauacaaagaaaaaaaaaaaaaccugguccagccagucuagcuaaguuggugaaguguagguucagugagaucucuugucucaaaaaauaagguagagaaugauugaagcagacacccaacauugaccucugacugucacauucaucacacacacacacacacacacacacacacgaacauguacauagacauauaccauacacauacacauacuagauaauaggacuucuucauguaucaguguagcaugaguacuccacuggacaaaguuuugauuaccaaaauuuaguuucuuaacaaaagcucuauauuuugucaugaguuuuuaaaaagaaucuuuuaucucuuaguugcucuagaacuuguaaagaaaacugacgcucagccgaccucugugauguuacuugauuuuauccagcacaucaugaagucuucuccgcuuauguuuguaaaugugaauggaagccagggccaaaaugaggccaaagacaguuguauugguaagugcuguuauuuuauguuaauccuuaaccaguuuuauuagaucuccuuugcugcuuuucugaauaucacauuuauauaauuacaugcucccacaagucauauuugcuuuuggggaaaagugguagcaguuuuguuuuugaggcagggucucguauguaccuuuggcuggcauagaaugcauuuguagacuaggcuagccuggaacucagagauuggccugccuccugagugcugggauuagacauaugccagcaugcccagcuucagcuacuuuuuuuuuuuucauuuugacaguuuuacuagaacaucaucucaaauuacuacaaagguuuuuuuuuuuuuuuuuagacauucuacucaaaaauacuuauaccagguguagucaugcaugcauuuaaucccagugcucaguaguagaggcaggaggaucuuugaguuggaggccaccuguucuacagagcaaguuccaagucagccagggcuacacagaggaaacacuuucuuuaaaaaccaaaaccacaucccuaacaagaucugacucccucuucuggugugucugaagacagcuauaguguacuuacauauaauaauaaauaaaucuuaaaaaaaaaaaaaaaaaaccaaaaccaaacaaaacaaaacuuaacuacauugccuucuaagaaaaauuugcuuucuguauguuaaagcauuuuucuagacuuuuacuguauuguuacuaccccauuaaucugccugcuccucacuuucugauucucucauaaaaggaugcagaacaaacuuuuuccuauauaaugaaauauuuuaaaauuuguuaauaguaucugcuuugauaauauagccuucaaaaaguguuuucugggggauggagagaugccuuagugguuaagagcacuaacugcucuuccagagguccugaauucaauuccuagcaaccacgugguggcucacaaccaucuguaaugggauucaaugcucucuucuggugugucugacgacagcuauaauguacccauauacauaaaauaaauaauucuuuaaaaaaaaguuuucugacucauccuggccaccuaggacuuguuuucuuuuuuuugcugcugaauuauauguucuuauuauugauguucuguauuucuucugucauaaguucuuaaauuauacuauaaucacauuuucaguuucuguuauauuuucuaaaguauggacaacaacucacaguggguuaugaacuaacuuuaaagcuaguaacauuucaaacaaacugagcugggcaugguggcacacaccuuuaaucccggcacuugggaggcagagucaggcagaacacugugaguucaaagcaagcccagucuacauaaugaauuccaggauagccagagcuauguagagagacucugucuuaaaagaauaaaugaacgaaugaaugacaugucuauauggauaggggauugcauuuaguaccuuacauguaguagguaaguaaucuuaacacaaaaucacaccucccacucuacauucaguaauuuucauugaaggaagcuggcuguuguggcuaauaaucccuagcacuugagaagugagaauagaaggauuauuaaaaguuuaaagucauccaugaccacauagcaauuuuaagaccagucugggcuacaugagauauugucucaaaaaagaaaaauaaguuuuuuuuuuuuuuugaagggguaauaguaacuucuguuuguugaauauuuguuauguuuuaggaacuauacugauuaucuuacauuuguuauauuacuugaccauuacaauagccaguaacauagauaauauuauauagcuucagagaugugaaguugacauaacuaguagauaguaaacuaaaacuauuuuuaacuccaaaguugauauucugaaguacaggcuuucuaucaugucgaaauguagauagacuguucucuuagugaaauuuuuacuuuaaaaaucaaucaccaaacauuuggcaaagucacacuuauuuauuuaauauauuuucuguuuguuucaaagaauucagucauuggaucauuacaagacuuuuacggauugcagcaacuccauccugccacaugcuacacaagaaaauaugugaaguuaucugcucguuauuauuucuuuuuaaaagcaagaauccugcuauuuuugggguacucacaagagaauuacuuuaucuuuuugaagacuuaauuuaccuccacaaaagaaaugcagugggugagguuauggaauggccagugguuguuagucgguuuuuaagccgauuggaugaacauaugggauguuuacagccagcuccuuugcaguucaugaacgugcaaaauguagaauuuauugaagucacucuauuaaugguucuuauucauauuguuccaaccguguuuuuuagacgacaagaauuguuacuguggcaaaucggcugcgcucugcuagagcacgguagucccaaaaucaggucuuuagcaauuagccuucuaacugagcucuuugagcuuggaggguuaccagcacagccagccagcacuuuuuucagcuuauuuuuggaguugcuacaacaccuuguuggaauggaugcugaccaauugaaauuguaugaagagccauugucaaagcugcuaaaaacgcucuuucccuuugaagcagaggcuuauagaaauauugaaccugucuacuuaaaugugcuacuggaaaaacucagugucauguuugaagaucgcgugcuuaugcggcucaagucugauuugcugaaggcugcuuugugucauuuacugcaguauuuccuuacauuugugccagcuggguaugaaucggcuuuacaggucaggaagguuuaugugacaaauauuuguagagcucuuguagacgcucuuggaguucagaaacauguugggguaaguaauuauugagaugacacauuaaguguuuuguucauuuaagugugugcauauguauaggauguauuaacaagaagagagaacaucuuacaauaauggcaugucaagggcaugaucauuuucauaguuuaguuucauuuucagacuuuguacuuccaguccagaaaaauuuguucauuaaguagugacuaccuagugaaguagaauagauuauuuuaaaguagaauuuauaaaauauguguuuauaagcagcauuaauugaaaggagacuaguuaaguggaaaaagcuuaaucacuuuuaucugugaauuucacuuuaggauguguaauuagugacauuaguuuauaccauuuuuccuguuuggacuguggggaaagacaugcaauaauaaaacacuccaauguguggcaacuugauucaguacuuuaaacauuaaacauuuuagcuuauuuuagucuauaaaucuuguugaauuuguaguaugaaauaaugauucccuuauaaagauuucugcauaacauuuugagaaaagggggaggguuuauaguauguauuuguuguaaaccuuuuuaaagcuguagaaccauccugaauagaguguaaaauaauauugauugauguggguauuugguuugucuuaaaagacucauguaacaccucaugcauuuucuguucauaaauaauguaaacaguuccuaagaggugguauuuaaaauuauuuuugucuucucaguauuuguugggaccauuuuaugcagccuugaaaauggaaaguaaggaaauuauugaaagaauucaaugccaagcucaacaggagaaucucagugguaauaaugaugaggugucaccaaagaggcguaaacucagcuccucucucagcucuuacaaaaagccauccagacagccugaagaguaugaccucaucugauuuuauuguagacaguucauaaaauuuuaucuuaaaaaauaaaguuucauuaacuauucugauuuaagaacauaaggaacaucuuuugcuagucauuaugauguacucuaguaugacacuauagauguagauguaguugcuuugaauguuuuugcaugccuguuuaauuuggguuuuuaauauuuggaaagugucaaccuguaugucuauuacaaguucaaaucuuaauuaauauauuauuuuuguauguagucaaagaauugccauaguucagccaaacugaacaguuuuaaaucuaucccaauguagauaaaaaguugauaguauauugcaauuuuuguuuuauuuuacuacuauaauuacuggugugugugugucugucuauaugucuauauugucuacauguguguaugcaucacaacaaauguguagagaugaguggcaguggguucucucuuuucaucaucugggucugcagugaccaaacucagguucucaggcuucacagcaagugccuuuauuugcuaagcugucuuucugacuuuuuuuguuuuaaauauuggcauuuacuuaaaauuuugugccggacuuuaagccuagggccuauguauguuaaauaaacacuauuuaugagcuguaccccaauucuauauuuugcuugaaacacauuuguaucauauauuaauaccuucugcuguaauuauacuuacuuauagaauuauucauguggauauggacaaaaagagcauauuauggaauguucugaaacagaaagccgaaucccuucagaucucucucgaaugugguacucucaagaauucuguugcugaggcauuagaaggaaucacuguuguauuacagcugacugcucucugcacuguucacuguucucaucaagacauggauggguaaaaaaaauucaaagauuuaauuuuuuuuuauuacguguguaugauguuuguugguguauguuacaggauauuugaucacacugcgaauccaagauuguguuauucacugagaaaauucuguuucuaguugugguauggcccaguccuuagcacaaaccuuuaaucccucuggcuggaauacagucaugcccuuaguacauaccuuuaaccccaaacagugaagguaaaguuaguuuguagaaggacgcacccauguuugaaagugaugucuaauugaguggcagcaaagugacaaaucugagaaagacuugacagaauaggauauguccagcucucaccacaagagaggggaaagcuacuuaagaaagcaauacagagagcaagcgagggagagagggagaaggugaggagacaaauugcagagaaaacaagguagacagagcaggugaugacagaagaagccagggaauaaaaaggagccagaagauuagaauagauugccaaaguuaguaugaggccaaguagagcaagugaguaagaaacugagagaagccagauugaaucagugagcuuggagaggaguuugaaucaggacagcucaguugaaucagccagccagagugcaggaaaaaaaaaaaaagaaaagaugagcuuauucaguaguaagucuaagaggcugaaaacauccuaagccuugauaagacuguauggaggcuaccagcuuccaggacuaggucuagguuagcagauggaggcagucagccucagaagaauaaaagauacuuuuagugcaugcauaccacggaaugcauguggagcucaggacaacuuucuggagucaguccucuccugcuuuuacauggguuccagagaugaaagucaagucaucgagcuuucaagacaaguacuuuacccacugaaucaucgcauuggcccaucuccucuaaugaauuuguauuuacucaguugauuucugugaccuuaggaaacaaacuuuguagugaaguaaggaaggcauuuucuuuuauuuaccugcuaaaggggagguacugugcuuacuuaaccuuugucaauccuagagguaaauucugguaaacuuuauuuaccaacgaaauguucaaguucagaaaagguagauucuuuuuuuucucuuaagccuaaauaacuuuucccaaggacauaugauaugaagauagcagaacauacuuauguguaauucacaaacccaugguucuuuuggcuauaauucuuaaaauagagcaggaauuuagaauucagaagagguagauuuucuauucauauaaauuuaauauaaauuuucuaccaaaagaaacaagugaagacuuacuuuucuaccauaacuuaggacagauugugaugauucuguacuuccugaccaauucucagaguuauuuaaaagaagagauuuuaggaaauuuuauuaauuuagcugcuacuaaauuuagaauuugaaauaaauucacagauaaaaaucucaaugauuacguuuucuccaaguaagauaacuaguccucuuucaauuaaugcugcuaaaaauacauauuauauaaauucuacuuuaaaacaauccauucuacuucaccaggcaguuuacuacuuaaugaacaaagauuucuggacuggaaguaaaaagucugaaaaugaaacuaugaaaauuaucauguccuugacaugccauuauugugagauguucacuuuucuuguuagaauagauuaacaaagaagagauuauuaggugcuugaacuuuuaugaagaguguuugccacaucaguuaauaauuauacuggcaugucuucuaucauuauuuaagccugguaauuaaacauucaaggauccuagaucaauuccccacaucacaagagugauuuuuuuuuaagaggcugagacaggaggauugccucuagaucaauguuucugcccucccuccauccccuccugcccccaaauauacgcacauaccacacacuauuauagaaaaaagcagugacuuagagcaacauaaaggcaauacacuuaagcauagguuguuuugcauauugacuuuaaauugacuuaagguuauaguagguuaguucuguacuuaauuuucccuuggcuuuauuaaaauauuguuagacuauaacagaauucuuaacucuaaugucuuuuuuuuauaaauguacucauugcagccauaaugucaaggaucaucaacacaaauauaagaagaaaccuccaguaguaguaacuuggaugucuuuggauuuuuauacaaaagugcuuaaaagcuguaggaguuuguuagaaucuguucagaaacuugaacuggaauuagucauugauagcauggugagaauuugugaugcucugauguauaugcaaggugaguacaacuaagugauagacguuagucauuguagaugaaggcuuucuguuucuguuucaaguuuaaaugcagaaguacuguuaauauucagaauauuuucaauuuuucuguuaauuaagcuuacugguaguuucugaguuucacauuuacuuguauagcauuuugauuuggucaauagacauucauuugaaacauuuaaauguuuugguuugagaaucugaagaacacuaugauccauauagaugguauauauaaaugcauaugguuuuaagccacaucugauuucacuggccucacagacuucagcaugggccuggaaguauagcucagugguagaauacauguuaaaugugugcaagguuugucacagaucacucccaguuaaaacagaagauuguuucuugcccuuuguuuuaagaauccuuguuaauuaauauuguuuuaauuucauauguuuuggauaucuacauucuuauuggcaaaguaaaaugacgaauaugauaaaggaauaaguuaauuuaugugcuuuugucuaucucuguaguaaaaaguucauucaaggaucauguucuggaagaguuauguggaaugcucucacuuccauggauuuauuccuauucugaugauaacucuuuaaagaugaccacauuugcuacuaaccuucugccauuaagccagaggguuugggauaguuacuguaaguagucacaaaauugucugauguauauagcuuauuuuguuguguuuaauuaaucucuguauagaauuuauaauacuuuaucacacaauuuuucaauaguuaaaaggagaaugcuuaaaagaaugcagaaaggaguuugguauauuagcaguauacuugcccuauaccucaaaauaauaaacaaacauuuuuaaagaacucuuguuucauaaaguuaauucuguuuagcuccacaggcacagucaaaauguguguuucuucugacacuguuuccaagaagaauauuccuugaauggagaacagcaguuuauaauugggcccuaaagagcucccaugaaguaauccgggcuaguuguguuaaaggauuuuuuaucuuauugcaucagcagaauucuuguaaccaaauucccaagaugcuuguguauguauuaagacuuugauuugaauauauuguuugauuguauaaaucauuagucugagugucuaaguuauuauugcagaauacauacagcaaauauugcuuguagcuugaaaauuaaauuuuucuauucuaaauuuuauuuuuccccuuugucucaaaucuagaaaguguaauccaaaauauuuacugguaagauuuaguacuuucucucucuuuuuuuuuuuuuuuuuccuccagagauagagucaaagaugauucugacauggucaagaaagaauuugcuucuguccuuggucaacuugucuguacucuucacggcauguuuuauuugaguuccucaguagagccuugcuuugaacauauggacuuguucaguaagaaccugaaagccacuucucagcaugaauguucaucuucucaaguaaaagcuuccacuugcaagccauuccuuuuccugcugaccaaaaauacaccuaguccaguaaaacuuggugaguaauuacuugggaauuaaaaaacacuuucuagugauacuguaguaugaguuuguuggaggguggagauuuacacauacaccagggagacccauguguuuagauaguaacuuguuguuuauugacaagcuuucagauaguugauaagugguucuaugaaccaaguucuauaaaaucaacaauaagacuaagaucccucucaguugagaguuuuugaauuaaaguuaauuuugagucuaauagguaauaaucuacaaaaucuaaaaaugaucuuuugauaacuuagauccuagaauuuauuuuaaauuaaaucacuuauagcuuuuacuaaguaugaaguaauuuuuauuggcuauuuuauuuauuuacauuucaaauguuauccucuuucccugucccccccacaaccucagaaacccccauccuauccucccucccccugcuucuuugaggguguucuuccaccuacccacucacucccaccuccccgcccucaguuccccuacauuggggcaucuaucgagccuucauaggaccaaggaccucucuucccauugaugccuggcaacugcuacaugugcagcuggauccauguguacucuugguuuguggcuuagucccugggagcucuggggguucugguggguugauauuguuguucuuccuaugggguugcaauccccuucaacuccuuugguccuuucucuaacuccucuguuggggaccccgugcucgguccaaugguuggcugagagcaucugucuuuguaguuguaaggcucuggcagggccucucaggagacagccauaucaggcuccuuucagcauguacuucuuggcaucugcaauaguaucuggguuuguuaacuguauaugggaugaaccaccaaguggaagucucuggauggccuuuucuucagucucugcuuuacacuuuaucuccauauuuguuccugugaauauuuuguucuccuucuaagaaggauugaagcacccacacuuuggucuuccuucuucuugagcgucuuguugucugugaauuguaucuugguuauuuggagcuuuugggcuaauauccacuuagcagugaaugcauaccauguguguucuuuugcgauuggguuaccucacucaggaugauaucuucuaguucuauccacuugcuuaagaauucaugaauuuaucauuuuuaauaacuaaguaguacuccauugugcaaauguaccacacuuucuuuauucauuccucuguugaaggacaucuggguucuuuccagcuccuggcuauuauaaauaagacugcuaugagcauaguggagcaugcauucuuacuacauguuggagcaucuucuggguauaugcccaggagugguauagcugaguccucagguaguacuagguccaauuuucugaggaacugccaaacugauuuccagagugguuguacuagcuugcaaucccaccagcaauggaggaguguuccucuuucuccacaucaucgccaauaucugcuaucaccuaaguuuuugauuuuagccauucugacuguugugugguggaaucucaggguuguuuugauuuguguuucccugaugacuaaggaugucaaacauuucuuuaggugcuucucagccauuugauauuccucaguugaaaguucuuuguuuagcucuguaccccauuuuuuaacaggguuauuugauuuucuggagucuaacuucuucacuugaucuuagccaaaagaccaagaagcgauggagucucacuucuugaguuacuuauauauauauauauauauauugcauauuaacccucuauuggauguaggauucgcaaacauccuuucccaaucuguugguugccuuuuuguccuauugacagugcccuuugcuuuacagaagccuugcaauuuuaugaggucccauuugucuauuguugaucuuagaacauaagccauugguguucuguucaggaauuuuuccccugugcccaugugcucaaggcucguccccacuuucucaacuaaaguaauuuaagcugguaaguuugccagcugucguggcacaugcccuuuugauuccagcauucaggaggcagaggcagguggaucuucguguucaagaucaacuggucuacaaacagaauuccaggccagccagccagguuucuacagugagaccugucucaaaauaaacaaacaaccacagagccaaacaaauaaauuaauaaguucuauuuuaauuuccuuaaauuauaugugccauguauaucuaaauauucauauauaaggcaacguggaguuguuugcaguauuuuauuugcugacaguguuuuuaaguacaacuuuguuauaugaugugucaaacuagaaaauacuaucucacuuuagcuuucauagacaaucuacaucaucuuuguaagcaucuugauuuucaagaagaugaaagagagguaaaagcaguucuugggacuuuauuaaauuugauggaagauccagacaaggauguuagaauugcuuuuaguggaaauaucaaguauauauuggaauccuugaacucugaagauggauucguaaaagagguuagaaaucuuaaauuaaaaccuaugauuuuuauaaaccuaggucuagaacuguucugaccagugaacuuugcuuuucuagcuuuuugucuuaagaaugaaggaagcauauacucaugcccaaauagcaaggaauaaugagcuaaaggauacuuugauucuuacaacaggggauauuggaagguauguuugacaguauuugaauugaaacuugcuuauuuuugucccugucuuauuugccugauauuacagaugugagggcuggagauggaguccaguggcagaauacaugccgacugugcacugaaaaaaaaaaagagagagaagaauaaauugugauacaggauauauauuaugggaaaauaugauuuccauaucuuugugugucugcauuaguuucugagacacugacuuccccauguuuuuauuuucagggcagcaaaaggagauuugauaccuuucgcacucuugcauuuacugcauugcuugcugucuaagucugcauccgucucuggagcggcauacacagagauucgagcacuaguugcagcuaaaaguguuaaacugcagaauuuuuucagucaauauaagaaaccgaucugucaggugagagccagcuuucagccuuucaauagacaauagcaacauuuuacaggaguuaaaaaagaaguugaagccaggcaaaguaguguguguguugauagucuauguuacuucauuuggaaggcugagguaguguaugggcacuugaggccagaacuuugagaccagacugagcuuaaggaaaacaauauauacaugucuucuuauuuugcuuguuuuaaaagauuauuuucuaaauuauauuuauuuagaacuggauuuuugccauuuauauuuaaggauaauugucugaagauauggauuguaaaugaaaaggaauaucaucuuuuaauaauugguaaauuauuauauucuuguuaaguuuagggagucauuuuuuuagccuuuuuaguagugauauuguaaauaggacacuuuguuuucagaagcaaaucauuaaugucuagaaaguuaggccauauuaaaguauuguucuuucccugauuugugauauccuuagcaugauauuaaaguuucuuaacuaagauucguugcuuuucuguaaaauguagauuaugacauaauuuaccucauuaaagugaagugaaagaguccaacuauggcauuauagaacuuaaaacuauccuuuaugcuaacuuaaaaaguauucauuggugggcagggagugggguuaguuagaauuccuuccaucuuugaaaacuaagaaaaaucuuuugcuuuaguuuuugguagaaucucuccacuccagucagaugacagcacucccaagugcuccuugccagucuucugagauucgaaaacaagauguugcucaucacagagagauggcuuuaaauaccuuaucagaaauugccaauguuuuugacuuuccugaucuuaaucguuuccugacaguaaguugcucuguguguguguguguuugugugugugugguggacuuauuugaagguuucauuucaacauuucauuuguuucauucuauuuguuuauuuuuaaagaaaaccuuacaaguacugucuuagguaggguuuuacugccgugaacagacaccaugacaaaggcaacucuuacaaggacaacauuuaauuggaguuggcuuacagguucagagguucaguccauuaucaaggcagaaacauggcagcauccaggcaggcauggugcaggaagagcugagaguucuuugucuucaucugaaggcugcuagcagaauacuggcuuacaggcagcuagaaugagggucuuauagcccacacccacaaugacacacacagccacaccucccaauagugccacuuccagagccaagcauauacaaaccaucacaaguacauuuaggaccauaugaacccuagauuuuuaaaauuaugugcuuuggggcuggagagauggcucagcgguuaagagcacugacugcucuugcgaaggucaugaguucaaaucccagcaaccacaugguggcucacaaccaucuguaacaagaucugacguccucuucuagagugucugaagacagcuacaguguacuuacauauaauaaauaaacuuuuauuaaaagaaaaacaaaagauaaaauuacaugcuuuauguguguggugugugucuguauguauaggucagaagacaaccuuggcuauuguugcucaggcacugucuaucaaauuggagggugugguuaucagggacagaguccuaucacaaugcccuggagcuuuugccaaguaaguuugacugucuggacagcaagccuuuaacaucuuucuguuucugauuccauagcacuggaaauaaaggcuuaugucaccaugcccagcacuuccuugugcuuauauggcaugcucuuuaccaccugaacuaucucccuagccccuaaauuguauuuuuacuuugucagagauuauugcuuucacaguauaacuuagauauaucuuuauuauucuauauaucauguuuaaugauaccauauucugguuaacuuuuuugagucucuauguuuucaguaguguccuggguuccauuagucacugaaaaauuaauauuuacccuuaagaaguugaauuauaaaauauagaauuagugguaugaucugcuaugaauucgaaugucagacuuuguagcuugggauaguuuaggaagacuaugaaauucauuaggguuaaggcuuaaaggaugauagacauauuaucuuuuuuuuuuuuuuucccagaacugaagaccaaacccagggccuugcacuugcuaggcaaacgcucuaccacugagcuaaauccccagccccugcauauuaucuuuuuaucuuuuccccaaagucagguuuauuguuaaucuaaauaaauugugauaacaguucauauaguggcuuucucuauaguaguauuuuaacaaacuuaaauugcuuuuaaauugauuauauaaacaaagaaaauaggaugcaauauuauaagaaccacauauucauaccuuauuauuaauuucaucaaaacccacaauguuuauugcaacauuacccauuggcaaaauaaaaacucugagaagaaacuaaaugucuaaaauuaagauauauuacauaaccaucuuaagcuaagcauaacuaaaguuaaaaaggcauaagguaugucuaugaagggaaacuuauuuauuuguuauuuuguuuguuuucuuugccucucucccucccucccucccucccucccucucucucucucucucucuuucuuucuuucuuuuuuuuucuuuaagacagagucucauucuguagcacaggccagcgucaaauguguucucucuugccuuagucucuugagugacagaaucucacacuuguaagcaaggccuggaucuuguucauuguuacaccccagguuuagaauaaugacuuaacauguaguuguaaucauuaagacauguagaauaaauaaacagaauaacuauuuucccuuuggaguuuauaugaauuuaaugagcuagaccuuaaauaaaccaaaaaggaaaguagauuuguugcaguauugggauguuagaugugcuuaacuguuuuacuggcuguggaugucuguaucugucugagucagcugcuagguguagccucucagaggacaacuuacuccugucuacaacagagcaucauuaauagugucagggauuggugcuugcccaugggcugcgucucaaauugggcuaguuauugauagucucugcuccauccccugugccuguauuucuuguagacaggauaaauuugggguugaagguuuucugaguggguuaguauguuuaucauuccacugggguucuugccuguuuucuguaauuaugaagcaucaauucuaugaucuaaaaaauuauuuuaaguuugcauuaauggcuauucucuacauguuuauucaggcccugauucauaguaaugcuaucagucuaguauagucaagugaguaaaugacaaagcugaauacagguacaauuccauacagaacuuccuauagcauuaaagaauauuucuuguggaugacuuauuugaacaguuuaucacccagacaaauguacuuuuuugauaauuauugugguuuuuuuuuuuuucccccagaggacauuacaaguucugcuuccugaucuugcugccaaagcaaguccugcagcaucggcucucauucgaacuuuagggaaacaauuaaaugucagucgucgagagauuuuaauaaauaacuucaaauacaucuuuucccauuugguuuguucuuguuccaaagaugaauuagaacgugcucuucauuaucugaagguauuuggauauuuguauuuauuuuauucguuuauguuaacacuauuggaaaaacuauuguaacacuguaauauggaagggcagugaguaauuuauagcuuauacuauaagacuguguauaaauauuauuguguuaaauaaucauugucgggcuggugaaauggcucggcuguuaagaauauugguugcucuuccagagguccugaguuuaauuuccagugaccacaugguggcuuaagacuaucuguaaugggaucugaugccuucuucugguauguagacaaaugcagacagaccacuccuacauuuaaaaaauaaucauugucuugggaggauucuaaauaaauuaaaaaaaaguuauuuuuuuuuaauuuuuuuuauuuauuacguauuuuccucaaugacauuuccaaugcuaucccaaaagucccccauacccuccccccccaccuucccuacccacccauucucauuuuuuuggcccuggcuuuccccuguacuggggcauauaaaguuuguguguagaugggccucucuuuccagugauagcagacuaggccaucuuuugauacauauguagcuagagucaagagauccaggguacugguuaguucauaauguuguuccaccuauaggguugcagaucucuuuagcuccuuggguacuuucucuggcuccuccauugggggcccugugauccauccaauagcugacugugagcauccacuuauguguuugcuaggccccugccuagucucacaagagacagcuauaucuggauccuuucagcaaaaucuugcuaguguaugcaguggugucagcguuuggaagcugauuaugggguggaucccuagauaaggcagucucuagaugguccauccuuuugucgcagcuccaaacuuugucucuguaacuccuuccauggguguuuuguucccaauucuaagaaggggcacucuaaugggauagaauagucauccuuucaugaaccugagguuuuuuaauauaauuuuauuuuagugauuuuaugcugauuauaguuauaaauuaacugauauugugcaaguaauuauaaaaagagauugcucucuuuaaucguaugccuguauuuggcuuauuuacuugcugcucugauuauaauucuuccuacuuuaaaauauuaaaauuuuuauagggcuauagagauggcucggggcuaacaguacuuguuacaacagaagaccugcauucaguucccagcacccauauggcagaucauaucuuucuguaacugcagauuugggagaucuaaaacccucuucugaccucuauggcaccaagcaccuguaaacauauaccuaugcauaggcaaaacccucuuggguauaauaagaaaauaaaaagucuuaaaaguuuagugugugugggaaagagagacagagagagugcauggucuguugugcauguguggagaucagagaacaacuuugggacuuuauccucucauuauggauuuaggcuguuaaauuugcaugucuggcuaauuuuuaaguuuaaaauuauaguuuagauuucuugugguuuuacauuaacagcaaugccuuuuaggaauauaagacuaugggaacagaggaccuuaauuucauuuucucuaagagaacagcagaucucuucucacuugaggagaaaugacuauuaauuguuuucauucaucacgagcguuaaccuguguguuauagagacagaauaacaauauuuauggaguacauacuacaugucaaaaacuccguaugggucacuuaaguuacuuggcaagauaaagagaacacaguuugucuuuuauacaaaaugcuugagacuagauuucagauuuuuuuuucauuuuggaauauuugcauauauauauaaugagcuaucuugagaauaaaaccaaaguuuaaacacagaauucauuucuguuucacauacuucuuaaauguauagcccaaagcuaauuuuauacaguauuuucaaugugcccacauuuugacaacaacuuguauuuuaaagucaaguauggaaucuuuugcuucuaguaucaugauaguguucaaaagaauugguauuuguguuuuuaauuagaaauguucaagcaguguuuuguuugacagaugaugacacuuaaggcaauaagggguuagauuagguaacuuguccaaaucacaggacagccuguaagugacagcuagaguuuaaacuccagcauucugaccgaaaccaugcugugaacuacuguucuuacucccagggucugugcaucuguaaauacuguguugcugguguagaaagaccuaggaaagcauagacuuuucuuuauuaauuuucauuucaaaauuaagucugaucacucuucuucauugcauacagcucaugggagaccuaucaggagagaacaggauuagaauccuuugccaguguccuuucuuaguacuauuagugaacugugucacuugaccuacuaacugugucacuugaccucuugauuuacuaaaaacacauaauaaccaaucuacuuaaaucuggaugcuaauaugaggaaauguuuuuaauaucuuuagaaugaaacagaaauugaguuggggagccuguuaagacaggauuuucaaggauugcauaacgaauuauugcugcguauuggagaacauuaucaacaaguuuucaaugguuugucaauacuugccucauuugcaucuagugaugauccauaucagggaccacgagauauuacaucaccugaacugaugguaagggauauaguacaugguauaaguuuguuugguuuucuccuuuucuguaccuuacuuauaaagcugaggaaacuccucuauuuuccaaacauagguauuucuuuagguuuuaauugauguguuuuuuuuuuaaagauuuauuuauuuauuaaauguaaguacacuguagcugucuucagacacuccagaagagggcaucagaucuuguuacagaugguugugagccaccaugugguugcugggauuugaacuccggaccuucggaagagcagucgggugcucuuacccacugagccaucucaccagcccaauugauguguuucuuuuagaaaagguuaauguuguauggugggaccucccucacuaauuacuaauuaggaaaaugcccugcauacuugcuuauagucccaucuuaugaaagcauuuucuuaacuaagauuuccuucucucagauaaccuuggccugugucuagcaagcaagugccucacuauugagcuacccauguguaaucucagcccccaaagaaaucuuauuauucuuuccucacuugauucuccuaaucuucccuacuuugggcaauggugcuuuguaccaucaccuacucauuugcuucaaccaaaaccugagaacagauaugagcucuucaaauaaaaucuauaagaccauaugugacauagugacauagugaccauaugugacauagugugccuuucugcccuuugguucaguucuucucacugcuuuagcucuaucucuguuucuuaaaaauggcaaacuuucagacuuguaguuguuggcguuagauggucuucauacuuacacuaauaauucccuggaugcuuuuuacuguucacaguuuccuugucaccccuaccuaaauucauuuauccaguuucuaucacaugcucauguuuauuuucuuauugcccuuaucacauacauauuuuauguguaaauuuauuuagugacuccuacugauuugccauauauauuaguguuuauuuuuuaaacacauguaccuagcaugacaguauagaaacacauauauuuggugaauggcagcuauacauauucaaaguacuguuugacucaagccaagaacuuugaaauuagaauauuuauguagauuugaaugccaccucuauaccuaucuuuuauuuaagaacauagauuagaaccauauaauuagugaauugugguuucucaugccaaaguuuaauuucaaucuaaauuaaaaguuuacaaaacauauuguuggagaugcugugaugaaacccaauauuuugcuaaucucaaaaagacuagugaugauuuuuuuaaaaaaaauucacaaaccaaaagguaaauuuaggcuugaaaaacaaaugauuucuuugcuugacaaaauuucuguaugcuagauagauaccuaguuccucuucacuguguacuaguaaggcucuuccucaucuguccucagccauguuguaacccuaagguaaccuaaaccaggugccucagcgucaagccgugcuaucuugagacauauuccaguuauuacucaucacuagcucuuuuucuugcaauuuuuucugccugguauaguucagugguagaaagcuacccacuaggaguuuuguaguaaaucucuaauucagagaaaaagaagagagacacuuaauauauguaaaacauuuaacaucuuuucuuuaaauccauaggcugauuauuugcaaccaaaauuguugggcauucuggccuuuuuuaauaugcaguugcugagcuccaguguuggcauugaagauaagaaaaugguaaguagugguauuugaauuccaagagacuagaauaaaauucauauugaauauucagggaauauggaaucugcuucuaguuguaaacauucaaguauaaaaagucauggaacuagcuggguguaguagcucacaccuguaauuccagcauguggaaagacugaggcugaaggauagcccagagcuuaaugucagucugggcuaccucaugaguuccaagcaagccuuaacuaaauaugaaacugucaaaaaggaaaagcaagcaaacauuugauauuuauuacuggauaucauauauuuguucuuuagauauuguaaaaauagaaauuguaccauuggcugcucuuucacugaugaugugaguuaggaaacccaacucaagcugucuaaaaggauuuguuggcucuguuacuaaauagacaaagauaauauaacuucagccacaacuuaauucuagauucaaagaacauuucaaaaucaguaucuuuguucagagucaccuugguuaacucucuacuuuuguuauuauagcucagggugccuuugaauuucugguaguccucuuaacucagccuccuguaugcugggauuaugacagacaccuugcucagcuagcuuucuacuucucaggugauaaauacuaaugucugcaggcccaugcugucaugacaucuagcacaguugaagacauaagccagcagcaacugagagcuugaauauugguuguauaauugaauuuuauugguucaccugggucuaguguugguauuucuguucuuaguguauauguguguuagcaugagugugcaacagugcucacauagaggucagaggacaacaugcaugagucaguauacuccuacuauauggcuuuuagggcuagaacuagguuguuaggcuuggcagcaagccuuuacuuuaggagccaccuugcugguccaguagcagcuuuuauuucagaaugcauuccccuucugauaacuuuaaguauccaaguaagacauagagcaaaauuuagcuacaaauuguaauagucaaugccuguaauuucaguuuuaacuaguaaauuuucaguaacuucuauucugucuaucuauauggcuucccaaacacuuaugcuaaaugaaagaauggauggcuguaagucuaaggaaaauggaauuuauauuauaaagccauaaagagccuccauguucugguacaugugcuggcuaguuuuaugucaucuugacacaagguauaaaucauuugugaggagggagccucaguuuagaaaauagcuccauaagaucaggcuguagccaagccuguagggcauuuucuuaauugaugauccuugagggaggguccuauaagaaagcaagcugagcaaacccugaggagcaagucaguacguaucacuccucuguggccucuguaucagcuccugucuccggguuccugccccauuugagcuccuguccugacuucuuucaaugaugaacagugaaauggaaacauaagccaaauaaacccuuuccuacccaaauugcuuuuggccauguuguuuaaacacaggaauaguaaccccuaucuaagacaguauugcaaaggauuaaccagagacuuucuauauccauucauuagaaccuagaacuauugaugcaguucucauucuguuucuauuguaaaacuaucuggcaguuguucaguguauuaaauucagaacaucuugaauuuaguaucauuaagaccauuauugaccauuaugaaacacucugguuaaauuauaaauaacuucaaauuaaucuauaucuguauuuacacuagugauaugaaacauauuugaaaaaaauuaagauguaucauauauauccuuuguaaauuucaagauuuauuagaccauaguaguagcacaacuucaagggaaacaaaaauaaaaaugcaauuuguguuuuucagauucuugguucucauguaaguuaaccaaaaaaaaaaaaaaauuggccagcauuuauuagaccuuuugugucauguacauugauaccuugacauuuagguaggaagcaauuguuucuauuacuugucuggcaucuuguuuauaaguuuuggauuuuuuuuuuuuuuuuuuaacaaacacuacuuucuuuguaggccuugacuaguuugaugucuuugaugaaguugaugggaccuaaacaugucaguucugugagaguaaaaaugaugaccacacugagaacuggucuuagauucaaggaugauuuuccugaguuaugcugcagguaaauaaucaucauauuuagaauguuuucuuguauuucuagauaauucuaacuugaguucuuaucacaggcugauaugaugggaacauuuuuuucacuugagguguucuuuuccuaaaugacucuaguuugugucaaguuggcauuaaacuagccagcacaauugaccccuugucaccuugaugcaaaaacacaucacuuauuaagucauaaccuuuuuuucuuaaucauccacuaggugguaugauaaacgucacauauaaaacauucuaacuuuuaaaaguccccgucuuuaaaauuccaaacacuuuaaaaguuaauuucuuuaaaacauuuaagucucuaaaauuucaagucccuuaacugugggcuucuauaaagucaaaaauaaguuacauacuuucuuacucuaagagcacagucacauuaacaaaucaaagccaaacucccaacaguguaaaucacuaacucaguguccaaaugucugugagcaguguccacgcucuucuaggcuccaaagggcuuagacaguuauacuccucugacucugccauucacagcacaugcaguuugucauccaggcucaggcuggcaccacuucccagcugcugcuguccucauaauugucccaugauacagauaucucuaaaacagucuucaccuuugccugucgacucuccuaggcucucuucagggaaccuaacucugccacacggugccaagccucagcugcucucccaccaucacugcauuccuuuaacaccuguggcucacgugugacucguucacuaccaaguucagcugccagcaugaacaguuuggcacaguuucugugugcuaaccaugaggaaauauucucagauuaauggucuucaaagaugcugauuuuuuuuuaaaucaguacuaauuuuucagauccaacuaaccagagucaguugaccuuguuaagcaaagguuuuacuucagugguauuggucucagcccuagcugaccaaacugcagauucuuacuucaaaguauaaaugguuucaauagagucuuugauuuuaucuaaagccauauaagucaggccgccuucaucugcacugcucucagcacauuuaccuucucacugaacagcccgccacucugagcacucaacagcguuuccagcccaaaguuugaaugcaacuaaaaucuucccgaaagcucaguggccagaucugucacagcagugauucacagcaugauucugguaccauuuuuugucccauuaagauuucuauugcuguaauagcuuuuaacucucaaguuacaguucaucacugugugaagucagggcaggaaccuaagcaaggcaagaaccuggaggugggaacugaaacaagucaucaaggagugcugcuuauuagauuucuucucacagcuuccucagucugcuuucuaauaccauccugagcuacucacccagggaugccaccaccccauuuaguaugacccgcccacaucaaucaucagucauaaaacguacuauaaucuuguccacaggcugaucucuugggagcauuuucucaguugugauuaccucuuccuaaaugacucuagcuuauaucaaguugacauaaaacuagcaagcacaccuauuugaucuuccauaguuccuaggcuauccuggaacuuucuuuguggacagagcugggaucauaaguguaugccaccacaucugucuuuggggguuuuguuuguauguuuguuugauuuuguuguuuggguuuuuugguuugguuugguuugguuugguuuugucuuuguauauguauuuggccauacugcuucuucaggcuccagauuucuggaauuauagaccuauaccaauauacauuuuuaauguaccuaaccuaccauacuuaaccuaccauaccauaacuuaacguaaccuggcuuaaaugagcuuagaacacucacaguagcuuccaguugaccaaaaucauaaaguguugaguaucucauuuagucuacugaacacaguagaugcuguuaaguacaguauucauuguucacuccaugguuccacuagaaacuguggcuugcucucacuguccagcaucacaaggaaaaaaauguguuuuauuccuaauucauggaaagaugaaaauugaguuuuguuuuuaauuuuuuuuaagguuuuuacauagcccaggcuucccuugaacucaguugugaaucaccacauccaacugccaaauacaauuucuucuaaauguacauuugcaucauucuaaaguuaaaaaaucuuaaguuauacuguucuuuuuuuuaaguuguacuauucuuacagauuauuuauauaagcaaaugcauaaauauauaacauucgauuuuucuuuuguauugaucauaccaugaaaaacugauuucacauuggugcuuguuuugaguauuugauugauugguugguugguauuuuuaaguuuuguuuuaccuaauauaacuuagagaucacugucuguguguuuguaugaucauugaucuuuauaucaaaagcuacuuuaaucucuaauauguauauaucauuauucagcuaacaacuaauggaugguacuuuacaaacauaaaaauacuugaauuaauuuuuguuuuucacuuagagcaugggacugcuuuguucgcugucuggaucacgcuuaccugggaccccugcucagucaugucauaguggcuuuguuaccucucauacacaugcagccuaaagaaacugcugcuaucuuucacuaccucaucauugaaaacagguauuggaacuaaaauuaaucagaaaaauaguagaauaguaguguguguauuuacgcgcgugcgugcauguguguguguaaaccaaaaguugacauuggaugucuuccucaauccacuuuauuuugagggguuuguuuguuuguuuguuuguuuguuuguuuguuuguuugaaguagggucucacuauguagcucugacuaucccagaacucacuauuuagacaagucuggccucaaacucacagaaaucugccuguuucuggcucccgaauacuaggauuaaguauuaauccuauuaauacuaggauuaaguauuaauaccaccuuaauuuuugagacaaagucauucaaaaacugacugauugcuuuagucuagcuagccagcauagccccaagaauccgcuugucuuugcuucuuuggcaccgggauuacaggcacauacuuucuggugguuacuuggggauccaacuuaauccucaaucuuacacagcaaaugcuuuaccacaugagaaaucuauccagcccuaaaacauuuaaaaauguauuuuuaugucccaaaguauuaguauuacuuugauaauauaaauuacuauuuuaauagagucgaguccuuggaggaaaauauugguauauaacuacuuauuaaauaguugaauuuucaaugcgucuuguuucuauuuuaaauauauuugaaacucauuaauagaucaacaauuaaaauuuuuucacugacuuucaguuaguaaagguaauuuuaccuuucuuaaguaaaucaggugcccuaaggaaggcuagcagggauaguuaccacuuuccuuaguuacuuagaauuccuauuuuaucccauuaccuuugaaccagcuuuccuuauuuuagacguuuauggaauuuuuguuucuuuaaaaaacauuucagcauaaagagauguccucugggucucuguuuucuaaauauugaauuggcuggcuugaccuuuaaagcuggacacuugacauuuuuuucuacugauuuuuccagucccacugauggcuguagcaggaagcuguagggaacaugaacuagugacagagaaaccacucuuuaccuacacuuaaauuuucacucacacugcuucuuacucuaaaauaucguccauuguguuucaagccuuuucuguuacauaacuaacugcuguguaucauaauucauuucuucugaaaaguuaggaugugaacacuacacaccugcccacccauaugcuguugccauuccuuuaaacuauuccaguaaccauucuggcaggaaaacacagaaguaacaguaucuuuuuauucauugaaaauacuuuuaggguuuuuuguuuguuuguuuguuuuauuuuguuagucuccuacaugcuagaacaauaaaaucaccaacauugcuuuucaauuucuuuucaguuccaaauauacauaugcucauugucucuuauggaugguagaauaacuuuucaugucauaagaaagauuuucuuucacuuggugcuagguagacccuucacuucucugagugaaugaauugcucuggauuuguuuaugauuucauuccaagucuagcacagaacuuggagucuaauaggccacaugauagcuauuucuggcuuuuuguuaauaaagacuagaauuaaaaauauauuuaaacccagaaagauuauuuauuauaauuuaagugaaacuuguaguaucaauaaguauuauuuucauauuuuucucuaaagcuucuauauaaaaauuuauauuuggggauugauuuucacuacuuccugcuuuuacaaauuacugcaaauaugguaccuuaggaauagugaauaucuuuauuugcucauaaauuuguaguguaggcugaguucagcuuguuauuucuucuggguauggccacauuugaagauagacugaaguggacucuucucuguccauguaauaucagagcccuucuuucugagugucuuguccauguugauagccagauuucuuccauggugacucaauuuuuuccugagcucaaaaauggaaacugccaggccuaagcccuuuucuaucuacagcaucucuucugcuacauguauuuagcaaauauauagcauauguauuugcuaaaggaauuuuuguacccagucuuguuaaagaauaaggugcuauauauaugaauguucauacugagaagcauggcuuauuaugggccacugauaugacagacuaucaaggaucauuuucauagcugugguuauuugccauuauuaaguauuuuaauauuuuuuuaguuuuuauuccauauguuauuagagauugaccccaggccuugugcaugcuaagcaaucacucuaccacuauauuagcccuagaauaauugcuaguauuaauuuagcugggaaucuagacaugacuaggaagaugacuuugcaugugaauaaucacuaugagcuuuuaaguaugaauuuuauagcuuuaccuucaacuuuacauugauauucuuacaaacaauucuuucuaacuauuagggaugcugugcaagauuuucuucaugaaauauauuuuuugccugaucauccagaauuagaaaagauaaaagcaguucuccaggaauauagaaagguauuucauuucuuuauuuuuaguauggaagaucuugaauacaaaauuguaccugauuccaguauauuaaaaaagguccuuaccaucaaagcuggguguguuggcucaugcauauaaucccagcauucugaaagcggagccaggaggaucuccauaaauuugaggccagcauguucuuagugaguuccagccaaggugacauagaaaacccuaucuuaaaaaaaaaaaaagaagaauauaaccauggugauuagauaauaguacugugaaucagugacuuuggcagggaaguuuugucauuuaaauuuguuuuuauguuguuuuggggguuuuuuguuguuguuuuguuuugcuuuguuuugugacugucucuuauagcugaggcugucuuaaaauaacacuauguagcuggggcugaacuuuuuauuuguuuauuuauuuauuuuuaauauuuuuauuagguauuuuccucauuuacauuuccaaugcuaucccaaaaguuccccauacccucccccccacaccccuaugcacccacucccacuuuuuggcccuggcauuccccuguacuggggcauauaaaguuugcaaguccaauaggccucucuuuccauugauggccaacuaggccaucuuuugauacauaugcagcuagagucaagagcuccgugguacugguuaguuccaccuauaggguugcagauuccuuuagcuccuuggguacuuucucuagcuccuccauugggggcccugugauccauccaauagcugacugugagcauccacuuauguguuugcuaggccccagcauagucucacaagagacagcuguaucaggguccuuucagcaaaaucuugcuaguguaugcaauggugucagcguuuggaggcugauuaugggauagaucccuggauaugacagucucuagaugguccauccuuuugucucagcuccaaacuuuguuucuguaacuccuuccauggguguuuuguucccaauucuaagaaggggcaaaguguccacacuuuggacuuuguucuuauugaguuucaugaguuuagcaaauuguaucuuauaucuuggguauccuaaguuuugggcuaauauccacuuaucagugaguacauauugugugaguuccuuugugauuggguuaccucacucaggaugaugcccuccagguccauccauuuggcuaggaauuucauaaauucauucuuuuuaauagcugaguaguacuccauuguguaaauguaccauauuuucuguauccauuccucuguugaggggcaucuggguucuuuccagcuucuggcuauuauaauaaggcugcuaugaacauaguggagcauguguccuucuuacugguugggacaucuucuggauauaugcccaggagagguauugcgggauccuuuaguaguacuauguccaauuuucugaggaaccaccagacugauuuccagagugguuguacaagcuugcaaucgaguguuccucuuuuuccacauccucgccagcaucugcugucaccugaauuuuugaucuuagccauucugacuggugugagguguaaucucaggguuguuuugauuugcauuucccugaugauuaaggauguugaacauuuuuucagguguuucucugccauucgguauuccucaggugagauuucuuuguucagcucugagccccauuuuuuagugggguuguucgauuuucugaaguccaccuucuugcguucuuuauauauauuggauauuaguccccuaucugauuuaggauaggucaaguccuuucccaaucuguugguggucuuuuugucuuauugacggugucuuuugcuuugcaacuuuaugaggucccauuuaucgauucucgaucuuacagcacaagccauugcuguucuauucaggaauuuuucuagcuggggcugaucuugagcaccucaucugccugcucaucauuccaaauguuggaauuauggucauguacugcuaccacauccuauuuagacaagagacacauuagcauuagauagaagccacccucucuauuccugagagggaaaauguggaaugaucccaguuaucucaugcuguaaauuacaguaucacuaugguuauacuaugauagcauuguguccggucuaaaugauucuugaucaucuugaaaucuuacaaacuuucuaaaaucaugaaaauauugugauuucauagaauuucaugacagaaacuagaauuugaggagugaaaggacugagcagaguccacaugggaaggcuuguaccuuuuuauuaucaagaagcacuuauuuuagauacauaagauuuuauucaauuggaagaaaaucucuaguucuaaggauuuuagaguaaaaaugauuuucccuaaaaaaaaaauuauacugaugacauagacuuugcaaagaaagggaugagaaaaaaauuuaguuggguuauauguuagcuauuuuaauaguaacugguuauauagagaauacaggccuuucagauguuaggauaguaaauaaugaauguuuucugcucuuuguauaggaaaccucugagacuacugaucuucaaaccacucuccagcuaucuaugaaagcaauucaacacgaaaauguagauguucgaauucaugcucuuacaagcuugaaggaaaccuuguacaaaaaucagguaugcuaaaagugauauaauucaaauuauauauuuuuuaaaaaaucuaucaggaguuuaaagaaaaaaugauggauuggcauuuuugcuugagaacucaaaagauuuaguuuucaugcuuauacauuuuuauuuuaccuagauuauuagaucugacugaaaaaugagggguugugagauagaugcccuucaguuucagucucaaaaauugcagaauuuucuguuguuuugaaggguccuuauuucauaguuguacuuuugucuagugcaucuuugaauuuuuaaggauuguuuuuauuuauaugccaugaguaugugguacauccucaugugugcagaugucuuacucuaucacucugcuuuuaagauggucucucacuaaacugaaagcucacuguuuuaggcuagguugacugucuacugagugucugauauccuccugucucugccuccuaacucuggguuuccagccauguacaaccauuuucuauaaauauauauuggauauuuucuuuauuuacauuucaaaugucaucccuuuaccugguuucccccucuuccggaaacccccaacccauccguccucccccugcuucuaugaggguguuccucuacccucccauccacucucgccuucccacccuccauuccccuauacuggguuaucuauugagccuucauaggaccaaggaccucucaccuaacaaggccauccucugcuacauaugcagcugcagccguguguacuccuugguucauuucccacuuuuuaaagugaguguuagauguuugaacucaggaccucaugcuggcacaguaagcaaucuuaacucacugacuuaucuccccagccaugaugacuucauuacaaguagggauuuggauguuaguacaucaguaauuuaugugauucuucuaguguaauuaccccauugauaucugucauauaaaauuuuaguaauuuaauauuuuuuaacuagacuaagcuaacuuuauuaguuucauuugguuuugaguagcccaaacuagccucaaacuuugaguagagccaaacauggcuuugaacucaugauauuuuugccccgcuucuugagagguagaaucacagguuuauaccaccaugaugacauuucucuuuccuuuuucccuccuuccauccaucccucuauuccuuuuuuucauccuuccaauggugcuacucauauuaaaggaaucuuuuugugcaaauuccagaaagauaagaaaacuguaagaagcacaaauuacuuuuuauggaaauucagaauucuauuuaaaagucaaagcagagaaaaauucauugaaaauauagagacuucuagauuauccuggaaucaagauaaaugccugaaucaacucccgaucucucccaacaacagaaguugggcaguggugguguauaccuuuaaucccagcucuagagaggcagaggcuagucuggccuacagagugagucccaggauagccaaggcuacagagagaaagccuacaaacaaaaaguagcaacagggaaggcacauaaaucuaagcauaauccacacuuuaaauaucauuagaagacaggauccugagcaucugaacaaucuguauaaagaacaggauggcuucacuccagguauaacaacuguggagaugccuuccagguacuuucugcauaaaagaugcuggaaaauauuuagaugcuaaagucucagacagucauuuucucuuggagaaguaaaagaauaggaaagaggagcaagcauucuuuagagaucuuguuauaaacaaacaaaagaaaaagacaaggggaagacuuaaaggucuuguagaaaugaauuuaucaaauccuaccucugaugccaaaaacaaaacauaaaauggugcuuuguuuuuaaacaaauaacuuuacuauacuuccuggcguauuuauuuauuuauuuauuuauuuauuuauuuaugaaaaucuuaaagccauuacaaaaugcuuacuguuuguuagagccuauauggagggcucacaauaugaauagaaaaauuacauauaagaaagcuggguguggugcugcaugccuuuaaucccagcacugaggaggcagaaacagguggaucucugugaguucaaggccagccuagucuacauugaaagucccaggccagccaagggucuuuaauaagacuacaaaauaaagaaaguaaaaaaagaaauccaagcauggaaucccaggacuugacaggcuggcugaggcaggaaagauugcuuaagaccggccuaagguacagugugagaacuugucucaaagaaaaaaagucuuucaguuugggacaauucuuucuuaaaaaccaaaaacauaaaagaaaacuggauuuagcauuauaaccuaaguuaagaauuucaaauauuugcaaauuuagaaaaaaaaugaaugagaauuuuaauuuuaaucagauagugcuggacagacggcuaacugguuaauaguucuugaugucaguugugaagaccagaguucaguucccagcaccaacauaacaagucaugaauucuauguaugccuauaaucccagcucugacuuggaggagaaagaacuguugggguuugucaguugucagccuagccuagaaaacuugagccccagguacaagaagaccuugccucaaaggacuagguggaaaagaauauccaaugcccucuucugguacuguuuauguacauacauucacauugcagacacacacaaacucauacacaaaugaaugaacuuuagaaaaauaaaguuaaauaagugagauaaaggacauaaccaagaagauaugaaccacaggugacugaacucaggaagacaauagaaaacagugaacaaauuauggacuauuagaauccauuugacuaaaaccuuuaaguguaauugauaaaacaucaaguaauuaguaugaucuuuauguauauaaauaacauacauuuauuuuucauaugugugcaugccuggugccugcauaggucagaacugggacugggguugguguuuguaagccaacaugugaggacugggaacugaauguaguuccucuguaagagcagcagguacucuuucuuggggggggggggggggcagggguugagacaggguuucucuguagcccuggcuauccugaacucacucuauagaccaggcuggccucgaacucagaaauccaccugccucugccucccaagugcugggauuaaaggugugcaccacaacugcccagcuagcagguacucucuaaccaucucuuuaacacccccaccucuuuaaaauucauuggcaugggcaaggaagcuaaauugauauagggaccuagagacucucucucucaaaaaaaaucucuccagcuguacuuauuagaggauuaugguuagaaacacaguuuuaaauacaagaacugaauaaauaauauuuuuauaaguuagcucuuccuaauacaucuauuugaggaugauuuuauuuagucuagaugacaagaguagacuuuguuuaaaaaaaaauaacacuuucuauauuucgcugacuuaauuauaaaucuaagaugaaauaauaguuggucaagaagagaaucucuaugaauguuacauguuucauaaauaaacuuagcacuuuuuacaugagcaauaacuaaaaguaaaaauauauguguaucaucauauaccuuuuaaagcuggcaaacuagguauaagcuuaacagaaaugagcacuaaguuauacuaucuaaaaaaauaauuauuuggcaagagagaugucuuaagagcacauacuacuacugcaaaacauacugugagguauauuauauaaagucaucaaaacauacauacugcgagguauauaaagucaucaaaaacuaauugaaaagauugaaguacaggaauuuaauuuuguuuguauuaauauuuuuaagcucuccaacuuagaaaaacaugcuguaagaguucuauauaaacuuucuacuuuuaucuaaggaaaaacugauaaaauaugcaacugauagugagacaguggagcccguuaucucccagcuugugacgguaauucugaaaggcugccaagaugcaaacucucaagcucgcuuacucuguggggaauguuuaggagaacugggggcaauagacccagggcgauuggauuucucaacaacagaaacucaaggaaaagauuuuacauuugugguaaguaauggugauuuugagugauacuauuucucuguuauuuuuucuguuguuuuuguuuuauuuuguuucuuguauaugaggguuuuaucugaauauaugucugugugccacaugccugccuagugucuacagaggccagaagagggcauuggauccccuggaacuagaauugaagacagcucuuauguggguacuggauauugaacccagguccucggcaaaagcacccaguacucuuaacugcugagcaaucuuucuuccugaauugaguuuuauauauuccauuuacacaaucagacauuuuaaauagcuuuuauuacuaauuaaauacugacauggaacucuuuagccaaaagcaguacuuugagcccaaucuaauguuuucugguuuuggaaacaaagcuuaguaaucuaauuaucauaauaguuaaggccuaauuaguuaucuaaagauuaacacuuaaacauaauugcuaguguuuccauagaaaacuaauuucuuaggauauucuaguaauguauuuauuuuaaggaaauccauguuaacaaucugugcuuuuugcuugcuugcguguguguaugugugggcuuguuuauuguuuucagugguagggauugaauucagggccuugcuacuaggcaagugcacuucuacugagauagaucaccaaucaaaaaugaaaaguuugauguguaccuggugaaucugaguggaaagaauguugaaauuaccuuggaguaacuacauucuguaaagcgacucagaagguuuacaaaguguaguuuaggaacugcuaugaauacaguuugcuuuuuaaauuuuauuauuauuuuguguacgugugugcacgcgugcaugugugccacuguacauaaguggaggucagagaacaacaagauacagcauaaauagagaaguuaguuuacuuccaucuuuagaugaguucugaggcuugaacuuaggucaccaguuguacauggcuagcaccuugacccacugagccaucuugguggccuugcaguuuguuuucugccuguuaaaacauaaacugaccuaccuauucaaaaguugaaugauuuugauacaauuuuauaucaugcuaagaacaugcagcauuugacuucuuagcuuugaauuuauuuguuuauuuauuuauuugccaugauaccagcucaguuugacuucacucuccucuccuauuucuaaacucacuguggguggcacaguaacaccugaagaaaauuuaugucaguucuugaauuaauuuuuuuuggguuugcuuauguuaagacuggaguagaagauuuaagcuuugccuauggauugcuaauggagcuaacaagagcuuaccuugcauaugcugauaacagccgagcacaagauucagcugcuuaugcuauucagguaagcgugcucacaugucauagccauuacugacuuuacaguauuaaaugcgcguaagaaagcuaucaauuccauacuuguaaaauacuuaacaaucaccuuuaucaucugagugauacagauucaaaauaaauauuuuagagaacacauuauauuuucuugaaugaauaagaacaaaauaugauauaaauaucaaaaugccauaaugaaacccaucacauuguugcaaaccuaaaaauaauuuuuaaaguaucuauucuuuuuaaaaaguaucuaacauauuauaaauacuuaaaugcuuaauaucuauacaaauaaaauguccuuuaugcuaaaucaugugaaauauuauuuaugaucuucaguuugauuuucuugugucuaaugguauaucuucgguaauuuucugugucaguaacauauauuuaguucauucuuugcagugauccaaugauacucaauaugaauguauuugagaaguuuucuugaaacaucuagguuguuccacugcauuuauaaaacaugacuuaugacuugggagccagaaauggugguacacaccauuaauuugagcguuggagaggcggaaaugggaagaucaccacaaaucugugacuagccaauugcacugcagucuaguuuacauagugagcccaugucuuggacugucucaugaauuuuaaguuuuaaauaaaaauaagugcuuuuaaucccaguauccaggagucagaggcaggcagaucucuauaaguucaagauaagccugaccuaccagaagagguccaggccagccagggauaucuagugagacccuuucucaaaaaauaaauaaaauaaaauuuuaaaaagauuuagagaacauauauacaacaacaacaaacaaacaaacaaacaaacaaacaacuuugcccuggauuuuguaaaaauuuuuaaguuaguuuuuuugguuuuguacauuuauuauccccaccccccauuuuugguauugguugcuucauuagauauuuagguauguucucagaaugcauaggaggauugcuguagcuaaguuauuugaggccaaguuaucaagacuauuucagaaaaggagaugggguauuucagucuuugguccugggaugagaaguuauagaauaguuaaagauacagcaaacagacaaaacaacaagcugccaacgauaggaggagaaugugguguucuagaagaccaacauauggagaagcuguaucuuagugaucugaacuaaaugcugauuauaccuguaguaauucaagaauugaaaacugcccauugaguacagagagaagaaaaggcaguuguugaucgugacaagaucaguuucaaagaaagaauauauaggaaaagaaaugaaaagaaaaaaaaagcaaaaacaaauuuugcuaucaagcugggucauaaagaacaauaaguuaggagaaaaaaaaaaaagcccagccgggcagugguggcacaccagugcuuuggagguagagguaggcggauuucugaguuugaggccagccuggucuacagagugaauuccaggacagccaagacuacacagagaaacccugucucaacaccccuccccccccccaaaaaaaaagaaaagaaaggaaaaguccaauauuucuauauugccuggaaacaggucaucagaaaggagacagugaugauauaggaguaaguuggugaagagcuuugguuuuuguugugggaugugaaugcuaaguauacagucugccauugagcuauacgcucaguccuaauacaauauuguaagcagguaaagagacauagacugagguacaaggucaaaggguuaaaaauaagugcaggaguugaggguguaguucuguuugcagaguacuuuccuaacauaaagccuaacauaacuuuccuaacauaaagguguggaucugggccggagagauggcgcagcaguuaagagcacugacugcucuuccagagguccugagucaauucccagcaacuacaugguggcuugcaaccaucuguaaugggaucugaugcccucuucugguauaucugaagacagcuacaguguacuuauguauaauaaauaaaucuuuuuaaaaaaaaggugugaaucuauaacauaccuugcaugcuaguuaguaccugugauccuaguacugaggagaugaaggaaguaaguucaugcugagauacauguaacccuaccacaaaagaauaacaauaaaaucccuuaagaauacuccauuguagcucaugguccagcuuaaaaguacugccuaaucuuccagaggacuuaaguuugauuaucagcaucuacaagacagcucacaacugucuguaauuccaguuccaggggauccagugcccuuuucuggccuccauaaagauaaauaugcagacaaaucacuuauacacauaaaauaaugaauuaauaauuauaauaacaauaaagagcaggucauaugagcacaaggaacugguauugccagacuaacauagaucuuaagaauagaaauuuggaaggucuucuaacuucuguuuucucugaaauuugaaaaaagaucuguaacuauaaguguacuauugguuuauuguuguuuguuuguuuguuuguuugagauauguagcucacuagagaguccugacugacugguaacucacuauguagacuaggcuagcuucaaacucauagagaugugccuaucucuaccucucaaguggggggauuaaaauugugcaccaccacacccagccccauauugauguuuuuaacuguguagguaagugaccagaaaucaaaggagaaucacugaucuaguauauccugcuacuaaaaaaaaagccuucuuuauuuuuucucaccuuuuuauagguauuuguguguaugcacaucuggaggucaaagaacaacuugagagaaucaguuucuccuuccaccauguggguucugggguucuaacuagaaaggaaggaggcaguuuuacuggggcagugguacagagacagguuacagagagagggacagagcaauucagacgggugaagacagaguaagccagaggaugggaaggagccagaagauuagaacaaauugccaaaguuaguaugaggccaaccagagcaguucagucagaagcugagaggaaucaaauugaaucagucagcuggaggaggaguuugagcccguuuaccagccagccagaguucagaaagaacuagaaagggugagcuuauucaauucagcaguaagucugugaggcuaaaaauauucuaggacuagauaagauuguauagaggcuagaagcuuccaggccuagguuagcagauugaggcaguaagccucagagaagacaauuggcucaggagaauaaaaguuacuuuuacagauauuagugacaagaaguuuauguuuuuaaaacauuaaaucucuacuuuccucucuuccuccuccccaacuccccccgcccccacacacacaccacaucacucacucucucagcucuuucagacaggcucuaauuaugaaugucaugucauccuuaccucaaauucuaaauccuauuucagcuuccugagugcuagggauacaggcagggacugcaaugcccaacuguguuugguuuuuguuguuguuguuguuguuuacagaaaugauaauagaaucagucagucucugagcuugaguaauaaguuaguggcuugggcuauuuuaauuguuuguuugaagacaguaccucaugauguagaccaggcuggcuuggaauuccuguguaguccguggucucaagccacgaacuuguggagaucuugugucuacugccccuaaugcuaggguuucagguguguucuaccacucuagcuaucauuuugaggugauuuuaagcucaguauuuuauaucuagaaguuaagauucccuaaguuuauguacucuauugaacuuuuagcuacuuuuauuauaacuccaaagaaaucagauucucaggaccagggacuggauauguaucuugguuacagagugcauacuuaguauauguguguaugaucauuccuuagcaccaaaagaaacauucuaaggacuaugauuuugugaauauagaaguucuuuuugucucaaaauaguucuuuuuuuuuuucucucuuucuuucuuuuuccuuugaugggagugcuggaaguugagaaaggauuucucuguauagcuguccuggaacucucuauagaucagacuggccuugaacuuagagauccaccuaccuaugcuucccaaauucugggauuaaagguguugcaccaccaccaccacccaacuucaaaauaguucuuaauuuuauauuguagagacuauuuuacaugaacuagcuucauaaucaaguguugccauagcuuugugaucccaaguauaguaccuuaauagauuggaucauugaaauacaugucuuaaaguuuggaaucuuaaaaguuuucauuuaucuguuucacuguggacuuaaauuguaacauauguguuuguaggaguugcuuucuauuuaugacuguagagagaugcagagcaauggcccagguuaccaguuguggaaaagauucccugagcauguccgggaaauauuagagccucaucucaauacuagguagguuuuucuauucauuuaaauuauugucacauuuuuuucuaauuuuguaaauuuaauauuacuuucauagaguuuuuaacaucaaaaguauuuuugauguugggguucuucaucaacgaagugccugcugguaagcaugaagauuggaguucagaucccugaacccauauaaaaagccagaccuuucacauggaccugaaacccauaggaccugaaacccaauggaauuuggcaagcuguugacccagucucaauuuaaaaaaaaaaaaaaaaggagaaggaggaagaagaggaggaggaaggaaagaaggaagggagggagggagggagggagggagggaggaaggaaggaaggaaggacggauggacggauaaacggacaagauguucgucaucugagaaggcacccaauguuuccacuggccuccauguauauacauacacauuugcaccagagaauacacucauaggcucacauaaaaaguagaagcccacauuucugccacuuuuuaaguaguuguacuaaguuuuaaguaguuguguacaagagugaccuuaggacaguaaugagaauuuguauauaauacuuuuuuauuuaacauauuuuacauuauuuaguuguaugugagugugugugugugugugugugugugugugugugugugugagcucaugcuauggcacacauagaagucagaagacaacuugugggaguugacuuuuuccuuccaaccauggugguucagggagcaaacucgaguuaucuaacuuggcagcaaguaccuuuaccugcugagccauuacacuaguccauggugugacacauuuguaacagagauugaaggaacuucucagaugggguaccacugagcuuuuaauauacagucucuaaauuuagagugcagcuguaaaugguaccuguauuuggaagauuuaaguuuuagaaccaguugaaucuaaugaaguucaaaguugccacagaaauaauuuguucagaaaacuugagaaugugacuaggcagaaccugacuuguaguucauacucauuaauuuuuuaaguuaaauucacuuaagcauuuuagucacauaaaaaugucuucacacaaaaguuuuacuccuguuuuacuguuauauuugagauuuguggauuucuuguuuucuaaaacaugggcuauaguaaaguauuauuuuuuugcugaagaucucgagcauagagcaacuauaauaaauaucaauuagaaucuaugccuuucagaaaauucuacagcuauguaguugugagaugagagcuguuugaacauguuuaacaaaaagucacgcugaggacacaaaggaaagucauacugcacuaaugggagacuuucucuuauuuuaauaaggaaagcuaaagacaccagcuguguuuacagguuagauuuuaagaaaagcacuuacuuuuauucuaugugaagucggaaguacaggagaugauaucacugggcaaaaguggcaguagacaugguacagauaaauaaaggagcauuagcauuagugaaggggaaaauucuuuagaagcuuagcauuugauuaaguggucuagccaaacauugaagucagucaugauuauaaaaauuaaggcagaaagaauuagcaguguacugaaauuaucaauuagugucaauaaucagugaguuaguagaugcccaaaaagaggagucauggagaauaauuuaagugagcagcuugacuuugacuggagguccggaggaucugagggugagauguacucagauucuaaggugcaccugaggaguauauaaugaccugcuccacccuuaagacagauagaacagcacugucuuucaccagaauucagcaacuauaucagaguaccuguucucaguaaagaggugcauauaacuucuugugcuuuuguucuaaacacauauuuucaauauguaaauuuucaaaauuacagauauaagaguucccagaaaucaacagauuggucuggaguaacgaagccaauuuacuuaaguaaacuagguaauaacuuugcagaauggucaucaucuugggcagguuaucuuauaacaaagguaagagaaccuaguucagaauguauuaacugaauagaaauucuggaagaaucuggaacauauaccugaaugcaaagcacauguuacaaaaagaauauauugauaugauugaaaauguuuaucaauaauaacaauauuuaacuguuuaauuuuaauuaaaaauuuuaguaauuauaguuccuagguaaaaggcuauucuuuuaucaaaauaaauucuagaauuaauuuacuacaaaguauccaucauaucuacauuuuacacugcaaaauaauaccacucaagagaauuuacaggcugaaagaauuaaaagguaguauuuuuuauuuuuaugcuuacauauuuuaauguaaacaagauaucuuaccauuuacugauacuuuuggaagaagauauaucaucuauacuuguaucuaaaauaaagauauuuuuaaaugaaauuucauaagguauaucuguaaaguuucccuaauagaaaauuucugugggccuaacuaaaaaaaaaaaaaaaaaaugcugugcauucuaagaaaaugcuuaagggauaauuaaaauuuacaacuuuugcuuuaaauuuacauguuucuuaguauuucaaaauaacaaguauuaaauggcaaauuuaaagcauuuucacuuuuuuauaaacacacaaaaauaggugugaaauagugaauauuauuaauuuaacuauuucuaguuccaaauauuuuauuuuugucaaaauuuaauauuuucuaauuuuauuugaaauuguuucaaguaaacaaucuuuuucauuuuaagugaaaauuuaauuuuccaguucaaaaaaauccuuuaaaacauuuucuaacaguucaauaaucauaauaaguugaagauuagaucauauuguugacauuugauuuuaaauugaaagcugaaccuugaauagacuuacaguguucauguuuugaacuuuuuaaugcccaacuuaguuucuauuucuuuuaucuuuauccuacaguuugucauugcauacuacuuaaaaguaccagcuacauacuuaaugugcuaacucagcauacauuuuuguuacuugguuuaaggaauuagcacaauuaauuauuaauuaauuagcacuuaaggaauuaauauacuuaauaauagcuaaauaagauauacucagggaaguuaaucuauaacaaaacaugagacauugaaaaagagcuguaaaagaggagaggccauguauguuaauguagcuagcagcuacauucccacuaggaucucaguacuuuuggcauuugagaucagucagagggauaaucugaaguuccccuuggugauuguccaucuuucucuucauggagaauaccuacucagucaugaauuaucucacgugguacacuugaacauucagucaauagaauaaaauggaaaacuacuaaucuuucuuaaaccauuugaguuuauagguucgggauaaucuugccaguaagaucuucacaugcuguagcauaaugaugaagcaugauuuuaaagucaccaucuaucuucuuccacauauccuaguauaugucuuguuggguuguaaucaagaagaucagcaagaggugagaguuaacuuauuugguuuccagacaugugacuugaguucugaacaugugaaacuuaauuucucuaacuuaguauuagaagcuacagaguaggggcuaacaagauggcucaguggacacaaugcuugccacacaagacugaugaccugaguucaguauccugauuccacauuagaaagagagaaccaagcucugaaaguuguccccugaccaucacauguacaccauggaacacccacacuugcuuucucacgcauacacaaauaauaaaugcuagcacuugagaggcagaguggcaggagcaucaggagcuagaagucaccuucagccacacagcccauuuaaguccaaccuguguacaugagcugucuccuagcuuuaaaaauguuuaauacaaaaaacuauaaugucauuaucaguucaauuauuuauuuacucugaaauuaauuacaauuacucuucuuaaaacuuuuuauuuauguguagguaggugucacauauauuugcaauugcccagggagaccagaaaaguguuucagagucccuggagcuggagguauaggcaguucugucucauguauuucuccugaacuccauccucugaaugaccagcaagcacuuuuaaccgcugaaccauuaucugucuagaccuuuuuuguuauucucaucaacucuucuaacucacugauuuagguauagauaagaaaaguuauuguuaaucugcuauuucucuuaauuauugcuaaaauguuuagucuuugauauuaagugauccgauagagauacauuacuaacuuuaacugaauuauuuagguuuaugcagaaauuauggcaguacuuaagcaugaugagcagcaugccaucaguacccaagacagugcaucugaucugugccagcugaguacacagacuguguucucugugcuugaccaucucacccaaugggcaaggcacaaauuucaggcauugaaugcugagaaacuugcacaaaacaaaccaaaaggagguaaggucaacaaaauaugugaauauuuccuuguacuaucuaccagucaacuuguccuugaguuaauucuaaauuuaagcauuaguuauuuucuuuuuaagacacugucucaacauggagccacagcuggccuagcuuuccauauguagaccagccuggucucaaacucagaaaucuguuugucugcuuccaaagugcuuaagauuaagggugugcuguaucauuuguuugucuuugcacuacugggaaugaaacaugaggccuuauauaugguacacaagcauucuacugcugagcaacaccuccagccgugugcauuuuuaaauugguaauaauucacacuucucacugagaaaagacaguuaauauaugaccucacucuaggguuagaguggagcucugagguagaaugcuuaucuaggauguugaagaccuaaauaccagaguuuuuaccucaguaauguaaaaaucaaaacaaaaauccaagaaacugcaguuuuauuauauccauggacaaaaugcauaccuaauuuuucuuuauauaagcuagggucucucuguccaauuuuuguguuuaaugagaugauauauacaagugucagugugagcuaugaguaggugauggagugauacuaaagcugcgccacuccucacuguuaaaucauuugcuccgugugccucgguguuugugugugagcagaaucugcuggccacugagcacaugauuguacaacaacagcauuagagcuacuguucuauaauuuuguuuuugugguauuacaguuucaaagaaucuuuuaguaagaucaaagaaucuuuuagaguuaugaaucucauuagagcuacccuaccaucagccccugcacauaguuauuuguugacaagacuuauauugaucgccgggugugguggcgcacgccuuuaaucccagcacucaggaggcagaggcaggcggauuucugaguucaagaccagccuggucuacaaagugaguuucaggacagccagggcuacacagagaaacccuguaucgaaaaaccaaaaaagaaaaaaaaagacuuauacugaucacacaguaaugaauacucuucuugcuuuugaaccacuuuuuuauuguucuugcaguacacaaaagguuacaacccuauugcugcuguuucucccucagccauucucaugguuaucauguuuuucuuucuagguuuugggacuaauuuuaaaaauugacaaucugauauuccuaaagagacaaaauugucaguuuaugagccacucccuccuuuuaugccuaauaaacacaauagguuauuauuuuacaaguuuucuguauuugcaaauaauuaccuguuugcaggaauguuuucuauagaguaugauuaaguagcaauuauccauuuguuuguaauagccuaguucuguuuguaaaaaaucuuaaaagcaagcuuacuaacuuggcuauuacuuucauuaacacugcaauuaaaauucuuucuuuuaagacuaacacuuggaggcaaggaguaaaaauagcucauagaucuuugccuagcaugaagaaaggccaggacucagucuucuccacugggggaugcaaaacaaaaagcugaacuuuaaacuauuaaaaaauccuaccccauaacucugcacguuccuuacuaaauaauugcaucuuaucaauauuuuguagucgucgguaaaaacaaaauauauuucuauuaucuucauaucuuuuuuaccaauuauaguuuugcauuuauuccuugcaauaauuuguaaggaaggcaaaacaaauaucacaauuucugcuuaacagaugagaaucagauucaaugaguugaauaguguucacaguuaauaaaaaugggagaaauggagcaagauccucugagcagacaucuuguacuucauuaagaccaaaauacuagccaccaauacauuuguauuacuuaauuuaaaaaauuaaaguuagauaugucaucauuuaaauguuuaucuuaucagucuuuaacuacuuuuuuuuauuuuuuuuaauccaguaucaaaugugaauuuugaagacuaucagaguguaacucguuuucuagaccucauaccucaggauacucuggcuguagcguccuuucguuccaaagcauacacacgagccguaaugcacuuugagucauuuauuacagaaaagaagcaaaauauucaaaagcaucuuggauuucuacagguuugaaauuaauauaguuaacuuaauaaaaaagaguaacauuuguggugacauguucuuuuuauugacuauuccagacacucuuagguacuaaauauuuguaauacuuuagaugcuuacugauaguaagaagagacugaaauuauuuuaguaagauaccuaaguguguugaugcauuuguccugaguaacaggcacuuguccuuaaaaugagaguagggaaaugaguaacuucugaaguaaugauaguuauuuagaggcaucuccauggaguugggaaggagcauuguguauacaaagaguaaaaugacaguuuuagaaugacauuuagagaugauaaaggaacacuaugucauacagaacauuagaagauguauacuagaccaguguggucauauuuugcuaaaugucuguagcaguuguggaggaaggguauaaagggcuaugauuccagccauuacuguugucccugcaagaggcauuagccucagcuuggggugacugaauagggagaugcaagaaugcugaugaaacaaagguuuauaaaauaauaugauacuaugugagaaacaaaagaagaaguauauaaggcuaagacagaggaagcaauaugauucaaauuagcagacuuugccacacugaaaguaaaguguagcagaagaacugggaagcaggcugagugugcugcucagggauaaacacuugacugccauaugcaaggucuuacaugugguugauuccagcaccacaaauccacacagaacgcaaauacaccagguauggcauagcaugaugguucacaccuguaaucucaguauucaggaggcugaagcaaaaaaagaauuugcagaauuuuaauagcugguuucaguuuacguucaugaucuuaaauaucuauaacauuauacagcucuuuaacaauaucuucaguucuucucuauuucucuaauaaaaccacuugaaccuucucuucaauuuaucauucuuaccucaaacuuaacuaauggucuugcuucauccuucauuaugaaaguagaagccaaaucugcagcaaauucucuguaaaucucuuauuccuggggaagacuccuugucagaaucuaucuuugcacuauguucuugguauuuaguuuuacuccuucaaaauguccuuucuucccuacuaucauuaauuucucuuacugacccagauuauauagaguauauagauauguucuacuuaauuuuaaauaauuuugaauuaaaucuugauucuacaauaacuccuuugaucuuagauucucuaacaugucuccuuucuuguuucuaguagccagcuuuaaaaagaacuuucuuucuaucccuguauuaucaucuuugacuccuauucacucugccuauucuaacaagacuucucacccagcaugguguacacaccuuuuaaucccaacaguugggaggcagagguagauggaucucuguaaauucaaggccagucaggucugcaaauagacuuucaggacaaccacaguucugguacacagaaaaauccugucucuaaaaaccaaaccaaaucagccaaacaaaaacaccaagacuucucuuucucucuuuacuuuuagcuuuuguuguuguuaucuuguuuggguuuuuaagacaggauuucaugcaaaaaucccugcccaagcuugccucuuaacucauaaacuggccaggaaugaccuugaguuccugauccucuugccucaacccccccaaagucagagguuauagcaguaugacacuguacccauucgucucuacacuauucuugcuaaaaagaacugguuuccauguuaucaaacucugcccauauuuucuuaaacuugcaauaucacuugacaaaccuuucuauucucaucaagacuuuugauuucagccagauuuggugguguauguauaguugugaacccaacauaaguucaaggucuucagggcuaacuugggcucuaugcaacccuuucucaaaacacucacagaagggcuuuguuguucugucuuuuaaucuaggagacauuugcuuuucuuccauggcuucaggaauauuuucuuucuuucuuuuuuuuuuuuuuuaaagauuuauuuauuuauguaaguacacuguagcugucuucagacacaccagaagagggcgucagaucucauuaccgaugguugugagccaccaugugguugcugggauuugaacucaggaccucuggaagagcagacagugcucuuaaccgcugagccaucucuccagcccccaggaauauuuucuuaccuagaauucuguucucucugguuucucuuaccagugcaugcucccuacuccucagaaauuacuuuauugagucauagcuugugcacaaaaaguuguauaugugcaacauguuuguagauaauacaaucaaaaucauagucaauacuaggagcaucauuacuucuaaaaaugucucccauacucuuuauugauugauuguguauguguuaaaagaauuuaauaugagagcauuuauuaaacucuaaccauucaauaauaugcacuaacgucagucaguauggcuuacucauguuuuauagugaauguguaaagaauuguguauguguaaauaacuccccaggcccugacaagcaccauuucuucuuccuacuuuauuuauaaagacccuaaaucaaugaucauguauaucccucuaacaugucugucuuauuugcccuacaauucuugaagcaacagaacagaggacuuaagugauauuuccuuucuauccaaacuccaccauuaacacuuuuuaguaucugcuugucacauaucccucuaccaucaucccacauucacuccuucaguuuguuuuuugcuucuuguuguauuucaaaguuucuggcguuuauguauuaggucuguuuuauuccuaguuuuuucuuucccacauaaaaauccuuaaacacaggucaaauaucuuaaaaguaauaagugguauuuaucaaccuuucguacacuccagauacaaauaaaugaacuucaagaucagagcagcaagaucucuagcaauucccaguacucacgcuugcucaguuauccgaaucccagugcugagcuguccauucuggcaucauuugcucauucacaguugauugcagacaguguggacaugaaggucacacaucuuuccgcaugcuccagguguagauguggguuuauucuugacuacuuuuucuuaguucucuaucaaauuuguccacauagccuaccacuucugccugguuccauaccucuuaacagccauucucaauauaauaagcaaguucucuugcuauuguaagcuauucaauuuuucugcucaaaccaugaguagauaacaaucuuuauugagaugaacacccaaaaguucagcgucugccauguuggaagugugcaugauaaucacagugagcuacaacuucacauccaccaggacagagggcuagaaacagcuguggugggcucauugucuuuugacucugcacuucuuugccuccaaggugaugcccugcaugagcuucuuaugagcgugaugcucagcagcaccagugcugcucaguaugugcacaggucaaaaccccagcaucugucauuagcuuccauuuauucuguuuauuucuaguguuuuuucugucucuaaagaaugucuuuaauaaagcuagcugcuuuccagauuucuaucuuuaagccuaaauaucuccuuuaagucaggguagcauuuugguuuugguggucauuugugauuuuuuuuuucaguuguuuguuaaauauacagguuuuguuuguuugcuugcuugcuuuugacagggucguauaugguccaggcuggucuugaacucaguauguagccuauuauuccuuaacacucuugcuucuaccuuacaaauacuggaguuaagguguguacuccauaccccauucacaaauuauaaguuacuugaauuuuaaacuauuuucauuuguacucaaagaaaauuucaggauaugagguucucugcaguguucaggaucauuaauaguuacuaaugucaauuuguauuuaaguggacuaaaagugucaagguaacaggaugccugaaaaauuacugugauucugccucaaaacaauuauuucagucuuauuuucaguaaaauguuuucgaaugcuguuuccguaugcuuuuggcuuuauuuuuuauugugcuucucccucuuacuugauugggguuuuguuuguuuguuuguuuguuuguuuguuuguuuuaauggaugaacaaagaaauuguaugcugcuaugcaugagccagauggaguggcuggaguaagugcaauucggaaagccgagccaucccugaaggaacagauucuugaacaugaaaguauuggcuugcugagggaugccacugccuguuaugacagggcuauucagcuagaaccagaccagguaagaugaccauuuaaaagcugcuaaguaagaaugguuguggucuugguuucaaaaccauauugcucagugucauauguaucuggaaaauguuuaaaacuaaccuuuaauucccagaccauuaaaacuuagagacuuguccuuuaugguuuuagaaauucuuucuaaugcuaaacuucuaugacuuuaaaaaaaucccuuaaauuagggcuauagcucugucaauaaagugauugccauguaugaagaccugaguucaguucccagaacccccauaaaaauaucagguguggugucaugcacuuguaacaucaguacugggggcacugagacaggcugauuuuugggccucccuagcuagccagccuagcagacuuggagagcugcaggacaugaggaacugaucuuaaacgggggucgggggcguugggguggauaaugcagcucuugagaaacaauacccaagauuaaccucuggucuguaugcacaaccagcguacacaccacuaauacaaacauauauacagacagacaaaagaacucucccaaauuagcuagaguauauuuauacugauaaguacauuuaguaauucuauaauguauuucuuuauuuuauauuuuucuuuuauuauuuauuuauuuauuuagaacaagggggaggcacgguaucaugcagcucagucuugccucaaacaaacuguccucucaugauguuugauuuaauuaaacacaugauguuuacauuaucaucuugacagaauggagaaucuuuuuggauaugagccuauaggcaugucuguaggguacuaucuugcuugcuccuguuaauggguagaccuaucuugacuauggguaggacuauucucugagggguucuugaacuauaugaggugaagaaaaugagcugagcaagugcuuuagaaggauugucuccuguguguguucuagaucccaucaaguugguaauuaacauuagccaugauauuaaagcuccaaaucuauauuaauaauguuguaucuauugacuuaugaugcauaaucuuaaacaagaugcuaaaaauauugauaccuuauguucucuauuugaucugaaccaaaaauuggaacaaacauggaaaaauaaaauaaauucaacuaaaauuauuuuuuccuguuacuuucaauauguuacaacauugguagugagugccacuacauagccaagccagguaguugcuaaaccaggaaagguacauauaagugggaauauaggaaauuaagauguucuuauuuccucagcuauauuugaaauuaaauuauuaucuuaaauguuuuuuuuaaauuucuagaucauucauuaucaugguguugugaaguccauguuaggucuuggucagcugucuacuguuaucacccaggucaauggaguacaugcuaauagguaauguuuuauuacagaauuguuuucuuuuuauucugaauaggaacguuuugauuugugaauugcaugguuuuauauucacuaaaguaaugaaacauuuuauauguuuuuaugauguuggagauagcaccaaaauuauuguagggcaggauuuugugggagaggcaugcauguguggaggccagaggacuuuugggacccuuaaguuacuucucaggugugaggcuuacguagcaaauaaccucucucuacuaagcauucaugcugcccuuuuccuacuuuuuaaucuuucaucucccuguuaauagcuuagcuuuuauucauagagucuagaaccauucuugaauagauuguucuuuuguuauguuucauuuuucaagauauaguuucucucuguagcccuagccauccugaaauucauucuguagaccaagcuggccucaaacucagagauccacuugccuaugccuccugaguucuagcaucaaagcugugugccaaaaugcccagcuaaauuaaauuguucuuuaaggcaagaacuauucagaguucaccugucauugauaugaauaguuaccuagcuucaaaacucaucagaguucugacuauaguauuaaaaccaguuguuuaugcuggaaguuuuuugaaauacuacuauaaaauuuauuuugucuaaaagauccauaauugugaaaacagucuucuuuuacuaaagaaaguagauuuauuguaguaaauuguaccauuccucuaaccaaaaaaaaaaaaaaaguuugcuaauagcaaagaugaagauugaacauuuauuucaauugaaagauuaaugaggaaauuaucucugcucuuggaaauauuuuucccggagagcuaaacucccuguuuuguuauauaucccacaccccagcuauucuaggcaagcagauuugauccacaagcuaauuagagaaucagauuauguuuguaguuacauacuuuaaagcagccuaucuaauuucuguaaguuaaaaugugugauuaauaaggaccuccauucuacauugagacagaaacacucacuuuagugugauaauggagcuuaugaagcaauugaaguuaugcagaugaagggagauugcuacaugcuguagguguguuucugcacauugaaaaacaccaucaauaaggggcaacaggaguuugauaggggacuuugugguagcacagauuggugugucaaguucuuuaaaauauacacuguaaaauuaaucccucuuguuuucugucuaggaccuaauacaugucagucuguggguuguggaaaggcucuggucaugucagugaaaggguauugcaucacaguaacgaaaaaugaucaacaggggcucagauuauucucggggaggaucucuauuugcauuuaaacaguucuuuuucugugcuuaaucuacacauaauuccauuuaauuaauuuauuuuaauauucccaucuuaauccucauuaauccuuaaucaucauuugguucuuuugauauaaagcuugggaugacacaucucugauacuccaauaauaauuauauucuuaauccugaaauuuugauacuuuggcauuugaugcuaagcuuuuaaaauuauuuucaguuagacuuuggaauuauaaauguucauuacuucgcauuagccuugcucuacauuggcuucaguaauaugaauauuuagaaauugaaguauguucaguauacugcuguuuuuagacuuuggggaaagaauguuuuucaacaggucucauguagccccagcuggucucaaguucacuguguagccagggaugaccugaacuugugguccuccugccuucaccucccaaguucugagauuacagcuaugcagcaccacaaugggucuauaugaaccuagggucuugugcaugcuacacaaauacucuaccaauugggcuuaaucccagccccauuuguagaucuuuaaaacuaaauguuauuaaguuauuugucauauuuugugauuuuugcuauaaaaagacgaggaggacacuuaaggauauugguccuaaucuagccuugcuacuuuguucguuuuuuuucaguguuguuuguguuuuaauaauauggguauacaacuaccuuuaugugauguuauuagauaaggaaucaucauuuuauauauauauaauuugaauauuggguauaagccagauuucuuauccagaauuauauacuuaaaaaaacugaaggcuagcugcuucugugcacucagaauccaaaauaucacuguuaaucucgugucauccuaaguagaguccuuagaggaaaaucgccaauuaauuggggaugggugacuauuucuuuuucuauugcugugauaaaacauugacugaaaccaacuuggagagaagguuuuuauuuuggcuuacaaguuaccauucaucaucaaaggaagccaaggcaggaacucaaggaaggaauucaagaaggaauaaaagaaaagaacauggaagaacauugccccuaguuaacuaccagucucauauuuaccuaacuuucuuaugcuggacagacccaccuccccaaggauaauaccacccuuagugcagugggcacuccuacagcaauuagcaaucaaaaaaaaaaaauguccauauacauagccacaagccagugugagacaguuucucacuugagguucccuguccucaggugugucaaauugauaacuaaaggaaccaggacaguggcacuaccuguauuaguuccuugggagguugagacaaaaagaugacauaauaagccuaggacuuuggggccagcuuugcuaacauagcaaggccaccuuuuaagaaauagacaggaaggaggaggaaagaaagggagaaggagagaaaagaaagaauuauuacugauuuugcaaaucaaaaauuccugaauaacugaaaauaggcuaagaaaacauauauaugguauagacuguuuuuguuuuguuuuguuuuaauguuguaaguaacuuucuuaaaucuuucuauuggauagccuaugcaggcuccaacuguccaugucucauaccaaaaaucucaggguuuuuuuuuggaagugcuuuacuuugccuuaaauuaguucucuuuuguuugaucuuguuuuaaguuaaacauacagauaauuuuauagagaacugguuauuauugggcaauuaacccuuuucuaauauaugccaaaauucauuuuaucacaaaaaaauaauuuuuaaaaauaucuaucagaaauaauuaguggagggcuagcaaaaugcucauuggguaaagacaucugaugccaaaucuuacugagcugggcucagucucaauaacccacaugguagaagaaaugaauccacauccaguaauuugauuuuuuaccuucauguguguccugugauauauauucaucagcacacuaaauaaaugaauaaauggaugaaugaauaaauauauaaguuucuuuagguaguuuuuguucaguugguugcuugguugguauuuuugugacagagucuugcuauguaucccugauggccucaaacucauaaaaauacaccugccccuuccucucugagugcugggauuaaggguuaugcugucgugccuggcuuaacuuuuaaaauauuaguggaaaauguucuucagcaacaaaagacuaaaaucuuuuugguuguuuuggguaauuacuuugugucauacuaugacauacacuauaaaugucacagcaguaaauaaguaaaauaucuaaaccuauaaaaauauaaaugcugcuuuaaauguaaauagauuagaaugugguugauaugcuucuuuuaauaggucugaauggacagaugaauuaaacacauacagaguugaagcagcuuggaaacugucacagugggauuugguggaaaacuauuuagcagcagguaaaguuacuucuuaaaguguuagcagcuuuucauugcuauaaauauuccaauuuagauauuuagcaaauucucaauuauuuuggcucauuuuaugauugucucuguuuaguuguuugaaguagaacagaaccgucuguugaguauuucuucugauucucuuauuaagugcagcaaagccagcugcuccuggacccucucaucacagcaugucuugacuuguuuuucagacgggaaauccacaacauggagugucagacuaggacagcuacuguuaucagcuaaaaagagagacaccacaacuuuuuaugacacacugaagcuagugagagcagaacaaaucguaccucucucagcugccagcuuugaaagaggcuccuaccaacgaggcuaugaguuuauugucagguauuuuugggauaccacuuuuauguuucuccuuuauauaugucaccuaggacaauuuuuacauguaaauaaucucauaauguuuuugguauauugcuuaacaauacaaauuggcucuuucauucuuuuuuaaauauccuaacauagucuccuuuaagucuaucuauucacuugaggaaaaaugguaaaaauaaaugcuauaauugaaguacuauaaguuuaaaagcgaaauacaguucuuuguuagaauuuauuauauuuuguaugaucuucaauauuaccuuagugaaaccagauauuggaucacugaauuaaauuucauucuuuagcuacucagcuauguuuuugugccuucaacacugagucauagacagauaguaugacuaucauggcuucuaucaccuagauaaaauuagcuaucacuuuacagguuuguuuuuuacuguauuuacuauaucaggcccucuuacauuacuaccaguguuauauaaauauuucauauucauuuauagugaauaaauauuuuacuuucauguuggcaguaaaguuuaauucucauacauuugaauuuaguuuuuauauauccuucaguuuaacaagaaaucagggaugacaucaagguacugaaugauuuaguguaaauacauuguuguuuacacuuaaguuuaaucauauaaaaguugccguuuauauaccaaaagaguguuaaaagguuacuuuuucauagcugaucuaaagugcauacuuaauaucugagguuaauaagacugaacauuguaauauuuuaacauguucugucugucuucagauuacacauguugugugaguuggagcacagccucaaaccgcuuuuucgcaagucuccaggugacaguuguaaugaagacucucugaacuggggagcucgacuugaaaugacccagaauuccuauagagccaaggagccuauccuggcccuccggagggcuuuauuaagucucaacaaaagguuguucauacuucuuuaaaaagucaauugucuuaaauuuaauauauguucauacuuucuuggaaaguguuuuuuguucuacaucuacauuuucuguuuuuaguucugggaauucaucacauaguugaaacauaccuagaccauaauaaucauuuuuacuaaggacuggagagauugcucaguccgugguaacaacacuugcugcucuuucagaagaccaggguuagguuccaagcacccacauggugguuuacaaccaucuguaacuccaauuccaagggaucggauacccucuucuggcccccauagguaccaggcacacauauagugcacauauauauaaacagacaaaaugcuuauaugcauaaaaguaaauaaguaaaacauuuuaagauaaacugaaauuuuaaaauguuuuuaaaaaaucuaaagaaucuguuuuauagccaaacaugauauuucaugccuauaaucucaguauucaagcagcugacagaggagacacuucuuagauguccauugagccuucauagaagaccuguguaaaaaaauauguguguguauuuuaucuucaaaauuuuuuaaauguaaccaauaaacauaucuugggaggugaauaccaacacaagucaagaauaaugucuuaugcaaggauaaguuuaggugcaguaccugccuaucaaguagacuuuggguuugauucuugauaucaaaaaaaaaaaaaaaggcaacaacaaaaaagaauaaagcccagauagacuuuaagacacagauggaacaguuuguuuguuguugcuuuacaaaguaagaauugaaauagcacacugacaacguucuauguugggaagagcuguguaaguuauugaauauacuuacaaacauuacuuuucuauguuuugcuacauuuuuuuuuaggccggauuacaaugaaaugguuggagaaugcuggcuacagagugccaggguagcuagaaaggcuggccaccaucagacagccuacaaugcucuccuuaaugcuggagagucacgacuugcugaacuguauguggagagggcaaaguggcugugguccaagguauuggccaagggaaccucauuagaaaauguucuguuggcauuguacaugucuaccaaaaugcagcugggaaauccuuaguccagauucagaacucuuuuucugucacuugucuucauucucuacuguagucuagguagaaaggcugcugcugcugcuguugcugcuucuuuuagauuuauuuuuauucauuuuauauguaugaguacacuguugcucuccucagacacaccagaagagggcaucggaucccuuuauagauagaugguugugagccaccaugugguuucucggaauugaacucaggaccucuggaagagcagucagagcucuuaacugcuaagcuaucucuccggcccugaagacugcuucuuauauuccguaguccucaaauaaaauaccuauuuuaaguuugaugguaauguucucucaguuuucaucuguccuacauauuucugaggaaaauguccgauucucaguacauuucacuuucuggagguauauaggauauauguaguagguccucaguauguaccucauaaaugauuauagcaccuucucacuuaauggcuuugggaagaaacacuuguguguggacaugucaucaccugccagggaagacuaagcuucaggacacacuccaagccuccagacuccagcaauagaaauaggagcuuuuuaaauauaugaacuacuuacuaauuuuaugucucauauuuaaaugguaauuacuaguuuagaguuaauaguaggcacagccuguuuugcaguuaccauuuuguagcucuauguaaagccauaugugauuguagaaacuuagugaugauuauuagaggacaugggagguguuuucuagagcgauugggaaaguaguaaucgagccuguguuagaugauaccaauguuuguauugcuaaacucaauaugcucagaaggcaguucauuacuuaauaaaaccuauuucucuuuucacauugcuucuuuuucugaacaagccacauuuccauccccuuaucuagaacaaaucugggcuuuuaucuucaacucuuccugaaccuguacauccacauccagucuuaggcuaagucuuugcuguuuaauuuuagaaauguuuuuugaaucauaucucuuuuuccuccuauuuuaauuaaugccauuauuuucagcaccuaacaauacacagccuuccuaaggaucucacaauuucucuguuuacauuacuguagucugugaccuuuccaaaaugcacuuggaaacauacugcuuccuuaaaagaguaaacucuucuaaauggucuucagacauuuuggauuaagugugaacucuuggaaauacacaaguccguuucugguugagugcugacccaucccuucagcuucauuuuuccccaucuucacagaugcuuuauuuaagcuucaccuaaaaugagacugcugcugcuacucagacauauugggauuauaucccaguaagcucauuguaaauugaaaaauacguuaaagucagaaguacauuuauaucccaaaccuagcaaacacugaagcuuggccccaguguuaaauuaguccccuucuucagcuuggcuuuccaucaccugagaucaaccuauggcugaaaauauuaaauggaaaucucagaaaugauccauaaacuuuaccacuguagugaucaauuuuaaaaauauuuaaauaacucaacuacaguguuuuaaucuuuuauuguaccuuauucauaaauucaacaccauggauauauauauauauauauuugagggaaaaaaccuaguaucugugggauuucuacuauucauaguuugaggcauccacugguagucuuagaauauaccuuuugcaaauaaggaaaauuuacauacugauaaguaucaauuguuuacuuuuaucaguauguagacuggcaucuguggcucacuaccauugaccagaaacugcuugaucauagaucguaauuuaaaguauuguuucugcuugaugugauaguauaggccugagauuauaguccucagagaagaaaaaucaagggcagucugaucuagauaagaaauguuaugccaacugggaucauauagugaccacauuccaaacccucaagcaucaaaauuaugugcugcuucuaaggcuagagaaauggcuggucauuaagaauauuuguuuugggggcuggagagguggcucagcgguaacaaacacugacugcucuucuagagguccuaagugcaguucccagcaaccacaucauggcucacaaccauguguaauaggauccagugcccucucuuggugugucugaagacagcuacaguguacuuacauacauuaaaauaauuauauauauaugucauagcauauauuauuauauuuuagucccagcauccacaugaaguggccgaaaccuaccuggggaucugacgcccucuucuggccuuugaguacauguauacauauguggcaaacacacugaggcccacacuugaauauuuguacacauagaauaaaacuaaaaugccauuuacuaaauugcaugccagaaaaauugaccagauuuaagauuuuguuuuuuucuguuuaagaucaaaaucagauuuuuuuuuuccuuucuugacuacugauggcuuacucacacccccuccuuacccccuccuucuuuuuagauuuucaauacuguuucuuuguguauccuauauggaccagacuagucuugaacucauagagauccaccaggcucugcuucucaaguguuuccugcucucuuauuuaucugugucuuuagauagauuugggggacuuucuuuaucccuauguuuauauguuauaacacucaaacauguugguguuuuaccuaguuuguuuccucaguugauugugaacuuguuuuauuuuauucucuuuguuugguugcuugguucuguuauguugagacaagaucuaacuguagcaaaggcugaccuugaacuugugauccucuuaccugcaucuucugaguaguacaaauauuauaggcauacaucaucacauccaauuaacuaugaacuuuuuaagccaaagauuuaauuuaagauucauuguuauuccagaucaucuacauauaucuucaguucccgguacuuuaauuuuaaaaugaaugaguaaacaauugaaugauuaaagaguucuacaugaaaugaaucagugcuuccuuaucuuuuauuuauuuguuuguaauuagauauuuucuuuauuuacauuucaaauguuauccccuuuccuaguuuucccuccaaaaaccuccuauccucucccccucccccugcuccccaacccacccacucccacuuccuggcccaggcauuccccuauacuggggcauagaacauucacaggaccaagggccucuccucccauugaugaccaacuaggccauacucagcuacauaugcagcuagaaccaugaguuucuccauguguuuucuuugauuggugguuuagucccagggagcucuggaguuacugguuaguucauauuguuguucuuccuagggggcugcagaccccuucagcuccuuggguacuuucucuaacucuuucauuggggaccuuguaccuccguuuaauagauaacuaugagcauccacuucuguauuagucaggcacuggcagagccucucaggagacagcuauaucaaucucccgucagaaaucucuuauuggcaucuacaucugucuggguuuggugguuguuuaugggauggauccccaaguggggcaguuucuggaugaucauacuuucagucucugcuccgaacuuugucucuguaacuacuuccauggguauuuuguucccccuucuaagaaggauugaaguauccacacuuuggucuuacuucuucuugaguuucauguguuuugcaaauuguaucuuagguauucugagcuucugggcuaauauccacuuaucagugaaugcauaucauguguguucuuuugagauugaguuaccucacuuacgaugauauccuccagauccauccauuugucuaagaauuucaugaauucauugucuuaucuuuaauauggagugguagauaaacuugaauuuacaagugaauuuguugagacaagguuucucaguguggucugguagccucaaacucagagauuugucugccucugccuccagaaugcuuggauuaaagguguauaccugcacagccuggcuaaggaucuauuuuuaaauuaaagauguauuaauugacuuuuccuuuucagggugacguucaccaggcgcuuauuguucuucaaaagggcguggaauuauguuuuccugaaaauaaguccccaucugagaguaagcacaugcuaauccauggccgggccacacugcuaguuggccgcuuuauggaagaaacggcuaacuuugaaagcaacgcaguaaugaagaaauacaagguauguguguaauguaaaccauugguuuuucuuuuaauggauuaaaugaauuuuuaaaucuauauugaaguguauauguguaauaguacucaggacaacugacuuuuucuuaaauaaaguuuauaaguauauggaauuaucacaaaugaauauaugcaugagaccaccaccccagguuagaaauuguugcacagugaaucuacuucugagaccaacuaccaaauccugaaauaguauagucaguacacuauagcacccaccuuucaccgaaguaacaaucuuauguuccuauacaaaguaaccacaucugagccauuuaauaaacuugcuauauacucaaagauggccuugaaauucugauccuccugccuaacauaagugcuaggauuagagucaugcaccaucaugcccuguuuaauccacagcugagacuuaaacucagaaucuuguccauguuagacaaacacuuuaccaacugagcaacaucccuagcccauggaauuucuuuauaaaaaauaauguaacaucucuaccagguauuaaauuuuacaagauaaaauuauaaacgacaaacaccccaauaauguguaaaaaaaaaaaacagaaaugcaaauucaaaaauaccuaggacuuuuauuauaaaaauuugcugcagauagaccucacuuggguccucgauccaugggcgaaacucaggguucugguuacaggcgggcaaggaguuggcgagaaaugacaaacaaauacgaacacagagugcuguaucaaauugagcaucaaacuuuuaauacagaagaaaauagguaaguuagguggcacaucggcaagauaaaaugaggucaccagaugcuuaaugacucuuacacaaaacagaagaaugcaaacacaaagacuggcaggaacugggcaauaaaacaacugagacaaagucagcucuauuuaaggucagcuguagucuuagaagccaggugugaggucuuuacacucccggggcaaaggcuuucacacccaagucaugguucuaauuagggaguucugcucuagcuaaccaucucaugaauaaugcaauacucuaguuccuccucaaacccagacagaucuacuuccuaaaccauuguaaauuccuguauaggggagugacuuggcuuuuauucuaagucauagugugagggggcuuucuacuaauaaguaauguagucugcgaguggaggugucuaagaacagaggagugucagauccccuugagcugagguuauaagugguugugagcccccuugggugcuggggaccaugcacuacaggagcagcaagugcuuuuagccuugagccaucccccccacccccuuuuaaaacacuuucuuaaaauacaaaaagaaaccaugcacccagucuacaaguaacuaaugccuggaccacuagaaaucugugugaggaaaagauaaucuaauuagcuaaauuuacuucgaaguggguuuaauaugcaugaacugagaacuuauaaacuuaaauaaaagaaacagaaggaaaucuuuuuaccuuaguuuaggcagaaguuucuuagauuaaaaaaaaaaaaaaaaaaaaaagcuuuaaccaaaaagaaagccuuauaaguuggagauccaugaaaguuaaagucuacuguagaaaacacugucaacaaaguaaaaggaauggcgcugacuggggaaaagacacggugucuguaccagcaaauucuaaagaacucaggacaaauaacucaaaaccuggaauagacacuucuuaacgaguacauacaaauggauaaaaggcccaugaaaacauguuuacugacauuaauuaguaguaagguacaaauuaaaaucacagugaaguaaccacuugaaagucuagaaugacuaaagucuaaaaggcuagcaaacccuuauugugacaacugggucccuucucaugguugguagcagucuaaaauguaacauacacauaguauaauacuagccauucugccucuagguauguauuuauauacauaauuuuauauacuuaagguacauaguugauaugaaaauuuuaccuuggaaaaagagaugugauuuuucaaaaaguagagcuuacuuagggagcugggagaaggcucagcaguuaaagugcuugcugcucuaguaugaaaccuggaguugggauucccagacacuugugugcaugcugggagcaguucgccuguaauuccaccccagggagggcaagcuaccuaucagugcuagccauguuggcaaacucuugguuugacugagagauucugccucaguuaauaaggugaugagcaauugaggauggucccagaaauaaaguucuggccuucacuuguacccacacacgggcacucucaugcauauacauuuauacaccacacacacaagagaaauggaaaaagaaagcauaaaguaagaaauaccauuuaggagagcaucaaaauauaaaguacugggguugucaguuaagcucaguaugagaaggcccuggguucaguccucagcucugaaaaaacagaaagaaaaacaaacaaaacaaaacaaaagaaguauaaaguacccaggauuaaguugcucaaaaaucugugaaaccuauacagguuauucaauaucaagugguuagcccugaauacauacauacaaucugaacagguuauauguaugcccuuagaaauugugugugugugugucuaccuauguauacaacaacagcuaaugaaaauaaggcugugaauuuuaaagagaccaaggaguauaugagaggguuucggaagggaaaugauguaauuauaaucuaaaaauaauuuaaaagccuuuaaagaaaagaaauucuaaaauauuauugggucaguuuuuauuuuauuuauuuauuuuuaugugauugggucuuuugccugcauauauauaucugugcccuauauauauaccuggugccacuagcagccagauagcacccuugaccuggaguuacaguuaauugugaacugucauauggauacuaggaauugaaccugaguuuuuuggaagaguagccaaugcucuuaaucacugagccaucucuccagcccuuguaugcaauuggauguagcacagcuuugaaugagaagacucgauaaucuaaagauguuauuucacaaaaaaaugaccaguaaguuugauguagucuucaucaaauacuaauauuuaaaagcuauguggaaaugcaaaggaugguaauaaccaagagauuuugugucucugauuucuuaaaaaaauuuuuuuaaagauuuauuuuuauuaauauauguaaguacacuguagcugucuucagacacuccagaagagggagucagaucuuauugcggaugguugugagccaccauguaguugcugggauuugaacuuuggaccuuuggaagagcagucgggugcucuuacccacugagccaucucaccagccccugauuucuuaaaauuuuuauauuuuaguuuuaauuaaucauaaacuuuuaaaaaaguagcauggugaauuccgguauccuucauuagguucuccaacuuuauuaauuuguacagucauaguucuauuuucagaaaauuuaccucuuuuguuaaugucuuuugggucuagaaugcauuucaggauccuauacaguauuagccaucaucaucauuauuauuaacguauucuaguuaguccaagauaccuuuauauaaagugaauguagguagaaaacagauagcaaauuaagagauaauuaacaguguaauaaauaacuauguuaaagaaaauuaacagaggauggcgacucaauagcauuucuagaucugaaggaacaagaugcaagagcguuuacugggcuaaaggauuauuauuauaggaaggaguaauagaccacacucaaacauggaagcaguaagaagaccagagaauaugacaaccuugaccucacuccuauucucuaauuucccggaccugauuagaagcuagagggugaaugggcucaauaauugaaauuagcagaauugcaucccuaagugggauagaaaagcuauagaguagaaaguauaucuguugaaaaaaaucagagacuagccagcaaacauauaaagaccuauaaaggcuuuauaauuaaaauacuauauucgcauacaguuagauaaaccagaagaacagaacaaagcccagacaggcuauagauuauuauaaaauaugaaaaaauaaucuucaagucauggugcuaugucauuuaaacaucuuacaggagaggggguuagugauuccuuuguaucauaaacaaaucaacuguuaguauaaguuggaauuuccuuuuuagggugggguuggcaguugaaaucaaaucuugccuuguauuucuggcuggcucgguacuuacuuagucagcucauacuaguuucaaacucaugacacuuuugaaaaccucagcaaccuuaguguaacauggugagacaugucuauaaacaaacuaguaacacuaagcguaggagaaaguguaauuuuauaagaggcuaauagucaugaauauaaucugaccuaucaugucugcauaggcuauauacaagaauguucuuuuuugaggugggguuugguuucugauucuuggugggggaguuggauuugcauguguuauuuuuugacaggauuuuacuguguaucccagauuagccuggaacucacuuugcauauguaucccagauuugucucaaacuuaccgaaauccuacuuccucagcuuccugggugcuagaaaucuagguguugcugccacaccuggcaagcaugauuaucagcaucguacauuugagcgagcuuauuuuucggacugaauacuaucaaaccaaaguaacacacaguaacuuaaauuugcuaugugaugcaaacucuugauuuuuaauaaccuauuaguuuuuuaugccccagccaaggguaagauuugcuuauauaugugacauaugucuuuuuuauaggaugugaccuuguuucugccagagugggaagauggacauuucuaccuugccaaguacuaugacaaauugaugccgaugguaacagauaacaaaauggaaaagcaaggugaucucauccgauauauaguuuuacauuuuggaagguaaguaugagaacuucauguuugagauuaaaaauggaugaauguuaucucacaucauggcauacucaggguguuuucuguuuuaccaugugugaugguuuguauauccuuggaccaaggaguggcaccaucuggaggugugggcuuguuggaauaggugugaccugguuggaaugggugugucacugugggugugggcauaagauccucacccuaguugccuggaagucagucuuccacuagcagccuuuggaugaggauguagaacucucagcucugcuugugccaugccugccuggauacugccaugcucccaccuugaugauaauagacugaaccucugaaccuguaggccagccucaauuaaauguuguuuuuuuuaagacuugccuuagucauggugucuguucacagcaguaaaacccuaacuaaaacaccaugcuuggauucauucuauaguuguaauuagagaaaauauuuuucuuucuuuuuccuaauguuuaauuuacuuuauguguauugguuuuugacuauuugccugcauguguguauaccaugugcauguguaguacacuuggaagccagaagagggcauuagauuucccuggaacuggguuagaguuaggaacuaccuuguagguguuaguaacuaagcugagguccucuauaagagcagccagaacuaagcuaucuccaauccaagaauauuuuucuucauauaauuuuuuccuuagucuuaaaaaaugccuuuuguaaauaaggcugcuaugaacauaguggaacauguguccuuauuaccaguuggaacaucuucuguguauauguccaggagagauauugcuagaucuuccgguaguacuauguacaguuuucugaggaaccuccagacugauuuccagagagguuguauaagcuugcaaucccaccaacaauggaggaguguuccucuuucuccacauccucgccaguaugugcugucaccugaauuuuugauauuagacauucugacuggugugagguggaaucucagcguuguuuugauuugcauuucccugaugauuaaggauguugaacauuuuuucagguucucagcccuucgguauuccucaguugagaauucuuuguuaagcucuguaccccauuuuuaaugggguuauuugaauuucuggaguccagcuuauugagcucuuuguauauauuggauauuagucuccuaucagauuuaggauugguaaaaauccuuucccaaucuguugguggccauuuugucuuauugacagugucuuuugccuuacagaagcuuuucaauuuuaugaggucccauuugucaauucuugaucuuaacagcacaagccauuuuaacuuuaauuuuaauuuuuuacucuuaguauauaucaggccccuuaguauaucacuucuuaaaucacacuccuaagaaggaagguauuuuacauuuuuuuuuucugucuuuugguuguuauuguuuuuguuguugauggggauuuuguuugugauagguucuugccuauauagcccaagcuguucucucagccuuagcuuccuaaaugaugggauuauuaaauguauaguacuacucucagcuucuacagcauacuuauagcugugauacuguaaauuuuggauuuuuguacuaguauuuaaagguuuuauuaucagauuuccuugcuuuauuuuauguguguuuugccuguauguauguauguauguauguauguauguauguaugaauauguaccauguaugugcuuggugccuaugaaggucaguagagggcaucagauccucuggaaacuggaguaauaaugaaugauaauaaaccacuauguaggugcuacaaauccuagguccucugcaagagcaacaagugcucugaaguacugcaccaucucuccagccccuauauuuauauuuucauaagaguaaaaauuagcuguuaaguuauauucacuugaauaccugaauguaccuuaaauaauuguuacuacugcuuuagugugaauguccucaaaagcaguuuaauuauaguuaaugaaaccuuaaauauauaaaacauuuagauaauaguuuguaauagaacuuguguguagauauaaaaauggaugauacaaauauuuaaaaaaaacuugcuuggcagggaaguuaucaugauuacaaagacugaggaucgggggaugguuuuuuguaggcugcgcuuagccauuauacucuagcugugcugucacauguggcuuuuccaaaugagggaaagccacuucguaguuugugguagugaugguuugcguucacacuuuucccugggaauggauggagauguauaugcaccauaccagaagcaaagcagauacuuguaaagguuauauauuuugggaaagucugugauaaaaacucaagcuacuggcuucaggauuauaaacauauaucucguucugcaucaucuguaagugggaaaauaugaagaaaaauauagaaaugaaaucucucagaaauagaaugauuaggccugagcauuaagcuuacuaccauagaauacaaacugagguccagauucuaaggaccauuugcaagaaguauuaaaaaguccuuugacuaacucaauauauauauauauaauuuuugaugcaggcuaacugaauacuuuagcaagaaaagauaaaagaagggaaaauaaccuacugugaagaaauaucaguaccauuguuucagggacuaggacuauuaucacaguagguaaaguguauucuugucaugcaugaagcccuggguuugauagguggcaccaaauacccacccaugccuguagucgcuaacuugggagguagaagcagaggauucagagucucaucucagcuacauacugcguuagccagauagauggauaaguaggugauacaguuuuuaucagaagacuguacauaacuaaaguuuaagcuuuuacauucuaguucauauaaccuacaaaaaacuuucuugcucauauaauugcagaucucuucaguauggaaaucaguucauauaucagucaaugccacgaauguuaucgcuauggcuugauuuuggugcuaaggcauacgaaugggaaaaagguauaacuuuauguaacaauuuuaaggcacuaggaagaaauauaacuuugauauaaaauaacauuuggcaucacaauuucacuuucuaaaaaccuguaaauaauuugauaauaaauaguaaaauacuauaauguuguaagaaaccuaagugugggggcuggaaagaugguccaacaguuagagcacacacuguucuuguagaagaccugaguguaauuccaguacccauaucaggcagcuuacaacuacucacagcuccugcuccagcuccagagauccaaacuuuuguccuccacgggugcauaugggugugcuacacccacaaaaacacaagcauacucuugaaaaauaauaaaaauuagucuuacgaaaacaaauuaaguauggggaaaaaaaaggaaagauaaaaccauagacuuaaaguacuuguaauuugggaaugcaaaguuacaguguuuuuauuucuugauaacccuaauacuuugaaagauguggguuuaagcguguaauaccacaaaacuuacagcagaugaugaaaacaaaugccucuucgaucuaaaugguuuuccuacuuacacagucuugucagacagcuagcuguggguaugccaaugauguauuuuuaaagcuguuuuaucaguuugauuuuuuuuuucugugaaaugaauugaaauacugaugguguuuguuuucuugucuuaaacugguuugcccucagguggucguucugaucgucugcaaaugagaaaugauuuggcuaaaauaaauaguguacucacagagcacacaaaucgguuagcaccauaucaguuuuugacugcuuuuucgcaguugaucucucgaauaugucauucucaugaugaaguuuuuguugucuugauggaaauaauagccaagguauuucuggccuauccucagcaagcaauguggaugaugacugcugugucaaagguaaucauuagucacccagugugacuaccacuuauuaugaacaaguacauaaauacaaauuccaggguucuggccuauauuguuaguaauuuuuaauuacuuucuauauagagaaaacauuuaccucauuuaauaucuugaaauacguauuguacgaaacaaagugaccaguaugugaagauuaaagacuugaacgcuuggugcuguccuugugaagcuuuuaguaaauauuuauaauagcaacuuuuuaaaagauugauuuuauauguaugaguguuuaguuggauguauggcugugcaccauuuauaugccuggugcucagaggucagagaaacuguuggauucacuguaacuggaguuguuaggaugccaucaggaugcuggaaauugaaccuagguaaacaagugcucuuaaucgcugagccaucacuccagcuauguguaacuuuuaaguguuuuaauccaagaucuugaaaaucuauuaguacauuuaaugaguaaauauuauagaaaagguaguauaaagauaaaaagaaaauuaaaauuuagacuauucauuaguuuuuuucuuguaacuuuuuaugcauuuuuguaaucauauuuugacaggaaauuuuaauuaaauugacaauuuuauuuucacuuaaauauuuaugauuaaauaaauuauuaguuaaauuauauuauauuaauauuauuugacaacacauuuuuguaauuguacaaaaugauaaaaauagcugacuauucauuaaaucauuaagguuuuauuuuauuuuccuuuuuucuguugugcuacauccaaaauauuggauuguuucuuuaaaaguauucacaagcuguaggauuaaaaugguguuaucaaauuaauuuccuggaugcuuaucauuauaaauucacaucauaaauauucuuuuaaguugauucuuaccauucagauuucauauauaauuguauuuauccucuuuuuuuuuuugauugacagucuucuuaucccaugcgugugaacagaugcaaggaaauucuuaccaaagccauccauaugaaaaagucuuuagaaaaguuuguuggagaugcaacucguuuaacagacaagcuacuagaauuaugcaacaaaucgguacuaucacugaucuuagugcuuaucagccagugugaaauaguguuacauagaagcuuaucuaugauuuggguuauauguuucauuaaaguuuuuaaguacaucaguauauuuauagcaaaauacaucaaaugcuauauuuuaaauauauaucucuguaucuuuucucccccugaucccuuuucuugauaugcuagagauugaauuagaaaccugaucuugcuaaacaagggcuuucccacugagcuauaacucuacccccuguaugauuuaccuuaauaaaccuguuuuuuuuuucaauuuguaacauaugacccucuuucauguguccucuauuuuaauaguuaucaauaguucuaaauaaaaaaaaaacaacuauauaaaauauuauaaauauauuuaaaaugcucuaaaggagucucuaauuauauugucauauccuuaagcuuugaaaacuuuuauguuaaucuaccuacaugauaggaaagugaauggagggcuuuuuguuaauugguugccuuucuauaguguuagauaucaaacccaaggcuuuauccauaguagacaagaacuuuauacaugagcccuugguuuucauuuuuucaggguauauuucagggcacaggcauuguggugaaggaacaaagaugacugguagaaaucugucuagaauugcuggugcauuuguaaggaaguaagcaacggcuauuacaugcaguagcaauuacuguuucaauaugcuuguaagugaaguaggacggugauaacagaggaagccacuguucuguguaaggacuagaggggaaagcugaauguaggagagagaaaaguguauggggugaguuuuaaagggaaagguucuuuuucaggugaacagcuaguucacuugacagucaaaauccaguaaccauuucuagguaaaaagauacagguggcccuauuuuuucccuuuccuuucaaaagcauaaucuuuaauuauuuccauuaauucuacuugaccucugaugaacuugacacacuuacuuauucgauauaaguguuuacauguucaagugccuacuccuuuaucugaaaccuuaggucuuuaucagaaacuacacuuaggaauucauuuuuuucucauuuuaaagguauucauacuuauauuggcuauuguaacugaugauaauguaucagaauaucccauaaucaaacacacauagcauucgaaauucaguaucauuuuguuguuaaaugagauuugguaaaaaguuaauuacagauuuucuuaugucugauaauagaucucugguuucuacuaucuccucugguccuuaaauauuccugugauagaggaauguuauuuauaagguaaaagagguuuaaaugagaugauuaaaaauacuuagacauuucacauuguugaguaauugagauuauaaaaguaaaauauuuacugugauuaaaguucuauaauucaagguaaacucagaaaaauugaaauauacuguuuguuuuucaggucgauggaagcaauuccacauuaagcaugagcacucacuuuaaaaugcuuaaaaggcuuguagaagacccgaccuucagugagauccucauuccccugcagucagucaugaucccuacucuuccgucaguucugggugcccaugcgaaucaugaccccuuuccugggcacugggccuaucuugcaggcuucgaugaugugguaaacuucuguucuauauaacuaucauuuuuaaauguaguuaaauuuauaccuucaaauuaagcuaaaaauuuaggugaguauuaaaaaagaaaacuccagaaauguacagaagcgcaacugucuuauaauauaguacaaaguuaaguaauaaggaauuauaacaagccaaaaauuuugauuuucucaugcucuuuauuucacuaugacuauuuuuuuucauaauuguauuuuccuauauuuucuuuugucuuggaaaaauggagagcaaaaguaacaaaauauguuuuuguuucuuaugaggaaacaagauucagauaacuuuuucguuuguuuguuuuguuuuguuuuuguuuuuguuuuuguuuuuguuuuuuuucgagacaggguuucucuguguaguccuggcuguccuggaacucacuuuguagaccaggcuggccucgaacucagaaauccgccugccucugccucccaaguucugggauuaaaggcgugcgccaccacgcccaccuucagauaacuuuuuauucuguuugugugcaugaguuaauaugugugugugccacagcccacaggaggucagagaagaaccucaagugucgguccucaccuucuucuugguuucagacagaguuucaggcuagcuggccauucgcuuccacaguuguccugcuucugccuucugccucauuauaaaccacuguauuacaggcacacuccaaacucaguuccucacacuugugcagcaagugcuccacugacugaacauuuccucggccucaucccucuuuuuuaaaggcacugcugggaaugagccuguggccucuuaccugccaggaaaccccuuuucuucugucccccaugccuacccuacccauaaaacaugacuguaaauguaugcuuauuuuaaggaaauaguccuagggaaaagcuguuaaagacuccauauuuauuccaaaauuucuauggcuuaggacauuuuaaaacuauuuuuagaaccacuuacauuguacauuauacaaucauguuuuaacuuaagcaguaauguuuagcuuauuuacaucaugagguaggcuucauuuggagaagcuucuuauuuucaaaaacaaaguaauuucaauugauaaacuuauucuuugaaaauuuuauacauuuauaugaugcauuuugauaauacucuuccaacauuaugauaaacacuuuuauuaugcaaaauuuugugacugcuuugaaaggacuaccugaauaugcauguguaaguacauguuuuacugauaaagucaggguuuucuuaauuuuuuuuuuuacuucauauauauuccuaauguuuaagaaaguaugucccuauucacagauagccuugcauuuuagcuucuagauaacuaagauaaaauacaaauuuaauacauacucccacuuaaucuuucuuaucaggaugauguauaacaauauaguauucaaauuuaacaaagaauuucagucuugucuuaaauauauaacacucauuauuuuuuagguagaaauucuuucuucucuucagaaaccaaagaaaaucucuuuaaagggcucagauggaaaguucuacaucaugauguguaaaccaaaagaugacuugagaaaagacuguagacuaauggaauucaacucuuugauuaacaagguuggaaacaguucacuuuuuaaagauuuauuuauauccuuuuuaauauguguacgugugugacugcaucucuauucacaugaguacaggugccugcuaaguccagaggcaugagacucccugaagcugaaguuagaugacugugagcaaccugagaaccaaaucuggguccucaagaagagcagcaagugcucugaccugcuaugccgucuguccaaccucauugcuuuuacuaaagaauuaggaaaauaauugucauaguaauguagacuuguuaauaggcaguuauauuucuauugaaauggaauguauguuuuaauuuucucauuuuugugaugaaauauauauacuaucauuuaaauuaaguauauauuucagugccauugaguguauucacauuaucuacuuaccaauuaugaaugcuugaguuuccuccaccugauaguuugaaugaguauaccaauuuuuguucaagucccgcuuaucagauuuuuuugauauauucauggauuuaaauugccuacuucaguuaauguucaacaguuauuauuuugcuuauagggaauauaagacauuaaugaaggaaaauauuuucugcuuaauaguuuuguauacaacauucuuucuacuuaucuagaccucagaguuucugcuucaaagcuagaaaaaaauagguucuguuuucaugauuucacuguuuaaaaguaaucacuagcauuuuuuuucauucugcuaauaagugcuugcuaucugacucaaagaaauaggggaaguguaauucaggcauauuauuagcuaggggugguggggauagcuccauuuaggggacuugauugggaagacuucaagcauagguaggcuucaaagaaucaucuuuagggaaaaauucauuuuucugugcagaagucacagaucucuguuuuaaggaaggacggacggacggaaagaaggaaggaagugggggagagaaagagagagagagucagucaaauaugucaugauauauaagcugaaaaugauuugagaaaggauuauagacuaauagaacucauuuuuuauuagaaaguuuggcaagcaagacccagucucagaauaaaagauuaauuaugucuauuuauacacagacuuacauacagcacaggauuggggauuuggggguggggggauagauaguaugauuccuuaugaugaggaaaguaaaauaacaauucuuagauaaaauuaaacauuauagucucugugcuuaaguacuuauuauuaaucauuaucucuaaugcuguagaaaagaaaacaauaguguuuuguuguugauauggcuauaaauacugcuuuuucaaauguaguauucuguuacaugcauaguagagaacuaaagagaagcuacuccaaggcaucuuaagguuuagaaguaggauagcgaugaucccauagcuucuucuucuaacuuucagaacuaugcauuacaggcugccaucagcacuuuuacuaggaaaugaacaauauuuagauauauuugacauaauaggaaucugaauccuauuuuauuuuuauuucugucuuuguuuuccauagagcuuaagaaaagaugcagaaucacgucgaagagaacuucauauccgaacauaugcaguuauuccacugaaugaugaaugugggauuauugaaugggugaacaauacugcuggcuugagaccuauucugaccaaaauauauaaagaaaaggguauuauauuuauucuuaugauagaaguauauacugugagguuguuaucuauaugauguaaaauauguauauaauaauguuuaucauaucaauguacauauuuuaccuaagccuagugaaauuuauauucuauauacagaagcaugcaaggucuuccuucccuuccuuccuuugaacccuuucuuuuuguuuucggcgcaaaaaacuuuugagguagcuuaccagaaaaaaaaaaaaaucugaacauuuacuuuucugaaauauuuguuagcgauuaugaaauuacuucauccgucuauagcaaagaagcaaauauucuaugaauaacaaaaguuaguuuucugucagaaaauuagaaagcuguccuagcuuuggauaaucuuagaaaaaugauguuggucauaauuaauuauaacccaugaaauaaaacaaauguaccuucauacuuauauaaucaaaucuuuucaaaaaaaguaaguaggaaaaggucuucauuguaguaaaauuggaaugaauaaugcaagauugaggaaauagaauauuacaaacuagcaaacgucauaggcaauuauuauaaacagguucuaauaguaauagacccagguaguuaaagguggugaugcuugccugugaucccagcacucaggaaguccaagacaggaggaacaugaguucagugucagucauggcugcaaaugauaucaugucccaaauuuuuaaaaagaaaaaauuaaggcaaaaguaugguaagaaacaggucauuuguaguaucaaauccuuuuucaugaauuagucaggauucucuaaagucacaggacuuagggaauguauauauuaagggaauuuauuguaaugacuuaagucuccaguucaaccaacccaauaggcagcugugaaugggaaguccaagagucuaguaguugcucaguccugugaggcuaggagauucagcuugccuucuguauaagcuggaguccugaagaaguauguuccaacagaugugcuggcaagaaagugcaagcagaugaaaaacaaaacuuccuauuuccauuguccuuauguaggccuccagcagauggcauggcccagauuaaagguguguaccaccacaccuggaccuaagcuguucuuuacuuggaacauccucugucccaggcuggccuugaacucagagaucugcuuggcucugucuccugggauuaaggcaugugccaccuuaccuaggccuaagcuuuccauagccacuaugcuucaagaucuggaucaaaugcaugugacaucacaugucaagauccagagaucagggcuggagagauggcucagugguuaagagcacugacagcucuuccagagguccugguucaaaucccagcaaccacaugguggcuuacaaacaucuguaaugagaacugcugaucucuacuggugugucacagcuacaguguacuuacauauaauaaauaaguaaaucuuuaaaaaaaaaaaaaguagaccacuaaggucuggcuuuaaaaaaaaaaaaaaaaagauccagagaucaaaagccugugucuuccagccucaagaucuuggucacaggugugcccuccauuucuggauuguaguucauugcagauguggccaaguugacaaccaagaguagccaucacaaugagauaacuguucauugugaagagaaaguaacuguauaauagaaaaaaauaacugaccauaugucuauguuguuacauaccuauuuuuuguugcugguuuuguuuguauguuuuugauacaaaggcucuuacuauguagacuaggauggcgucaaacucaacaauaagaggcugucuuggguuuuacugcugugaacagacacugugaccauggcaagucuuagagaaaacaacauuuaauugggggcuggcuuacagguucagagguucagucuauuauccgggcaggaacauggcaauguccaggcaggcauggugcaguagaugcugagaguucuacaucaucugaagucggcuagcagaauacugacuuccaggcagcuaggacaagggucuuaaagcccaugcccacagugacacaccuguuccaacaggccacaccuccaaguaguaccacucccugggccaagcauauucaaaccaugacagaggcuguacuuauuaaaaguauuaaagaaaaauaauaggguucauucuuguuauacugucaaguuauaaccauuaguauauauaauugguauuuuuucauucuugcuuuucaguuguagcaaaaguugauacuuuaauauuuuaacaaaauuauucuugcuucuuuucucauuuggcuguacaaacaauuaaaaucauucugcuuuguaggaguguauaugacaggaaaggagcuucgccaguguaugcuaccaaagucagcagcuuuaucugaaaaacucaaaguauuccaagaauuacuccugcccaggcauccuccuguuuuucaugagugguuucugagaacauucccugauccuacaucauggcaaguuaacaagaauauuguuauaguuugauguuucuuucuaaauuuuuuuguacuuaaccuggcacagaguauuugacaagcauuguacugcuuuagguacaguagcagaucugcauauugccgcucuacugcagucaugucaaugguuggcuacauccuggggcuuggagaccgucauggugaaaacauucuuuuugacucuuucacuggugaauguguacauguagauuucaacugucuuuuuaauaagguaugaugugacuuauuggauauauuacuuugaguuuucuuuccccaacaacuguucucccucgcuauacauuuuagucauaguugcauaacacagagugucuugacugguuuucaucagugaauuccucagaaaagcuauuuaggauacagagaaguuagaaaaaugguacauggaagguaugaacuuuaaucgugaguuaguuacuagcuaugugaacaugggcagaucaguucauuuuacagagacuuaguuucaugaaauuggaguuguuuaacauuucuaaauuugacaauauauuuaagucugaucuagauuaaagaaaaagucaaucuaagguauaguucaguaguagaguacuuacccuguauguucuaggucuugauuucaaguccuagcaacuaaauaacagcuacaacaaauaguaccagaguggguccuugagaguaaauuaaggcuaauggauccaucuuuaagaacaucaaaauuuuucuccuuuuacaauucuggaggaagauuagaagguaauuucgguuucgaugaccuaucuucuuuggguugcuaucagcuaucacaggaagaugaaaaaguccauagauucagcugaaaagaaaucaaagauaaauaaaugguauagaucaaaccauacaaaaggagaauuuaggacaauagacaugagaauaguugaacauuauguuauugagagggaauacugaaugugcuauaacaauauucaguauacuaaacuggacaaagugaauccauucacuugaucuuuuguuugagauuuauuuauuauaaauaaguacacuguagcugucuucagacacgccagaagagggcaucagaucucauuacagaugguugugagccaucaugugguugugggauuugaacucaggaucuuaggaagagcagucagugcucuuaaccacugagccaucucuccagccucuuucacuugaucuuauaucuaagauuaagccaugguuuuauauugcccaaaagcaaaggcagcauuauauggcucuuuucaacagaugcuucuauguaauuacauaaauauuugaaggauauuuuucucuuuccuaagaauccaaacaugaaguuccaaacucuuugagcaaagguuuuguaaguuuauuauuaccauauaauaaaacucuucucuugugagacuaugccagggccuagcaaacacagaaguggaugcucacagucagcuauuggauggaucacagggcccccaauggagaagcuagagaaaguacucaaggagcuaaagggaucugcaagccuauagguggaacaacaauaugaacuaaccaguaccccccggagcucuugacucuagcugcauauguaucagaagauggccuaguuggccaucaauggaaagagaggcccauuggucuugcaaacuuuauaugccccaguacaggggaaugccagggccaaaaagugggaguggguggguaggggagugggggggaggguacgggggacuuuugggauagcguuggaaauguaaaugaggaaaauaccuaauaaaaaauauaaaaaauaaauaaauaaaacucuuuguuuuuaagggagaaacguuugaaguuccggaaauuguaccauuucgacugacucauaauaugguuaauggaauggguccuaugggaacagagggucuauuucgaagagcaugugaaguuacacugagacugaugagggaucagagagaaccuuuaaugagguaauuauauauacuuuguaaauaaucuacuaguggccucgaauguaaauacuggucuauuaauacauuuucuuuacauagaaaccacucuguuaaaguauauuuuuagaaauaguaacauaaggcuuggcauaaugguccauguuugucaucccagcacucaagacagaagcaaaagaaucauguaagcucuaggccauccuggucuacauacugaguucugguccaaucagugcuacauagugagaucucuuaccucccaccccagaaaaaaguuuuucugagaguuucaguauagcgccaugauuacucauucauuacauucucuaauuuuaagauauguucagcaccuaacacagagcucuucuguggguauuaccaauucucaauuccuuccuccuuuccacuuccacuaaucuacucucuaucucuggauuuccuaucgugggcauuuaaugucaguuugaucauaugaccuuuugugucuaucuucuuucauguagcauagugguuucaaaguucaucauauguaaguacuucacucauuucaguuaccaaguaguguucuauuuuauuaaugagucuguguuuuauuuacucaacuaucagguaguaggcauuuauaguaauuccaccuuugaccuauuauggauaauauguugugaacuuuauguacaacuccuauauggauaaguauuuucaguucuuuuguguaugccuaugaguggaacuuuugagucaugauacuuugaauagccuucaaauuguuuucaaaagcaguuauaaaaacuauaauuccaauaguaauguguaugaguuuccauuccuccaugucuucaccaacacugaaaauguuauuauuuuugccauccuaugagauaugaaguaauauuucauugugguuuuaauuugccuuuucauaaugaccaggaauauugaccauuggcuuuuuuguucccuuauuagcauuuguauaucuucuuugcauaaaugucuauucaaaucauuagcauauuauuuuggugugggugugucuuacuguauuaucuggcuugcccuuaaagccaggacucaaucuauccuccugauccagcaucucuaguagcuggaaguauacguguaugcuacuuugcauacacaccuucuuugccuguuuuuugauuggguuggguugucuuuuauccuugaauuguaagaauuguuuucuuuguuuuguuuuuuguuguuguuguuguuguuuugguuuuuucaagacaggguuucucuguguagccuggcuguccuggaacucaaucuguagaccaggcuggccucaaacucagagauccgccugccucugccucccaagucuugggauuaaaggugugcgccaccacugcccagcgaauucuauaaauuuuuaauaugaauacaagagccuucugacacauugaucaacaaauauuuucucauuucuuuaauuuaaaaaauuauauucauggguguuugacuaaauauaugucugugcaccacauguaugccuugguaccuuugaaggccagaaaaguguguuugaucccuuaaaacuggagucagggacaauuaugagcugccaugaugguacuggguuuuauccucuagaagaacaaccaaugcucuuauccacugggccaucuugccagccccucuuuucucccacauugacccuuucagucauaagaguuuguuuugguucugcagguugaacuuagggccuucaguguauuagauauacacuuaagcacacacuaccaccugucuauaucucuagccaaagucuuuaauuuugauaaagucauaauuuauuuacauuucauucugguuauucuugaugucauguguaaauuaauaauaauaaaaaaaagcugucuuaaccagauuugugaggcuuucugugguuuuuguuuuuuucuaaucauuuauagacuuagcgccuuuuugucuuugaucugauuuauggguauuuuuuuugguauggugugaaauagaaguuuacuuucauucuuuuuucuauacaaacucacuugucuugacaacuuuuguuucagacaaggugcuaguuacuacguagcucugacugaacuggaacucacuguguagaccaggcuagucuugaacuugcagagauccucugccucccuaagugcugaggaauaugucaccacacuuggccauccuuugccgauaagacucuuuccaacauuuaauugugcuuuuuauugagauggucaguugguuuucaguacuucuaauaaguuauauguuaauaugccaauuacccauccacugucuugaugacuaucuuuauaaaaauuuucgaaaucaggaagagcauucuaauuacuuuuuuuaaucaagauuuuucgacuugccugaaucccucacauuuccuugugaauuuuaaaaccaccaauuaccgcaggaagccgucuuggauuuugauaggaaugaccaugaauuuguaguuauauuuguaguguaguaccaucuuaacaacauuguuuucugaacuauaaauguuuuucuacuuaauuaaauauucauuaauuucuugagacaauguuuuguaguuuuaaauguacaagucuuaacuuuaaaguuacuuuccugaagauagagcgauaguucagugguuaagaaccugaauggaguagugguagcagagauggaugagugaggggacucugaacugguuuuguauguaaacuggauggcagaugaacaccaauuaaggaugauaguguauauuuuguuuagggcaagaguaaaaauuauguuuguuacuaauuuaggaauauagaaaaauagcucaaaaaagacaaugaauuuuguuuugaagauaauuugagauguuuguaguauauccaaacaaguuucccaaggcaguuagaguugaugucuagagcauagaaagaugugagauuaaucuguaugguaacugaagguauuguauauuccucgaacaugauagagaauaaguuaauacucauuuaacaggugacaguauacaucuugagagguuacacagaauucaucuuacucuccccaaaacaucugagucccuucaacauuaccucucuacuuuuuuucccuuaccuugucccuccuccccccaaauaauuucauauaauuuaucugaaaauguaguauacuccuauaucuuauaauaauacuuuaucuuccuauucuucccuuauucuacuuuuuaaguauugauuuaaguaagauuucucuucugcaaaaggaaugaauguaucauuacuauauucuauguuucaauuuuagugucuuaaagacuuuucuacacgauccucuaguggaguggaguaaaccagugaaaggacacuccaaagcaccacugaaugaaaccggggaaguugucaaugagaagguuaguaagagcugcagccuggcaugagccaauagugucucucuguguaagcgagagcugauuccagauauuaucagugaccaaaauaacugauuacccugaaaucuaaaauugguuaaaaccugaguuaaccaacauacacugaagauuccuuuucuucugcaacuuuuuuuccugcuugaaacucaacccaaggccuugcauaugcuaaguauauaauuaauguuaacaaccccagacuucaucccacaauccgaaauuauuuuucuaguaacaucauucucaauuuugcauucuguuauguuuuuucuugagauguaaagaaucccaaguaguuacuuaaaauuccauuugcaugcacuaauguaaacuuacucgccaccauuguuagaaucuucccuaaacuauuuaagaacuaacauuucaaaauagguugcuuucuguuugcauuauucuguuugauaguggaagggaauagaacccagggucuccugccuacuaaacaggcaauuuacugcugaacuauaccucuugcccucaaaacaaauguuuuaauuuauuacuuugcuggaauuaugauaugcagaguuaccuagugguuuuuauauuucagaaaccuguccaauuaguacauguucagcuauuguacacaucaaagugcgaucucaaguuaauuggauuuguuucauugcuacagugggauauuguuuagucaaacacugcuaacauuaagugagaaaaguugaaauuccaaauuguauugggucuguagccuuaaugacuuucuguaucuuuuuuaggccaagacccauguucuugacauugaacaacgacuacaaggugugaucaaaacccgaaauagaguaacagggcugccauuaucuauugaaggacaugugcauuaccucauacaagaagcuacugaugaaaacuuacucugucagauguaccuugguuggaccccauauauguaaaauaaaauuauuucaaagaa

SEQ ID NO: 12442 - RNA, 2856 nt, Mus musculus
ugacagaacacuugcuuagcauuucagagcucuggguuugggucccagcacuacauaaguggggcaugguauggacauacaugguacauacaucuauaauccuagcacugcggugaaacaggagaaucugaagucugucauccuaggccauguugugaguucaaagcccaccugggagacuugaaaccuugucucagaaacagaaggcaaauuucucuuguucaugauucuacuuucuuuuucccuuuugagacaggaucuuacuauguagccuugguuggcuuagagcucacagagaucugcccgccaccacaaaugaccaugguucaacuucuaaguccaucuccugucacuggccauagucuccagacucuagcacaauuagcuggaaauagcugugccguccacacuuagccccccaaugcacugggaucagaggaaguuucacagcaggcucugaggacucccauucaaggaggggccccuccuuacccagcugaccauuuucuuaccaugaugcauuagcaagaaccauccucaacucugcgcugcuccucccgacagguuuucaggauucuguuuguuuauuuuacuuuucuuuccuccaugauuucuggacauaccaguacaaauauaagcuguauggcugcuggggagacuguugcaacuccaacuucacccagacacaugaccaugcuccccuggguugacagcaagaaaagggagacacucuagugugaggagaucuaccccugagugcccuagucccugaaauguccccagacccugucaguugugagaguccaacagguuccgagcuccugguccgaagcugaggugcaaauccagccuucguaauaacuggugagugcucauggcuggauccucuugcgguacagguaggcauugcucacuugguucaugauuaccaaacuggugaggauggggcacaacacagccagguaccaggcaccaccagugacaguggcagugaaccagagugagaacaugcccaacaggaggcuggcacugcccagcagguagcccaccaacccagaaguggcgugguagaguuucagcuuugccaggggccaucggggcagcaacuugggguagagcagccccaugcccccugaacacugcagaccugcccacagcacagcuaacagcccugccugcccaugccgaguggucaggugugcuuugccaagcugcucuuuguggaggaugacaagaccuagacccagcagagcacagaguagggccagcagcuggagcacccaguggcagcgugcgcggaccuuccgagagagggaccgcagcagggaacucucaggagagaacaucaggagugccucggucaucaggaaggagaacugaggagacaaaaacucaagugagcucugagcacuuaacccuccacaaaggugcacccccuuccguccccuucccccaaggacaaaaugcugcacuugauaagaugaaggcccuguguggcacaaaauggcugcccugaguaguuagagcugccucuccagacuucuuccuggguguuuuucugaaaugucaccucggcuaugugacccagcaaacaagguuugagacauggcaguuauaaaugauucacaagcuuugucucccuuccauggggcaggauacaauuucuuggcaagagcuagccacacgggugcacuguuucagggacaauuagaugcaucaccagaaauuaagguuuuuagggacagagcagccuccaaaugccauuucucagcuuccuagcuggaggugagagaagccgcccuuuugugcuugggugagcuucaucuguucguccugggucaugaauaccguuuucaagccuuggauauucgucagaagcaggagugaggacauacagcucgucuacacuggcacuaaaugccuacaaggauucugagagccaccaacaacgcccacauucuaccccuaaaagcuacccaaacccacuacuuacagccagagacauaagaacggggugccaggagaacagaccuggaaugagaagagggcgccucauggaacuagggaaaaagaaaccagcauaccaggcucuauagccgggauggacagcccauccaucacccaaggaggggucaaaaugcgagccuccuccaguaacaagcucaucuuacccacccccuguucucuucccuggacagaaagcacgcucugccacuccucuggcggcuccuuccuccagcauccccacaagucaggaaugaaaugccaaaucaaaggaagagaagccauguacuuaaagcuugcccuggcgggcagagcccccacacuggucugcucuucccacgacguuaaauacguucaacagagaauauccuucagccagucaauccuguucucaggaguuacgcccaucguuuccuacugcccccuguuccccaagagaaguagcuuuucccuucccauaaguggacuaugaauucuacuuacuggagccaggucuggcaagcacagcaacaaagaugguaaagccuaacgccacgaggugggcugcagccccagaggcagugcgcagagcucgguagauaugcgacuccgucuccacagaaagggccauggucagcccagccgauagcugcacagccugaaagcaucguaggcguuggcaagagugcccacuguccacgccccucacuggggacaguaacucaggacagaaauggcaccuuuucccggagaaguuaugacaggagcagaguagugccggcacuaacagucccaacuuagcagucuaccugucaaacaccuguauuugaagugguaacgaucgcaccuuccaagugggaggaggaagacuac

SEQ ID NO: 12443 - RNA, 2855 nt, Mus musculus
gggucuacaaauaacuuuuauugaaauugaacaaauaacacaacagccuuccugugcuggggaucacucgucccaagccauuucccacacucuagaagcacagagcuuccacaaggaaguauuuuuuuaaagccaucucuguauagaaaucagacucugccccaacauuaucauagucuagacuauuuacaaaccuucacauuuuaauuaugccucuuaaguauuuuccccuccuuucuauccuuaccaaggagcuccaguacuuucucuuaacagacccugaagggguaaagauacuguaaggagaaggggggggaugggcuccucauagcuacuggcaccagccccagucguuucuuaccacuaggugguggacugccucuccccuacaacuggggauuugugggacuggugcaaagacaagggagacgacgaauaugugguuuggggcaaguccccacagguacaggcgucaguagccuguccugaccccggccuguacccucucaacuugagggcaacugguugaaaucaagagagaucaguccagcccugggugaaaggagaagccucccacacugguccucauucuuauugaacagccagcaaaguguccagcuuaagagcgggagcaugugguagguaggcaggaagggugaggcugguauguaucuccagucuguccgauacaggaggaaucgagguagcaaacggcugaaaugcucugacuaggggggaaggggagugaggaaaaggaaguucccacuuggguagagccccuacagcccaggggcuggaagaaggcagacucugcuuguaaagugcuguagcuucuaggagggcugggcccuaggcaagcuuggaagaaagcaggucaggcagguaaccaggaaccaggcauuccugaccggcacgugucuccugucaugcuucucccacaagcggcugggggagacgggcugguaauucuguccuuagcccucaccagccaccaaccucuuauuguucagacauccgccaauaccaguuaacacugagggacaaccccucuuacaacugaagguucugggccaacggaguuuaguuuauucaagguuguggcaccagccuggacuccugaauggaagcuacaccuugauccugggaguuucuugcuggggcagugggugcucgugucugccaugccacacacagguucauacuucauagaggaucacggggaaauccacguggauucggggaggauccagcuucacgaugcccugccauggaaacagaggcuagugaagaucagcucugggccucuaugcuaagagccucucuguucuucccagcucuucccccagaaagccccaucuguaucuccguugacauacugauguaggcuuuaugaucacugcucggacccucaccugaggaaucagauucuuauguacccgccucagcuuggcucgcuucugcccauucuuggugacgauugucuccucauagaauucgugagccagaucuccaucuucaucguagaacauggagcuguggagagaaggggaacaggcuggauuggagccucaucccuggccuuggcaagggccacagaccacagggaaguacgcugaaccccaagagaagacgcacaacgugcguucuccguggaagaacucuuugcuuggugcccggagggaagcaggcagugugacaaggccacuguugcccugucauaccaacaggaugucacaucagagcacccucucuaggcaacuaaaguuaguccucaccacuggucuguuucacaaaggucaugauucuaguagcaggcccuucaccuagggcuuauuuauggagugggugggguaguggccugggcauacuggucucacuucuaaagacacugcugguccagggccaaagaccaagaugguggaugucugagcccagaaggcugcacuccaagucauuccccaguggcuggcacugucuaaucgacacuguugggucuuucugguauuuacggucaaauuuccaucacagggaaugccagucccuaggagcucacuagguccaggccauuuugugugagcaccugggaaaaaagaagguuagguuaguguuccagaucuagagaacccaacuggcugagggcacuuuuuuuguuguggccccaccuucaacacugacgccuuucucugcuuuuccagacacuauucucggagguccaacuucacagugaggaaggcaagacaccuaaacagaaggucaucuucccuuagauuucuucuaaggcuuagaagaacagaagggacauaaaugccuuuaauuugcaggcugaguuggaugaaagggagguuuuaagacucuuagaggccgucuuagcugaauuauggagcugcucccuaagagacgaaccucaggcaauucucuaaaaagaccaucugggcggucaagagcugaacgccgcuugguuuucccuucuccuugcuuugacugggacccaaaauaugacagucgucugauucaaauguaggggggcguuucucauucccggauguccucccaaaggcagauacccaugcccuuacccgcggcgcgugaauacgaagggaggcacugcucgggcucgagaccgcaccagagacugcucggagccugccgccucugggccgccgccccccggaguggaggcaaagggccagaggccccgagcuuuggagccgcuggcgcccaugucagcgccgcgggcgcauggcggacccagcggccgcuccgcucucacagcgcggcgggcgcgaccaugcccugccccagcuuccacucgcaggugccgccgccgccgccuuccgcaggcucugcugucucca

SEQ ID NO: 12444 - RNA, 6552 nt, Mus musculus
guucagaguucccauuuuuacugugcauauucaugaacaauuauuauaaaaacugacuugacaauacgugguuuuuauaaucugguuuacuacuacaauaauaaacacuuucuuuccuccacaacaguugaauaauuguauauagcuuggagaaagccuucguacuuuugcagaaaagagacucggguguuuggguuuucugugagggucuugccauucagucuuuguuggccugguacucuguacauagcccagguuggacaugagcuuuuaguaguccuguuguagccuccugagagcugacauuaauagugugcaccacugugcuuggcugaagaacuuagcuuuuaaauucccaguaccuccguaaacaucaaucaaacaauccacucuguuuccccagucuuagucacuuccccaucugcugcucccucugcacagacccucauuacuuccucaacucccucguaggaugcuuuuuccuuuuugagacagggguucgcuacauagaccaggcuggccuugaacucuugagauccuccuaucccuaccuccugagggcugggauuaaagccaucugccacaaugccugguccauuaauuuucuuuuaagauaauaguuuuucuucucucucucucuuuuuucuccccgagacaggguuucuguguaggccugucuguccuggaacucaagaaauauaccugccuuugccugauuuaagguagacaccaccaccucccugcuuaaagauaauuuagcuguuuucagcuacucugaauuuacuuccaguugcacauugggauuuaauaauaaccuucagaacuguuuaaaagucuuaggaagaaaaguaagagaguuacuucuaucaagaaacucaggcuauggcagacagcacauucuuagaguagcuuuuaggcuaggaauguaacucgcuguuacagugcuuggcacacacgccauaguuuuccagaaagaggaggggcugugcagagguaaggccuaguuaguguuuugagggguaacauuagggauucacugugagcaucaagaugaaugacaucuuugcuauggcacuggcauggaauucacaugacaccuauacuuucauaucuagaaaaaggcaggcgccagcuagcauaaaaguggucgucacagacggcguuugacacggagucccggaugcuuugagguccugguccaucacgugaccaucugaaagguugagauacucagucacuaaaggaaauccuuccagcucccugcugccuucacgauccagaacucugcuggggccuaacucaaagaggacaguguauucaccuacaggaucagcaguagcuacauaacacucuuacgcuccccgaagaucuuacaucaaaaccacagauggugcagaccuugguuaggcucugguaaggggacaacagaaccaaaauuccaggaagaaaauauggccuccauucaucuaaucacucuaccguuccuugcuaaucuauauacaauacccaggaugcaaugguaaagacauuugcuuaaugaacuuccacagucaauuuuaaaagcccuagccacauagaguggggacaucacuguuccucugcucugauccccuuugucauugucuccuucagaucuguaaaaugaaggugcugugaccggcuaccacagacuuuuaggaugccagaagaaccaguuuugguggcucacgguucucaaccccagcacccgggcugggauggggcagaaauagggcggaucucugaguucugggucagucaguuacgugguaagaccuugucugaaaaggucaccaguggguagauccugggcuaauggugcauuccuggaccagcacuauggaggcugaggcagggaggcugauggaguuugaggucagcuuagacuguauguagagcgaaauccaggccagccugggauauagaauaagauauuuuaucaaaaaccaaaccaaaccaaacaaaguacaggagggacuaguuguaggguuggguucuaacuaaauggccacccuagagccuguucggaaucuucugcccaaaggacaagacagcagaagucacuucuuccugucuugguggcuaggucuuuuccuguucauugucuccagcagaagccugcugacaaucagucucaaguagaugugugggaacucuguaggugacgggacaguaggggcugagggaguguccuucagucaggaccccacgccuccuaaagauccauuguaucagagauugcacaccaaacagcuccauacccaaggggucauuccucuccuagccagugcuuuaggaacauuccaauggccuuguaucugggacaugcccacuaagaaccccacaucggaaugaccugugccugagggagcacccccacggaucccacacguugggaccucaucuacuuaagguaucacccaccaaugacucuggaucaccaugacggaucuaaggaauccuuucccaggguuagcuaagggagcauucccuaaggacccagcaucugagagcacccaccaaggacugcuaggcuguauggcccugcugcccuuaugcuauuuuauaggcagaggucuggcuggcuggcuggcuggcagguccugucaggucaagaaggcucuggcagagcaggaggagaaagggggucccuugggcaucugaaggaccugacaggauuaaagaaagagggacaauuacuuaccacagccagguagaaaggucugaggaagacaguggagcuggccgugccagcaucugcacagggaacacuucuugggcagccaggugccauggaggauagacccacagugccugggaaagaagugacaacccccacugucagaaauuccucucccuccuucccugcccaucccccauccuguucccucucaacagcacuuacucuuugcgaacaucauguucacaguugcguccauagaaggaaggagggcaggcacagaaggaccccaggaugcaagucccuccauucagacagcaaguuuuauuaagcgacuuaccugaaauguaagagaagucauggggcagguggaggauugaaaagcccauaagcaacgguucaugcagcacucuggcauucacuccccagaguacucggaaagaccuauagcacacgagccuaccuuucagggaaauaacuuucaugguuggaccagauuggucaccuagucugauggucugauagcuggucccagcaugaaguggcaucaggagagaaacugaguaucagagacuaucagggacauucccucucccucucucucucucucccucucucucucucucucucucucucucucucucucucucacacacacacacacacacacacacacauacacacagagagacauacaugaacaugccucacucacuuuuaugacaagcuaguacaacccacccagcugcuaacucacucaucaugucucuugggguaagugcuaaaggguuacuucagagaugugccaagagccaugacagagauggauuaaggcaaaaagucuuacuguucuguauccccacggaaggcacaaacuggaaagaccgaucgcguacggcagguucuuucuggucccaaaugcuguuaucucugauggcaaggucucucccuguauugcauauuuuaggccacaaaauauuguugguguucauaagaaaaacaccuccuccccaccauccaccaccaaguaggguggugcuugccaaaggucuccacacucaggaggaggagggaggauccagugagaggcgacacugagcagcccuguccccaaacacugagugcuggggauguagcucaaugguagugugcuaaguaagcauaagguuuagccccagugcagagggggguugggggggggggguaggauggaggguaaucuggaaguauguccaauaggugcagagccuggguuaaaucacaugaacaacaauggcaacaaaaguuguuggucaaaaaaauaaaauaaaauaaaaaucaaaaccucagcuagauuugguagugaacuugggaggcagaagaaucaggaguucaagcucaaccuugacuguguugugaguuccuaggcaggcugggguacaagguccuuaaagugcacacaugcaggcuggugagauggcucagugguuaagagcacugacggcucuuccgaagguccugaguucaaaucccagcaaccauaugguggcucacaccaucuguaacgaaaucugacgcccucuucuggagugucugaagacagcuacaauguacuuacauauaauaaaauaaguaaaucuuuaaaaaaaaagugcacacaugcccauauguggagggguggggggacagccuggacuuggugacauccaguuucaaaaaccugaaacccaaccauacagggguggcuugcgccuuuaagugaaucugaguccaaggacacccuggucuacaaagugaguuccaaggcaaccagggcuacacagagaaacccugucuggaagccuccuuccuccccagggggaaaaaacaaaacaaaacgccugaaccccaaacaaaagaaaacucaccagcaacggguccaaauucaaacgcacuggaaauggccacaagcaaaaccacacugggagaagaagauuggacaucaguuagcaaaaccaagcguucagcgcaagggcacaggccacgaaggagaccgugaacagcgccaccgcgcugucuccaguaacaaaaccggacagaaguucccucucuuaaaaagccacauguuggagcugcuggagagauggcucagagguuagagcacccucugcuauuccagaggcccagaguucaauucuuccugguggcucauauccaucuaaaaugagaucuggugcccucuucugggccgcaugcacaaaugcaggcagaacgcuguauacauaauaaauaaaucuuuaaaaauaaccacauguagagugacugugugauuguagaguuggaaggcugcgcacuagcagcccuaaguguccuggggcuauguuuaacgacccaguggcggcuguuuaucaugaaccucucucucucucucucucucucucucuaugacuuaguauccuuuugacagucacauaaagaccucggggaugaagcaguguaagcagaucacagcuccagaaaaaacugaggcuggagcccuacccgaugucuucacugauacagcuaauguuugcaucauuuacacguacacaguuaacgucuacaagucacauuuauacuuucuuuuguucugugacuaccaaggagcucauauaagcucuuccauguucauuuagggcaauaugaauccuuguucccaagccacggccacgcucggaauaaacucuuacucuucggaacaagggcuguguuuugaauuaacuguuuaaaacaaguccccagcauccaauauuucaucaugaauauuccuuaggccccacccuuacacacacaauuuuaaaguuauaaaauuaaaaagcuaaaacauucuauucugcauaagcggcauauuuuuccacggugcauuguuugcauauauaaauucuuuuuuugcauauauaaauucuuaaauggcuguauggguuggagaagacuugccaaccacacgcaagcgcugguccgacgcccggcuccacggggaaaaaaaacuuguccugucacuugaaaugguuccaaguucaauugguuuguuauuccuaauguuucuaaguauugaauuuaucucucccauuaacguguagaggcagucuugauuaggcuguaagauuaauauuauguaugcaagagaaggaaagcauuauuucucuggcagucaccgacaugacugaugggacgagcccagagggugcuuuacaaccugagucggaugcccagaacccaaaugaucgaucggacuccagugagucaucgucuaaccuccacucgaguauaugcgagcgagugcccgcgcgcgcgcgcgcacacacacacacacacacacacacacacacaaaggcaauauaaaaaauugacauuuuaagaagccgauggcaaagcaguaucuaacuauaaaguuccagguucuucaggaaaagcagcaauguuacugacaagguucaagcaagacaaaaaucagagcgucauagaacgugauuuuccgaaguggcuaucuccagcaaccaaaaagucaagguuagcucauaccuggaugagaaguaccccaucuucgacggcucguaaaaacguuggaggaaaagacaagaaacacaauauuagcagauggcuuuaguucauaaagccauucucgaaacacccaaaggcuaauuucacaaaaugaaaacaguagauuaaaaagaaagauaugccaaaugagagaggcccccguccuggagagucugugggaaguuagcagccaagaucuccguguagaccggcaggggauggggccucuucuuccuauaaacgguuugugauugaggacuucggaggaauauaccucccuuaaaagaaacuuaagguguugaguaggacccucaggu

SEQ ID NO: 12445 - RNA, 21970 nt, Mus musculus
guucaguugggucccugcaccggacugcgcaaggaccccaggccgcuuggugauuuugcucaagugaaucacgccgcguccccuccuccgcgcgccccgaccggcauggacuccggucgggacuuccugaccuugcacggugagugucccgaacguaggggagacccucgggaaagccgaaauacacccgggcggcagggauaacagcuccuucggccgcauuuaaaccaccagagagccaacuccuuguccccuugugggaucccagaaaaaccucggcccgcgcuggacacaaccuugggcguuuccagacuuucccccaaaucuggcccaagagaucggggagcaaugcugacaucucucggggauuuccccuuagccuguucauaaaaggcugggcuccuggguccagauggcaccaaaggggucagggaaggaaagggacagcauccuuagccaaacucucgauucagaggcuccccaaaacacgggugcgccugaagcgagucaggccgcgcggguguggcggaugaggguguaaauggguggggcgaggaggaggugugcaaguuuggcugaagucguucuggcagccuucgcuccccagaacagagaaaagcgaugccagggcugggaggagcagcgcugucuuuuugcugacccuccuggucggacugggccagaucucaguuagaaccgccuggcagcuugguccuuuguccagccggcuuuguuucuucccaucugggcuagcucuucuccccaugccugucccucuagcagagagggaaagcgcaggcuccuggcugccugucuuagaagcguccagggaagagcaaggaacuaagugguauuuacgcacacucugugggaggggcuguggggagucuuuccuucgugucuccccaggucaucuauuagcucagcaauaccugcuccucucacaucgauccacgguuucacaguauuuuucacuuaacucgaguaucccugagauuguagguucuugguuuuuguuuuuuaauuaaacaacguguacuugugcuggaggggguauggguguauggagaucagaggacaacuugcaggaaucaguuaucuccuucuaucuugugcguucuaggaucaaacucaggucacugggcuuggcagcaauugccuuuacccacuaagacgccuugccuccugggcuguagauuuuuguguucaccuguccuccgcuccacucccccuuggaugugugcccugcaggcagcccccaaccuguuuugcaucaguugaccuggacuuuauuguugugggggcccaguaagcuuggguuucuaaaagccaccuuguugggcuguguuccugccccucccacuguucccucauucucuccagaggucagagaugccccuacagcuccugacuggugggaacagaggguggccgcucugagggucacaguggagaggggcgggcucuccccuggccgccucccucuggcugccucugaccgccauagugucauggaaccugggucauggagcaggccucagugucuguacccuggucccauuucuuucuugggucagcccugguaucucccguacccaggaagacacagagccucagucuaauacagcacaggcuuggccagccuggcccauccuguuugagcccagccuccuggaguugugacucaguccagccuuuccugcaggacuggaauguacacuguggccaagcugacggaccugugggcccagcgcuucaagcguggcauccaccgugaccuccagaagcagcuccugccuacacugccaacccgauggggaggggagaggggucaaggagggucucugugggagggcguggucacuguggcuuguacuuguuagcugauggggagucugcacuccucuccacagugcaggucccacagcacuggucacuuucugacuugggcaguugggggucugcuggagaggugcccucaguccccuccauuagcuggagaccuguggacucaccaagagaugacacguggcucuguccuuacucauacagaggcgauguuggauaaagacacauauugugcagacaaacaguagaguucucacucuccccugaauuccuugcagaagucucucucucucucucucucucucucucucucucucucucucucucacacacacacacacacacacacacacacacacgcucgugugcccacaagcugggaauugucuggcagagugguuagaugaugggacagaaucaagggcaaauguagcuggauuuguaugcacggaccaaggggcucuuucuaccacugaagccugcuaauugauacuauaguugccaucuuccccuccuacaccaccccucucuauuuuaacuaagccuggacuggcauccccagcagggcccugaaaagacauuacuucccaggaccuuuuccuucacuaaagacagucaccacacugacuugcccugcaccuggcccaccugcccuauugcccgagccggcagucuguaaaagggacagggagccccuagagccacaggcuccaacucuagcuuugccauuugcuguguagcuguggccuuucugagcccuuuucucauccaugggauugcaauauauuuuuccacagaggauguugccaggauaaaauacuagugggggcuggggacuuaacuucagcaaaguagcucggcgggcacacauuccuggguuuaguccgcagcaccuuauaagccuggcacaguggcacaagauuacaauuuuagcauuuggaaguuggcaaccauuaguucaagaaguagcagcccucagcggcacaggguguuggaggucagccuaggacacacaagauccucucucagacaaacaaaaucaaugggcuugggaguucuaagucacuucggaagccaaggaccccaagaaaagugagcacagaaaguagggguggccugccccccacugaugggaguuaugcuucaaagcuaucugcuuuggggguucugggcccaugauacacacacauugauccaaguuguuaacucuuuugugucucaggccacucgaggaguagggaccuucucagaacugcauucuguuguugugggucguuuccaguuuguuguuguuuggaggguuuuauuuguuuuguuuuugaaacaggaucucacguuauaccccagacuggccuguucacuauguggcacaagcugaccucaaacucaucgcaaucccccugccucacaauccugaguacuacaauuacagaugugagccacccuaacaaacuuagggucgugaucuuaaaucaucacauaaagugcuuaagaauucaaagaaaauacagcauauugggguucgaucccaucagggcccaggcagucuuuguuuuggcuaagaaccucuauauagcuggguagugguggcacacgccuuuaaucccagcacuugggaggcagaggcaggggguucucugaguucaaggucagccuggucuacagacagaguucuaggaagccaaggcuaugcagagaaaccugucuccaacaaacaaacaaacaaaaccccuucacauguuuuuuguuuuguuuuuguuuguuuuuacaacgugggcacucuacucaccccuaccucagacaaagcuuucuuguguccacauuucacccaugcccacauuucaguucgucuccauucacugccuugcucauccaucacgcaugcuucaguguggcgguggcacccuacucacucugugcuucggcuuuuuguuuuuacugugcuugucugugccaaaaaacuggcucugccagugacucagucuugcugcuucagugaagccccuggggaccucuucaaggacaguggguaagggagaggugagccaggccucugggugguguccugacccuccugcaguggggacucaguaauugcagagugaaugaaagggagguuguacgaaugaaaggccccaguguuuccgggcacucuggccgcacaguucugcacaaaguugcagucuuucugauuuauucuagguaacccugcagacucccuuugagggcagcauuuuccuccuccuccucuuuuuuucauuuuuacuuuuucuuuuucuuucuuucuuucuuucuuucuucuuuuuuuuuuuuuuuuuuuuuuuuuuugaaaaauuguguuugugucaggugguaguggcacacaauuuuauccuggaggcagaggcaaguggaucugcguuuaaggccagccugguuuauacagagagaaauacuguuucgaggaggaggggggagaaggagggggaggaggaggggaaaaggagggggaaaaaagaaggagaaggaggaggaggaggaggaaggaggaggaggaggaggaggaggaggaggaggaggaggagaaggagaaggagaaggagaagaagaagaagaagaagaagaagaagaagaagaacaagaagaagaagaagaagaagaagaaaagagcauuugcauuuguuaccuuggggaucgcaucgcuuagauaggaaaaccagggagcaggcagcaggccuagucacaacaaaucaguugaauaguugaggauaagagauuuggcgggcucaguugauuagcaccggcuccaccugaccaccuccacgucucugugucaccagaauucccuccgcagagcauucuucccaguucugacgccugggcuaucuugcagaguuggcguuggcauuccuugccaggcucuaccgcacacuuuauuccaguccccacccucacacacccucucaaguagagguuccucccuucccugccuggacuccgccuuucccgagcaagagccucccuccugggcuccgccucucccuccgugugcuuccuggcugugauuacuccacgucgccuuccaggcaguggcugccagcccucgggaccuggguuaugucuggcaggcucugccacucuaacccuccagccacgcuuacuauucuaacacucuggaggugaaggcacaaauauccggaguucaaggccaccucagccacacugggagauugaugucaaccucccccgucccaccuccaagguucugguuccacuuccuccgccuauuuucuguucucuccagccucccuagacuaugaacccgcccccagacuuggcuccgccucccaaaaucuggccccgccuccagagagacgggaccgcccccuccucugagguucuggcuccaccuucucaaggcuagacugccggccggacucagucggcuucuaagcuaggauucacccuggcagaggcuuaggagaacaccaugcagugucuagggguccggaguugcagacggggcagcgugaaccgcucccgggagcucuaccugcaggagcagagucgcaaaguagcggcgcucaauggacagagacuggguaagggaugcaggggacaccgagaaccugcugccagugacugggacagcagcuggaacaggacgcuccucccuuuaagccucagauuauacauguuuauucuucugcggggcuguguuuucagugugggugugugggggugaguacuuggagaacuagauaacuaccuuuuccugagcagcccaaucuccaugcugccugcuaacuccaaccccuccugguuacaaacucaucccugggugugugauucccuguggaacugguaugacuguguaacccaacgcugucuacuaugaugguggacaaauguagaccugaacaagugacacuuggugaccccaggguuggcuaagugauucugucacacuggugguauuaugacacgauuguguggggaugauaguguguaaugacauauacccaaguguggcauucugguacugaaggugucuguguauagccuugugugacaguggcugcuuaugacugaugugaccauguggccuagggugauggaauggcugcccugcuguggugugaguuuucugaugcuguuacccgcuggcucugugacuuuugaguaguguggcugcauguuucacugcucugacccugcgagcagccugccuacuucugagucccaacucugccguacaacuuccuccaaccucaauuuccuccucuguaaaauggggauaaugauacugccuuucuaccuacgguuguugaggggauuaaacacaugugcugccaacaguaacuuauucaaauaguagcuaucauuauggcggcugcuguuauuauuauggugauggcauccugcacuguaugugugugaaacaguaacacgcgcuccaugagacuaggguaguuugcacacugugucccugggugcaagguugugucugugagaucguuugugauggugugguauaucuugguguagcuauguaugugugugguguggguuccaagcccagcaccuccaucauguagcuuguuuguuggcucuccuggauucccacccuccaugucuucuacaugguugcuucucugugggcaagccaggaaaagauuggugaaaccccugagugcucagccuacccgcccucccaaggcugaggugagggcuggauaaggguuucccaccgacuuuguacuuaagagaacaagcauccugugguaggccacccagaggccucagaaucaggaagcccuucccacuccauggagacacccacccagauuucccaguuccuggagggugguagcugucucccuacugcagcccaucacugucugaccccacagccugggccucugcuggcucugggacaggauaagcuugucaucccuucacaguguuuuccagaaugagagggugggggcuugccuuccauuucccagcaacccccacucccaucugggcuguuagcaggagcuugccuaacugcauccagcucagggggcagggcauugacagauggucaggaggggccccuccuaaaguaccucagccuggaagagacagugggaucucccagccgaggccagaggugacccucugcucugacagucuggaaagucccuaaccuucccuccaugugagauauuccaugcgagccccuucucuccucccaggucuccccacacugaaaagcugcucauacugagguagagcaucuucuagcaaugagucaacuggcaugggacaaaggugguggcaugugagaugacugucaucucggaguggcaauaaggcuuucugggacacuguucuuaccccagggcagaugagggagcagaggcaugggggauggagggagaaggaggcuucugaagcuaugggagguggaugcucucacaaaagcagggagcugaugauggguagggaagaugugggugagugaagccugguccaucuuggcuuguggauaauguguugaaggccauaggggcacggcgugguggauuaacugggaggagauaucagagguggagagucugggcuccgaaaagcagccuguggcuuugugacaauucuccaacacgagcaaagauucuagcuccucaaacaggacgguuggagucccugaugccacuuuucuguugggucacauaguuuuuagggacacauuuagguguccauuuggcuuugaacugauccggcugcuggacugugugugauguaaacacacugggugcgugcaggugcccacaccgcuuuauagguguaucucugugccacacuggugcguuauuaagguacagggugcagaucuccuuuaucauccuuaguacaggauuugugucuggaugaagacuccuaagggguuuaaugccuuccuggugccuccugccugggucugucgggagagaggacucugaauacuccagagcccgugacucaggucaagccacauaagagcugggcaggaguggggcaagcaagcagaguucuguccucccugugggcucugucucagcuucuggaaggauugagcucugucuuaaagcagcaguguucugagggagcccagacccaggacacucagugguugggguccaguaggaaagacagggccaucccagcaggcuaaacacaguccacaguggggucaucauucucuucuggggacaaagaucagagaauggcuuaagcagauucuaguuagaggcugcgggaugaggacauaugggagaggguggcuggaauagcauagccccagggauuccauggcaguaaaccaugaggucacacagcuggucaggaagugugccggaacuuagguacagauaauguuggagccauuggaggcgggagguuauuuggcucugcgggccuggguucauuuccagcugcgcuggucacuuucuuccccuccuuugccuuguccuuucaucccagcucacuucacucugagccaggccauuucccaggucacccaguaacugcggagcuuuugaauugugcucauugauguuguagacaagucacagugucuaaguaugggcuuggggcagagaguguagcacaguggccaaacacuugucugcuaugcacagaugacguagguucaauggagacucaacgcuggggcagaaagugugaucuuagguggguagacgucuugccugugaaggaggcagggaacgggccgguggagucaaaggagggaggaggguacagcugaguaaggaugaggccaaugagaacggacucugaguggccagaggacaaggccaguaugggccugaugcuaagagggacacgguggagaaagugacaucucaccagcguugccucucccagggcugcaggaugacccggaccuucaggcccuccugaagggcagccagcuucugaaggugaaguccagcucguggcguagagaacgcuucuacaagcuacaggaggacugcaagaccaucuggcaggaaucucgcaaggucaugagguccccggagucgcagcugugugagugcccgggguccauguugggugugguacaggguuaggguggaggccagucauggaccucgaccacagguggcccaugccuaaggagccaaagggagaaacucagguuggcuggggucaaggagagauugguguugaaucacuuguagggaagccaaaguuaggcuggucacagagagaagccauaggagucaaaggaaggugaacaaacuuaaccauggucacagauggggacagccagucucagaagcaacuguagagccggacagggugguuugaaugcauugcugccacccagacaauggguggaucagagcgguagggccaaaagcuaggcccaaaguccgaggacagauaagguacuuccgucccaguggcugguauguaagguggggcucaggaggaguuaacacuccugagagugagccuugggaggcgggguagagaaccggagggagaggagagaggagggcuggguacugucuuucuagagcgucucaaaggcucagggauuuaaaguugugggugggagugcaaauggagacgaccuccugagagguuugggguagcuuugcagacacgcccuuccgugcaggagcuccaugaaagcuuccugaaagagagagagagagagagagagagagagagagagagagaucuuaccugggagugggaguggggguggggguggggcuuagccaagugccaucauuagaauugugacaguggcuccugcccgcacgauggucugauaugggaaccuccagcucaagauuccugaauucccucugcuagaauuaaagcauacaccgccacguggaguuuguuguauuuauuuacuuacuuacuuaauuauuuauauaugcauaaagacacuguagcugucuucagucacaccagaggagggcaucggaucacagguugugagccaccaugugacuguugagaauugaacucaggaccuugggaagagcagucagugcucuuaaccaccgaaucaucucuccagccucuguuguuguuuuuguuauuuuuuuuuuuggggacaggguuucucugugacuguccuggaacucacucuguagaccaggcuggccucaaacucagaaauccgccugccucugccucccaagugcugggauuaagugccaccacuuuguuuuuaaaacaggaccacauacagccggagcuagccuugaauuuacuguguaguugaggguggugcucaccccgcauccuaaggauggauuccugaccccugcugcuguagucuucugguguguuccuuuggagaauggaacucuaaagcgucucagaggucacucugaggguugggaaugcagcucgauugguagaacacaggccuagcaugcaugaagcccugccuugaguccccaacacuccacacacugaaugugguggcacgugguuguaacuuaguauaugggggguggggguggggauaggaggaucagaaguucaaggucaucuucaucugcauaaaguucuagaccagcuuagaaacaggaagcccuguuaccaaaacaaacaaacaaacaaacaaaacaacaaaaacaaagcaagcaaacaaacaaacaaacaagaaaaucaccuugauuuucugccccaacuaauggccccuagcacaggauaaccccugaccuugucaguguuugugaagccagacaggcucccgcacugggcuccuguccugacacagaguuuccuguuagcugcuggugggugggcguggaugggaaaggaggcuucacuggauuccuaguggguacauuugaaugugcacuuagugcuuggagggagauaggggaagggguaagaagagaaggcucuuccaggagcaacugucacucaggcuagcccccuguaaacaggccagggagccaggcugagaugggggucagaucugggggcacuggacucauguggggggaggcuugcuuccgacccagauggcugccacaggucucauuguuuagcaggacuugguugcaugcagugucaccuuaccucuggggaaacugaguccagauaauggaggaguaacagauucuccgguuucucuuugucucuguauccugcuaagucucuccaguaacuucccagugcucauucuuuguccccaggaguguuauuagcagcgaggauaggcuggccuuucucucccaggcccugggggcuccacggcccaggcuuccuguuuucauuccuggcccagcaggguccagcugccuaguguggggcaaagacggauuagccagggauacguucugcaucccagauggugcaggggucccucuuuucagagcuuaugacccagucaaggcacgugguacacguguaguccugaggguggcugggaggccccggggacucaggguaagagcgguuuggggaggauucagacugaauggaugagaaaggcugaagaaggaugugacagggguaguccugcuguggggaggcuggcucucagccaggcugugggggauacauugggauggcagcauagaagaucuuguuuguccccagcuuggaagacuggcuugaugggaaggcucucccagcuuccuaagggcagugauguaaucuccuagacccccaggaauagcauaguaaaccggcuaugggcuaugucuaaccugcuaggguggccuugucugucccuuacugcugagcccccuaggucuaggaugccucagaguacaguagcucuaacgcagaacucagccuuuccggaagcugagacagguccacgaggacagaacccugccuccgucucccuguccugcccagcucucucagagacgcagacuggcuucugucugccucuugggacccuggaagguggggucuuucucugcccuucugccaaagggcucccugaagucagaacucaugcagucacacgcaggguaaacacaccgcguuucuaucuggcuuugggauucugucgcuugaccccagagccaggacuguccaaagugggacaguagagggaccugaagauggugauagcuauggggacucaaagacuaguguggucuggagggugcaugaccucuuccuaucgcaggugccagaucacagcaggcuucuccugcuaccuggucccuucauuucugugaccauggaccugguccuugcugcuucuccuagccuaagaucucugccucugugucucccuguauugcucccacucugcccacugcuggcugcccugugcccugccuguaaaguguuuccguucuucuucucucccaccauccugaccuccuguccuucucccuggacccacgcucugagcccccagucuggcuguggcacuaggccgugcucuucuccuuguggccuuggcugugccagaggcagucauuucccccacagccuguucaucugacccauccccucuucgcagucuccaucgaggacauucaggaggugcggaugggacaccgcacagaaggccuggagaaauuugccagagacauacccgaggaccgaugcuucuccaucgucuucaaggaccagcgcaauacccuagaccucaucgccccgucuccagcugacguccagcauugggugcagggccugcgcaagaucaucgaccgcucgggcuccauggaccagcggcagaagcugcagcaguauccuccugggggcagugggucccggucgugcgugggaugugcuaucuauggucaguugugcuucgguaacaaaaugccaggguguguuggauccuacgcugguugcuaugauacuaggcaaaaacaagucaggagaagagggcuuuauuuuauguuuuaggagaaugugguccaccgugcaggaaaggccuacaguagaaacucggguggcugguuacaucgucaggaagcacagagaaaggggcgaacgaacacuaaggugcagcucacauccuucuuacucaaccugagacuccagggaauggagugaaccucauuucuuuccucauuuaaucuccugacacucccucaaagacacacccaacugggcacugcagggacugacuggcuggcuugcccaacacuaguguguuucuucagguacuagcauggcugguucuggggagggcccucucccuuguuugcaggcugcugcguuuucucucucugaccucucaugaagagagaaagcucuccuuuauaggcacuaaaccuuugguccgggccacaccuucauguccucaucuaacucaaauuaccuuccaaaggcuccuaccuuggaaaucauaguacaggggggggagguugcuguuucaaccgugcauucuaggaauucuuguuuuaacccagggcagaagggagaguacagaggaucuucugacccaaggucaacagcugugucucucugugagcaguguggagauaggcaccugggaagugggguguggcagguugggagagagguggggugauguagucauguuuuucaggguuacugcccucaaggacuuggaaggccauggcacucuccugagccaugucuuggggggcaauacugggaccccaggguucagaucugccuucaggcugaagacaguaacuugugaaacuugugaauccguccuauucacugauugcuucagcgugagauugggccggggccagcucucauuuuugcuuuauuugccugagacagguucugggcuggaacuugcgauccuucugccuccugaguguagggaucacagccuuucccaucaugcccugcagugucgccuuuuaugacagcuuuauaaagggauaauccacauaccauaaaauuaaccccugugucgaaccuagggcuggggcaaugguucagucaguaaaggacuugccauguaaacauagggaccugaguuugagcccagcacacacgugaaagcccugauguuagagcaucaucgcccucucccgcccccccacaaccccaccauuaguggcucuuucauauuucccccuaagucaggccaagauagcccccauaugcucccugugacgcagaguccugcagccucucccgaauggcuucuuguuccuagugugugccggcacucauccacucuguacugaggcucuguacuccauuucuuccggcgcccuaacaguaucccaccauauggacacacccuuccauaacucauccgggacuggggcugugaguccauuccacucucggacucucgucuguggugaaaacucaaaacuacauucuguguggagcguguguucucaucucucuugggugcacacuaggaggaaaacugcuagguuauuuaguaacauuuacggcuaacuuuuuuuuuuuaaauaagauuuuauuuuuaucauuuuauucuaaguguauguguguuuugccugcguguguggccgguguaccauguccaugccuggugccagaggagaccagagacagguguuagaucccuugagacuggaguugcaugcuguugugagccgucacgugugugcuugggauagaacccugguuccucuggggaagcagccggugcucugaaccacugagccauuucuccagccccuuguucuaguucuaaguaugugucugugccugugugugcauugugugugcauauuauguucaugcgugugcagugucugcagaggucagcggaggacacuggaucaccuggaguacaguuaggagccacugugaacagccccauguaggugcugagaauugaauucuaguccucuaagccaucucuccacaacccucccugugcuuggcuuuuugaaaaccugccaaaucauuuuccaaagugguucuaacuauuuagauucccacaguaauguaggggguuuccauuuuugcaccaaucacuggcucuuagguuucucuuugguuauagaugcucuuccugacugagagguaaaucuuugguucaucuucugcucgcuuuugugugugcuaugagauggaaaaucuaguuucucuuugcauuuggguaugcagucuuuccaguacaacucacuuuguagaccaggcuggccucgaacucagaaauccaccugccucugccucccaagugcugggaucaaaggcgugcgccaccgccgcccggcuaagauuucuuuuauuuuauguaaguacauugucacugucuucagacccaucagaggagggcaucggaucccauugcagaugguugugagccaccaugugggaauugaacucaggaccucuggaagagucgucagugcucuuaaccucugagccaucucuccagcccaugacuuauuuuuuuuauaaucauuuuuauuacauuaguuauuuauugugugucuuugcauacuugucccucguguguguguguguguguguguguguguguguguguguguguguguguguaggucagaggauaacuugugggaguugguucucucuuaucuuauggguccuggggauuaaacccgguugucagggacccaugcuugcugugccagcccaugggccugaaaauguguuauccuguugagcauuccuguugaacugucacuggcugugaacaugaggauuuacucuggacuuaguucugugcauucguccaucugucugucuuuccaugcaguaucccugcccucucuuaucucccguaacuucguaguuagcuucauaaucagcaagugugaguuguccacaucuguucuuuguuuugcaagguugguuuggccagucuggguccugugccuucccacauguauuuuaaggucaguuuggguuaauuucuugaaaagaagucaacaucauuugauaggauuguacauuaaucuggagacuuuucagcaugaaaaugucuuucaauccaugggcaaggucagaugucuuuacauuugauuauuccuuuuuccacucguugaagauuugcguguguguguguguguuguguguguguguccacaagcguguagugccugcagaggccuagagcugggguuauaggugguugcaagccaucugaugaggacacaggaucuuaggucugauccucugcaagaacagcaaacagucuugugugcugacccaucucuccagccccuagucuuuugccauuucuuuuaauaauguuuuguggcucucagaauuuuaaguuuuauacuuuuaaaauuucuucaaauaaucuuaauaauuuugguacuauuauaaauugugcaguucuggcuauccuggaacucacucuguagaccaggcuguccuggaauucagaaauccaccugucucugucucccaaguccugggauuaaagguaccacugccuggcacuucuuagguuuuuguuguuguuugguuuugcuuauccguuuugagacagaaucucagguagcucagguuacccuggcacuggcuguguggcuaaggaugaccuagaacucccgauuguucugcgacaaccuccuuccugggugcugagauuacaggauguacaggccuggccuggggcuuagacuuuuuuuuaaaguuauguaaccucucuuaugcugccugugcuguuguuucaugugugauuaaacucuaaugucuuuuuuuuuaaacacacgcccaugagguucauccucuugucugacucagugcucugugagaguuagaagcacuguccaccccgucaguuccucagcgucugaacggagaacgugggguggggugugugcgcgcaugcgcauuugcaagcaugggggcugagacgucccuggacaggaugacuugauccagguuugaguuugcaugggauuucuccacuuucguuuccagccucagguaccagaggcaugcuggcugaaggucugagaaacccaggcugucaucagcaccgugggaggugaucaggcggggcaguuacugccuggguuccuuuucaguagucuaaauguccucagugaaccuuuuuuauaguaaauauuuucaaacaucaucagguuucauaaugaacaaacagaaaaaagucccuuagcugggucugauggugcaauccuguaauccuagcuacucgagaagaugagacagagggaucaccauuucaaggccuaacgggacuauggagcaaguuuacggguugguguaggucauuugacuuaaaauacaaaguaaaugcagggcugcaguagagugcgggacccugcucggucccuagcaccaaacaaacaaacaaaccaacaagcaagaaaagcaagggaaaggaggggaaagacccauccauaguaaggaaggccucccgguccucggccccugcuuuguggucacgugaccacgggcaaccgcgacuucccguggcugggaucuuggugggcaucgggcugcuguguguuuuccugacugcucgcccagcuggauucacuccugcuugcgaaaggcugauaaaaacaaggauaacaagaugaacuucaaggaggugaaggacuuccugaaggagcucaacguacagguggaugacagcuacgccaggaagaucuucagggugagcuuggcucgguguggcuauagggccgugggccuggcccgaggccagcucugagcccugcccaugggcugugcuggguuugcaggaaugugaccacucccagacagacucgcuggaggaugaggagauugagaccuucuacaggaugcugacccagcgggcagagaucgaccgugccuuugcagaggccgcagguucugcggagacccugucgguggagaagcuagugacguuccugcagcaucagcagcgggaggaggaggcggggccagccuuggcccucucucucauugagcgcuacgagcccagugagacuggugagggcccaacagucacagagccaauggcugggagacugauggaacagcagacagacagacagacagucgugcuucagggagccagccccaggguugcugaccaguguguggcuauccuguguaagcaggcagauaggagaaagagaucaguaucuacccugucugggccucaucuuccuccugucccuuccucaaugggcauugagcauuccugccccgagacauagaaagaagugcugacaaagccaagguuauuucuacuuccuucuucguuagacacagcgucgauccagcuuugacacaugacagagagaagaagaggccugcucaacacuuccagccugcuuaguuuagugagacccagucucaaaguacagagaaaggaugacuuggggacauggcucagugguagagugcuuguguaagaccccgcgaucaguccucaggaccacgcacucuagggacacagaggaggugacaccccaccuuuggggauuuuagacuaggaggaaggaaaagagacagggccucagcacacuguaaccagagucucaccgggagaucaggacuucugcuccucagagcugcagaggacugggcgggcaggcagaguggagaaaaaacuucucuuuccacaguggugggcaacuugcucugacucaaaaugguggcuucucccauccuagccaaagcccagcggcagaugaccaaggauggcuuccucauguaccugcugucugcugacgguaacgccuucagccuggcgcaccgccgugucuaccaggacaugaaccagccgcucagccacuacuuagugucuucuucccacaacaccuaccuacuggaggaccagcucacagggcccagcagcacggaggccuacauccggugcggcccagggaacuguuaggggcaggucgcggugggacccgggauggaaccuggagggucuuagccuaguugucaccuuuucucugcagggcucugugcaaaggcugccggugucuggagcuggacugcugggacggccccaaccaggaacccaucaucuaccauggcuacacuuuuaccucuaagauacuuuucugcgacgugcucagggccauccgggacuacgccuucaagguuggccaugcccgugggagugaggagaggacacaagggguggaccgucccuuuuaacucaucuuggggcuucuaggcaucccccuacccaguuauccugucccuggagaaccacugcagccuggagcaacaacgagucauggcucaucaccugagggccauccuggggcccaugcuguuggaccagccgcuggaugggguuaccacgagccugccuucgccugagguagggagugguacccuuaaggugaggaagugaaccuggcuuguaggccuaugugggucuugaccagucuguccguacauccccagcaacugaaggaaaagauucuguugaaagggaagaaacugggcgggcugcuaccugcuggaggggaaaacgggccugaagccaccgaugugucugacgaagaugaggcugcugaaauggaagaugaggccgugcgcagccaagugcaacacaagcccaagguucuaggggaagcuguggggguggggcgaccccgggccccucccaccccguuacccacgggacuugccuugccuugguuuuucuguggcugccauucagauccucugcccccucucuccgugucucucucucucucucucucucuuucucucucgcucccucgucuggguuucuggugcucagugcccaccuuguccuacccuaccuauggcucuaaccugggccuccccgcggcccccaggaggauaagcuaaagcuggugccggagcucuccgacauggucauuuacugcaagaguguccacuuugguggcuucuccaguccuagcaccucugggcaggcauucuaugagauggcuuccuucuccgagagccgugcccugcggcugcugcaagaaucaggugagccccugucccugcagacacacgauccuggccaucuggacugguugaggcugggccugcccuacguacggcccugcagggucccaaguuggcauucccagcguuguguccagacagagcuggugggguggguauguccuuagcccacccuggccuucucugaugacuugacuccaucuguucucaggaaauaguuuuguccgccauaacgugggccaucugagcaggaucuacccagcuggguggaggacagauuccuccaacuacagucccguggagauguggaauggaggcugccagauugguacgaaccagcugggguuggagggagguuagagaaagcacuuggccuugauguccacagcugugaaggucacaggaugcgaggucugggggggccugagaagguuuggaugcgggccaaauuacccagccagcaagucugugucuggugugaacuccagcccuuugaguuuccuuuuggggaaugaggucacaccugucacuccagcacuuuccgggggaggggggggagugggugggucaggaguucaggguuauccuuagcuacuuagugaguucaaggccagccugggcuacaugagacccugucucaaaccccccagaaagagauuggggagaugacucagucagcaaaaugucugccauagaagcaggagguccugcuugggaccccggcccacaugaaagcacaggguugaugacaggcaaucuguaaucagcacuacugaggcagagagaagcugagcuccacucacuggccagccagccagcccagaggauucaauaggagcccugucgcaaaaaagaugccaggccuuuggccuccgcaaguauaugcaaauaugcaugugcacacacucucgugacacaccuauauuauacacaacaccacacacacacacacaaagaauguggucaguguggugggucagcuaggaugcuggaaggcaggagacacuggaccauuggauccugcucuaacucacaugggaacccagaugcuagugcacucugaguaggaggcuaggcucuaggacucuggggccaacccacaguugaugacugcucuguuccaccuguaguggcucugaacuuccaaaccccugggccagaaauggauguuuaccuuggcugcuuccaggacaauggagguuguggguaugugcugaaaccggccuuccugagagacccugacaccaccuucaacucacgggcccugacucaggggcccuggugggccccgaagaagcuccgagucuggguauggccugauacagggggcauggcagccuguggaagucccuuccugcucauugauguccuugaacgcucauugucuccgccuuuccucagaucaucucuggacagcagcugccgaaggucaauaagaauaagaauucuaucguggaccccaaggugauaguggagauccacggugugggccaggauguggccagccgucagacagcaguuauuaccaauaaugguauaguaugcauugggccuggguuaggugcgcuggugcuguugacuuugcugcucauacgguuuuugccuuucuagguuucaacccacggugggacacggaguuugaguuugugguagcagugccugaccuugcccuuguacguuucaugguagaggauuaugacuccuccucuaagaacgacuuuaucggccagaguacuauccccuggaacagccucaagcagggugaguguuggaggggaggagucuucaaggagcagugggcggagccugccaggggcagugggcggggccuggcuucucuuaacccacagcucacucauccucucccaagugaccagaacuguccuuucccacuaggguaccgccauguccaccucuugucuaagaauggagaccugcauccaucagccacucucuuugugaagaucuccauccaggacuaagccugggggacugacgcaguccgcccugagugggcggagcuguguccacaccugucuggcaauguugcaccucuggcgcggagcuugaggccacugaacugccuucagcucuaacacaucgccugagcuucuacuucucuggggguccaggagcaguccaguccccggaguggucuaaaauuccguuaggaacaacacugcaucucucucccuaccccuaguugacuuuagguugugaguuuuuauauaaaaaaaaauaauaaucacaagauaaa

SEQ ID NO: 12446 - RNA, 1734 nt, Mus musculus
cucucucguuucgccgcgagccagcagagccuccuggccguccaagggccccagcucugggggcagcggaaccucgacgagcggagucugaagaggccaucgcggcccgugagccggugucgucccaauacacuggcagaguuccgccucggccuuccaggccccgcgguucccucaccggacggucgccugcgcgccaugcagccgccgccugccccgcgcgcguaggcgcucgccacaggccaugcugccccuucucgccgcgcuacuggccgccgccugccagcugccgccggcgcacggcggggccacggaugcgcccggccuugcagggacgcccccaaacgccucggccaaugcguccuucaccaacgaacacuccaccccgcgucugcuggcaucggcggcaucggcgcccccagagcgcgcgggcccagaggaggcuccggcggcgcccugcaacaucagcgugcaacgacagaugcugagcucgcugcucgugcgcuggggccgcccgcggggcuugcagugcgaccugcugcucuucucuaccaacgcgcacggccgcgccuucuucgccgccgccuuccaccgcgucgggccaccacugcucaucgagcaucuggggcuggcggcgggcggcgcgcagcaagaccugcgccugugcgugggcugcggcugggugcgcggccgccugcgggcucccgccggggcucccaccgcgcugccugccuacccggcggccgagccggggccgcuguggcugcagggcgagccucgucacuucugcugccuggacuucagccuggaggagcugcagggcgagccgggcuggcggcugaaccgcaagcccaucgagucuacgcugguggccugcuucaugacccuggucaucgugguguggagcguggccgcccucaucuggccggugcccaucauugccggcuuccugcccaacggcauggagcagcgccggaccaccgccggcgcccccgcggccgcuccugcagccguacccgcggggacuaccgccgcugccgccgccgcugcugcagcugcugcugcugcugccgcggcugucaccucggggguggcuccuaagugacccccuccgccccgcguccgcgcuguguaagcgcucgcacgcgccuuccucaccggagacggggcaggugcgcuucgugcuguccuuauuguucauccuuuucccgggaggggaccgcagagaggcacaaaugaggugggaaagugggguuugugcugagguucugguucggaagagcaggggcaagcucucgggcugaagggugggauccacgcguggcucgaggacacaagggaaaccggcucuuuccccugcggcacccccucccugcgcccacaugcccuuuauuuauggcagaaagugaccagauccuguguauuuguuuuauauauuuaauaacuguuuuaaaugaaaguuuuaguaaaaaaaaauacaaaacaaaaagauucaacugcuaaagcugugguaacaggagcucuuuguaucugaauguaguuguauuugaagcuucuuguuuguuuuuuuaaagggggggacgagggaagauuugacacggauuuauuguaauugcuuacaaaagaacuuuaugaaucuuuuccaagucgaucuauucagugacauggccuggugggcguuucuucuuguauuaaugugguuuucuggcuuuuaauacagacauuuuccuccag
